United States Patent 8,106,174 (NUCLEIC ACID MOLECULES AND OTHER MOLECULES ASSOCIATED WITH PLANTS AND USES THEREOF FOR PLANT IMPROVEMENT) - sequence listing, part 9

SEQ ID NO: 33611 - protein, 95 aa, Sorghum bicolor
  Clone ID: SORBI-28MAY03-C34607_1.pep
TEIQERYFRLSSWLTFLKHDIRTPPIGENLITEVDRYVYGYIQYSLPSTLEQTMKRDLEVQTWMNIRSKTEGIVMEIWEFVLDELIDETVFDLWM

SEQ ID NO: 33612 - protein, 86 aa, Sorghum bicolor
  Clone ID: SORBI-28MAY03-C34627_1.pep
SISGLQNMTIVHLAGITPNGLTATLMVCGCLTKVKLHEAFKSMMPPHMIKNVEARGCVFQWIDKPFKVEVEPCDVCKQQSQDVLVR

SEQ ID NO: 33613 - protein, 137 aa, Sorghum bicolor
  Clone ID: SORBI-28MAY03-C34669_1.pep
TEAELVTEHIWSLPKYSSRKQGDIKERLKNAYSALHKDFRSIFESFVTDQTEISDDEKIRFYEMKASAWYQVTYHPKWVQKSREMLKPDFEDMPARLSFAWIGVEHLARIKIRCHGEVKVDSRRPVERLAAYISGSM

SEQ ID NO: 33614 - protein, 191 aa, Sorghum bicolor
  Clone ID: SORBI-28MAY03-C34688_1.pep
RTEEIETLVRNAATFIENRQQEDGSWLGTWGVCFTYGAFFSIKGLVASGRTYKNSLSIRKACHFILSKQLSTGGWGESHVSNETQVYVNIKGDCAHAVNTAWAMLALIYAGQFERDPTPLHRAAKELINMQLETGEFPQQVRAGRFFCARVSFYPHVRFFFPSCALGEFHRALWANMGNPSIWLDTCFCVV

SEQ ID NO: 33615 - protein, 120 aa, Sorghum bicolor
  Clone ID: SORBI-28MAY03-C34715_1.pep
AIENPHIKEIIDDAADRPEEWKETVGDESREFGRYMRQREEQEKQEEELFTRAPVTKRDKQIEKRIRRQLHGLGGLTDGFDLGMNMLIGGDKEDDGGSSKSHGKSGHRKKHLKSSKRKRH

SEQ ID NO: 33616 - protein, 115 aa, Sorghum bicolor
  Clone ID: SORBI-28MAY03-C3473_1.pep
MSSSCSTAIDGGAANPPAALDLAPDTDAPAGDGLELAQFAAGCFWSVELTYQRLPGVARTEVGYTQGHHQAPTYELVCGHGTGHAEAVRLHYDPKACPYTTLLDVFWAKINPTTL

SEQ ID NO: 33617 - protein, 200 aa, Sorghum bicolor
  Clone ID: SORBI-28MAY03-C34343_1.pep
ARGNAVLVFNNAGQPRLTKFYTQLETSVQQRLISEIFTLVANRPNSACNFLPLPPLLASSSKSSTPTTPHNDTPSLVTYRHYATLYFIVISTSTESPLALLDLIQVFVQALDGLFENVCELDLIFNFETLHATLGEMIVGGVVVETQLDKVIQGVKAQGRVAKRPVNEGKNIGGGGGGGGVMGGLTFGGLGRGDGMWAGR

SEQ ID NO: 33618 - protein, 171 aa, Sorghum bicolor
  Clone ID: SORBI-28MAY03-C34346_1.pep
QTHPPNPRRRPAWATLPRSLRICPCRTPPRDASFGRSSPGPRTRACPIPRSVPSSRTRTTSGARSPTSGVAGHRIRRRNRRPTSAAARPPWWCGCGLAVLQHVLPLECGGSRGLGKEELVAGSGRTALGFRPGGDWRSRSGVRCRWGAIAIAGPDLVVRCDTTSASVCETA

SEQ ID NO: 33619 - protein, 167 aa, Sorghum bicolor
  Clone ID: SORBI-28MAY03-C34384_1.pep
TRDEHNHLVALQLTVDLKPSIPSEAARIRQRRGRVFSLPDEPDVARVWLPTFNSPGLAMARSFGDFCLKNYGIISMPDVSYHRITDKDEFVVLATDGVWDVLSNAEVVSIISSAPSQASAARFLVESAQRAWRTRYPTSKTDDCAVVCLFLNTEAASASSSSVTKVW

SEQ ID NO: 33620 - protein, 315 aa, Sorghum bicolor
  Clone ID: SORBI-28MAY03-C34388_1.pep
MQPQSQQNQLQQPQQHMMSQFQSQPNQVQQQLGMQQRLQTSAGMLLQQNNIDQQKQYVQAQRGLQEAPSTSVDSTAQTGHPGGDLQEELYQMIKSLKDQYFAHVDDLYNKISMKIQHIDNHMPAQKSAEQYEKMKGFKLMLERTLHFLQVNKNSIQPAFREKIPVYERQILSILSSQRRKPVQAPGQQIFQQSGGQAPSSNISQQHQTSQGLQQHDSHTNQMPQASIPSMNTGVQTSGAPGIQHVPAPQATNFGVPTTQQNVTNAPQAGSNLENAQGNSFNPVQHGSMGTALQQGSTGPMQGALNAQQQSSSNMI

SEQ ID NO: 33621 - protein, 94 aa, Sorghum bicolor
  unsure (1)..(94): unsure at all Xaa locations
  Clone ID: SORBI-28MAY03-C34842_1.pep
RAVAECPVLVVGRHGCCMSHVVNRLLQGLGVNXPARHEVADAEAELAGVVDGGDVALPAVFVGGRLLGGLDRLMAVHISGDLVPILKDAGALWL

SEQ ID NO: 33622 - protein, 87 aa, Sorghum bicolor
  Clone ID: SORBI-28MAY03-C34860_1.pep
GASDGSSSGEQPEVPNHKNKSMSLRALATPLRRVRRKPLPLTIPKEKKNRSLWKRLKKERQEMGENISQRLRLCLQGQARHKRTKSS

SEQ ID NO: 33623 - protein, 203 aa, Sorghum bicolor
  Clone ID: SORBI-28MAY03-C34863_1.pep
QFHGICFNETHGLCIVTRMMEGGSVHDILIQRNKRLSLRDTVRIALDVADALAFMNNYGIAYRDLNARKILLDRQGNACLGDMGIVTPCSNVGEVTEYETSGYRWLAPEIIAGDPETVTETWMSNVYSYGMVLWEMITGEEAYSTYSPVQAAVGIAACGLRPEIPRDCPPFLRSLMNRCWDNSPLKRPQFSEIISILQKQNVR

SEQ ID NO: 33624 - protein, 168 aa, Sorghum bicolor
  Clone ID: SORBI-28MAY03-C34871_1.pep
AGPRSEAQSYWAIAESKGWFGNDESVRSRALTEEHARDSFENLLFSVCRFRELTGRYPQNITVVSYDFKEERFAQLHRTALGFPEGRFFFTGTPATPSAREAALKGEAAVRSQFLEDPYGCLGSLHVKRLKRDPFHRTIPYPDGCPELKGLFSYCGPVPYSGHLPWTE

SEQ ID NO: 33625 - protein, 151 aa, Sorghum bicolor
  Clone ID: SORBI-28MAY03-C34880_1.pep
TRECFEVPPKATGVVSERMAFPLSLMHSHDYVSKRLALVGDAAHTVHPLAGQGVNLGFGDAAALAKVIAEGVSVGSDVGDLTLLQRYEKDRKAANVAMTAVLDGFQKMYSVDFGPLNVVRAAAFHGAQYISPLKKNIISYAMGDTKWPLFR

SEQ ID NO: 33626 - protein, 154 aa, Sorghum bicolor
  Clone ID: SORBI-28MAY03-C34896_1.pep
LGIQREIAAETIYKERCITVDNGDSWTKYMSISGSAEDEHDIITVQYTEEGLLTIDENRDGRAAAFGDDIAIECLATEFKREVYVVQAHGADAMVDEDNCVFFLPHRPRGEICEPPIFLFMKGTAAWRARAHLCLPLLATVLRRVPPDLAPVVL

SEQ ID NO: 33627 - protein, 152 aa, Sorghum bicolor
  Clone ID: SORBI-28MAY03-C349_1.pep
VRPRVRFFDQLETRSKGYASMEYSLIGYRESQLVKLDIQINGDPVEALSTIVHRDKAYAVGGALTQKLKELIPRQMLKVPIQACIGTKVIASEALSAIRKDVLSKCYGGDITRKKKLLKKQAEGKKRMKAIGRVDVPQEAFMAVLKLEKEVL

SEQ ID NO: 33628 - protein, 133 aa, Sorghum bicolor
  Clone ID: SORBI-28MAY03-C34496_1.pep
MASHRHFLRLLDNPFFPFPPPPPSSSSCPFLLDGVLDHPSPFPDLDDLLLPSASAPALDPFFAFPATPSPYTPLLLRDLTDRVAALELAVATARRRPEPPATRKRTYVTDAGGRKVKWTSVEKPRAGERTLRW

SEQ ID NO: 33629 - protein, 221 aa, Sorghum bicolor
  Clone ID: SORBI-28MAY03-C34499_1.pep
ARGSVIVSQYNNQQDTSSEIPDLSSFVKDARRLILLALKDITDTLQSGHNDAMFSSSNVGLLIDCVRSISDVGTRNHCFSLIASLGKACPQLVSESIVDLFVAIGDAIKQDDSHSQRVLEDLLSVLVPCWLSRTTSIEKLLQIFIKALADVPEHRRLTLMVYLLRTLGKENSLSTVIMHLLHSLVERISHSFSEHYGSDCRLAMSQEWEYGLAVNVTDQFS

SEQ ID NO: 33630 - protein, 160 aa, Sorghum bicolor
  Clone ID: SORBI-28MAY03-C34511_1.pep
MASTSLFRLATRAVRPSSFVRASQLPRSASRVQTPVALAINRPGFSTTSIRRSGQHDDETYEEFSARFEKEFDGVQDVFELQRNLNNCFAYDLVPSVEVLTAALKAARRVNDFPTAVRVFEGVKAKVENQEQYEQYLQALDSLRQELGVALREELYPGEQ

SEQ ID NO: 33631 - protein, 50 aa, Sorghum bicolor
  Clone ID: SORBI-28MAY03-C35048_1.pep
VDPATIKEGAVLHYNGNMKPWLKIGMEKYKSFWDSYVDYSHPLIQQCFMR

SEQ ID NO: 33632 - protein, 137 aa, Sorghum bicolor
  Clone ID: SORBI-28MAY03-C35105_1.pep
ASAPQQAQAHQHQHQHQHLAESSTGRCHCSKKKRSRQGLSRRTVRVPAAAAAAGAPGSHVPASSDIPADDYSWRKYGQKPIKGSPYPRGYYRCSSAKGCPARKHVERAADDPAMLVVTYEGDHRHDAAAAAVRARAA

SEQ ID NO: 33633 - protein, 144 aa, Sorghum bicolor
  Clone ID: SORBI-28MAY03-C35051_1.pep
RVYCWKGLRFSARQDLDGFARFSDYGIEGVVPSELLPPEVNARFSSKPAEKVKRTRREDSKGMSAQPKEQQVAATPETDGGGSGGDPEEGAAPMDSDNGGVEDSQKRSPGEVSGPESGQCEPEADADDNVKTETTSRDARARVV

SEQ ID NO: 33634 - protein, 151 aa, Sorghum bicolor
  Clone ID: SORBI-28MAY03-C35113_1.pep
VVLGMGSQRTSLRSKQTRILGRPLQCRRHGMCRPACLAGQVDTMRKTALQACISSNLRQAQQAPMALRNLATLAPDRVSNAIRSGTLRTLAHFWPLLPSSSSSSIGAVALHQVVMVSSSIGAAALRQVVMVSSSPILELPTTESQYPSNQA

SEQ ID NO: 33635 - protein, 103 aa, Sorghum bicolor
  Clone ID: SORBI-28MAY03-C35118_1.pep
SRKTLTSNVRDDQGLEKFKKPNKEVRSFFSFRAAGALHEGVRGHAYKSNNVTPSQTGNVKTKAPVPPPPPLPPGRPYCTEKKPNVNNSPVGGRKPKVSAPRWH

SEQ ID NO: 33636 - protein, 135 aa, Sorghum bicolor
  Clone ID: SORBI-28MAY03-C35127_1.pep
RLVSLTGDLGEDETELLHSEAEQNRRKRIESIVNLQQERNGLIEPKKDLAIQPGMYVSLPPSTPETAEEENADPSKDTATSPSETEHRGLANNPSSNKPKNSGHRRRNRANASRRQPHPHGQPARQQWQRKEADP

SEQ ID NO: 33637 - protein, 196 aa, Sorghum bicolor
  Clone ID: SORBI-28MAY03-C3516_1.pep
TDNMKKRYWKLSLLVHPDKCPHPLAQEAFVKLNNAFKDLQDPDKRGAIDEKIKKKEEMEQFEIELKAMREAAEWRRLQGVSLAGDDELLAGPKDVRAPKRDEWMTTLPPERKAGVPMHSTKSFSMNGKEGRGDTSVWTDTPLDRAQKAQQSYLEAYNKTKAIAEGEDVKSKNPDASIVDKYNTSKRSVSLVQKHRE

SEQ ID NO: 33638 - protein, 90 aa, Sorghum bicolor
  Clone ID: SORBI-28MAY03-C37212_1.pep
QDGEEEASTGEVDYEKKEKHHKHLEQLGGLGAIAAGAYAIHEKHKAKKEPESAHGHKVKEEVAAVAALGAAGFAFHEHHQKKDAKKQGQS

SEQ ID NO: 33639 - protein, 91 aa, Sorghum bicolor
  unsure (1)..(91): unsure at all Xaa locations
  Clone ID: SORBI-28MAY03-C37183_1.pep
LESWAAANGISGDFESLCKNPKAKEYILGELSRIGKEKKLKGFEFIKDVHLEPVPFDMDRDLITPTYKKXKRPQLLKYYQGVIDNMYKSAK

SEQ ID NO: 33640 - protein, 76 aa, Sorghum bicolor
  Clone ID: SORBI-28MAY03-C37257_1.pep
EAMPVHLRTAQCQLHRCDRKISLSEIIDTELILHGLKSYNLQVEKVANADTLHSVYRFPSMLSLTSPCLKLNKWRQ

SEQ ID NO: 33641 - protein, 105 aa, Sorghum bicolor
  Clone ID: SORBI-28MAY03-C35202_1.pep
HEAQHISRSAYGSPSRYIGSSHMSHGSPSYYLGSSGQRIPYLRHCTLSGPSLFTMVPQSPQQNQSQHGGDSETNLSAAASTQSFRQLYLQHCPDSDTSSQSLPGC

SEQ ID NO: 33642 - protein, 106 aa, Sorghum bicolor
  Clone ID: SORBI-28MAY03-C35209_1.pep
SLQSIYELESVGGVSRRRRVRFQIDEEERIDPQVRDELSDLLEAKEAGVAYIIGHSYVKARKNSNFLKTFAINYAYSFLRKNCRGPSVTLHIPHISLIEVGMIYYV

SEQ ID NO: 33643 - protein, 85 aa, Sorghum bicolor
  Clone ID: SORBI-28MAY03-C35203_1.pep
GQGACSSLGVRAISSSHLHNGNSILQSSSRSELPDITCDQGSATTDEMLQNGGAGVLLVSSYLITIHMSTIHLTHCFLMNLVNDA

SEQ ID NO: 33644 - protein, 133 aa, Sorghum bicolor
  Clone ID: SORBI-28MAY03-C35227_1.pep
IIYEDGSVQKITEVPDDLKAIYKTVWEIKQKTIVDMAIDRGCYIDQSQSLNIHMEQPNSGKLTSLHFHGWSKGLKTGMYYLRTRAAADAIKFTVDTTLLKDKQPTSEEEDAQVKMAQVACSLNNREECLACGS

SEQ ID NO: 33645 - protein, 207 aa, Sorghum bicolor
  Clone ID: SORBI-28MAY03-C35243_1.pep
MAQLVETYACSPATERGRGILLAGDPKTDTIAYCTGRSVIIRRLDAPLDAWAYRARAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCGEDFLANFYEGPPFKFKHSIRDHSNFVNCIRYAPDGSKFITVS

SEQ ID NO: 33646 - protein, 252 aa, Sorghum bicolor
  unsure (1)..(252): unsure at all Xaa locations
  Clone ID: SORBI-28MAY03-C35244_1.pep
MEDEASSSARKPKRPRVAPAAAAAAAAWEPHFTYLPIADALKQRPRARVCLFAVVAEIGAAFHSSGTDFTVTLRIVDESRKAGISATFFAQEPDLLPCVKSNGDVISLRDVMVKCYLEEFFIAVDKRLSSFALFESKVSAECSPYQTSKNYHGSKHDKERLTQLRTWLPLGLKDFGLKDLELQLRSLKSDSTFDLVCKVLHVLKHKDKWIFYVXWDGTDTPAAEFQAISDAEAVASPALPRELLCTMPCIGT

SEQ ID NO: 33647 - protein, 150 aa, Sorghum bicolor
  unsure (1)..(150): unsure at all Xaa locations
  Clone ID: SORBI-28MAY03-C35251_1.pep
MAAAPTAEAMDVDAPARPLTTSSATKSRSPHDVLAETRASIEKVAARILAIKQXGAPKSELRELVTQXMSLLLVTLRQVNREILMEEDKVNAETEAAQAPVDSTTLQLHNLLYEKNHYVKAIRACLDFQTKYPGIELVPEEEFQRSAPAD

SEQ ID NO: 33648 - protein, 182 aa, Sorghum bicolor
  Clone ID: SORBI-28MAY03-C34946_1.pep
GTLSNGDSRMDDDVIDDEEDAQSTRSRSKKNVVKEANNPAVAYQLHPLKIILHVYDTEDSGSRRRKLITLRFEYLAKLNVVCVGIEDSEGLDNNVLCNLFPDDTGLDLPHQMAKIYAGEVPNFSDKDSRPYKWAQHLGGIDFLPEVPPSAGDDSSRALSSADLSSRLALYRQQNRAQAILQR

SEQ ID NO: 33649 - protein, 56 aa, Sorghum bicolor
  Clone ID: SORBI-28MAY03-C34948_1.pep
RKGFETFLDRLKACVLDVGLTIQGNKAEELPEQILCCVRLNGIDYNKYQPLLTHGA

SEQ ID NO: 33650 - protein, 408 aa, Sorghum bicolor
  Clone ID: SORBI-28MAY03-C35_1.pep
RPHDSGELFAVKSAPASSAGAAELLRRERGIMAGLRSPHVVPCIGGRGGRDGSYQLFLEFAPGGSLADAVARNGGGRGLEERAVAAYAADVAAGLAYVHGAGLVHGDVKPRNVVIGGDGRAMLADFGCARSAEAVGGPIGGTPAFMAPEVARGEAQGPPADVWALGCTVIEMATGRAPWRGVDDVLAAVRLIGYTHAVPEVPRWLSADAKDFLARCLARRPSDRATAAELLEHPFIASASGISNCRAALDLDAAAKGRWVSPKSTLDAAFWESDSDDDEHDVVSAQSTAERIAALACPASALPDWDSDEDWIDVLSTPAEASSSDATNAPADEEVPYLDDGGAGTEEEVARAEAAESLDIDVDGAHNVGEADASPDHEWHLRVSSPCVGETPCKLLCDTNNAMDFVLA

SEQ ID NO: 33651 - protein, 124 aa, Sorghum bicolor
  Clone ID: SORBI-28MAY03-C34982_1.pep
LWIIIDPGSPSLSLIPSIVSNHPLPPPNSLQFSMSDGVICEGSSVIFYQNNTLIHLSGIPSSTLKQKRTNSLRDEARWNTEPTQPDAGRATSTSKLVVLPLPKRPPGDFLPVVIAGGERPLPLR

SEQ ID NO: 33652 - protein, 195 aa, Sorghum bicolor
  Clone ID: SORBI-28MAY03-C35318_1.pep
MAAASFARALSLHVLLLFLLAGSALGKTVKRDVKALNEIKSSLGWRVVYSWVGDDPCGHGDLPPWSGVTCSQQGDYRVVTELEVYAVSIVGPFPTAVTNLLDLRRLDLHNNKLTGPIPPQIGRLKHLRILNLRWNKLQDVLPPEIGELKKLTHLYLSFNNFKGEIPVELANLPELRYLYLHENRFTGRIPPELGT

SEQ ID NO: 33653 - protein, 169 aa, Sorghum bicolor
  Clone ID: SORBI-28MAY03-C35321_1.pep
RLVTWVPSQAQNRILAMTSSRSDWCISRQRTWGVPIPVFYHVDSQEPLITEETIEHITAIALKKGSDAWWHMTTEELLPDRYRDKASEYRKGTDTMDVWFDSGSSWAAVLAKRGGLNFPADIYLEGSHQHRGWFRSSLLTSIATTGKAPYSSVITHGFVLDEKGFKMSK

SEQ ID NO: 33654 - protein, 140 aa, Sorghum bicolor
  Clone ID: SORBI-28MAY03-C35322_1.pep
HNIQGATKVVGGYIQVDSVLVFALFDRSASHSFISADLVKTIERVKCPTRKPLLVQTPMGEMQADQVCSNINLVIKKENFTVNLIVLESLNIPLVLGNGWLCAHRAVIYATQWKIFLTAPSGKRIEYQGGPLLPEEAYPC

SEQ ID NO: 33655 - protein, 192 aa, Sorghum bicolor
  Clone ID: SORBI-28MAY03-C35346_1.pep
ARGAGGSHSNEDSLVEKKRRRVDEEIAAEGTLPSYGDLEDVKGGSLRHPSNAEGSELARTISSNASLAEQVIEPALVMFEVHVPPVCMLDGVHSQHFFGTGVIIYHSEHLGLVAVDRNTVAVSISDIMLSFAAYPIEIPGEVVFLHPVHNFALVAYDPSALGAGASVVRAAKLLPEPALRRGDSVYLVGLSR

SEQ ID NO: 33656 - protein, 177 aa, Sorghum bicolor
  Clone ID: SORBI-28MAY03-C35375_1.pep
MAVPELAFHLFLPAALLSVAAPAVARSPSCPDGWQVGPAQNKCFMYISTSLSWDRSEALCHNYSGHLAALSSLQERHFVKSLCGSSSLGCWVGGHHYNTSTGNGWKWSDDSSVWNETVFLGEPLHACSDAACKVATGSDLCTLVTNNGRVSIIMEKRCSEAHGLICMMNHVDRCYHD

SEQ ID NO: 33657 - protein, 144 aa, Sorghum bicolor
  Clone ID: SORBI-28MAY03-C35411_1.pep
MAVDLMSSCGGRAGAYEQLAFQEAAAAGLRSLELLASSLSSPCGAGQRAESPPLGQIADQAVSRFRRVINLLDRTGHARFRRAPVAAVETETTLQAAVEEPQPPQKKAALTLDFTKPVPVPAAAATKPAAPAPAPAVSGTSTSF

SEQ ID NO: 33658 - protein, 139 aa, Sorghum bicolor
  Clone ID: SORBI-28MAY03-C35434_1.pep
MAAAQAEAEEELRLELEAVAAVYGDDVRVLRDLPPHLVVDVRPRTADDSSQQFVELFLGIKASSQYPKEPPHIYAVESKGLDENRQIYLITSIQSKAKELSNYPMFVTLCEEAGEILSNMNHPAGDCPLCLYPLVGEDK

SEQ ID NO: 33659 - protein, 131 aa, Sorghum bicolor
  Clone ID: SORBI-28MAY03-C35153_1.pep
MAGTRDLGITAEQLARQAIKNVRKREMDRKAQERAQRARIRQHNEDVLRDAALASTSHSAAAYEQPPGAQGRRGRRGKAKAPTLASMLKKKVTTKDRIAERLLNTRATDATIREVSHNEDMSYREAFPNQW

SEQ ID NO: 33660 - protein, 191 aa, Sorghum bicolor
  unsure (1)..(191): unsure at all Xaa locations
  Clone ID: SORBI-28MAY03-C35160_1.pep
YAAVTPFLLPFVLIFFGFAYVVYRHQIINVYNQEYESAAAFWPSVHGRIITALIVSQFLLLGLLSTKGAGXRSTPVLLVLPVVTFYFHKYCKNRYEPTFVKCPLQEAMKKDTLERAREPGFDLKGYLMNAYIHPVFKGDEDDEKFSIADEPETEQVLVATKRQSRRNTPVPSKYNGSESPSLPEIVNDQRL

SEQ ID NO: 33661 - protein, 158 aa, Sorghum bicolor
  Clone ID: SORBI-28MAY03-C35176_1.pep
HKRNALKLRREGKTAEADAEFELAKELESQLEEPDNQSSSSGGKSSEPNDAIVENLLDPQIMSALRSIGWSDMDLSMQSPSAQPQKPMQPSTSQPPQKVEAKSSVTGTSKPQSERSQLEEQIKVEKLKALNLKREGKQAEALEALRSAKRLEKKLNST

SEQ ID NO: 33662 - protein, 367 aa, Sorghum bicolor
  unsure (1)..(367): unsure at all Xaa locations
  Clone ID: SORBI-28MAY03-C35467_1.pep
TRVEDVFSSGNLPKAAETLATMRHCLSAVGEVAEFANVRKQLEVLEERLDEMVQPRLVDALSNRKVDAVQDLRGILIRIDRFKSLEAQYTKIHVKPLKKLWEDFDLKQRSSRVDMEKLSGESISGLSFSSWLPNFYDETLLYLEQEWKWCLTAFPEEYKSLVPKVLTETMSELNSSFVSRLEXATGDVVPETRSVAKGILDVLSGDLPKSTKLQNKHLQALIELHNMTGTFARNIQHLFSESDLAVVLNTLKAIYSPYDTFKARYGQMERAILSAEMAGIDIRGAVPRGVGAQGIELSETVRRMEESIPQMIVLLEAAVERCISLTGGSEADELVLALDDVMLQYISNLQETLKSLRIVCGLDSDAL

SEQ ID NO: 33663 - protein, 225 aa, Sorghum bicolor
  Clone ID: SORBI-28MAY03-C35474_1.pep
ARGNNFGILLGYVSNFAFARLPVHLSWRAMFLVGAVPPVFLGVAVLAMPESPRWLVMRGRIDDARRVLQKTSDSPAEAEERLLDIKKVVGIPEGVSDADDVAAIVRANNKGSRHDGGGVWKELLINPSRPVRRMLMAGLGLMFIRQATGVDCVVMYSPRVFERAGIKSKTNSLGASMAVGACKTFFIPISTLLLDRIGRRPLLLASGGGMAIFLFTLATSLHMMD

SEQ ID NO: 33664 - protein, 165 aa, Sorghum bicolor
  Clone ID: SORBI-28MAY03-C35511_1.pep
HEDLSSDHRFDASKEEVDRVTECGGDVGRLNVVGGAEIGPLRCWPGGLCLSRSIGDQDVGEFIVPVPLVKQVKLSTAGGRLIIASDGVWDALSPEVAFNCSRELPPVPAAEQIVKTAVQSKGLRDDTTCIVVDIIAEKNHPSMPHPKKQPGMGVFKNMFGKKKSS

SEQ ID NO: 33665 - protein, 215 aa, Sorghum bicolor
  Clone ID: SORBI-28MAY03-C35530_1.pep
PARMSGGGGGGGGGGARGPSGPVPASARKLVQGLKEIVNRPDAEIYAALRECDMDPDEAGTRLLSQDTFQEVKSKRDKKKEVKETPEPRSRGASNSSRSSRGGGDRAGRSSVQSGSSDYMASRSSILGPAVPATNAMQKPAVPSSSTNKDVVPNGSVGAPQSSSGFQHNWFGVPGQMSMADIVKMGRPQVRSSGKPMAAAKQSTSTALPTTFDQG

SEQ ID NO: 33666 - protein, 191 aa, Sorghum bicolor
  Clone ID: SORBI-28MAY03-C35534_1.pep
HEGRKGAFAVYLEPWHPDIFEFLDLKKNHGKEENRARDLFYALWVPDLFMERVQHNEQWSLFCPSEAPGLADCWGDEFQNLYQKYEREGKAKKVVAAQALWFDILKAQIETGTPYMLYKDACNRKSNQQNLGTIKSSNLCTEIIEYTSPSETAGCNLASIALPRFVREKGVPIESHPAKLVGSSGSKNRYF

SEQ ID NO: 33667 - protein, 178 aa, Sorghum bicolor
  Clone ID: SORBI-28MAY03-C35545_1.pep
MSQERTLDEVVSPFLMQLERARVVPLGPDEDSSHSDIVLLFENIKKEACEVKDILLRVSKWENEIINDFGGIARHLDEIIEEGNQLNSIRSTLQLVNTEMSKLKDRMQLPLHVPMIKPIAPTTLPSYVPSKWVHAKVSEQWKRLEVERKILESSTMSNLQVSYDNLDLQLKLCLLCFS

SEQ ID NO: 33668 - protein, 150 aa, Sorghum bicolor
  Clone ID: SORBI-28MAY03-C35572_1.pep
DGLPMQIGGMCYQACNSTGSPPWLGASACAFGPDLLIEFLWVGPFPASLPTLFGRDNRFLAGAFTCTSLSFGLRTALEPISVGWELTSSKTSSVTFAFCLDDPKDVDGNTFACRANEVQLTSEYDFLWFTPFFLLRPGVFEVDTLPFGVI

SEQ ID NO: 33669 - protein, 299 aa, Sorghum bicolor
  unsure (1)..(299): unsure at all Xaa locations
  Clone ID: SORBI-28MAY03-C35254_1.pep
ARGYYEGLLAADGEREDNKCSDSPTTECADGKPKASQPFSSEKWKGQIEKDLPRTFPGHPALDEDGRNALRRLLTAYARHNPSVGYCQAMNFFAGLLLLLMTAGNAFWALTGIMDDYFDGYFSEEMIESQVDQLVLEELVRERFPKLVNHLDYLGVQVAWVTGPWFLSIFMNMLPWESVLRVWDVLLFEGNRVMLFRTALALMELYGPALVTTKDAGDAVTLLQSLAGSTFDSSQLVLTACMGYQAVGEARLQELRNKHRPSVISXMEQRAKGLRVWRDTNSLASKLYNFKRDTEPLVS

SEQ ID NO: 33670 - protein, 120 aa, Sorghum bicolor
  unsure (1)..(120): unsure at all Xaa locations
  Clone ID: SORBI-28MAY03-C3530_1.pep
SAHACGDPTGHMTSAQEWPGAGTMVAAVXASLQGEPIVVGKPSGFLMDFLLKSFNLETSRMCMVGDRLDTDILFGQNTGCKTLLVLSGCTSLPELQDASNNIHPDVYTTSVYDLVGLLQK

SEQ ID NO: 33671 - protein, 287 aa, Sorghum bicolor
  unsure (1)..(287): unsure at all Xaa locations
  Clone ID: SORBI-28MAY03-C35275_1.pep
CDGISDEKYQEFQADQNLQYTCAACRGECSQIRDTEDAIRELWKRRDVVDHELMVTLRAAACTTFSXDVSPPYPNSDDEKLGAYVLKNESRNTLKFSLKSNSSKPPSDTPEQEKIVFKSPGSNKKSSKKKGGRARETDDGHDEIFLERRHDVKLPNSRLGDQSIDGNHDRSPFKNDDNAYISSSTRSSEKSLKSPSKKAVPNNADMIPKVKIKGSKVSTLHYKDGEENTPKNDTGKATKLVIHLGSRHKTRSGSPKSELSNSQREQDLGSIHGGKVDVTSQLKSSRS

SEQ ID NO: 33672 - protein, 155 aa, Sorghum bicolor
  Clone ID: SORBI-28MAY03-C35302_1.pep
HEREDTPQIPLTYRSSLVQSVHQAEKALQHTISLSFFSHLRPHSARTHARAGRPDRRAPGGGPSLSLSAGSSGLSRPGGAEIRPRGRRLLPRCSAGARSWHPAMSSPMPSPTLKDHLSTPAGPLHLKVWEVICIALGAFMVLVLFVTVWLTIRSK

SEQ ID NO: 33673 - protein, 95 aa, Sorghum bicolor
  Clone ID: SORBI-28MAY03-C35599_1.pep
FYVIHSTTAVTFNVAGNLKVAVAVLVSWMIFRNPISAMNAVGCAVTLVGCTFYGYVRHLISQHQATVATGGGGPRTPRGRLEMLPLTAEKQGDKI

SEQ ID NO: 33674 - protein, 149 aa, Sorghum bicolor
  unsure (1)..(149): unsure at all Xaa locations
  Clone ID: SORBI-28MAY03-C35621_1.pep
MQGPNVTIEPFDRPGMAVTNGLLAVGRPAGGRDTLFNAVPGLDGAPGSVSLELATRPGCFVATAPAAGANAATQVVCRGSKNNGGSASGDGAALRRAASFVPRRXLRRYSPLSFPARGTARNFLLEPLRSLQDEFYTVYFSLVVSDAGS

SEQ ID NO: 33675 - protein, 130 aa, Sorghum bicolor
  Clone ID: SORBI-28MAY03-C35623_1.pep
FDIDCLQTIKGLDGREKRAGSEMHLPNLHPEDDSDAPPAPEYCIDASSIGNFARFINHSCQPNLFVQCVLSSHNDVKLAKVTLFAADTILPLQELSYDYGYRLDSVVGPDGKIVKLPCHCGAPDCRKRLY

SEQ ID NO: 33676 - protein, 185 aa, Sorghum bicolor
  Clone ID: SORBI-28MAY03-C35630_1.pep
VFNENFLVADQKLTYALMHCNSQSESNLRRILKFLIPVKLSIGVLPKRTLLERYNLLEYADVVTALKRGDLRLLRQALDRHEDQFLKSGVYLVLEKLELQVYQRLVKKIHNIQRQKEPAKAHQIKLDVVVRALKWLEIDMDVDEVECIMACLIYKNLIKGYFAHKSKVLVLSKQDPFPKLNGKPV

SEQ ID NO: 33677 - protein, 154 aa, Sorghum bicolor
  Clone ID: SORBI-28MAY03-C35635_1.pep
SSWLSEVDLMFSYVKKALEGTIEIRILSGSSSFYGRVTVCTTDIPSHILLYDSDVHGANTIGNDRVLKLLRHVVSVSVDQMLIFHIYPRSGDLNPRIFEFTPQIKGADKVEITCGGHRMLVKVTWSILSVKRGSLEASFGCPGTGYYGPDTVPP

SEQ ID NO: 33678 - protein, 141 aa, Sorghum bicolor
  Clone ID: SORBI-28MAY03-C35657_1.pep
VRHVNGSPMNTETERLRVIQCLEAAIERRVSEGVKLELCTNDKVGLLSEVTRIFRENSLTVTRAEVTTRGSMAVNTFYVRGSTGEDVDQKAIDSIRQAIGHSLQVKGQPEPQEAQKKESPTWFLFANLFRPRSLYSFGFMR

SEQ ID NO: 33679 - protein, 162 aa, Sorghum bicolor
  Clone ID: SORBI-28MAY03-C35663_1.pep
MEPAERIESGSALGKRPRTKVLPRTASLVTVPSAAKQGRRQERAGAGVPSSSSLPAGGAGIGAGGGGGAVPSFYYGPFTTVETAAFLKACGLCNRRLGPGYDTFIYRGEVAFCSQECREKQIEYDERMEQTCSLTSIKEAPSVAGASGSDQSGSGGETVAAA

SEQ ID NO: 33680 - protein, 352 aa, Sorghum bicolor
  Clone ID: SORBI-28MAY03-C35436_1.pep
LILFGGATALEGNSATPPSSAGSAGIRLAGATADVHCYDVLSNKWTGLTPLGEPPSPRAAHVATAVGTMVVIQGGIGPAGLSAEDLHVLDLTQQRPRWHRVVVQGPGPGPRYGHVMALVGQRFLLTIGGNDGKRPLADVWALDTAAKPYEWRKLEPEGEGPPPCMYATASARADGLLLLCGGRDANSVPLSSAYGLAKHRDGRWEWAIAPGVSPSPRYQHAAVFVNARLHVSGGALGGGRMVEDSSSVAVLDTAAGVWCDTKSVVTTPRTGRYSADAAGGDASVELTRRCRHAAAAVGDLIFVYGGLRGGVLLDDLLVAEDLAAAETTSAANHAAAAAASANVQREPGRYAY

SEQ ID NO: 33681 - protein, 197 aa, Sorghum bicolor
  Clone ID: SORBI-28MAY03-C35459_1.pep
ARGEDAEEEIASMSMRSIRMASLMAGEWVPETQENEAVFDALREAHRLLVSKHLVTVQEWITVLVRVNLPDNRFRDSALKDFIDVKNEIRAVRDRCNDLGLDLDNVHRRKSDQEEEDNEFWVEGNIEAPNRARVQSSLDVASTSKDTRKGKCVVGAVSDIGKAPVAANGTRNLDPQKSELFAKAPVLPWSSVFDRWG

SEQ ID NO: 33682 - protein, 118 aa, Sorghum bicolor
  Clone ID: SORBI-28MAY03-C35466_1.pep
MATIQDIGLSAAINILGAVVFLLAFAFLRLQPINDRVYFPKWYLKGARESPSHGGTFVRKFVNLDMRSYLKFLSWMPAALKMPEDELISHSGLDSAVYLRIYLVGLKIFAPISVLAFI

SEQ ID NO: 33683 - protein, 79 aa, Sorghum bicolor
  Clone ID: SORBI-28MAY03-C35807_1.pep
VLINGLQHIVSSNVRPKLQTVDTFIKAYYLPETEYVHWARSHPEYSKSQVVGLVNLVATMKGWKRKTRLETVEKIEAGP

SEQ ID NO: 33684 - protein, 132 aa, Sorghum bicolor
  Clone ID: SORBI-28MAY03-C35827_1.pep
QLGGILAGLVYLWLKRAFNGPDPITLLISSIANVVTWPVRFAQNLLRSARSQGRATGRGRVGRRISARDSPRGFWRCPTCTYDNSVSTDICEMCSTAREDHAFSRRQHHQARGNAELSVDEIRRRRLQRFDR

SEQ ID NO: 33685 - protein, 99 aa, Sorghum bicolor
  Clone ID: SORBI-28MAY03-C35830_1.pep
ILTKMLHRPSAEWQTLQHFLRQPIGITPHSGVMPYELNYITKVGSQNCTIGGSQSAIKLVSWGEGLIGRYCRVHVELLQSYVHSGSDQPTMGKSRVIFC

SEQ ID NO: 33686 - protein, 196 aa, Sorghum bicolor
  unsure (1)..(196): unsure at all Xaa locations
  Clone ID: SORBI-28MAY03-C35865_1.pep
AGMRLLLVGALLLCAAAAVESKPPLDTLGIPPQDEAYYRGGVIKCRDGSGRFSRDQLNDDFCDCPDGTDEPGTSACPEAKFYCKNAGHTPVTIFSSRVNDGICDCCDGSDEYDSNVTCKNTCWEAGKAPREKLKKKVATYKNGVVIRKQEVERAKEAFAKDESELAKLKGEEKILQGLVDXLKEQKRLIEKAEEEE

SEQ ID NO: 33687 - protein, 149 aa, Sorghum bicolor
  unsure (1)..(149): unsure at all Xaa locations
  Clone ID: SORBI-28MAY03-C3586_1.pep
MRDRDLLGFPPAAGAAMSSAAALLLLPLLAAAGEGAPVSRPAPPPAAAVILRHASTSCRTVDALGLRGHRAGVVEGDDGALXKAVALVLQNKEDFVAILFYACGCPVSKIFWTDFQKLSSFFPTIAHFSFEESNIKPRCVFLKEINNCS

SEQ ID NO: 33688 - protein, 257 aa, Sorghum bicolor
  Clone ID: SORBI-28MAY03-C35881_1.pep
MAKRLAAAEKEVLVEVVRFTQKNGLRGCDGGWKDFLARNDRKFGASVSDPRKRTARGLPAFRLSSSRRCLQYFGKLVKRHKERSDVQQYMTDFPDEVSPEQKLVQLTAEHPEYRKHYCSPSYQEGWKVLRIGEVSSLMSSSAMLAIDCEMVLCSDGTEAVVRVCVVDDKLKAKLDILVNPSKAIADYRTDITGVSKNDLEGVTSSLVDVQKSLKRMLSKGNILIGHSLHRDLCVLKLDYSQVIDTAYIFKYANLPTT

SEQ ID NO: 33689 - protein, 102 aa, Sorghum bicolor
  Clone ID: SORBI-28MAY03-C3556_1.pep
KDGSLMLWMHLGAEPESSHMLYIFGSCDVWIAPSFKKKKNAWIALDQPYMKLWCDQFSNGQMGFFDRIGHAFSTAPWIDPSVLGITHHLPLHYTPPGTSHSS

SEQ ID NO: 33690 - protein, 174 aa, Sorghum bicolor
  Clone ID: SORBI-28MAY03-C35579_1.pep
EEGEPHDCLKDAEAAMNLVLVKLKNGFNDPIGIAASSVIESDVVKLLAHRIPVYLPCQELCKIFSGNPNIDDKIDSRIRGEFYSTCISFNDVDEVEKAFEELDGQKTKDSGGRLQKHVVLKRDNGDVVSFYVRKMVYGSWPKQLEVPKNRPEPTEDPEPKKEHAEGVQQKKEEK

SEQ ID NO: 33691 - protein, 159 aa, Sorghum bicolor
  Clone ID: SORBI-28MAY03-C35589_1.pep
AAGTIAEVTIQHYKQESARLRQQITNLQNSNSPQCFRALIGDITTMSPKDLKHLETRLDKALGKIRARKNEVLCSELEYMQRREMELQNDNLYLRSRVDENERAQQTVNMMGAPSTSDYQQQGFIPYDPIRSFLQFNIMQQPQFYSQQEDRKDFNLGGR

SEQ ID NO: 33692 - protein, 185 aa, Sorghum bicolor
  Clone ID: SORBI-28MAY03-C35919_1.pep
TRIIQYIPSTFDWKATGLTVNQQAKPLLSTDPFFKVSLTFSAKGDAQLAKVSVRIPSWTSTDGTTATLNGQKLNLTSTGNSTNGGFLTVTKLWAEDTLTLQFPITLRTEAIKDDRPEYASIQAVLFGPHLLAGLTHGKLPVTDSNHSNDGLTPSIWEVNATSATAVTDWVTPLPSETLNSQLVTL

SEQ ID NO: 33693 - protein, 197 aa, Sorghum bicolor
  Clone ID: SORBI-28MAY03-C35933_1.pep
MAAEDCDGLPMYIEEDEEEAAAEKQKRRQQSQKPPFKYSWEIDTPEENARWELRRTMMNKLFEFDPKTGSRSYTQVWFVNLITFNLDDETQYGPMRFTDSLIGGDHMLTDSLNVLCLKIRSSDVGYPINVYGTVIVRDRLDMKCNYIFKRNRNNCQLVESEGESLILTGPTRGIVLSTDAYFEINLKIKQDRESEDR

SEQ ID NO: 33694 - protein, 219 aa, Sorghum bicolor
  Clone ID: SORBI-28MAY03-C35953_1.pep
ARGIPKRLAAMQHLGVLLVLAALTASPLAAAWRPWPPRANGTTAGLGASKKFARASEFVKLEYHMGPVLASAITVHPIWYGAWPAAQKRTIRAFLRSLAPPPDSSARIPPPSVSAWWRTVRLYTDQTSANVSAAVTLGAEKCDARMSRGARLSRMDIQSVVRDAVTARTRPLPVDSSGGVYLVLTSPDVSVEDFCGQVCGFHYFTFPSVVGYTLPYAWV

SEQ ID NO: 33695 - protein, 193 aa, Sorghum bicolor
  unsure (1)..(193): unsure at all Xaa locations
  Clone ID: SORBI-28MAY03-C35940_1.pep
MNITPCSIKTLKGLYDISGVEVGQHFYWQIGGFQIHAQVLITSWFVITILLGSVIIAVRNPQTIPTDGQNFFEYVLEFIRDLSKTQIGEEYGPWVPFIGTMFLFIFVSNWSGALLPWKIIELPHGELAAPTNDINTTVALALLTSAAYFYAGLSXKKGLSYFEKYIKPTPILLPINILEDFTKPLSLSFRLFG

SEQ ID NO: 33696 - protein, 162 aa, Sorghum bicolor
  Clone ID: SORBI-28MAY03-C35961_1.pep
MAGGGMAALGVKTERAAQYKGRMTLAVAMTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLS

SEQ ID NO: 33697 - protein, 217 aa, Sorghum bicolor
  Clone ID: SORBI-28MAY03-C35972_1.pep
MELWSKLRNLDAYPKVNEDFYSRTLSGGLITILSSLAILLLFFSEIRLYLYSATESKLTVDTSRGERLHINFDVTFPALPCSLVAVDTMDVSGEQHYDIRHDITKKRIDHLGNVIESRKDRVGAPKIERPLQKHGGRLDHNEVYCGSCYGAEGTDDQCCNSCEEVRDAYRKKGWAINNVELIDQCKREGYVQRLKDETGEGCTIHGFVNVNKVAGNF

SEQ ID NO: 33698 - protein, 155 aa, Sorghum bicolor
  unsure (1)..(155): unsure at all Xaa locations
  Clone ID: SORBI-28MAY03-C36009_1.pep
HDDETASSSRRKKKTTSTCSTTPCPPLHHGQWRSPESSTAAAALLRTSCSSQAPGWHTSSPSSASSRHSRATASAAPSXPSSRQSPTPRPTTSRRCSRRSQASSASTSTSCRWTPPPSRAPTRSCSGGRHCAARRTSSTGSSPALTRASRPSSPT

SEQ ID NO: 33699 - protein, 141 aa, Sorghum bicolor
  Clone ID: SORBI-28MAY03-C35710_1.pep
VLDAPHEDYITFLCSIPDVNQSEVSNIAGSACNSNSKGQRPFDLNIPSIAISQLRGTVTVKRTVTSVSDETETYTMMTRMPPEVALEVTPPAVTVLPGASREITVSLTARSVTGTYSFGEIAMKGDRGHLVRIPVVAMGFK

SEQ ID NO: 33700 - protein, 91 aa, Sorghum bicolor
  Clone ID: SORBI-28MAY03-C35716_1.pep
ALPGCRRRRTRSAVQPTSSGRRRWPRAPRRQGQVAGAVEAPAAPPAPRRPPGTRRTRTTAPRPRRRRRPRRPSSPRARGRCAAAAATTAAG

SEQ ID NO: 33701 - protein, 187 aa, Sorghum bicolor
  Clone ID: SORBI-28MAY03-C35756_1.pep
MEPRAAIHRSGALLLLAAILAAAVTSASAIGDKCAACKAVAAELEIGIASEKPRNHLDLRNRLNSKGQREGKVIDYRVSELRVVELLDGLCDKMQDYTLKKLESGEKGWVKVTDWNSFQAEKKAAARAHSKNLSTFCGRLLEETEDELAEWIKTSSTESENVSKALCEDISKHCQSTSATIQIDDEL

SEQ ID NO: 33702 - protein, 135 aa, Sorghum bicolor
  Clone ID: SORBI-28MAY03-C35792_1.pep
NLFWSLEKVAHNVTAKTYQQIDARAKGRFDGVAPEPRKGVRSGHIPGSICVPFPEMFDGAPSLLSADELRQKFQQAGISLDQPIVVTCGSGVTACILALGLYRIGRHDVPVYDGSLTEWEAQSDSDYPKITAPAC

SEQ ID NO: 33703 - protein, 145 aa, Sorghum bicolor
  Clone ID: SORBI-28MAY03-C36056_1.pep
MMAAEVVWLLLLLAHELLPCPCAASAVDRGQFPDSFLFGTSTSAYQIEGAYLEGHRGLSTWDVFSHKLRTIEDGSNGETTADHYHHYLEDIELMHSLGVNSYRFSIRGQEFYQLLLVAGGQFGHVNLDGIAFYNDLIDALLQKGI

SEQ ID NO: 33704 - protein, 200 aa, Sorghum bicolor
  Clone ID: SORBI-28MAY03-C36066_1.pep
ARGINVMSEVGIKNDNCFQSEKWQDISIQSGAHAAEAASNFSAPLYPLQTAEPVTMMGGPVYYQSSVTSLPPDFISSDGASNASGVKFETNHNPVSRQGLEIKTCHNPSGDPDQNSYMCSEDDRNRTSEPMDSIPESEKEQQVDVEQSCLEPAAYSFNEPLSSHGDTILNEKEDAGALCYEPPCFPSFEVPFVSCELVNS

SEQ ID NO: 33705 - protein, 232 aa, Sorghum bicolor
  Clone ID: SORBI-28MAY03-C36096_1.pep
NPDASTSETGSPFYQLRTDATKLVAQTFQRGRRNLWQLATSRLSVLLSSSAVCSTSTYQFLKNYEDLVIFILAGEAFCGFEASEFRQKLKTVCLNYMVSFHRQNIYALKMVLEKESWTIMSAEASQIISLAGLTGDGAALCSPTSRSLKLPINCYHGNSTTANSGNEKLGFAAWLEIENPFSFKLENGSAESPKSNMLFDSSVSNNHGNGKNSSFDEENEDLLADFIDEDSQ

SEQ ID NO: 33706 - protein, 153 aa, Sorghum bicolor
  unsure (1)..(153): unsure at all Xaa locations
  Clone ID: SORBI-28MAY03-C361_1.pep
MAGILAWAGRGGRRGRRXDDEADDDARAAASAAMTPAQRLRAADLDARAASLRRSIQDLRLRVPPPHVAQRLPHLHAHSLASSAALALQLNAHSSTKEQTQQREVTLQEENAAYEKAISECKHKIQEKQMEASQLQSNLEEMEVTEHNLKTXA

SEQ ID NO: 33707 - protein, 196 aa, Sorghum bicolor
  Clone ID: SORBI-28MAY03-C36118_1.pep
TRANLNAIAFLRYCAVKLAEEGFVCQDTAFEQPRNSAVMCGGNATVQKDGHISLWEPLLAGLAKLTTDPRLTIKKGAVGVLFDILKDHGHLFSLTFWTDIFERVVYPLFSNERTTSSDQISTSNSVEYNLPDLETQTFAVKCLVGLFVNFFDVIRPELGRTASIVTFFIRSPYKHCATIGVSAIMRLAEGVGNKLT

SEQ ID NO: 33708 - protein, 202 aa, Sorghum bicolor
  Clone ID: SORBI-28MAY03-C36135_1.pep
TRSRSTSKPIETEGAPLVDEDALKALIRLLRVVQPLYKGQLQRLLVNLCTHRDSRQALVRILVDMLMLDLQGFSKKSIDAPESPFRLYGCHANITYSRPQSSDGVPPLVSRRVLETLTNLARSHPSVAKLLLFLEFPCPSRCRPEAHDHRRGKALLLEDGEERKAFALVLLLTLLNQPLYMRSVAHLEQLLNLLEVVMHNAE

SEQ ID NO: 33709 - protein, 99 aa, Sorghum bicolor
  unsure (1)..(99): unsure at all Xaa locations
  Clone ID: SORBI-28MAY03-C36165_1.pep
ARDKVPWKSDSCMRGKHANXSDSETSSARSSGSLAYQYRLMTPLPNLGTNSLSPPPLSSASSSGSAAHTPNSMHFSVAYHQPSPLPKPNGKEAINLISH

SEQ ID NO: 33710 - protein, 155 aa, Sorghum bicolor
  Clone ID: SORBI-28MAY03-C35889_1.pep
MPPPRPPPPLVDDLVEEVLLRFPPKDPAALVRAALVCKRWRRLVSGPGFRRRFREFHRTPPMLGMFCSGELSRVYRRFVPTTAFRPHHAERRHRRALDARHGRVLLLGEGGALCVWDPITGEERKLPSPPVPPRPSMSWTATAPGPAAAAAAGGD

SEQ ID NO: 33711 - protein, 179 aa, Sorghum bicolor
  Clone ID: SORBI-28MAY03-C35909_1.pep
MLLAGTVTNQALQRVARGPPTRLAVPMVVPAVELLGTDTAHRTTGRSHSTKPRRRFQETFSQYASRIWAAHINKIQGPSLLADRIGAGKLPPPPQIRTGIPPHALPTSPQQLPNRNRATRRRRPPRTATGEKENRDLFLRLLRRKRRATGRIGGGEPGVGIKTEPCSRKSRDVGPREVP

SEQ ID NO: 33712 - protein, 95 aa, Sorghum bicolor
  unsure (1)..(95): unsure at all Xaa locations
  Clone ID: SORBI-28MAY03-C35918_1.pep
MAMALALGGGQDAERKVKVAEVALRALLCGLGALAAALVATDTQTRTFFSLQKKASYTDMKAMVFLVXAAAVAAGYSLLQLAARCCGGGAMSSGR

SEQ ID NO: 33713 - protein, 222 aa, Sorghum bicolor
  Clone ID: SORBI-28MAY03-C35928_1.pep
MAAYLSMGEAHRRIGDYLSRVTNAISYSDGAPLASLLSVSSAPASTPLSDALAAFPDFPRLAGDRFPHLADFLVPLLRAIHSHPVQRFADAYSSFEKASSAFLQEFRNWETPWAMEAMHTVALEIRLIAEKADRELATNGKNPDKLQAAGSFLMKVFGTLAVKGPKRIGALYVTCQLFKIYFRLGTVNLCRSVIRSIETARNFDFEDFPVKDKVTYMYYTGR

SEQ ID NO: 33714 - protein, 83 aa, Sorghum bicolor
  Clone ID: SORBI-28MAY03-C36223_1.pep
QKCRRDLRSWLTQDRRRPKSAHDWHKRKEAVPWQASCGTQQISEVMNFAGRLKPTTGPRNMARHKGKPVVDHCRKQLPTCPAG

SEQ ID NO: 33715 - protein, 91 aa, Sorghum bicolor
  Clone ID: SORBI-28MAY03-C36220_1.pep
HFNSDDGLFTGGGATLCSTYEIASQVNDGLFLRRHRLWPPIAYHHHIISPRGAYHCVQRACRANPKPPLHQVAHRLPEVHCLPTAAYFNLR

SEQ ID NO: 33716 - protein, 289 aa, Sorghum bicolor
  Clone ID: SORBI-28MAY03-C36225_1.pep
QADVRKTIAQIKDETLGRDKTDWITVKAAISHVQTESFCYPACPLIFNEKPCNKKVIDSGDGIWFCERCDKSSGSCEYRYMVKFRIQDHTSTIIATAFQEAGKQIFGRTAQELRTIRNVNHDEALFTEIIEGARWHLNLFKLKVREESYNDEQRIGCTIINAEKLDPSKESNVLFEAIDRLMQGRSGPSPGDQGSIANKAGFSNSPDGRSAINMCGTNQFGQQGSIDGRVSTTSAGLDSEQQPAGGGFTGNNYGSAAGNYGYVAAGNARQGPCFKCHQPGHWSKECPGR

SEQ ID NO: 33717 - protein, 122 aa, Sorghum bicolor
  Clone ID: SORBI-28MAY03-C36259_1.pep
LMAGLRELRRRHPGAVVAYADYYAAHLAVMRAPARYGFSEPFRTCCGSGGGAYNFDLFATCGSPQVTTACARPAEYVNWDGVHMTEAMYKAVAGMFFDEHGGEAYCRPAFKDLLAMKAQGKP

SEQ ID NO: 33718 - protein, 96 aa, Sorghum bicolor
  Clone ID: SORBI-28MAY03-C36243_1.pep
LCPVLSVQQLYKICTQYWDDKYNTESVSEEVLEEMRTLMTKESSQDTLENTFLLDDEISMPISLEEIADSMDAKEFQNVAPPQELTAIPAFQFLKS

SEQ ID NO: 33719 - protein, 78 aa, Sorghum bicolor
  Clone ID: SORBI-28MAY03-C36261_1.pep
MRRVAYKTGKRVEPWPYVPYEMVAHPYAPGAYLKKAPPGYVRDVVADPTAAPLARASSTEVRYTAAFSDENPNACAVM

SEQ ID NO: 33720 - protein, 97 aa, Sorghum bicolor
  Clone ID: SORBI-28MAY03-C36282_1.pep
SRIPLLIHLQRLELHMDLLGLCQRFMLPTRLSDPQLLQLLACKRRNETVESFSPLSVMKDRSWATFSGFSAIGGMRSRILFCSSSTSHQSIVNKGCS

SEQ ID NO: 33721 - protein, 178 aa, Sorghum bicolor
  Clone ID: SORBI-28MAY03-C38873_1.pep
FGQSAQIGSGQQSGFGQPAQIGAVQSGFGQPAQFGAQQALGSVLGSFGQSRQLGGVGSGGFGGFASASTSGGFGSLSSSNAGFAGAATVGGFSAPAASAGGGFAAATGGGFAALASKSGGFAGAASSGGGFAGAAQGGGFGSGGGFGSFGGNQGAGFSAFGASGTGRPPADFLTQMRK

SEQ ID NO: 33722 - protein, 184 aa, Sorghum bicolor
  Clone ID: SORBI-28MAY03-C38874_1.pep
EWFSTFLGCPTRLVRFNEDSETRLTDPNYARGYKTMFSDGFPYLIVSQGSLDALNEILKEPIPINRFRPNILVEGCHPYAEDMWKSVKINKLTFQGVKLCGRCKVPTINQDTGIPSPAEPTETLQTYRSGEVLLPSHKNKRQVYFGQNAVCSESLSLNSKGRIVKVGDPLYVTQSFSSSDEVPA

SEQ ID NO: 33723 - protein, 145 aa, Sorghum bicolor
  Clone ID: SORBI-28MAY03-C38878_1.pep
LDYVDMITLSGAHSIGRSHCSSFSRDRLPPSNTSDMDPAFAATLQAACASPNGTDNTVVQDFQTPDVLDNQYYKDVLAHKVLFTSDAALTTNITSNNLVRAYADFVPFLWQNKFGKAMVKMGGIEIKTAANGEIRTNCRKVNGRP

SEQ ID NO: 33724 - protein, 116 aa, Sorghum bicolor
  Clone ID: SORBI-28MAY03-C36354_1.pep
PDRRGRERSPGRRRSPSPYGRGRERGSPDYGRSKERGSPDYGRGGRSPDNGRGGHSPENGRGVSPANGGRGDHGRGGRSPDYDRERREASPRRERREASPGYDRSPSRSPGRDERD

SEQ ID NO: 33725 - protein, 174 aa, Sorghum bicolor
  Clone ID: SORBI-28MAY03-C36368_1.pep
TRVDAVVAEVGSDRVGIRLSPYANYLGCHDSDPDRLGVYMAQELNRYNILYCSAVEPEMVMVDGKMKIPHSLQEMRKAFNGTFMVGGGYDREEGNRVVADGYADMVVYGRLFLANPDLPRRFQLNAPLNKYDRSTFYTDDPVVGYTDYPFLENSEPLNSLTRRGGIYQNKEGMI

SEQ ID NO: 33726 - protein, 149 aa, Sorghum bicolor
  Clone ID: SORBI-28MAY03-C36372_1.pep
CVRSELSKDQFKLLCSLSNVTNLVLSGFQTMVIGEEFPEFQNLRTLLLEKCDLSDNFQMLGHFLQHSPNLEKLTLDHCKFSKDPKRKKGNVKSNKAYLNQFDVRCKNLKLTKIIYNDDDAQKLLNLLFSISSDLPKNNIKFTKVGPGHP

SEQ ID NO: 33727 - protein, 170 aa, Sorghum bicolor
  Clone ID: SORBI-28MAY03-C36384_1.pep
GPVRPALLAHWGPGSGREDDPDVRVSEYLPTRGGRAGASAAAYTDMMRRSRFCLCPGGYEVASPRLAEAVYLECVPVVVDDGEYALPFADVLNWDAFAVRVRVADVPRIKEILSAVSPRQYIRMQRRVRMVPRHFMVHGGPPRRYDAFHMILHSVWLRRLNVRIDAHAQG

SEQ ID NO: 33728 - protein, 157 aa, Sorghum bicolor
  Clone ID: SORBI-28MAY03-C36418_1.pep
FHSNGFSLVRRVLEKSGLSLSDQLPRNDGITTTVGEALMAPTVIYVKQVLEIIKKGGVKGLAHITGGGFTDNIPRVFPSGLGAKIFTGSWEVPPVFNWLQQAGNIDDAEMRRTFNMGIGMVLVVSRESADRIIEDTHGSNHAYHIGEVIEGDGVQYV

SEQ ID NO: 33729 - protein, 221 aa, Sorghum bicolor
  Clone ID: SORBI-28MAY03-C36473_1.pep
RKESRGRETTKVPIFARSGWNSATNSGGKPARSVATEPRNQRAGSNLSSLTPAPQKSIKISTPNQVSFSFELTNRAPLARIQAAAFFAGGRTPPSESVTHSLLTGREETLLPERRRSRCRSSHLESTRGRRQRQTHPHQEPHVRGGRVGVRPDSRLTWCWLAALDGRRRGAAEAEQASKAADGRKQPARHRPSSGGEVWKLRKGRGGFFGFSLPLVRCTLQ

SEQ ID NO: 33730 - protein, 108 aa, Sorghum bicolor
  Clone ID: SORBI-28MAY03-C36465_1.pep
SSLITHGEGDCSHLTAVVASSMGGKCLVPRPSVHIPLTVVARTTLGEESLLAQAGTGAAGHCQAMPPSSTAGWPEPTIFALLCVARRKVENACCKSMFHMFQRYVASV

SEQ ID NO: 33731 - protein, 214 aa, Sorghum bicolor
  unsure (1)..(214): unsure at all Xaa locations
  Clone ID: SORBI-28MAY03-C36166_1.pep
ASTSLTAAAPELSPIFSLRPARPQGCQFDLRRPALVRGSRPVLRFLAVVRWVRPADILLSVVFSGWFAYEPHSSVMTCFGGLEPLFTPVFVMGWVKQLHAPGLVXVFGLVPHANRRVFRGRTRPTARGRAESAPALRPGARVPSAAAMFAAPGLPASCFAPKLLERPCWPGCGSACSFATRPLVPARRSPCGRGLGSAGSGCLFXDEQTNVSPL

SEQ ID NO: 33732 - protein, 177 aa, Sorghum bicolor
  Clone ID: SORBI-28MAY03-C36175_1.pep
NVPLHTSMPTQLWTIHNLLQLHSFTSGGLRFYPFPFHLNSQCQSRLCAERFHTSLLQYKEKRTLGMLAPGQFDSGSSFSWLWFAQSRQPQSEWLSWGRCCRLRRSTSGWSGKLKWLELLIGFALQIIIRILGPQTGYLFQVIFRTDLQRWPPVSIYIFLINFNLMMGYQLIKFIRCG

SEQ ID NO: 33733 - protein, 182 aa, Sorghum bicolor
  Clone ID: SORBI-28MAY03-C36185_1.pep
ARGREAGIRCRRHNTDRFWDIKFDNGVLHIPRILVHDGSKLLFLNLIAFEQCHMDIATPGGNNITSYAIFMDNLINSAEDVKYLHDRGIIEHWLGSDAEVADLFNRLCEEVVFDINDSYLSGLSDQVNRYYDYKWSTWVASLQHNYFSNPWAIVSVVAAVFLLLLTMAQTFYSAYSYYRPPQ

SEQ ID NO: 33734 - protein, 180 aa, Sorghum bicolor
  Clone ID: SORBI-28MAY03-C36538_1.pep
TRQDVRSKVFPFKRKKVNAEEAESPITLPVKVKERSISSLVVNTPRVAPAASTRRRTRAVTRKAAALRGLGPIIVDPLKKDNDNSNKQTDNSSLLDSLSKIPQTRRQLLSNGDTSGHPSVKDKAGDNKDLDKSELWKPLNRLVDAASKTKALTSAQSPALKGDKPRESPSSEHSSRTEAR

SEQ ID NO: 33735 - protein, 118 aa, Sorghum bicolor
  Clone ID: SORBI-28MAY03-C36545_1.pep
MVEGPNFAGMIGGHDNGGNFCHMAYYRKLGEGSTMSIDSLNSMQTSTHGGSIAMSVDNSSVGSCDSHTRMLNHPGLKGPVVGNYSVGGHSIFRHGRVSHALSDDALAQALMDPRYPTE

SEQ ID NO: 33736 - protein, 245 aa, Sorghum bicolor
  Clone ID: SORBI-28MAY03-C36557_1.pep
ARGDYLPCPLEVDNYALDQNKSEEKVLLAGTPAEPLVALAFKLEEGRFGQLTYLRIYDGVIRKGDFIYNVNTGKKIKVPRLVRMHSNEMEGTREAYAGQIVAVFGVDCASGDTFTDGTVKYTMTSMNVPEPVMSLAVSPISKDSGGQFSKALNRFQKEDPTFRVGLDAESGQTIISGMGELHLDIYVERIKREYKVDAKVGKPRVNFRETITQRAEFDYLHKKQSGGQGQYGRVCGYIEPLPSGS

SEQ ID NO: 33737 - protein, 235 aa, Sorghum bicolor
  Clone ID: SORBI-28MAY03-C36564_1.pep
ARGSFAARLNLRTRRVFEIMQHARGYSWMFGNRVPHMLDNDYTPYSAVDIFVKDLGIVSSESSNSRIPVHVSTIAHQLFISGSASGWGRYDDAAVVKVHEALTGVKVEGKAPMLSKEDVLHSLPAEWPEDPIDNLVSIASHSSKKILVVLDDDPTGTQTVHDIEVLTEWPVEALVEQFLKLPTCFFILTNSRSMTADKAMLLVQTICRNLEAAAKKVPGVSYTVVLRGDSTLRGH

SEQ ID NO: 33738 - protein, 97 aa, Sorghum bicolor
  Clone ID: SORBI-28MAY03-C36570_1.pep
LVTDHVRGIHPPPRIRGNTRGFEGLPINPNLRCRRKRGCGAVRGRDRGQVLEGRASRKRLQRAGGDAGGTAARGGWRQPARVSGEGGRGERGQSRLV

SEQ ID NO: 33739 - protein, 310 aa, Sorghum bicolor
  unsure (1)..(310): unsure at all Xaa locations
  Clone ID: SORBI-28MAY03-C36571_1.pep
MWRLKIGERPSNPLLRSPNGFFGREVWEFDPAAGTPEERAEVERLRREYTRNRFTHRECSDLLMRMQYTKQNLHSTNLPSIKIDNDSEATGETILAVLRRALSQFSSLQGPDGHWPXGYSGILFILPLMIFALHVARALHEVLSIEHIHEICRYIYNIQDEDGGWGTHTLGPSSMFGTCVNYATLRILGEVLDGENDALSKGRAWILSHGTATAAPQWAKIYLSVVGAYDWSGNNAIIPELWMLPHFLPIHPGRFWCFCRMVYMPMAYIYGKKFVGPITPTILAIRNEIYNIPYNEIDWNKARNSCAKED

SEQ ID NO: 33740 - protein, 189 aa, Sorghum bicolor
  Clone ID: SORBI-28MAY03-C36577_1.pep
PTVGGLLNATFGNATEMIIAIYALKNGMIRVVQQSLLGSILSNMLLVMGCAFFAGGIVHRNKDQVFSKATAVVNSGLLLMAVMGLMFPAVLHFTHSEVRQGASEVALSRFSSCIMLVAYASYLYFQLSGRSNMYSPIGSEETPNEDTVEEDEEAEIGMWEAVTWLAVLTLWVSFLSEYLVNAIEVFSSP

SEQ ID NO: 33741 - protein, 116 aa, Sorghum bicolor
  Clone ID: SORBI-28MAY03-C36286_1.pep
SLWKKMERTSITGPSGCTILRKGFQLLSLPRTQLTQFHFPMRKLTYVLFSPQNYDQTYPKSGSMLSLDTTRYHTSASQPLQLSRRELETSINTFHEDRCIWISLINIASVQNASEQ

SEQ ID NO: 33742 - protein, 138 aa, Sorghum bicolor
  Clone ID: SORBI-28MAY03-C36290_1.pep
CSITAMMGSIFSAIVQVLMEGKLTAGTANNLTRIIGEIVLVGGVVIGLCTAFQVSSIGRKGPVLVSMFNPFQTVFSAFISFIFFGQWIGLGCFVGIVLMFVGLYVVLWAKNREDNMFADLAAPSPSETGCDIESSLLQ

SEQ ID NO: 33743 - protein, 173 aa, Sorghum bicolor
  Clone ID: SORBI-28MAY03-C36323_1.pep
IPLDKVLVTKQIDLMTAKAWLSADKQLERKVIKLSIQNGVPSEYTEMTLLQTNLDKVDGTQKVKQKLKGQKGRDEQRILMHGLKLGFGNKDATRENLITGFGDRNPAEKLVMLHKGKGCCSSVADCLCCMCCIKACNRMNDQCAILMAQICAALACLGCYECCSEVCCGGSES

SEQ ID NO: 33744 - protein, 142 aa, Sorghum bicolor
  Clone ID: SORBI-28MAY03-C36346_1.pep
ITAISENPANFKGKVVVIRGEGPKGGPGMPEMLTPTSAIMGAGLGKECALLTDGRFSGGSHGFVVGHICPEAQEGGPIGLVQSGDVITIDVSKRVIDVDLTEQQLEERRRKWTPPPYKSTRGALWKYIKLVAPASRGCVTDE

SEQ ID NO: 33745 - protein, 141 aa, Sorghum bicolor
  Clone ID: SORBI-28MAY03-C36616_1.pep
MDRSRTRRMLCCGDGVSSMSMSCSDVVTICGLFAVQCIYGLYMMFLSALLAAGVPSLFIIVVACAASSVVVLPFALALERKKWPKVWSPMLVVQLIIISLGGVSIYQVIMMLGVARTSPAIASAMPNLCPGFIFVIAACLR

SEQ ID NO: 33746 - protein, 165 aa, Sorghum bicolor
  Clone ID: SORBI-28MAY03-C36631_1.pep
ARGRDAAAVQRDTLRRILGDNATAEYLRCRGLAGRTDAASFRACVPLATHADIEPYITRIADGDTSALLTANPITSISLSSGTTQGKRKYLPFNQELVKSTMQIYRTSYAFRNRAFPVEDGKALQFIYGSRQFTTTGGLTATTATTNVYRSEEFMPTMRAIQSHV

SEQ ID NO: 33747 - protein, 135 aa, Sorghum bicolor
  Clone ID: SORBI-28MAY03-C36649_1.pep
MEDFARAVEDGLKLSKRLVLPGGLPPPRPPAGMERTVSAAAASGPDPRLLPTAPMAYAVVTDPAAVDTPDVPSYQPYVYGNLDPPALIPLQMKEVDLTVDCAVDTAHVTLRARWWLHCITRSRECDVRLVVPLVE

SEQ ID NO: 33748 - protein, 110 aa, Sorghum bicolor
  Clone ID: SORBI-28MAY03-C36660_1.pep
SISARGESRGLVPLYSDEIRARLGRNGTARGANRIRIRAAGAQRGQIQAAHQGIRAAASSNRTNEQGDKNERTEMESKSSKTGGGRNSGGPGSGETVREEKNTLFPEQNS

SEQ ID NO: 33749 - protein, 190 aa, Sorghum bicolor
  unsure (1)..(190): unsure at all Xaa locations
  Clone ID: SORBI-28MAY03-C36663_1.pep
TRVFAMMLGLVTDSISEKFDSLRKGRSEVIEQSHTLILGWSDKLGSLLNQIAIANESLGGGTIVVMAERDKEEMEADIAKMEFDLKGTAVICRSGSPLILADLKKVSVSKARAIVVLAEEGNADQSDARALRTVLSLTGVKEGLSGHIVVELSDLDXEVLVKLVGGDLVETVVAHDVIGRLMIQCARQPG

SEQ ID NO: 33750 - protein, 200 aa, Sorghum bicolor
  Clone ID: SORBI-28MAY03-C36679_1.pep
MKRGKGGRNGLLPSSLRIISSRLETVTSNAGSVASTVRSAGASVAASISSQAEDEKDQVLWAGFDKLELHPSSFKNVLLVGYSNGFQVLDVEDAANVCELVSKRDGPVTFLQMQPTPVSSEGIEGFRASHPMLLVVAGDETNGLGAVQGGRLSALIRDTNSEPQAGNCISTPTVVRFYSMKSHTYVHVLRFRSAVYLVRC

SEQ ID NO: 33751 - protein, 164 aa, Sorghum bicolor
  unsure (1)..(164): unsure at all Xaa locations
  Clone ID: SORBI-28MAY03-C36674_1.pep
HEEEAEIAENNARIHQVQERISAVVSKFHGSQSDIDLKLNSLKEAQSKVDLETEALVLKKNEIDKFISLSEQKDSELREIIGACSSEAKTCQQSVEIRRKLASSILKSREDRIGLLKMEEEILQEIQMLRQKXTDARTTLQEVSSRRTSIQQEMDSFKQKLSFI

SEQ ID NO: 33752 - protein, 147 aa, Sorghum bicolor
  Clone ID: SORBI-28MAY03-C36481_1.pep
MSPAAASASPDDRIRNYEDFVRVHAYLLAAAGIPPSLHQRLYRKLADEVFDGGEVFAVEPCEDGRQRRLVLSADESLRKESDVFLVDHAWSFRLPDALKQLREVPGLAERMAALMCVDLDRRIETEEADDKDGHESGSLEHVLQVVE

SEQ ID NO: 33753 - protein, 152 aa, Sorghum bicolor
  Clone ID: SORBI-28MAY03-C36507_1.pep
MAQPLVVKKDDDLDEEEYYSPFLGIEKGAVLQEARVFHDPQLDARRCCQVITKLLYLLNQGDTFTKVEATEVFFATTKLFQSKDAGLRRMVYLMIKELSPSADEVIIVTSSLMKDMNSKTDMYRANAIRVLCRIIDSTLLTQIERDLKQAIV

SEQ ID NO: 33754 - protein, 176 aa, Sorghum bicolor
  unsure (1)..(176): unsure at all Xaa locations
  Clone ID: SORBI-28MAY03-C36537_1.pep
MESLASAMRRENRRSKAPSSSSAASTLASGRVPLVMAFLSCLAWLYVAGRLWQDAQTRAILSGLLEKSSGSVPKVLSVEDKLRNLGCKAIGSKIVEAEMDLTKAKSEGYLWGNRTAAVDSDKKQQLLAVIGVYTGFGSRLKRNVFRGSWMPRGDALKKLEEKGVVIRFVIGRSAXR

SEQ ID NO: 33755 - protein, 114 aa, Sorghum bicolor
  Clone ID: SORBI-28MAY03-C3679_1.pep
RPAGAASRLVAARAAASGARGEGDAETVFFDGGAHYGDLAANLLLGLTLLWLPLTLAAVSRAFILRYRFTSRRVTVVSGLSGADRTDFPYSCVTSAVVVPRFIGECGDIVITLK

SEQ ID NO: 33756 - protein, 72 aa, Sorghum bicolor
  Clone ID: SORBI-28MAY03-C36851_1.pep
LIIACDQSASYALVRLSSATDTGGRTHLGPKDRELTRRFGWTVCIKRTKVVYRKLEIYRSLMIVISRSFWRY

SEQ ID NO: 33757 - protein, 108 aa, Sorghum bicolor
  unsure (1)..(108): unsure at all Xaa locations
  Clone ID: SORBI-28MAY03-C36892_1.pep
RDLKFCSSFNKLKYLLLDEYWXEPADFSALACLLKLSPVLEKLTLQLYSEGPKHNVEIKLSCKPMEISTEISQHLKTLEVNCEVYDKRVCNVLTFLSKKLNIWFQFSG

SEQ ID NO: 33758 - protein, 89 aa, Sorghum bicolor
  Clone ID: SORBI-28MAY03-C36898_1.pep
RACSNQQPYVAATCQTLTSGWLEVPDSESPAESAPSLLAEFMAGDVLGFLSEVPNASKASRKNFLFGTIPCLFILLSNFCTSTLSFALV

SEQ ID NO: 33759 - protein, 152 aa, Sorghum bicolor
  Clone ID: SORBI-28MAY03-C36924_1.pep
SPSIPHASRHIGTETYSCPGYTCLPPDTRIAGPVLGGLDDSTRLLLFARCVAFLPMAMEREESQRVWFSGKGKCMAWNLLSCFVRRTRKKGRREQENSIRQHSVLTAICLLFLSSTWQINRKVSSPFHTSFSFGLLSVPNICVSLNPRLVGH

SEQ ID NO: 33760 - protein, 245 aa, Sorghum bicolor
  unsure (1)..(245): unsure at all Xaa locations
  Clone ID: SORBI-28MAY03-C36933_1.pep
TRRQVPDRNGKPPSPYKMRIPRKCTPKCYESRVLPALLKKHVVXQLTKFDYRLSNKLETDLQKLRCRVNYHALRFTDPIFTMGEMLVQRMREKSGRFIALHLRFEPDMLAFSGCYYGGGDIERRELGEIRKRWKTLHASNPDRERRHGKCPLTPEEVGLMLRALGFGKDVHLYVASGDVYGGEETLAPLKALFPNFHSXETLANKELAPLLPYSSRMAALDFIVCDRSDVFVTNNNGNMARMLAG

SEQ ID NO: 33761 - protein, 153 aa, Sorghum bicolor
  Clone ID: SORBI-28MAY03-C36945_1.pep
TRQPPRPHHRHRPHSELCASTSLHRSLLSLPRTGTLSTSRHRQQQEVEHGHGDRTRTPLISASFHQREGGAGSSRDGGSAGAGREGGAPGVRPRHRHPQPRLRARAPATPPLPPPGGLRAGRHTSRPGRARPRFWVPGCSSRSLRLSLSTLYR

SEQ ID NO: 33762 - protein, 119 aa, Sorghum bicolor
  Clone ID: SORBI-28MAY03-C36583_1.pep
ARGSSALLLSHHSPPLLCSTAAHLTSAQPRLLLVLWCRFPFPSPRPAPPPPPRPAPRPALAAPPSRGGGAGPGTCRHASTPLAARGRCRFHCPTCWPGPPWRSRYTHADGGDEGTDRLR

SEQ ID NO: 33763 - protein, 212 aa, Sorghum bicolor
  unsure (1)..(212): unsure at all Xaa locations
  Clone ID: SORBI-28MAY03-C36598_1.pep
ILDKLHRQKXAKVEKLSLPVGELEEAVLQGGATANVVRDYQRRFQEINEEKRTLDRELARAKVTANRGASVVANEWKDSNDKVMPGKQRLEERRFLQGEMQQLRDKLAVAERTARSEAQLKEKYQLRLKVLEDGLRGPPSGSSRPPTEGKSFSNGPSRRLSLGGADNISKLSPNGLLSRRSPSFHSRSSLSSNSSLVLKHAKGTSKSFDGGT

SEQ ID NO: 33764 - protein, 210 aa, Sorghum bicolor
  Clone ID: SORBI-28MAY03-C36606_1.pep
MEPYAAAKGGGADAGTGLEESMRRLGLGDDGEPGEEKLPERPGEADCAYYLRTGACGYGERCRYNHPRDRPPPVNGVGKTAGMVEYPERPGQPLCEYYAKNGTCKFGSNCKFDHPREGGFVPVTLNSSGFPLRLGEKECSYYMKTGHCKFGSTCKFHHPEVGFLPETPGMYPPVQPSPISSSHPYPHLANWQMGRPPVVPGSFLPGSYPP

SEQ ID NO: 33765 - protein, 142 aa, Sorghum bicolor
  Clone ID: SORBI-28MAY03-C3699_1.pep
MALSLSLARPAPLAVSAGAGARSLPARSLAFPAKSFFGAPLAATAASVASPLPRKPATSTSLEVVAAGKKGYKMKTHKASAKRFRVTGRGMIVRRCAGKQHLLAKMNTKRKKRLSKMVQANMSDYDNVTGALAYLKVNRIAN

SEQ ID NO: 33766 - protein, 182 aa, Sorghum bicolor
  Clone ID: SORBI-28MAY03-C37011_1.pep
MLPQKAPKIASAAAAAPVEGRDHISNLPDAVLQHILSFLPAQDVVRTCVLAKNWRHMWESTTVLRFLCGRMKEPESTVEIQEFVDHLLRLRIRGGMPVDTCEFRLLEFDEDEMRSTILWIRIALQCKVRVLQLICAGNCGDIPFLDGHPFFISQYLKKLELYRIDLSMDRDSRFLDFSCCPV

SEQ ID NO: 33767 - protein, 155 aa, Sorghum bicolor
  Clone ID: SORBI-28MAY03-C37024_1.pep
HEGAGGLRDSFLLSLSRLRRYSLTRWPRRRRAEVLMLRGPARRPTPPRGSVRAAPDAEAIDALPYIDGDYGDPAVKREVDRLVEEEMRRGKRKPADFLRDLPPVPTAGFESHPMLAKEYERVRAGKPPFMLDMSRYGLEPPPMNRRNDVGAWRQA

SEQ ID NO: 33768 - protein, 142 aa, Sorghum bicolor
  Clone ID: SORBI-28MAY03-C37026_1.pep
TRGDWQELGQAAAIGLLFAYLVAKLISTVIAFKEDNLRITRSPPSSPTAAAPAPATPFPAEPRLPSHDGSTDGGSASDSDWEARGSTELDEEFSAASAFVAASAASGTSVPEEAQLRLYGLYKIATEGPCTAPQPSALKLKA

SEQ ID NO: 33769 - protein, 202 aa, Sorghum bicolor
  Clone ID: SORBI-28MAY03-C37039_1.pep
ARGEGICNGLHYLHEKWQASTPIIHMDLKPKNILLDDNMVPKIADFGLSRLFGEEQTRTCTASRDGTLGYMAPRGLNRGIITKKLDIFSLGVIIIEIVTGHKDYPDETDTSSQEFIELVLKNWRNRLEKTPGYTTAFSIFPSFCREIDYQRIRRCIQIGLACVKLNRAKRPTTLEGVNMLHKSERAECSNGKEDYTNERPEE

SEQ ID NO: 33770 - protein, 175 aa, Sorghum bicolor
  Clone ID: SORBI-28MAY03-C37062_1.pep
GCPLENTVLESNDGITGLKGDFLFGMSSTGSGSSRLTLGSDKCDCREGRFGMGALSTTASCFSAMTSDLCRLFCSFLAFRSSLAGFTLTLDGCCPKSRDRGMSSRLASSSASYRMSSPNSTAHEAESSVEPSAELDLSAVAGRGSSVNFWRIDRRVAVPLELTLDLRCLLDFTSC

SEQ ID NO: 33771 - protein, 198 aa, Sorghum bicolor
  Clone ID: SORBI-28MAY03-C36712_1.pep
MRATTSAAAPCLPWLRSHGHGRASSAAAYTAVAACLLALVTFLVVAAFWDPTRTQASTWFLSSSSSSSASSLTTAGGVGGEHLLATASSYYSDGGGGGGGRNSTGKEVHEEVRGQGGDDDGFLSLVNSSSGGYGAPPPHQISVTPAPAALAPAASPVTGNSDEVIRPTPQVETSRDIKLERLELGLAKARSAIMEAIR

SEQ ID NO: 33772 - protein, 160 aa, Sorghum bicolor
  Clone ID: SORBI-28MAY03-C36728_1.pep
ARGLTSAGAKLEGSKQKLAVLKAQGDNKQATPILVPTLGNKNMTAEKVRDKRTELQDLEATHKELMELTSKRLEEIRRLHTERIEILNKLAAFQNILMDFKSIRSSKAFQLVNDQLQKSQAELDDQQTLLEKLQVEMDTFVWRERQFNQKADLAEIPQKV

SEQ ID NO: 33773 - protein, 194 aa, Sorghum bicolor
  Clone ID: SORBI-28MAY03-C36735_1.pep
TRTLDTSEIDGSLSAGNDLNYIGSDVLKENELGTGELLELERRELIGEILRLNPGYKTPENYKPVLKETKVPLPAEAHPGHNIIGVLLGPESNTQKRLHEETGAVIRVYGTKKINGEKNEIRHQDINEAQDAYEDLYINVSADSYDKVDAAVVLIELLLAPVSVKSTATSTTTAVPSEVTSKDAVSANVQLVQN

SEQ ID NO: 33774 - protein, 141 aa, Sorghum bicolor
  Clone ID: SORBI-28MAY03-C36744_1.pep
TRGRRTTSSSTSSCGRWRRGPSPTRSAPRRRGARPPTAPRASGTAYAASRPRRPRWRSSDGSSPSASTSSQTSSSGSRTSSRRRSTAATLRRRRRRTSSRLPPPKRRGRPLHRRRRRHRHRTEPPSRRMTPRRTPTTSGAG

SEQ ID NO: 33775 - protein, 60 aa, Sorghum bicolor
  Clone ID: SORBI-28MAY03-C37139_1.pep
YSAESIETDGQSEKLNLVKFEIQLYKTRDEKYLLDLQRVSGPQLLFLDLCAAFLAQLRVL

SEQ ID NO: 33776 - protein, 203 aa, Sorghum bicolor
  Clone ID: SORBI-28MAY03-C37116_1.pep
TRLIIAMDAAFGLEYLHSKNIVHFDLKCDNLLVNLKDQSRPICKVGDFGLSKIKRNTLVSGGVRGTLPWRAPELLYGSSNKVSEKVDVFSFGIVMWEILTGEEPYANMHYGAIIGGIVNNTLRPTVPASCDPEWRRLMEQCWAPDPAQRPAFTEIAGRLRSHVSCSKSGESNQINYRWSTSFQSPICWGFISLFFSLLFLTGE

SEQ ID NO: 33777 - protein, 71 aa, Sorghum bicolor
  Clone ID: SORBI-28MAY03-C3716_1.pep
RPVECCLICHSSDLGDWVNCGVCGEWAHLGCDRRQGLGNFKDYSKTGGLEYICPHCSHAKSPLPVQVGNDS

SEQ ID NO: 33778 - protein, 104 aa, Sorghum bicolor
  Clone ID: SORBI-28MAY03-C37161_1.pep
MALACATHARRFLLAGPARSFHAQPYQAKVGVVEFLNGVGKGVEAHAAKLEDAVGGDLQRLLETRTLRLKKLGIPCKHRKLILSFAHKYRLGLWKPQADPRKVE

SEQ ID NO: 33779 - protein, 179 aa, Sorghum bicolor
  Clone ID: SORBI-28MAY03-C37162_1.pep
LADAYYTNTRFKSLQENGGGTSSQEGNRKKKGKGKAPVTESSAANDVKGALADNILDTVRRLQSNHQAQEGEAEVLSKDGYRPSKGVQPAAGPSSNLDSSAGAKDNSGKGGGNKQPKKTSKFLRARLGDNSLATLDLSRSSASPERPERESQGPEAGLPVRGAWKNGGGQKLFLSNGRK

SEQ ID NO: 33780 - protein, 142 aa, Sorghum bicolor
  Clone ID: SORBI-28MAY03-C37166_1.pep
TRLDYTRKAINKLTELKKMLEKFKNDVEKQQVDQMADWQTKLVMMDSKERQYILQVSNYKAMLNRVGYTPEINHGVLMEMAEHKKDLERKTKPIADTLRSYQDLPPDKALAALAIEDKKRQYAAAEKYLEDVLQSALTTTGL

SEQ ID NO: 33781 - protein, 146 aa, Sorghum bicolor
  unsure (1)..(146): unsure at all Xaa locations
  Clone ID: SORBI-28MAY03-C37164_1.pep
HILEEEPEKLAGPLLAATXVSVLEGRTAGHRHMLATGDLSFGLPVSVTGIATPHGLSAGVAWFLLPGRQRFCVMLPVPYCAVAPVDLGPLLFARLGLLIPRDRPADSILQAIRDETMYDPRERIEMAHGHSLYRPSLLGQPKDVKT

SEQ ID NO: 33782 - protein, 165 aa, Sorghum bicolor
  Clone ID: SORBI-28MAY03-C36959_1.pep
TRLNGRKANLSFGAAAYVTHEDNLIGTLTVRETISYSASLRLPDNMPREEKQALVEGTIVEMGLQDCADTVVGNWHLRGISGGEKRRVSIALEILMRPRLLFLDEPTSGLDSASAFFVTETLRGLARDGRTVIASVHQPSSEVFLLFDCLYLLSGGKTVYFGKAS

SEQ ID NO: 33783 - protein, 256 aa, Sorghum bicolor
  Clone ID: SORBI-28MAY03-C36984_1.pep
TGCPVADSLEMDLFGSDPISSLALVSVPQPTTTSNVEAPANSGFETNSFVGMPPASTGFGEIDASNPFGDPTPFKAVLDESPALPQTHAAPAGSFQSSGPGADVNPFQPASAASFGFGDTLGDLTFASNAAPEQQDIFANTASFPSELAPANPSVVLQQPAPANFPSQPPQPVAGPLHAAPTAFAPSQAAPTSFAPSQAAPTSFAPPQAPQAAPVFAYSQAPPHPGAANHSQFPQTAAPSFPPSQVPQSVAPSLPS

SEQ ID NO: 33784 - protein, 83 aa, Sorghum bicolor
  Clone ID: SORBI-28MAY03-C36986_1.pep
QLWLHKNRVCFFGVYAAWTPCCPPEAGVDVDTTFSFYQYLLSFCKKGRIPASVRPWLVPSASLPTERARCHVVWGKRATAARD

SEQ ID NO: 33785 - protein, 173 aa, Sorghum bicolor
  Clone ID: SORBI-28MAY03-C36989_1.pep
GGWSGYIQKYRGRGPVTIKEQTTFLNMWLDKFVFCGRSAGPTSVYLSAAERLANGGQFPLGRYLLGAVYHLLHQVAQKLLLGQSIGNLGGPWWFINMWLNLHLHKRLDFNLFSQHFPRDIAENHVLGEEESATRAPLNFGEAVIVLPGSGSNPDQIGRFFETLYEGLARDASC

SEQ ID NO: 33786 - protein, 54 aa, Sorghum bicolor
  Clone ID: SORBI-28MAY03-C37282_1.pep
TLLVIKPASDGSSSGHGNRKEVDAFVSGAFDGPLRFAAKAVMKRRTYLLEMNGF

SEQ ID NO: 33787 - protein, 112 aa, Sorghum bicolor
  Clone ID: SORBI-28MAY03-C37286_1.pep
WRETLCRCETCSNFYAQRGIAYLTDKEDSIEEYERIAKQKREKKLEQQQGAATNFLNSLDHVQKIEMLSGINDLKNEFQSFLESCDTSKPITSEDIRSVFENLAKKKKQRLS

SEQ ID NO: 33788 - protein, 117 aa, Sorghum bicolor
  Clone ID: SORBI-28MAY03-C37306_1.pep
RTYESHDILESKISEATVWPAGLRFLEKFRRAVEEQHQHRHRSIKTSSRGSPGCWSSNRSSKSNTRRRPCPGSRRSWTSPERMGDPWPVRPRGSAGVREERDVAKNADGGAGAARGQ

SEQ ID NO: 33789 - protein, 111 aa, Sorghum bicolor
  Clone ID: SORBI-28MAY03-C37332_1.pep
LDKPLVVKVKLSKGGPRVSLYESCKKLQWPMPMFEFVKVEPSVCSSSGDSSQKVAPQGYAFASTITLHIPSGDIISLTGDGRADKKSSQDSAALLMLYELQRRGRFQVQEV

SEQ ID NO: 33790 - protein, 109 aa, Sorghum bicolor
  Clone ID: SORBI-28MAY03-C37337_1.pep
PEYAYTMQVTVPGNVYSYGVVLLEILTSKLPVAQVFGEGVDLVKWVHAAPARGETPEQIMDPRLSTVSFAWRRQMLAVLKVAMLCTERAPAKRPRMKKVVEMLQEAKNS

SEQ ID NO: 33791 - protein, 103 aa, Sorghum bicolor
  Clone ID: SORBI-28MAY03-C37352_1.pep
MAYKKVVLGLFTLALFLVAHYVEAVDVCTTRNWYFYGPCMSNKNCAASCIQHGIGGGGYCSPWRRCKCTLQCPWRKMTLAGIGLTHGRDKPEPLDKPSMELFN

SEQ ID NO: 33792 - protein, 123 aa, Sorghum bicolor
  Clone ID: SORBI-28MAY03-C37358_1.pep
VWRNCAEDYRNPVSIWFPRPPGGYVSLGCVAVPSFEEPPLDCAFCVDERLTEDAEYEEQIVWASSDAYPWGCYIYQVQSASLHFMALRVPKEKSEQRPKKMLESLFVQRASETPCQDKQTCRA

SEQ ID NO: 33793 - protein, 166 aa, Sorghum bicolor
  Clone ID: SORBI-28MAY03-C37086_1.pep
ARGSSSNSKQLQRGGSSLSSSSSSGGSSFRAGMQLRRLSGCYECHMVVDPVSGSTSMRATASTICPCPDCGEVFVRQESLHLHQSIRHAVSELSADDTSRNIIEIIFQSSWLKKQSPVCMVDRILKVHNTPRTLARFEEYRDAVKARAAAGGGAGQQPVAMGANNK

SEQ ID NO: 33794 - protein, 122 aa, Sorghum bicolor
  unsure (1)..(122): unsure at all Xaa locations
  Clone ID: SORBI-28MAY03-C37102_1.pep
CDTISVSKKAQCEPLSXSSPVCVSKRGEQPMFTIEQVQEMITQALQGLNEAWEKKFLSLEQKMPSISSSQTVSNGVKESSLAVGRSKRCKLARQDTLDSMDEEDPDAEDDSDYQIKEEEHSS

SEQ ID NO: 33795 - protein, 119 aa, Sorghum bicolor
  Clone ID: SORBI-28MAY03-C37106_1.pep
TAEVESALVSHPQCAEAAVVGVEHEVKGQGIYAFVTLVDGVPYSEELRKSLIMTVRNQIGAFAAPDKIHWAPGLPKTRSGKIMRRILRGIAARQLDELGDISTLAEPAVVDQLIALSDC

SEQ ID NO: 33796 - protein, 110 aa, Sorghum bicolor
  Clone ID: SORBI-28MAY03-C37114_1.pep
EERIIKRAFGKLKLEHVVIGKGQFEQERAKPNVLAEGELLALLRDEQDEEDRMIQTDISDEDFLKLMDRSDLSGPPGAADATPLIPLKGPGWEVVVPAKSGGGMLSSLAS

SEQ ID NO: 33797 - protein, 171 aa, Sorghum bicolor
  Clone ID: SORBI-28MAY03-C37421_1.pep
MSKIFAVTYKADEKNISCICGGFQFSGILCRHSLSMLKFQLVREIPQHYILDRWKKDFRQLHVKRRPPSDLVPNNRMDRYDYLSMRCLQLVDSAVLSDKYRLALRLVRETEKFLLNSNTHDDTQPRIKSRVPKVNKSNTVPGQTVVGAATGNRNDGLKGPEAPAVMQVPQI

SEQ ID NO: 33798 - protein, 117 aa, Sorghum bicolor
  unsure (1)..(117): unsure at all Xaa locations
  Clone ID: SORBI-28MAY03-C37437_1.pep
PPPRSESVLTFPRALAPPALALLPLLLPLPPRASWLFFCLFTGLLLSSSAAASAASAASSSSPSSPSTXSSSSSSSSPPPPTTXSSSSVSSPPPAGAAGGGGTGSAAPASGSPSAES

SEQ ID NO: 33799 - protein, 159 aa, Sorghum bicolor
  Clone ID: SORBI-28MAY03-C3745_1.pep
NHGTYNDCQAGDFGTMIVHTEDGDEVAESPIFPRTEFIPGLGSINSFTHDPKRAELISSFWAENTGDSDANKDRDLDDRPDIQESKAIPPLTGTVKKHIGAEGTIRRHDNQVNLSPGLANTTKLNSSPSRKAFSVQDKLWSIYAGGNTVPIPFLKAIDI

SEQ ID NO: 33800 - protein, 81 aa, Sorghum bicolor
  Clone ID: SORBI-28MAY03-C37484_1.pep
MASVKLGSKPDAFKRQGQAWFCTTGLPSDVTVEVGDMSFHLHKFPLLSKRAFLERLIEENSDQEECIVKLNEIPGGAKSFE

SEQ ID NO: 33801 - protein, 134 aa, Sorghum bicolor
  Clone ID: SORBI-28MAY03-C3749_1.pep
RVSGPPEAENPNRRGHSSSDEMLSASSRADDSSSKDARSLFSGEDGYKSRSAVSLPSNQVQAEWIEQYEPGVYITLTTLRDGTPDLKRVRFSRRRFGEHQAESWWNENRDKVYEKYNVRSSERVSSASSIRSAR

SEQ ID NO: 33802 - protein, 128 aa, Sorghum bicolor
  unsure (1)..(128): unsure at all Xaa locations
  Clone ID: SORBI-28MAY03-C37499_1.pep
TRKLLSPLLLPGPNRSPRAPVVTEPHPPPRRPAPASXAWPSSSAAPPPPPRPLVPPRRCSPPPSAAPAAAFCPVPPRSAACMWPAPRPSRSRSAPRSPSPSLAASETVRSLPRSRSLRARGVGLWSRC

SEQ ID NO: 33803 - protein, 114 aa, Sorghum bicolor
  Clone ID: SORBI-28MAY03-C3751_1.pep
GQIEALSSPYVGGSNGGGDGSKHQQHLHEASVHGERHSIFPEDPGQLLHDSAIKKRGLPDRQDENCEEAKKDLRSRGLCLVPVSCTLDVGVDVVAGPGDYWAAAAPAFGMGFGG

SEQ ID NO: 33804 - protein, 128 aa, Sorghum bicolor
  Clone ID: SORBI-28MAY03-C37539_1.pep
TRVPRSSTKHSHPAPQPESGGEEEEEGESSESEPENPVPVVQKKRPASDPAPTGKAKRAKAGEEKAVAGAEASPPPAKAKKGKAELEKPAPEASPAGKAKKGKAELEKPAPDASPAGKAKKGKAEKAG

SEQ ID NO: 33805 - protein, 155 aa, Sorghum bicolor
  Clone ID: SORBI-28MAY03-C40312_1.pep
QGKNDLSELLPRYPALGNDENVHAVYEYWTSKRSKRAAPLLRVFQGAPIRRGHLSQKSAMKRKRSFKRQKSQAGRGKPEALLLDNAEEEAALQRVAQAERAAKQAVETAIRLRNRAQSLMTNAELAAYKSIMALRIAEAARISDSSRDIVCTILD

SEQ ID NO: 33806 - protein, 174 aa, Sorghum bicolor
  unsure (1)..(174): unsure at all Xaa locations
  Clone ID: SORBI-28MAY03-C40337_1.pep
DGSIMEYDSRLYGFDIGTCLEVIEHVEEDQATLFGNVVLSSFRPTVLIVSTPNYEYNPILQGSAMPSKDDEADESXXPCKFRNHDHKFEWTRAQFQCWATGLAVKHNYSVEFSGVGGSGEEPGYASQIAVFRRXCRGTKQCAWTKVVINPYELLWEWPTACEEKEIGTDCELGV

SEQ ID NO: 33807 - protein, 124 aa, Sorghum bicolor
  Clone ID: SORBI-28MAY03-C40351_1.pep
KLNNTMGHDKTIQQARCKSYIAARLALYMGTALAKQNYTQVYEHRSHLIVSSYPPASSRCKKNVFIQLSCWWVGTHGVVIYGQQPESDLQFCAGTHFAAEADVPGLAKAHRLCAIVACWGDVCE

SEQ ID NO: 33808 - protein, 76 aa, Sorghum bicolor
  Clone ID: SORBI-28MAY03-C376_1.pep
NVCIELSITKSAIFSACRKIMNRLCSCAHKLHHQVCQTSDGSALSSTNMFSLSSLPIRKDSSTYLFKELRKTCRIE

SEQ ID NO: 33809 - protein, 181 aa, Sorghum bicolor
  unsure (1)..(181): unsure at all Xaa locations
  Clone ID: SORBI-28MAY03-C37640_1.pep
TQEKRAGGTTRNRFSSDSERFSPANARLSWGEKLRFHRPSGFGTATAARGQFILRVPPSVAERIERLMNESAAASSNPDEASLDLSFSGEGPHRPRLTPSEPAPAPRLPRPARPVAYRASGVPGRGITALVALMRMAXGGYAPAPGGLPALHGLTPPGGGPRRPRVRPVPALHAELVCRAQ

SEQ ID NO: 33810 - protein, 152 aa, Sorghum bicolor
  Clone ID: SORBI-28MAY03-C37651_1.pep
HMGYVWLGRAPGGLPRRQGWPGQAPGLAPAPRPRRLLLLCGGPDGAGCRWATDALAWCCRAPPCRLAPCPTALPALPGAGSLASCAAPPGSASMTVVSRPATALLLLGGLSSAPGPWAWPRCRRWGRGGGWCGPASVGLWGTVLVKPNCYVS

SEQ ID NO: 33811 - protein, 193 aa, Sorghum bicolor
  unsure (1)..(193): unsure at all Xaa locations
  Clone ID: SORBI-28MAY03-C37653_1.pep
TTPRPPPPPAPPPPAPLPLPPLPRRPPPALARPLALAPPPQAPPRRSTRMAAAFLAAWPRLLRLRVGAPGGCCLGPCPAAPPGSCRCAAPAGPPGACRXRRGAPPPPPPPPPPAPAPPPAPPGRGAEPAGALRAFSRPSALDCVPLPVPGPSFAFRALKNDWKMDCFPLADYSECKVICADQSGRGFVFDLDS

SEQ ID NO: 33812 - protein, 166 aa, Sorghum bicolor
  Clone ID: SORBI-28MAY03-C37661_1.pep
HEGSNAPGASSTVALPTTPPRKLQGKVAMITGGASGIGERTVRLFVEHGARVVVADIQDEAGARVCADVGAGAASYFHCDVTSEDDVAAAVDHAVATFGALDIMFNNAGVSGPACYSVRDSGKADFERVLAVNLVGPFLGTKHAARVMVPARRGGCIIGTSSVAAA

SEQ ID NO: 33813 - protein, 208 aa, Sorghum bicolor
  Clone ID: SORBI-28MAY03-C37681_1.pep
ARGKEKEKVEEEAKLKVTAVVKVEGTEKEVKVTRPPAGASAATPILAVPVVAVPCFIAPPGFAGQFAMTHQAALASVTAQAQMHLQSPTSSACSEVPSSPFYMTPRSLVPLQQSPSVTEGNICKPIADKSFSSDSKSHHVVVNMVADGFNWRKYGQKQVKSSDNSRSYYRCTNSGCLAKKKVEHFPDGRVVEIIYRGAHNHEPPQKTR

SEQ ID NO: 33814 - protein, 68 aa, Sorghum bicolor
  Clone ID: SORBI-28MAY03-C37788_1.pep
ESTCRSSATWPEEILPSRSIRAILDESQYKFLRNCFQTTPNSWGQVIVTAGWDGKIRSFQNYGLPAHQ

SEQ ID NO: 33815 - protein, 84 aa, Sorghum bicolor
  Clone ID: SORBI-28MAY03-C37361_1.pep
AVIMGSKGFGAARRTSKGRLASVSDYCVHHCVCPVVVVRFPDDGSAEAGEAGGFSAAVGAEDVLHPVLEEEAEYHDAAEEHKDT

SEQ ID NO: 33816 - protein, 211 aa, Sorghum bicolor
  Clone ID: SORBI-28MAY03-C37387_1.pep
EALVKAQDDLRETTGHLGMTLIKLAKFEREQATCNSLRRRAGEIHSFANSVLKMSRSQIKLNSEIVKHLGSIHEYLEMMISVHHAFTDRSNALHYVQSLSADLFSLHTRAGRLESSSARDMGHEWSTYQKVEGLKETIRSAEAAKSDALREYESIKENNKIEIKRFDKERRHDLIEMLKGFVVTQVSYSDHFANMWTKVTEETEVYANRSN

SEQ ID NO: 33817 - protein, 126 aa, Sorghum bicolor
  Clone ID: SORBI-28MAY03-C37418_1.pep
SIGIDKLASSSSTLSCLTGSRSCSSSLTALTTGGTPALSISWSTGRDELASTRSSECSCSCLNDSVAKEAFPVLDSEIFSSSRTDLGESALAATAAARAPSAFTPFGTATTIPPTMGRQPDQALAT

SEQ ID NO: 33818 - protein, 137 aa, Sorghum bicolor
  unsure (1)..(137): unsure at all Xaa locations
  Clone ID: SORBI-28MAY03-C4172_1.pep
RPPTRPPTLPPTRALLVPFFCRGKFGVGADTHAMHYLNAAFLLIDTVLNNMPLAXYRMGFSVFWSCAYVTFHGVLHASGDLTWGPDPFFNLSXCRAPLXYLGMAIAHIPGFFLYWFIVKAKHTYFPRMFPHAYVRTI

SEQ ID NO: 33819 - protein, 107 aa, Sorghum bicolor
  Clone ID: SORBI-28MAY03-C37840_1.pep
AATDQTEEIADKEMVTDLDKNHVSLKVLLVDKNVEPKEKEKKASTKDRVLSFRRRVSKDNVSPVKPGSPKDGSGQQDWNSPARLPVEKKPKGRKQQWVPFICCSSVQ

SEQ ID NO: 33820 - protein, 191 aa, Sorghum bicolor
  Clone ID: SORBI-28MAY03-C37889_1.pep
PIFKCVPDSTGMPFLSLATLQGILKFLCSKLQEQAEGCSLLHNQLLSIPIGTWSPHTGRSSSRQLRTLLLSSPLNTCLDFLLQDRVSSIPIVDDNGSLRDVYSLSDIMALAKNDVYARIELEQVTVQNALDVQYQVHGRRQCHTCLQTSTLLEVLEGLSVPGVRRLVVIEQSTRFVEGIISLRDIFTFLLG

SEQ ID NO: 33821 - protein, 104 aa, Sorghum bicolor
  unsure (1)..(104): unsure at all Xaa locations
  Clone ID: SORBI-28MAY03-C3789_1.pep
QLDGIRNRIXSVREYIDDTEDYVYIQLDTQRNELYQLQLTLTIVSFGIAANTYIAGAFAMNIPTSLYNTDGSLFWPFVGGTSSACFVITVLLFWYAWWKKLLGP

SEQ ID NO: 33822 - protein, 116 aa, Sorghum bicolor
  Clone ID: SORBI-28MAY03-C37920_1.pep
GGFSSGEETMYSAETRESRNIPSPKEKKAEVVGRSQSFVNHNKWDSPKSVESSRGFPSKSQTFIPLRKPHLQAAAISQKSQDYFSPTVSSNMKKRNLSQTPMKPRQRSQVTSKWIT

SEQ ID NO: 33823 - protein, 231 aa, Sorghum bicolor
  Clone ID: SORBI-28MAY03-C37926_1.pep
HEEEQEKGRLTPIVEALSNAYFGPDYSQPKDTVDISLKDIDQLAKSSFPLCMRHMLDKLRENHHLKHGGRMQFGLFLKGAGLKLEDALAFWRAEFSQKVGSERFDKEYAYTIRHNYGKEGKRTDYTPYSCQKIISATPGVGDHHGCPFRHFGEENLRAALNKMGVGGHALEEIMDKVKNRHYQLACTLTFETTHGVSCDSGINHPNQYFSESQKILRAKNQTMESQSQSAT

SEQ ID NO: 33824 - protein, 249 aa, Sorghum bicolor
  unsure (1)..(249): unsure at all Xaa locations
  Clone ID: SORBI-28MAY03-C37946_1.pep
MPVGSRRRPPPSHHRRAMTPASVSAPAPAPTKPLYLRGPVIAGAAALAAFLLLAAAYATRRAGSPPTALLAHPAVATRFFSFDLVREYPHDPDAFTQGLLYAENDTLFESTGLYHRSSVRKVDLQTGKVLVNHQMDGQMFGEGLTLLGHRLFQVTWLKNDGFIYDQHNFSKRTSFTRSIPAGSGSAPGGXVLSGSDGTSMLYKLDPKSLEVMKVVTVKYHGDEVPYLNELEYIDGEVWANVGQVRCSSS

SEQ ID NO: 33825 - protein, 164 aa, Sorghum bicolor
  Clone ID: SORBI-28MAY03-C37968_1.pep
NLSQFIGSLLDIENISLLGHAFECAAHGILPGKLSRLLNRLTEITLELDLGNLKEANAAHCLFQIAPNLRRMELQLMHRGYSAPTSNFWDSIDHQDCLFKNLYTVVMNNFTGSCAESGFLELLLKDAPVLRSARIEDNNKLDKESLKRILKMRRASKDAEIILL

SEQ ID NO: 33826 - protein, 312 aa, Sorghum bicolor
  Clone ID: SORBI-28MAY03-C37521_1.pep
VIAFTNSRFNKDISLNAIGFLRFCAAKLAEGDIGSSRLKDNPSNSNPPSPRLTNDGKQEGTVLVDKEDHIHFWFPLLAGLSELTFDLRPEIRKSALQVLFDTLRNHGHLFSLPLWEKVFDSVLFPIFDYVRHAIDPSGSSPQGQARGNDPAGLDQDAWLYETCTLALQLVVDLFVKFYDTVNPLLKKVLLLLTSFIKRPHQSLAGIGIAAFVRLMSSAGSMFVDEKWLEVVLSLKEAATETLPDFTYVSSGAYLENAPTENGVSADNREDESQPLADDNEESSRSRNLYFAIGDAKCRAAVQLLLIQAVMEV

SEQ ID NO: 33827 - protein, 137 aa, Sorghum bicolor
  unsure (1)..(137): unsure at all Xaa locations
  Clone ID: SORBI-28MAY03-C37518_1.pep
HEENAKQIRCARLLKAHRAAGCLASLASTAVALGGAARRRVAAGRTDAEAGVVAATGESPVVRSRFYAFIKAFLVVSLLLLAVEVAAYFSGWXDLAASALAIPVIGLESLYASWLRFRATYVAPGIQFLTDACVVLF

SEQ ID NO: 33828 - protein, 208 aa, Sorghum bicolor
  Clone ID: SORBI-28MAY03-C37599_1.pep
YLARVNWMHNSALAVQVLNRSHTKLKLLKFDITTGKREVLLEEQHDVWITLHDCFTPLDKGARGKHPGGFIWASEKTGFRHLYVHGNDGACLGPLTQGDWMVEHIAGVNESNGLIYFTGTLDGPLETNLYHTNLFPDWSLPLQTPKRLTRGTGRHSVILDHQLLKFIDVYDTIKSPPVILLCSLLDGSVIMPLFEQPLTVPPLKKFQQ

SEQ ID NO: 33829 - protein, 66 aa, Sorghum bicolor
  Clone ID: SORBI-28MAY03-C38173_1.pep
MVLQRFSWPYGGRRASFCGSFTGWRECPMGLVGAEFQVVFDLPPGVYQYRVLVDGGWRCDEAKPFV

SEQ ID NO: 33830 - protein, 155 aa, Sorghum bicolor
  Clone ID: SORBI-28MAY03-C38201_1.pep
PGEGGDTSPFLNGDFGEFGYVAPEYASNPVGTMKGDAYAFGVILFELVSGQQAAAVVTDVTGEGFKGPLVDWVNQLKASGRISDVVDKPLRGKGHEAEIEEFLKIAFACTQPCVRERHSMYRVFHALKSIGEGRDVTEQFDEFPLAYNKDDSDTM

SEQ ID NO: 33831 - protein, 288 aa, Sorghum bicolor
  Clone ID: SORBI-28MAY03-C38208_1.pep
ARGTYGRDPFWFAVHRRSTRQPLFNTSAGVLVFKDQYLEVSTALPKDAALYGLGENTQPGGIRLRPNDPYTIYTTDISAINLNTDLYGSHPVYMDLRSLGGRGVAHAVLLLNSNGMDVFYRGTSLTYKVIGGLLDFYFFAGPTPLAIVDQYTSMIGRPAPMPYWAFGFHQCRWGYKNLSVVEGVVEGYRNAQIPLDVIWNDDDHMDAAKDFTLDPVNYPRPKLLAFLDKIHAQGMKYIVLIDPGIAVNSSYGVYQRGMERDIFIKLDGEPYLAQVWPGPVYFPDFLNP

SEQ ID NO: 33832 - protein, 175 aa, Sorghum bicolor
  Clone ID: SORBI-28MAY03-C38233_1.pep
SLPRPLPLLRPGHGPSSASRACTRLASPISTDRGRPLLCPLRFCRLSSRAGAPFACAGADPPLLQGLLLSILLLVAHTGIRCCAVYPQARSNAPVPRAAAGPWNWDPRVAVLAVAVCRTQGGVVLRIQKPVERFVGGRMILEVMALMEGLDASMGLGIHSVTAVTGSACSTTMWT

SEQ ID NO: 33833 - protein, 68 aa, Sorghum bicolor
  unsure (1)..(68): unsure at all Xaa locations
  Clone ID: SORBI-28MAY03-C38232_1.pep
KRNRGSFSENKINKVVERETSRWISKSHVEPTTSHYDICNQESRCPTHTQKKKKTNNKKQKRQINRXL

SEQ ID NO: 33834 - protein, 328 aa, Sorghum bicolor
  Clone ID: SORBI-28MAY03-C38256_1.pep
NLSLAGSGAAVPRPHRDFSFGPRSGSPAHHRAGWSVHRGRSFRRLPPPAPVNRARSQSSYALEAPTIFCPVLPCGFSTAAPDTTAAKEGRERRGRNQLACAGARTRSGAAEPEPQTPGEVLAIEVCPLERGGSQKKRHKSVANVDIISNLPDVIKDKILCCLPIKEAIRACLLSRKWRYTWASMTELMFREDDFALGNGNEDGDSVRFASFVHTFLSLHYGPILKFEMNARRVHTFSPGGHIHRWMLILSRNGIKEIQIKTRIWRNYKIPSSFFSCAELEYACLQGCIFQLPSLFTGFKRMHTLHFIEFCATENNIGELVANCPNLEE

SEQ ID NO: 33835 - protein, 155 aa, Sorghum bicolor
  Clone ID: SORBI-28MAY03-C38319_1.pep
PFPDAEGHPPRTVGGHRGPRQERAHAVAERPAWWRRHRLAGGRERPQVQRARPRRHPHALRRPPGDHRHERRRRDPVGRFPSLGAARGERGCAECGGGKGSDPRGFQRTDPRRPFESGEGARAGRIWAGGGREIFGWERISRGRAAGFRAIWPRA

SEQ ID NO: 33836 - protein, 92 aa, Sorghum bicolor
  Clone ID: SORBI-28MAY03-C37790_1.pep
WLRDQLILKNKSVYYASMMLNLVLRLAWAQSVMKLHLGMVESRLLDFSLASLEIIRRGHWNFYRLENEHLTNAGKFRAVKTVPLPFRELETD

SEQ ID NO: 33837 - protein, 182 aa, Sorghum bicolor
  Clone ID: SORBI-28MAY03-C37809_1.pep
CNGVARFDFEYLCGRPVGAADYIAIARSYHTIFISDIPAMSMKIRDKARRFITLIDELYNHHCRLICLAASSIDDLFQGTEEGPLFDLESFQFETESEGTKLRRDVLAGGNVGLGPSTTGLVAILSGQEEMFAFRRAISRLIEMQTPLYLERVQDVHPSFRLQCPPGLASNRTAVPQPAPAV

SEQ ID NO: 33838 - protein, 99 aa, Sorghum bicolor
  Clone ID: SORBI-28MAY03-C37816_1.pep
LVLSFYPLYLHDTDHKKPDPFPCRTFLSCPENLTGAVKPPPCDCSSFSSFTRNKMDGGIGMIEGLIFRGQAPWSFCAGSCVLVALIRLRHLSLRSTEVR

SEQ ID NO: 33839 - protein, 274 aa, Sorghum bicolor
  Clone ID: SORBI-28MAY03-C38330_1.pep
ARGRSGGALAWQQYRALLRKNATLTWRNRRSAALQLFSSLVFIFLIFCIDRAVRSRFSSTTGYRNVPDPEPLVAPPIPPGEDKFFIKSPCYDFLWSDGGSNRIRGILDAIRKNNPGRPIPPEKVLGFRTPDDVDAWLFQNPMRCPGALHFQDINPTQIKYGIQTNSTPVARRGTYEDPTFKFQIPLQVAAEREMARLLIGDPNFSWTVGFKEFAHPATETFSTIAQAGPTFFLAIAMFGFVFQISALVSEKELKLRQAMSTMGLYESAYWLSWF

SEQ ID NO: 33840 - protein, 152 aa, Sorghum bicolor
  Clone ID: SORBI-28MAY03-C38353_1.pep
MEGDAAGADGGGGGGGERSSFVIGLIENRAKEVGVAAFDLRAASLHLSQYIETGCSYHNTRTLLHFYDPMVVIVPPNKTAADGMVGVSELIDKHYPANKKVTMARGCFDDTKGAGIVKSLSARDPSALGLDTYCKQYYLCLAAVTATIKWIE

SEQ ID NO: 33841 - protein, 173 aa, Sorghum bicolor
  Clone ID: SORBI-28MAY03-C38356_1.pep
MAGGVVVNAGGGKDYPGKLTMFVLFACIVAATGGLIFGYDIGISGGVTSMNPFLMKFFPSVYHKEQEAERNQSNQYCKFDSQLLTMFTSSLYLAALVASFVAATVTRVAGRKWSMFGGGVTFLVGAALNGAAKDVVMLILGRVLLGIGVGFANQSVPVYLSEMAPARLRGMLN

SEQ ID NO: 33842 - protein, 94 aa, Sorghum bicolor
  Clone ID: SORBI-28MAY03-C38362_1.pep
DLNRAFTTIISPSDTDTVPQVAKQFKEKLRPCCESCDPNGYCGQVDKDGGAQYSVCSNPEKHFFWDDVHPTQAGWEAVMEQLERDIKDFLHISY

SEQ ID NO: 33843 - protein, 87 aa, Sorghum bicolor
  Clone ID: SORBI-28MAY03-C38381_1.pep
SESFHNNESSGSSEAWKRRRRADLDNQFDTQPLYQPPVMTNGNRLQESSSSAGILGWGPVEMRRYGNERPKRGVHPSHFSTGHGPLL

SEQ ID NO: 33844 - protein, 127 aa, Sorghum bicolor
  Clone ID: SORBI-28MAY03-C38393_1.pep
ANGTVRVQGRCAGGERRVGIYRMERGVDKWTVNCSCGAKDDDGERMLSCDSCHVWQHTRCAGISDFDQVPKRYVCNSCKLLHKHKSSGPRPVYNSGPSKRCKIGTGAFSPCRWGIFEASHWLTCKYQ

SEQ ID NO: 33845 - protein, 148 aa, Sorghum bicolor
  unsure (1)..(148): unsure at all Xaa locations
  Clone ID: SORBI-28MAY03-C38455_1.pep
MGTGRVALLLLLSAALMQALLPAPAEGLVRIPLKKRPADKNGRLQFHDERRRGFLGSNAAAASEKAEAEAEGDIVALKNYLNAQYYGEVGIGTPLQKFTVIFDTGSSXNLWVPSSKCYFSIACYFHARYKASQSNTYKKNGKSASIHY

SEQ ID NO: 33846 - protein, 160 aa, Sorghum bicolor
  Clone ID: SORBI-28MAY03-C37972_1.pep
ARGPLLLVPQAPAGQEQRRAADDHRRRERGADAGAGDRAGTQHGGHPVGEPHPHRGRAQDRGGGAAAQGGRRGRRDPQDGRRQPGRRHAGGHRDRPRRRHGVTRRQSPATTMHRTLLASSDDGRRRTTVVVGGWQRRAAYIADYCCMQASSSSPPIVSPR

SEQ ID NO: 33847 - protein, 126 aa, Sorghum bicolor
  Clone ID: SORBI-28MAY03-C38007_1.pep
LSEQERHAVDLQDVLLRFAFDNICAAAFGVEAGCLADGLPDVPVARAFERATELSLTRFYTPPLAWKPKRLLGVGTERALVDATRAVREFADRTVADRRAELRKVGDLAGRCDLLSRLMSSSPPPH

SEQ ID NO: 33848 - protein, 259 aa, Sorghum bicolor
  Clone ID: SORBI-28MAY03-C38090_1.pep
MILRRLHVRVSRLSLASAALLDVAPRALPSAGLFRARGLHGAAGDDGASSEHGRKPAGPLTLYRNLVSQGKLTHDARRENVASELDNLLSRLQQYEMEMEDYHNKLYIWENSREKERRKLLVQEAEDKQRDGVWIDEKRGFLDKLVTRRRRGNIEPGVGKWVSYLNREKKLDTLVGHRPVAPVAPKGLYLYGNVGSGKTMLMDMFYGATEGVIKHRRRFHFHEAMLEIHDHMHDVWKRRDDDKSIHSSAFNWISSLPFD

SEQ ID NO: 33849 - protein, 219 aa, Sorghum bicolor
  Clone ID: SORBI-28MAY03-C38155_1.pep
MELPPPRPPRRRGVLSACGFGRACLLPVLGDSIKGKLVEAIQDGDVRRLKGLVSSMKKNTRAKLAKMNIDRHGLLQLAVFLGKLEVCRYFVEDLSFDVDCSGLCNGATPLGCASLFGEVACARFLLDHGADPNKMDETGSVALHNAAKNGNGELMRLLLSRGARVDIAIPQGTPLHIAASYGNIDAVKILLDHHADPDIISEVSGSPLVSALQSTKLVN

SEQ ID NO: 33850 - protein, 147 aa, Sorghum bicolor
  Clone ID: SORBI-28MAY03-C38542_1.pep
KYHVYPDQWVGFYRPLWLISSVINSLYSFYWDIKRDWDLSILTRIFMFKNPSIWTNLLYGQNWVFYWVLGSNLVLRCTWTYKLSAHLRHNYLTVFTIAALEILRRWQWVFFRVENEWNKMTAKQNLEMSSDMPSEADRLLDSSNHTV

SEQ ID NO: 33851 - protein, 124 aa, Sorghum bicolor
  unsure (1)..(124): unsure at all Xaa locations
  Clone ID: SORBI-28MAY03-C38607_1.pep
MAEHLASIFGTEKDRVNCPFYFKIGACRHGDRCSRLHNRPTISPTLVLVNMYQRPDMITPGVDAQXFREEDQAAAAHTALQGRFYSGRPIVVDFSPVTDFREATCRQYEENSCNRGGYCNFMHV

SEQ ID NO: 33852 - protein, 119 aa, Sorghum bicolor
  Clone ID: SORBI-28MAY03-C38639_1.pep
MQTQTQTTTTTQMTMTRRPAADQVVVQQEAAAKATEDMKSRQQVVDAGFDAGKPPPFRIGDVRAAVPEHCWRKSPWRSLWYVARDVAVVAALGAAAAAMDSWAVWPLYWAAQGTMFWAL

SEQ ID NO: 33853 - protein, 195 aa, Sorghum bicolor
  unsure (1)..(195): unsure at all Xaa locations
  Clone ID: SORBI-28MAY03-C38647_1.pep
HEADSPLGGPAAALRGRCLGPRDAGGPAPLLGGSCDFSESAXPGPSGPALGRPSSPFPLPGLLLPLACLADLPLLAHHFVLPSACLDGVVVLAPLAASTAVSSASVGLLSPFARLFTRVCNARSLALCLAARGGFAPWVARRPMHAPPGTATGTPASVRGFRMAVITSLKQFNPNDDDALSMVYKHFDMKHEAAS

SEQ ID NO: 33854 - protein, 188 aa, Sorghum bicolor
  Clone ID: SORBI-28MAY03-C38744_1.pep
FIVEPYIFDDGSDAATHSDQYNVFSGQVITAVKEACRAAVLQNKPRLVEAMYFCELTTPTEQLGATYAVLGKRRARVLKEEMQEGTSLFTVHAYLPVAESIGFSNQLRSLTAGAVSALLVLSHWEAIPEDPFFVPKTQDELEEFGDGSSIGPNLAKKLMNSVRRRKGLHVEEKVVEHGTKQRTLAKKV

SEQ ID NO: 33855 - protein, 164 aa, Sorghum bicolor
  Clone ID: SORBI-28MAY03-C38673_1.pep
KSKIYRDPPLASIFLMNNGKYIIHKVNDSELGVLLGDEWMKQMMSRVRRWSMEYQRGAWAKVISVLQTGGPGVGSITVKSMLQKMQMFNSYLEEICTVQSDWVIADEQLRADVKSAIVDSVMPAYRGLIGRLRSSPEAARDLFIKYTPEDVQARIQHLFEGVAK

SEQ ID NO: 33856 - protein, 132 aa, Sorghum bicolor
  Clone ID: SORBI-28MAY03-C38745_1.pep
MACRGFFECVLKLLNLVVMAVGLAMVGYGAYLLVMWLQVAPPLPPPAPSPAPSGGDLVRLGRPLLLLVDASLSDSDGTAERLSSAWFIFAFIGVGAILFITSIFGCAGARNGCCLSIYSFLIILFILVELGA

SEQ ID NO: 33857 - protein, 98 aa, Sorghum bicolor
  Clone ID: SORBI-28MAY03-C38325_1.pep
PARRRFPPPPRAPAPEAPPQWSPSTRPPRRRRRGPRHRPASPARSVRASGRHGGTARVRRTGGEGGGDHSRLKLAGGLRWRWPSRARVFGARRRRWCL

SEQ ID NO: 33858 - protein, 201 aa, Sorghum bicolor
  Clone ID: SORBI-28MAY03-C38326_1.pep
SPPLVGFSGITWLHHHSPRKQPTTFHCQRIPEKVDDAVPSPDVSSAITVSVKSPAACTSGATNSQKRSINTKCCQFPGCEKGARGASGYCISHGGGRRCQKPGCQKGAEGRTIYCKAHGGGRRCQYLGCTKSAEGRTDHCIAHGGGRRCSQEGCSRAARGKSGLCIKHGGGKRCQRENCKRSAEGYSGLCISHGGGRRCQF

SEQ ID NO: 33859 - protein, 132 aa, Sorghum bicolor
  Clone ID: SORBI-28MAY03-C38331_1.pep
MGLGLGALLKSGALSVSDYDAIVSINIFIALLCSCIVIGHLLEGNRWVNESITALVMGLITGGVILLVTNGTNSRILVFSEDLFFIYLLPPIIFNAGFQVKKKQFFRNFITIILFGAVGTLISFVIISLGAM

SEQ ID NO: 33860 - protein, 214 aa, Sorghum bicolor
  Clone ID: SORBI-28MAY03-C38795_1.pep
MMSPNKLAVLTVFALLGSVSCQDGGYYPPPPAPPAPPPPACPPPPPSPSPPPPTPAPPPPPGTQLMVGYYKNKCGAYVDVEAIVKKHVNATDAGMQAGLVRMFFHDCFIRGCDASVLLDSFSNDTSLTPEKFSVPNFPSLRGYEVIDAAKAEIEAACPSVVSCADIVAFAARDASYFLSGGGINFAMPAGRYDGNVSLASEALPNLPPPFAGFD

SEQ ID NO: 33861 - protein, 109 aa, Sorghum bicolor
  Clone ID: SORBI-28MAY03-C38796_1.pep
MAASVVMHRSSSDGGSSSGWSDAAAAVAAAAEERAGWEVRPSGMVVQARDDVAAGPGGAPPRPPPPEIKVRVKYGGARHEVSVSPIATFGQLKKLLAPRTGLQPADQQL

SEQ ID NO: 33862 - protein, 106 aa, Sorghum bicolor
  Clone ID: SORBI-28MAY03-C38797_1.pep
MVAAAFTVDLDKPLVFQVGHLEEQYQEWVHQPIVSKEGPRFFENDILEFLTRTKWWAVPLIWLPVVCWCLSTSIQMGNTITDVAMMTVFGIFLWTLIEYVVHRFLF

SEQ ID NO: 33863 - protein, 272 aa, Sorghum bicolor
  Clone ID: SORBI-28MAY03-C38826_1.pep
ARGKNTVAEFATRGFRSLGVARKRGEGAWEILGIMPCSDPPRHDTARTINEAKRLGLSIKMLTGDAVGIARETSRPRGLGTNVYNAERLGLGGGGDMPGSEVYDFVEAADGFAEVFPQHKYNVVEILQQRGYLVAMTGDGVNDAPSLKNADTGIAVEGASDAARSASDIVFLAPGLGAIIDALKTSRQIFHRMYAYVVYRIALSLHMEIFLGLWIAILNRSLNIELVVFIAIFADIATLAIAYDNAPFSQTPVKWNLPKLWGMSVLLGVVLA

SEQ ID NO: 33864 - protein, 113 aa, Sorghum bicolor
  Clone ID: SORBI-28MAY03-C38829_1.pep
KENWRIAKWVALGAVVFEALLFTVAIIVQSGNQADYDSDDEYIGARSGIRQPLVNQQAAATDPRVPNLDYRPIRNDAWSQRMREKYGVDSFDPNRFQQATISPGEQRNRCTIL

SEQ ID NO: 33865 - protein, 95 aa, Sorghum bicolor
  unsure (1)..(95): unsure at all Xaa locations
  Clone ID: SORBI-28MAY03-C38840_1.pep
ANLCIRRDPHSRPRMSHVLRILEGGMVVESGSVTGSSSDSGSRSWRMLNEQQHYQEHSSSPAQQESQRAGEGKPSYSALRAXWDRDKQKSISNRY

SEQ ID NO: 33866 - protein, 207 aa, Sorghum bicolor
  Clone ID: SORBI-28MAY03-C38845_1.pep
FDLPELPPGYLSQTGDQCIENKNNRKAQCRDSHFGNRSNNNKRPRYERGGFQSKRSNVWNRTPCADDAMAKSREPTLLQKLLSSDIKRDRHRLLHVFKFMTLNNFFKDWPDKPLQFPSVKVNQIEIRSTIGTDDLDNAEMANDSILGVNENGDCKELSSIDEEDTDSANHNDEDVDGVSADSSIEDGAEEEDAYQEQFNEPEDDTAV

SEQ ID NO: 33867 - protein, 216 aa, Sorghum bicolor
  Clone ID: SORBI-28MAY03-C38467_1.pep
RPWMQISSKLKNQHAMRPHNNKYADSRTAPTQSRSKRGGGSTGGSKKKTSRPRVYQTSTDHSLAWDCRWPRPISSRERNEKCGPAQCSIERDESESERKGFVHEPICHLATGYDAKDGTKQTEIQNRYRFSLRPQRNRDGTSKMQPSGSLKGDSFLSLIFEIIGTHIQTKKKKAMSYGKKSRRIGKKKRSVEIWAMAAATAPWPERAGTGRASPRA

SEQ ID NO: 33868 - protein, 93 aa, Sorghum bicolor
  Clone ID: SORBI-28MAY03-C38468_1.pep
FQLVPLPPLRLYETDRPLARRPHRQGGAGGEMKGATIPSVAIMPSPLFLWRFKVVLFLLWGLCCCKISWDSVMRMSVDLRDLFLYEAFLYYNP

SEQ ID NO: 33869 - protein, 322 aa, Sorghum bicolor
  Clone ID: SORBI-28MAY03-C38497_1.pep
TRLSQVASAHYFFEVATVNGKDSAPFQYIRDFTRATKYNPIKFSSNPSADIRDNSFADGEDIICNQGATGNGASTEVADVKAGDVITFKLGVGGKMGHPGPTLAYMSDAGGDVKSYKGDGEWFKIMEEGVCNAGGDFTKDAWCNYDSPSADVKIPEGTPSGEYLLRVEHIGIHRSHVNQPEHYVSCMQVKVAGGSGKVDAEMVKFPGAYKATDDYANFSIYNGAKDFPMPGPKVWGGNTSAGGAAPAGDNNAAPSGDAPAQTPAPDAGNGQQGEAPQQGAPQQGGEQQQNNGQQGGFPGQQGQQGGFPGAQAANNGNSPCSA

SEQ ID NO: 33870 - protein, 263 aa, Sorghum bicolor
  Clone ID: SORBI-28MAY03-C389_1.pep
EKISCTFAFEKPPDKREERVINLERTESEIFAAAPTTPPPAPPPPPSPPAPPPTPTPPPPPPRPPSPPPVEKVTVNPIVRSEKRVSTPPRTGPSTSATYFSVASLQQYTNSFQEQNLIRESRLGKVYLAELPGGKLLEVMKIDNANGRIPVDDFLELVARISDIRHPNILELVGYCAEYEQRLLVYNHFSRKTLHDVLHEGEDLDEPLSWNARLQIALHAAKALEYLHDTCEPPVVHQNFEPSNVLLDNRCSVRVAECGLAEL

SEQ ID NO: 33871 - protein, 111 aa, Sorghum bicolor
  Clone ID: SORBI-28MAY03-C38900_1.pep
VPPPDSIQIETRKEHRITFLEQPPPSHHQRSRGSSSQGASGESRGGGGEPGVPEVSHLRRCSLPPRACSPSACSVAPTACPGAAPPRPPPRLLLVTTSPSPELLVEAMYVF

SEQ ID NO: 33872 - protein, 72 aa, Sorghum bicolor
  Clone ID: SORBI-28MAY03-C38880_1.pep
LFGGGLLGYVIYDCTHYYVHHGRPSSDPAKYLKKCHLNHRFRIQTKGFGITSTLWDHVFGTLPSTKTVDKTV

SEQ ID NO: 33873 - protein, 188 aa, Sorghum bicolor
  Clone ID: SORBI-28MAY03-C38922_1.pep
ARGLGARASAKDLLGHASFGKPASTAKNPGSGESTSGYDDDPVVAVSRILEDVERGDQSIDDLDHLALTGVGYALAPADEVQFRRILVCLLRICGRTGNLATGVRVLKLMEWLVMGFVESRKMRKVQVLFELISPEKCEAEGYVLFPVVMAACGGLRALRVASARYRLDFDPQLKQAPEWTIQFASEQ

SEQ ID NO: 33874 - protein, 165 aa, Sorghum bicolor
  Clone ID: SORBI-28MAY03-C38940_1.pep
ARGEFYGEWIGLVAEFTTRSLLSWQWASNSVYYLLSLWSRLVTSVPYLKGETPSLLDKTVPKITEGFITSRINSVRASLADNSLENPLDSVEVLQDQLEFLPFLCRFQYQSSSLYIINIMEPLLQAYTERSRLPAPGDADELSVIEGQIAWMVHIIAAIVKVRQV

SEQ ID NO: 33875 - protein, 190 aa, Sorghum bicolor
  Clone ID: SORBI-28MAY03-C38929_1.pep
MSSPSVPSLRLPLRPASPPLSRRYLAGGSPNAAAPRAALLKPLASKAPASYHQPALLLHQRRRHGPPPAAATTTSKPVLKDPKKYQEWDSVTAKFAGAANIPFLLLQLPQIVLNARNLLAGNKTALFAVPWLGMLTGLLGNLSLLSYFAKKRETEAVIVQTLGVISTYAVLVQLAMAESMPVPQFVATSV

SEQ ID NO: 33876 - protein, 166 aa, Sorghum bicolor
  Clone ID: SORBI-28MAY03-C38947_1.pep
PCLIFRRHHVTSNHTDSMPSGASSARRRRLLPSGALGRPQPGAALAFHTSDRPEPPTPRSRASGRRSRARRRLQHGLGLGAVASHSMKGTGRGTMEMTQGHSRRNATPWRTYGSPAAARTVGDAGSAPAGGVPCPQRNRGEEGGGRRRGRRLRGFSAAAAAAGTGT

SEQ ID NO: 33877 - protein, 175 aa, Sorghum bicolor
  Clone ID: SORBI-28MAY03-C38952_1.pep
TRLPPIGQLEHLRKLKLYELPSIKDVRSDVYGTSNVVFRSLEELSFGSMVKWENWADAENRQFFPNLQKLQINRCYNLRELPYMVMGLAIKELSLSRCGSYSSKVSSYLCRLTCLTHLKVNDCSQKLILPCQNLVSLEYLHLSNCKELCFEGGIFCMNNLKALHISSCHIITLSL

SEQ ID NO: 33878 - protein, 133 aa, Sorghum bicolor
  Clone ID: SORBI-28MAY03-C38747_1.pep
MPTTPRSRSQARTTRPWILSGMDFADSRRKPNFTGKIAVAAALTVMCIIVLKQSPSFSGTSVFSRRETGVTHVLRTGGAGYIGSHATLRLLSDNYRVTIVDNLSRGNMGAVRVLQRLFPEPGRLQFIYADLGD

SEQ ID NO: 33879 - protein, 215 aa, Sorghum bicolor
  Clone ID: SORBI-28MAY03-C38790_1.pep
TRKSNASTEPNILPSITASKTSQSPLSVKTTGESGDLPTLTMKNRQDSQSMKSLGNIKGPGASLQNKGGIFRDLGKSSFTSEHSKPAVLHEKTGQLSGVGDAVQNTVKDTPKMAPQPSAFSSAPVTQTDSYSLRSTVYSSATSASSGAKTSEVLSSSVQKVSPIVARGTVSSSIPTPAKDSSTGLSQNASKPEMLISEVTSTILSASSTSVISTT

SEQ ID NO: 33880 - protein, 212 aa, Sorghum bicolor
  Clone ID: SORBI-28MAY03-C38792_1.pep
MTPETGGHASAEEEPPPRPKGILERMHKYLLLLAILAATVTYNAGLSPPGGVWADDADGHLAGDPVLQAHYAARYNVFFYCNATAFVASLVIIMLLLSSTFSFHGYRVRALQAAMVLDLLGLMGAFTAGSCRKVRTSAYIVALACACVAYLVAHLLLHFWVRSSRCPSTRREVTELLNLHRLCPCCCCCCGRSDDGGAAAQDAPRGTTRARV

SEQ ID NO: 33881 - protein, 114 aa, Sorghum bicolor
  Clone ID: SORBI-28MAY03-C39003_1.pep
MQPMQHQQPQPQQMQSMQHQQQMQHQQQQQQQMQPMQQQQQMQHMQHQQQQMQQMQQQQQQMQQMQPQQQQQPQMVGTGMGQQFMQGQNRAVQMMQGKIMPQGPGSMPGGGFLP

SEQ ID NO: 33882 - protein, 120 aa, Sorghum bicolor
  Clone ID: SORBI-28MAY03-C39037_1.pep
LVFWELSELPVVVLSNLYRLLLRLALVPRALLSALFGVHGSMLLVSHLRPGCPGLAWGVLLAAVLQPQPPAFPVCTYWFSSVAATPFALVRWIRLQCLGSAVAPSWSARRSDRWLLVVFL

SEQ ID NO: 33883 - protein, 111 aa, Sorghum bicolor
  Clone ID: SORBI-28MAY03-C39061_1.pep
ESIPPANVVLLKWILHDWSNDECIKILKNCKQAIPSRDAGGKIIIIDVVVGSDPSDTKLLETQVLCDLHLMKIGGAERDEQEWKKLFLEAGFKDYKIMPVLGLRSIIELYP

SEQ ID NO: 33884 - protein, 197 aa, Sorghum bicolor
  unsure (1)..(197): unsure at all Xaa locations
  Clone ID: SORBI-28MAY03-C39068_1.pep
MSRALLSHVLHRPPHFAYTCLRRSGVGXEECSLLASTHSVVSIAARLKPFPAPLRRRLLLRQGTSCVHCCRKRVVSGVQPTGLVHLGNYLGAIKNWVALQDLYETFFFIVDLHAITLPYEAPLLSKATRSTAAIYLACGVDSSQASICVQSHVRAHVELMWLWSSSTPIGWLNRMIQFKEKSRKAGDENVGVALLTY

SEQ ID NO: 33885 - protein, 275 aa, Sorghum bicolor
  Clone ID: SORBI-28MAY03-C39072_1.pep
HEASGGTFSFIEDEGVMQDAFAQCIGGLLSVAVQEMRLSMECVDPGVQLCSIKCGSYPSKVARDGRNGSVDIAHLYADEEKDILLSVTIPKSCEQTSLLRVACAYKDSVTNETIKIQGDEVKIKRPTSTVSVPVSIEVDRERNRIPAANSMESAWAAAERGALSEAVTILEDCRRALSESVASQNGDRLCMALDAELREMQERMANRQLYEASGRAYMLSGLSSHSWQRATARGDSTDSTTLVHSYQTPSMVQMLEHSQNFSSLPQGRRPQVQGR

SEQ ID NO: 33886 - protein, 191 aa, Sorghum bicolor
  Clone ID: SORBI-28MAY03-C39078_1.pep
ARGASSTPAASAPPPRSTAGLLSRPGAGSSFGASATGGSFGAGRSRGGRSWDREPDPFADSDPAPAPSSATDGTPFEEHQNTGINFDAYEDIPVETSGREVPAPVSTFAEIDLGEALNDNIRRCKYVPPAPVQRHAIPISLAGRDLMACAQTGSGKTAAFCFPIISGIMKGPPSAGGGRQRGGGMGMRTAY

SEQ ID NO: 33887 - protein, 225 aa, Sorghum bicolor
  unsure (1)..(225): unsure at all Xaa locations
  Clone ID: SORBI-28MAY03-C39114_1.pep
MPCNKLNEPKDHMPTEQNALPQHLRGMRRRSLFNEKAGVSNKGVDKASDHHPVNSTTPKCKTISGDNSKPLRTPPCALPGIGLHLNALAAIPKEKLEIQSSINELSNLIGPSGSSPAPSEQIIINDDFNQTTDVATAEASSQGSPKKKRQKFDNGDGTSCKRCTCKKSKCLKLYCECFAAGVYCSEPCSCIGCLXXPSLTETVLSTRQQIESRNPLAFAPKVIHT

SEQ ID NO: 33888 - protein, 195 aa, Sorghum bicolor
  Clone ID: SORBI-28MAY03-C39135_1.pep
MRHVLLSRFLLRRQQGGGMPTAHRPRLLRALSSAPSPVSSDAELRKYAGYALLLVGCGAATYYSFPLPADALHKKAVPFRYAPLPEDLHAVSNWSGTHEVHARVLLQPDSLPALEGALAAAHKERRKLRPLGSGLSPNGIALSRAGMVNLALMDKVLDVDAKKKTVTVQAGIRVAELVDTLREHGLTLQNFASIR

SEQ ID NO: 33889 - protein, 163 aa, Sorghum bicolor
  Clone ID: SORBI-28MAY03-C41700_1.pep
RRCSKIEGENHGPHRYGHGGGLLVLGLLRPSTGLPGPSPAPGGRVREHRNLGFRGACLGEHPRRQPPEGPARRALLTPCRGRGRAPAGHTGGAPPQPEATVMPQGRPAVKRCRWGPTSRPPHRGEGEEGRGGGSTGRGRRCVAVAAVSGAGGTGRAGGGGARA

SEQ ID NO: 33890 - protein, 112 aa, Sorghum bicolor
  Clone ID: SORBI-28MAY03-C41707_1.pep
MALPYLEAVLCFMILMYIFETYLDIRQHRALKLPTLPKPLLGVISDEKFERSRAYSLDKSYFHFVHEAVTILMDTTILYYRVLPWFWKKSGELVTNVGLNAENEIIHTLAFL

SEQ ID NO: 33891 - protein, 103 aa, Sorghum bicolor
  Clone ID: SORBI-28MAY03-C39228_1.pep
HEGQVFIGPFTGDEAPRRRSQHGARASLSTRCAHPFASLTVVQDLKPKPYLKANWSNLIWIPLKGHHAYACMCTANARTKLQEGCCSQSQVKWEILPLIERLE

SEQ ID NO: 33892 - protein, 231 aa, Sorghum bicolor
  Clone ID: SORBI-28MAY03-C39236_1.pep
TRRPLDFRTIDIRLAKGAYRGSWEAFLDDVQEVIRNLQTAFADRPEVVVMVAALSESFESLYKAEVQDLVEKFDKYLSNENGNSEIHQELQDALTTANNKLPKAPWEERVGKVWGIDRDDESVLLCDTCDSEYHTYCLNPPLARIPLGNWYCPSCTAQTHVSVQEQKKCLGEEAHVFIEKLNKLAVAMDEKEYWELSVAERIYLLKFLCDELHNTALIREHLDQCSDRSND

SEQ ID NO: 33893 - protein, 142 aa, Sorghum bicolor
  Clone ID: SORBI-28MAY03-C39258_1.pep
MPELGNAVKVSLSDEEDADDGHLDHGKAEAAASPWHRVKWTSGMVKLLVTAVSYIDEDVDADYGTSSGRRKHALLKRKGKWRLVSSAMAERGFAVSPQQCEDKFNDLNKRYKRLTEILGRGRACQIVEKHELLDQVSLSGKL

SEQ ID NO: 33894 - protein, 171 aa, Sorghum bicolor
  Clone ID: SORBI-28MAY03-C39267_1.pep
MARFVDPLVVGRVIGEVVDLFVPSISMTVAYGPKDISNGCLLKPSATAAPPLVRISGRRNDLYTLIMTDPDAPSPSDPTMREYLHWIVTNIPGGTDASKGEEVVEYMGPRPPVGIHRYVLVLFEQKTRVHAEAPRERANFNTRAFAAAHELGLPTAVVYFNAQKEPANRRR

SEQ ID NO: 33895 - protein, 121 aa, Sorghum bicolor
  Clone ID: SORBI-28MAY03-C39290_1.pep
ARGSAPPSQGPRASPPPSQGPFAAGPPPTGPFAAAPAPFRPPPSSLAQPQSPTGGPLPPPPTYARPPQTQGYYTGAPPANPQFPMSRPAFQQPVQTMPPPPMGPAATFGNQAAYAGPPVGG

SEQ ID NO: 33896 - protein, 157 aa, Sorghum bicolor
  Clone ID: SORBI-28MAY03-C3932_1.pep
MALPLARLVLPGFPACQCQPRPPLRFPKHHVSFAAPASSRAAFAACAAASAPAAPAAQAPEAETVEQVGPRTRLVAQNIPWDSTADEMRALFQTHGSVVGVELSMYSASKNRGLAFVTMGSEEDALAALTHLNSTILNDRKIKVDFARPRKKQPKQP

SEQ ID NO: 33897 - protein, 101 aa, Sorghum bicolor
  Clone ID: SORBI-28MAY03-C39312_1.pep
SVDLTTSIYRYTEQEPVSIIILIIWYVVFSGLRFFNIKCPLIDNYCVSYYWIMDSEITIGFGNQSEPSHMAKNAYSQEKTNNYLIDYKIKQEKGVKLKTVV

SEQ ID NO: 33898 - protein, 120 aa, Sorghum bicolor
  Clone ID: SORBI-28MAY03-C38959_1.pep
ARGFSATPQKPPPGTPQLRCHRRPLPTPMWIWPRRPAHAWRRRRPRAALHPAFTTEETEGAAAYLALAESGPSSGGSWRRIRILERRSSVPIQTLEQSHPHVKSSSEHFKAKLVHIELLR

SEQ ID NO: 33899 - protein, 99 aa, Sorghum bicolor
  Clone ID: SORBI-28MAY03-C38967_1.pep
MYRVKSEGEGDCEMMLQDQMDSPVADDVSSGGGSPHPHRGAGPPLKKGPWTSAEDAILVDYVKKHGEGNWNAVQKNTGLFRCGKSCRLRWANHLRANLK

SEQ ID NO: 33900 - protein, 107 aa, Sorghum bicolor
  Clone ID: SORBI-28MAY03-C3899_1.pep
MAPSISIGSAAPSWAAGANKKKSVGAVVDDEAELLRRRNAELEREVEALRLELGAARRRAETAEEAEERLCVQLGDAEVEALELARAYQAQVQALAGELAGARGGRR

SEQ ID NO: 33901 - protein, 152 aa, Sorghum bicolor
  unsure (1)..(152): unsure at all Xaa locations
  Clone ID: SORBI-28MAY03-C3941_1.pep
DIHPRRDNDDDDDQERALQKSKKKSLXKKVAGCEASAERMQKADTNLQLLNPAEQYRHLQKQKYPRLGGTMNEALVKLRKFXASLLSINLATNHVKEKNPSTDKVEKEDEEDDDYKGWHTNRLSFLPSSSKDGMARKDDPDDYVVVDPLLVE

SEQ ID NO: 33902 - protein, 109 aa, Sorghum bicolor
  Clone ID: SORBI-28MAY03-C39422_1.pep
MPRNFRKRGIEPDTDDRSDDEDTRRVALEEIKYMQKLRERKLGIPAGTAAASTNGSSARGGRVGSGAAAAGEAEKEDLVLQDTFAQETAVTIEDPNMLRYVETELAKKR

SEQ ID NO: 33903 - protein, 155 aa, Sorghum bicolor
  Clone ID: SORBI-28MAY03-C39427_1.pep
TLLYVYMRLKCKSDRLTVIRGTPRIRSSVDLTVATGKNDCPQTRRRDQPAPPPAAQETGSHRAPPPPLRATRQANPLLEAAACVWTRQWVWEPAAGVINAGNACAEGTPDAKLIMAVAAARPAIRDEVKWRLEESAGEHGAAKDARGPRGRGVSC

SEQ ID NO: 33904 - protein, 168 aa, Sorghum bicolor
  Clone ID: SORBI-28MAY03-C39451_1.pep
MPYPAGFLFSFPRWSARRQHLPACLPVTPTTRAKPKQPSSSTDPPARPFPIACQIAMAQQQQVVRRVLKVAPPGKGDGECFPTVQAAVDAVPLGNRARVVIRLAPGVYREPVYVAKTKNFITIAGASPEATVVSWDNTATRIKHSQSSRVIGTGTFGCGTFIVEGEDF

SEQ ID NO: 33905 - protein, 74 aa, Sorghum bicolor
  Clone ID: SORBI-28MAY03-C39478_1.pep
SRLKGMYSDLVGQLILPHVQGSLFVLGRTSPGQSLHQNCFCHTRICSEWCPEHLMHLEDSIPWWLVGTYVMVLA

SEQ ID NO: 33906 - protein, 108 aa, Sorghum bicolor
  Clone ID: SORBI-28MAY03-C39496_1.pep
SDVKRFPIIVDPRLEGHYNLKSMTKLSSVANRCLVRMPKSRPKMSEVYDMVQKIVDSIGTGPPQPPLLHYRGSASDPATKRAKKGSLRTRLREFGLGCRNIVQRGWKA

SEQ ID NO: 33907 - protein, 139 aa, Sorghum bicolor
  Clone ID: SORBI-28MAY03-C39513_1.pep
EPVVHMSAMKLVPQHCLTGLAEGLNLIGQIEFYYSEFPKTMSSIGVSLLALGLGFGAVLGSAIVGVIHAGTAWLPSNLNEGHYDRYYLVPAVLCAANVVYFVVCGWAYGEEGKNRVVAADAAAAEDDQEEEEEHKAGII

SEQ ID NO: 33908 - protein, 130 aa, Sorghum bicolor
  Clone ID: SORBI-28MAY03-C39144_1.pep
PDDAQKITASCNQVQTPTQQPPLLGEQSEGMSEMDMIAAQQEEADLNAAIAASLMDSGGPFASYNAVQGSSNSQDAPATEAAPSKDNTQEEAAKSEPSAPPCEDTQELASGSDPKREVSSVEEKGSAKEE

SEQ ID NO: 33909 - protein, 130 aa, Sorghum bicolor
  Clone ID: SORBI-28MAY03-C3916_1.pep
GIGGNISDLQCSQREMVIDCLSGSDGKEGIAKAGSLLCSTYINGDTHGDGKRKPAFTEADMASALKAVGCGGPEPDLLLMYGPARCHLGFPAWRLRYTEIMYMGPLKSMKYGAIVEALYNFSKKHQNYGK

SEQ ID NO: 33910 - protein, 82 aa, Sorghum bicolor
  Clone ID: SORBI-28MAY03-C39215_1.pep
VRNHNKAPLLWQVHPVVFLCLYFYTGYIRIDFGTFNSSSSEPMQSRKKEEATYQLLKLWHKRPCKNSLLQVLRTFQLVQDLQ

SEQ ID NO: 33911 - protein, 270 aa, Sorghum bicolor
  unsure (1)..(270): unsure at all Xaa locations
  Clone ID: SORBI-28MAY03-C39613_1.pep
MRERGFSPAGRPILFVSLHFLFLFTAAAASAAAPEEEKFTEELLLRPLPDRKALAHFHFRSSAPPAASVGRHHHLFPKAISQLVKKXHVGELELSFTQGRWNYEQWGGFEPMSTNNAKPPGVELWAVFDLPLSEIDATWKNLTHTLSGLFCASINFLESSTAFSSPRWGFKLNEGNLRYGALPREAVCTENLTPWLKLLPCRDKSGIAALLYRPSIYKGYYHSQKLKLRSSQSLGIILDQTLTVVLQPNSVSGEQLHSNHGQLQPNWSMR

SEQ ID NO: 33912 - protein, 204 aa, Sorghum bicolor
  Clone ID: SORBI-28MAY03-C39623_1.pep
ARGAGIGGNPHLRSLQLSMNNLARAFPPSLYNLSSLKLLSMAENELHGRLPQDFGTTLGSSMRFFALGGNRFTGAIPTSLTNLSNLQVFDVSVNEFSGVVPSALGRLQQLEWFNLDNNMFQAYSEQDWAFVTSLTNCSALQVLELGWNSRFAGELPNSLANLSTTLQELLIFSNSISGAIPTDIGNLVGLQQLMLGENLLTGAI

SEQ ID NO: 33913 - protein, 126 aa, Sorghum bicolor
  Clone ID: SORBI-28MAY03-C39616_1.pep
MAAWTSAKGALLPWARSSSGGHGGLSSVLGRALALATAGGGGGGGGGGSLLPRRWQSSLPQLDHVDRSDEESGEIDWDKLGFGLTPTDYMYVTRCSPEDRGDFPRGELCRYGNIELSPSSGVLNYA

SEQ ID NO: 33914 - protein, 209 aa, Sorghum bicolor
  Clone ID: SORBI-28MAY03-C39656_1.pep
MAMALRRRLLLLLPLLFLVVLVQRPHNCVASGGGGGEPAEFEIPRDGSVLELDESNFEAAVRAAEFLFVDFYAPWCGHCKRLAPQLDEAAVVLAGLSTPVVVAKVNADKYRKLGSKYGVDGFPTLMLFDHGVPSEYTGSRKADLLVENLKKLVAPDVSVLESDSSIKGFVEAAGINFPLFIGFGMDESLIVEYGAKYKKKAWVFTAKDF

SEQ ID NO: 33915 - protein, 144 aa, Sorghum bicolor
  unsure (1)..(144): unsure at all Xaa locations
  Clone ID: SORBI-28MAY03-C39660_1.pep
MGSKKRSPQHPASPAGGEGGAQTAGKAVPVTAAPESAPVSVVPKPPDVAPFLTKVYDMVSDPATDAXISXIAXGGNFMIWDSHVFERDLLARHFKHNHFTSFIRQLNTYGFPKVDPDRWEWANEGFVKGQKHLLKTIKRKKKSS

SEQ ID NO: 33916 - protein, 206 aa, Sorghum bicolor
  Clone ID: SORBI-28MAY03-C39664_1.pep
MDSSEKRARAATAAARLADDLIVDILSRLPVKSVCRFKCVSRHWHGLISHPEHRKNIPQTVSGFFYPHYLLNQEDEITAIPEFIRIRGTEEPPFLDPSLPFLPGYRWIRPRDCCGGLLLNMCWKVNPRDEFNYVVCNPAADTWVVLPEPLNNSPVSTVRLGFDPAVSSHFHVFQLLEEDQYGYITGLEIYSSETGAWSHKENGWSD

SEQ ID NO: 33917 - protein, 163 aa, Sorghum bicolor
  Clone ID: SORBI-28MAY03-C39670_1.pep
MGRHAASGGGGGVQQKLRKGLWSPEEDEKLYNHIIRYGVGCWSSVPKLAGLQRCGKSCRLRWINYLRPDLKRGSFSQQEEDAIVGLHEILGNRWSQIASHLPGRTDNEIKNFWNSCLKKKLRQRGIDPSTHKPISANAASALEQPAASQERKPLSTAAADGGF

SEQ ID NO: 33918 - protein, 140 aa, Sorghum bicolor
  Clone ID: SORBI-28MAY03-C39341_1.pep
MLLSDDDDYYEDDELHDNLEASAEDHGVHRVHATKKLKHDHGEGHCGSHLSEVAAIDMNRMFSEGSGGPSAEKNLSAVRAQIERERLDIKSQMLRIEQRHFKWLKFSREKDRELEKMKLENEKMKLENERLELELKLKEN

SEQ ID NO: 33919 - protein, 172 aa, Sorghum bicolor
  Clone ID: SORBI-28MAY03-C39381_1.pep
QRSGSSSFLLLWPRGLGRRENWLRSIDWIPQRLGVQFSASHGGSLTGTIGYFHEGAFALSVGYTTTEEQTTNGTSEGTIFRKGLSSIYERSYVRSSYLLHGFRLVRRLAFSVRDQWNLFSSEVHGKLTRILHRFWTTLQGSCEDIGWLQRTRASLCSVDGTGRFKEILHDIR

SEQ ID NO: 33920 - protein, 155 aa, Sorghum bicolor
  unsure (1)..(155): unsure at all Xaa locations
  Clone ID: SORBI-28MAY03-C39384_1.pep
VGTAGACTAPEVRVAQSSSTSDYPTRRSCLAVPDIFYPTRRRWAELCEARQLCSHLNRLKWACNRCTSPGVSNNGLKIDLSDAHMQGRRPVRGGRRRGREATGERLEVEPPTPPPSLGLPLRRWTPPRGSRRRAEDPIPGIEPERXVGGGAEDLR

SEQ ID NO: 33921 - protein, 59 aa, Sorghum bicolor
  Clone ID: SORBI-28MAY03-C39727_1.pep
MAAVMVARQGRELQRYSASTGGRVVVGCVPYRVRNDGGGEVEVLVISSQKKGPAGGVLI

SEQ ID NO: 33922 - protein, 169 aa, Sorghum bicolor
  Clone ID: SORBI-28MAY03-C39763_1.pep
MHVAEVTVVHHAALVLAALWAAAAAGWAHPALFLVALLYIFAVNQRYTMRLWRRIQYEERKCANQRKLLSDAETVRWLNYAVEKIWPVCMERVASQQFLLPIFPWFLEKFKPWTARKAVIQSLYLGRNPPMFTDIRVVNQSTGDDHLVLEIGMNFLSADDMDARMAVQL

SEQ ID NO: 33923 - protein, 112 aa, Sorghum bicolor
  Clone ID: SORBI-28MAY03-C39743_1.pep
MPWRGHGWEGVPALSSRELFLCSRVLAVSGRVHACPVSCLLHLDRLTWVLARMPTLFGAPPSPEPNALQPFLLRRVLDYIGSVDVSPESCYLHHELLNLMLVLMSTQLCSGP

SEQ ID NO: 33924 - protein, 250 aa, Sorghum bicolor
  unsure (1)..(250): unsure at all Xaa locations
  Clone ID: SORBI-28MAY03-C39790_1.pep
RRLIQLDEVKQAAKQQHNLKAGSIMTNAELRVNKNKRIGEVPGVEVGDMFYFRIEMCLVGLNSQSMAGIDYMSAKFGNEEDPVAISVVSAGVYDNTEDDPDVLVYTGQGMSGKDDQKLERGNLALERSLHRGNPIRVIRSVRDLTCPTGKIYIYDGLYKIKEAWVEKGKSGFNVFKHKLLREPGQPDGIAVWKKTEKWRENPSSRDHVILLDISYGVESNPVCLVNEVDDEQGPSHFTYXTKLTYGNSLN

SEQ ID NO: 33925 - protein, 168 aa, Sorghum bicolor
  Clone ID: SORBI-28MAY03-C3982_1.pep
MQDHHAELRSRDFHHADDAFADSVSTDFSEATSSEWSLFTSSDESSFTTESTRDSFSVVDYGDNAGLRPISSIFGPSYAPEHPPGNFVSCTRFSPSNPQTRYFSESTGFVSDSSMPAHPSGIVHRGRYPDRACASSAEPLASAHQRSGYGRYPLSRDGFVQTSGFCQM

SEQ ID NO: 33926 - protein, 126 aa, Sorghum bicolor
  unsure (1)..(126): unsure at all Xaa locations
  Clone ID: SORBI-28MAY03-C39870_1.pep
LPRRQPIHHISKSRNLRNKTEPRLRHAVDLHVHILMILRRIRKMNVFYIPPCLLARFEMEEVVECYVGVDRLYRDGSGLVCCVGQGEGCFYSVXFRRGRRLVFRRRCASRRRCCGEDGRVGRCWVL

SEQ ID NO: 33927 - protein, 97 aa, Sorghum bicolor
  Clone ID: SORBI-28MAY03-C39929_1.pep
GIRHQSVGSSAGSLHHACARSWRRVPLAAAPWESSLGLSGAQVSLHGTMMFESPWRLHIETDQSELGMWTGITPRSGGSRQCSTCNRRDQTGNVSFR

SEQ ID NO: 33928 - protein, 137 aa, Sorghum bicolor
  Clone ID: SORBI-28MAY03-C39527_1.pep
DVKNPPKKRGRPKGSVTPVRLKGKSAEKDSQETPKTGINSKKEGARPSRSTGKAKDAVVKASRKDEADSTDNSKDDAGSEDNTSHDEVKSGEAIDGSKTNGLSSKRKPEENEGESSEEEKGSAKTTSRKKRRRKSRN

SEQ ID NO: 33929 - protein, 105 aa, Sorghum bicolor
  Clone ID: SORBI-28MAY03-C39530_1.pep
PYHSILVGESYLARKRPVYECTDAQVEAAKGFLAVLRDYLDTLCSNLRSHTITNVQSNNDKVSLLLKESFIGSFPIRDRPFMKLFVDTQLFSVQTDLVLSFYQKD

SEQ ID NO: 33930 - protein, 236 aa, Sorghum bicolor
  Clone ID: SORBI-28MAY03-C39573_1.pep
MTPVSHCSVGSISLFHIGSFRTSREIQVRRFQGTARYSRVASPSPRRLLQPQAAFHLISIYKRRSWSSAERPTTLSAATVGTDVTVEDQNPETSDENSEAAPDAVEASEQAEASTGQASSPRKLGPSIRKSEMPPLNEEDLVPGASFTGKVMSIKPFGVFVDIGAYTEGLVHISRVSDGFVKDISYLFTVGQEVSVRLLEANKETKRISLTMTEGDDYVKPKKETPKAANGGRSAT

SEQ ID NO: 33931 - protein, 127 aa, Sorghum bicolor
  Clone ID: SORBI-28MAY03-C39989_1.pep
DAAAGAALYGHMGGGGGKQDAGAFVDYSSVLDVSENLGYGESSSNSSNWNCAPEANNALDGGDAPLHWASESKATPHFAGYGGGEEQSLEEHKFLLPCHGQQEQSLPHFDFDISRGAVVGDFNPEFF

SEQ ID NO: 33932 - protein, 131 aa, Sorghum bicolor
  Clone ID: SORBI-28MAY03-C4002_1.pep
MNDDASSSPASYIRLVQHLIEKCICYKLNKEECMETLEKHAKIMPVITSTVWKELEKENKEFFETYKKDRGVGPNTNQEAATTTGHHPSRVQQSCCSQESTTTMLQQKNLSGEQEQRVVEKEKRELFETYK

SEQ ID NO: 33933 - protein, 141 aa, Sorghum bicolor
  unsure (1)..(141): unsure at all Xaa locations
  Clone ID: SORBI-28MAY03-C40029_1.pep
GMPISAKPDVYSFGMVLFELISGRRNTAHXGEGRRRRRHGASSDADDDDEDREATTTFFPVWAAVRVAEGDTAAVADARLRGDVSEDELERACRVACWCIQDEEAHRPTMAQVVQALEGVVDVDMPPVPRALQHLATTTLT

SEQ ID NO: 33934 - protein, 124 aa, Sorghum bicolor
  Clone ID: SORBI-28MAY03-C40060_1.pep
VLHRQEVFEPFKNHPRFNELLENIYTVLDFFNSRMDMQQLDGEWSVDKVLEVINKTCRSWRGEGMKMFTQLRFTYEQESHPEEFFIPYAWRLVLSRGFSFNPGAINLFPVEIHLEDAPAGEQKV

SEQ ID NO: 33935 - protein, 117 aa, Sorghum bicolor
  Clone ID: SORBI-28MAY03-C40062_1.pep
LGAVYERGLIGIYHDWCEAFSTYPRTYDLIHASGLFTLYKNKCSMEDILLEMDRILRPEGAVIIRDDVDILTKVNSLALGMRWNTKMVDHEDGPLVREKILYAVKQYWVGGNQTAVA

SEQ ID NO: 33936 - protein, 134 aa, Sorghum bicolor
  Clone ID: SORBI-28MAY03-C40097_1.pep
IVEMLENTMDMSSGGEYSDFTEDKKYQHTNFLFDCIIESLDSKFCNFGKCGYKAWLKLPLSLSKDLMKRQVLEDITKWRESSGTALRQISEKEVDQVTDRWDASQVEAFDISIAIENDILEALVGEFTVDLWWY

SEQ ID NO: 33937 - protein, 94 aa, Sorghum bicolor
  Clone ID: SORBI-28MAY03-C40110_1.pep
GCRNRKVFRRQSSSVLNIKGTATLQKLGRDCRWLVLNSDPTCYYIIASGRDHYRTGLTLSQVQRNHQCTFIFQLPNEVLRPHRLHDDKAKQLGL

SEQ ID NO: 33938 - protein, 160 aa, Sorghum bicolor
  Clone ID: SORBI-28MAY03-C39669_1.pep
MVKRSKKSKSKRVTLKQKHKVLRKVKEHHRKKRKEAKKEGKAGQRKKVEKDPGIPNEWPFKEQELKALEARRAQALQELELKKEARKERARKRKLGLLEDEDIANLASAASAQGSEFAAKDAAKENAPLAVAKSNDHSERSFYKELVKVIEASDVILEVL

SEQ ID NO: 33939 - protein, 141 aa, Sorghum bicolor
  Clone ID: SORBI-28MAY03-C39709_1.pep
SRIRPAYVYNTTADATAPAMTKKVAAEADTAALFSVTGAAAGVRAEAPAGAVASPTPAAMGLEAGASAKGADTGAIVGGEGGEAVGALVGGGGRGAILGGAGAGARLGEAAGACAVAATAKRATSKATSRAARRAICVTSE

SEQ ID NO: 33940 - protein, 174 aa, Sorghum bicolor
  Clone ID: SORBI-28MAY03-C39710_1.pep
GFRNLQQLFPGDAGGGGSSSSASSSLYLRLSESELRHLRGAKGRSKNRRWLAIGIVLACVAALGVSAVAAWILVSRRRRRAEMAKQQKGSSSLVVYSYGDLRSATSNFSERLGGGSFGSVYRGVLNGDGHTQVEVAVKKMEGLRQGDKQFRAEVNTLGLIQHVNLVRLLGFCCS

SEQ ID NO: 33941 - protein, 185 aa, Sorghum bicolor
  unsure (1)..(185): unsure at all Xaa locations
  Clone ID: SORBI-28MAY03-C40190_1.pep
EVVCVDQDCKGLTARGTYYVNVEKLGNGAHWRRTCGQHVYSPFLLAFTHEDETSSKSYNVAKAGMMDANYSLPDNVAIITLQNLDDGTTLLRLAHLFQAAEDPKYSEIAKIDLKKVFGKRTITELTETNLSANQKKSEMKKLNWRVIGDTESXSCPSKRXXPLDSRALVVELGPMEIRTFLLKFL

SEQ ID NO: 33942 - protein, 104 aa, Sorghum bicolor
  Clone ID: SORBI-28MAY03-C40191_1.pep
SDFSPTPKEISMDDLLGRIDEIPVCDSVRPADDLPLDNFKRLQDAFPTGDFIGPGDDHLYDHYIGLADISHLPLPMNEPAFNLDAELDWSGFDFAAIERELDVL

SEQ ID NO: 33943 - protein, 53 aa, Sorghum bicolor
  unsure (1)..(53): unsure at all Xaa locations
  Clone ID: SORBI-28MAY03-C40206_1.pep
QQVGGWTQVYXGGALSFATIRGASHEAPFSQPGRSLVLFRAFLQGQPLPETFS

SEQ ID NO: 33944 - protein, 130 aa, Sorghum bicolor
  unsure (1)..(130): unsure at all Xaa locations
  Clone ID: SORBI-28MAY03-C40211_1.pep
LRATLDALLLRAGAGGGCVTAQHAAEEEGFGESGGGGADDDAQSCCFVEAGAPSSWKPPAAKWACRACGEGEASVLLLPCRHLCLCKXCEPRADVCPVCSGDKNGHPHRAAQLIPSVAIRRSRRPTTAAK

SEQ ID NO: 33945 - protein, 68 aa, Sorghum bicolor
  unsure (1)..(68): unsure at all Xaa locations
  Clone ID: SORBI-28MAY03-C40215_1.pep
LQQLMNDALIVAKQKNYDVFNALDVMENESFLKELKFGSGDGQLHYYLYNYRIRNGIKPXSELGLVLL

SEQ ID NO: 33946 - protein, 140 aa, Sorghum bicolor
  unsure (1)..(140): unsure at all Xaa locations
  Clone ID: SORBI-28MAY03-C40262_1.pep
TXFRHRAKDDPGRGSNQATDDDGDDLDLRQMRPWPHDNMRALLSLYSAHRPCLISLTCLHHIHSLCDELTIESRGFPLARMQARDSDETTTRVYASVHSTGLAKANHVAQLSSGAEFSSGGCVSWSTYGVAQRSEAVLSF

SEQ ID NO: 33947 - protein, 138 aa, Sorghum bicolor
  unsure (1)..(138): unsure at all Xaa locations
  Clone ID: SORBI-28MAY03-C40306_1.pep
KLLVIFIVIIVVISTYPVARVMLRSRNSTDNFRMFFHVIXFVKAALHCLHYLQLVACLEHLQRWAALTWHSAHWCLHFCASGHXFSLLASKLLGVLPESSDQILVWLETFSGTGVAAALGSPVCCADVAGCWASLLSD

SEQ ID NO: 33948 - protein, 96 aa, Sorghum bicolor
  Clone ID: SORBI-28MAY03-C39957_1.pep
LELPTFLAAFTTTIDMEYSKLQQILIMIHKKKRISGCIPSSVLPNPHLLKEHPTAQLLSSAYTYSVCRSHHLNSQAGCCYSPAKLNINTIVREKHC

SEQ ID NO: 33949 - protein, 154 aa, Sorghum bicolor
  Clone ID: SORBI-28MAY03-C39963_1.pep
ADLLDVILKGLCSHEKVEEAYSLFVEMVDKAELRPFQGTCQRLIGDLLRVNKLEEALALLKTMKTCKFPAFVDPFHPYIAKHGTVEDARNFFKALTVKTSPAPAVYVDVLKLFFAEGRYSEAQELLYKCPNHIRKHPHVTKLFESIKVESASAS

SEQ ID NO: 33950 - protein, 142 aa, Sorghum bicolor
  Clone ID: SORBI-28MAY03-C39974_1.pep
DESDENSPQLIKVLRSAANANHDLVFGYVGVKQWEEFSETFDVKVPQLPKIIVWDTKEEYEVVEGSESLREGDYGSQVSRFLEGYREGRTIKKKVGRGSPTLLGLNAIYILIFLVAVLVVLMYFSAQGEEDHQPRRGRAHED

SEQ ID NO: 33951 - protein, 88 aa, Sorghum bicolor
  Clone ID: SORBI-28MAY03-C39979_1.pep
MTSNNVDTFDSTGNDFTDTSALCEWDDMDIFGDELEYILQQPEQNFQVDPPLTVEDYGYDRPRLEQDCQMEAQQDCKNPQYADVTTEA

SEQ ID NO: 33952 - protein, 158 aa, Sorghum bicolor
  Clone ID: SORBI-28MAY03-C40363_1.pep
TLHCTIMHSSSAKRSQVTTHKCVLDLQFYSAYIDAFHTGHSTNLSDSHRKKLPGLYTQCDTSAVVLYQNPLTIVVRYKFLNASKGEEFNDSWIVYPEDGAEHFFLLQAAESKLPSTRRVFKKFTSRRWSCSPYHFRSFCSLLSAARAVLFCGSKPKHA

SEQ ID NO: 33953 - protein, 114 aa, Sorghum bicolor
  unsure (1)..(114): unsure at all Xaa locations
  Clone ID: SORBI-28MAY03-C40393_1.pep
PVTKAAADAIARRLHELRQKQSEGPKRRRGKAALKASLDEAMEAKRKAEDEASCIEGEVDCXWKKVRXKLQEATSQQKDRRYPEEQDFTDPKELEGEQSSPPGFVQIQNQALMK

SEQ ID NO: 33954 - protein, 132 aa, Sorghum bicolor
  unsure (1)..(132): unsure at all Xaa locations
  Clone ID: SORBI-28MAY03-C40429_1.pep
MYGQGGGFNPHYRPGAPPPPQQQVGVPGSFPQQPVPPPPAPYPQHPGLRPPPPPGPDQHGVLPPQNQPFPXGQHGQMHQMPMLPQQRGYAPVPMPGMLPPQQAMHQAPPQYPPLPPPPPRPAAPPPSPPPPP

SEQ ID NO: 33955 - protein, 196 aa, Sorghum bicolor
  unsure (1)..(196): unsure at all Xaa locations
  Clone ID: SORBI-28MAY03-C40437_1.pep
FGGFFNSYCLQVQQSRKQGSKCRNPEYFTPNPNPEILKQKPQCLAPLCPGWRREQEEAADVGSSEPWSGSRADDINQQLARCVRATPLLIPRSTAWVPRLCNDLRRPKHCPRPPLLGGMGTTRNPRGSGSGGSLRGQETVGGPVGMGRAERRGGREXGLNGGLCFGRKSRGGGLVWSGVVEVEDEEERCGAGRRNV

SEQ ID NO: 33956 - protein, 187 aa, Sorghum bicolor
  Clone ID: SORBI-28MAY03-C40457_1.pep
RPAGAVRPPTARPPSVAAGAARWWTPPRSPPCGYCSRCSPPAGSGAARPTRTARGGGTAARGRRPCRASATPPRHPNRPRRCRSARSARRWPRHRRRSGPAAAPACCCPQRRLTGAPAADLRPTRRRRRRRGIGTRRGRRTALARPCLSVTARQVFFLGRHTDGRDALSVEIGSGKRGEETQTVVLV

SEQ ID NO: 33957 - protein, 194 aa, Sorghum bicolor
  unsure (1)..(194): unsure at all Xaa locations
  Clone ID: SORBI-28MAY03-C40462_1.pep
HEEDVYEYEEGVPEEEAGKNGRYDAVAKYEYNFDSDASDADEDVPSDEGEDMEEDDNARGDDEDRQXRILQETTGMPREAFDGKKRKQPLELPLQHGDGDGPVTIHDLLDNVQGKPGYSKIRKRLQQQEKKPMVVVAPLPKVERXRIERSVDVSEIQXELTKWEGVVKSNREAPVLYFENDTNLGVNTVAAIAS

SEQ ID NO: 33958 - protein, 130 aa, Sorghum bicolor
  Clone ID: SORBI-28MAY03-C40484_1.pep
MARRCPCRLLLAVVVLVLVSAAAQAQAQETCSGAVPAPPRRGARVSVASFGGAGDGRTRNTAAFARAVATIERRAVPGGAELYVPPGVWLTGPFNLTSRMTLFLARGAVVRATQDTSSWPLIEPLPSYGR

SEQ ID NO: 33959 - protein, 215 aa, Sorghum bicolor
  unsure (1)..(215): unsure at all Xaa locations
  Clone ID: SORBI-28MAY03-C4044_1.pep
RPEYLWCIDPLDGTTNFAHGXPSFSVSIGVLFRGKPAASTVVEFCGGPMCWSTRTISASAGGGAYCNGQKIHVSQTNKVEQSLLVTGFGYEHDDAWTXNINLFKEFTDISRVSVCRTAIVLQICRSEFSIILEIYSFFQGVRRLGSAAADMSHVGLGITEAYWEYRLKPWDMAAGVLIVEEAGGVVTRMDGGEFTVFDRSVLVSNGLVHGQVCSN

SEQ ID NO: 33960 - protein, 143 aa, Sorghum bicolor
  Clone ID: SORBI-28MAY03-C40149_1.pep
PSRRITNGSWNKTNIGFDGPEQAEASTSWQSWMVSASGAPLQSNDDATREQLRMPLLSSSGDERAGLVEEQTSPSAGEEGDAKKRKRGVRRARVMDLGRRMGGKLEEKGKHFIGKMRENARNNRLLLPDLEQASTPPAPAPSY

SEQ ID NO: 33961 - protein, 104 aa, Sorghum bicolor
  Clone ID: SORBI-28MAY03-C4011_1.pep
VREQTGPAAAAGGGDDDAVRGVSLAALRTTRYGCRPNFEAEFAAFAERAGDAADVGVLVCGPPGLQTSVARECRARNLRRRGGGGAEKSRSSAVFHFNSHSFDL

SEQ ID NO: 33962 - protein, 175 aa, Sorghum bicolor
  Clone ID: SORBI-28MAY03-C40167_1.pep
VPDSGGVYFVPAFNGLFAPWWRDDARGICIGITRFTNKGHIARAVLESMSFQVNDVLSSMHKDAGEAGEVKSAEGEFLLRVDGGATVNNLLMQIQADLLGSPVVRPADIETTALGAAYAAGLAAGVWTKEQVFAGLHKENTTVFRPKLDEAHRKKRADSWYKAVSRSFDLADLSL

SEQ ID NO: 33963 - protein, 183 aa, Sorghum bicolor
  unsure (1)..(183): unsure at all Xaa locations
  Clone ID: SORBI-28MAY03-C40563_1.pep
MELSMSGGSLRTFGRCVTFLARVASELVLQAHPAKLXMHTLNSSRSAYASVSLARDFFDQYTLAAAASAPSSTPLQCSVLLKSLLAVLRTPHAALDRLAVSLPEPDAPKLQVTLHCLNGVRKTYWIVCSAEPEVQSLSLDRGRFPSRLAIRPRELARLLSNFQSSLQELTIIATDPASGLPDA

SEQ ID NO: 33964 - protein, 138 aa, Sorghum bicolor
  Clone ID: SORBI-28MAY03-C4056_1.pep
MAPTARWSPLLFLLLLAAATATATNTTAEHPSGSDPPPSPTPTPWPERFHAVLFTNLTNYSDASTGPPLRITDLYYDWPRRRNLNLVRHQLSPDPLYDVEWNNGTTFYFDFRACRVERFPVGVLPPWWLSGGGAQYLG

SEQ ID NO: 33965 - protein, 245 aa, Sorghum bicolor
  unsure (1)..(245): unsure at all Xaa locations
  Clone ID: SORBI-28MAY03-C40570_1.pep
QVLRCLHDWSQPRLQLNCDPVCQLLXRSGAMSLARGCIRTVLTALPAHDAAVRLAIGKAKEFIAADDDPNLRYLGLLAVGMLGPAYASTVHDCQDAIAKSLGDADTNIRQEALHLIMGMVNENNVMDIAGMLIGHVAKSDPEFANDILGAVLAACGHNVYEMVVDFDWYVSLLADMARTLHCAQGDEIGRQLVDVGLRVQDTRPELVRSARTLLIDPALLGNHFLFPVLSAAAWVSGEYVDLTKD

SEQ ID NO: 33966 - protein, 138 aa, Sorghum bicolor
  unsure (1)..(138): unsure at all Xaa locations
  Clone ID: SORBI-28MAY03-C40590_1.pep
TRLPPEVGDLTALTRLEVFENKLSGPLPSLPGLSSLQILLAHNNSFASIPADFFKGLTGLTAVSIDYNPFASWTLPADLAAXASLANFSANGANVSGTLPDFLGAMPGLQRLSLALNQLSRPVPASLAGAQLVQLWLN

SEQ ID NO: 33967 - protein, 139 aa, Sorghum bicolor
  Clone ID: SORBI-28MAY03-C40597_1.pep
HEAHLLQISGKGIGKCPNVTYEMLSAMGKEIERCKNLVEKSRSRMVSLPTAPSSSNTDDTNKRSKRGPTSALEKAWRAEDRNHLDALISRAIYSGGVSFNFLRNPYLREAFAFASSRNMQGYVMPGYNRVREGLLRCQK

SEQ ID NO: 33968 - protein, 83 aa, Sorghum bicolor
  Clone ID: SORBI-28MAY03-C40622_1.pep
MGCDDKCGCAVPCPGGKDCRCTSGSGAGGQREHTTCGCGEHCECSPCTCGRATMPSGRQNRKANCSCGPACNCASCASASASA

SEQ ID NO: 33969 - protein, 120 aa, Sorghum bicolor
  Clone ID: SORBI-28MAY03-C40603_1.pep
MGKAVVVGTAVVACAAVGVALALAHRRRKRDAELLGSAEAERKRRAAAVIEDVESSLATPTALLRSIADAMVTEMERGLRGDIHSQLKMLISYVDNLPTGDEHGLFYALDLGGTNFRVLR

SEQ ID NO: 33970 - protein, 81 aa, Sorghum bicolor
  Clone ID: SORBI-28MAY03-C43353_1.pep
RLHLSSRRLSTSVSAKPPRRRWTLTRTRPPRASPRRWTSRNRRTRRGRGRQRRGAGRARSSRTPSVASQSVRGAPISRRSL

SEQ ID NO: 33971 - protein, 196 aa, Sorghum bicolor
  Clone ID: SORBI-28MAY03-C43356_1.pep
HEAYSFEILRFPGGITIIPPQTAFVPQKPDGLFNFSLNFPIDVVQDKLSELKAQMKSGLFLNEHEILYVTLTNLYGSTVAPPTVVQASVLLAVGADNKPPSLQRLKQLAQTLRNSSSGNLGLNHTVFGRVKHISLSSYLQHSLNNSGNAHSPSPAPQPNNQSPSVHQDNNSDHGHHHHHHHVHHRHHHRYDHSHQS

SEQ ID NO: 33972 - protein, 199 aa, Sorghum bicolor
  Clone ID: SORBI-28MAY03-C43362_1.pep
KGEKSTRLTDYDDTDALEVARLVAIEVEREVIDYRGPFCSSPDTNSRNADSPDLEAPRQPVAVASELNDNKSSSTEAKSGSSSSHKEDGSGITDGSGPLSRKHTRSVDLGNLDLNENQCAEETDCNPKSVLSNSVNLSMPIAVAASRGSSGFPARLHFEGGLGWKGSAATSAFRPASPWRTPDAEKSLSASSHKTSNML

SEQ ID NO: 33973 - protein, 189 aa, Sorghum bicolor
  Clone ID: SORBI-28MAY03-C40693_1.pep
EQLRDIAVGLDRSGQRFLWAVRTPPAGTDDGGGLESLDDTLFPEGFLERTKDRGLVVRSWAPQVEVLRHPSTGAFVTHCGWNSTLEAITGGVPMLCWPFYAEQQMNKVFVTEGMGVGVEMEGYSTGFVKSEEVEAKVRLVMESEEGSRIRVRAAALKNEAIAAMQDDGSSQASFATFLFDAKNLHEQLG

SEQ ID NO: 33974 - protein, 124 aa, Sorghum bicolor
  Clone ID: SORBI-28MAY03-C40717_1.pep
KGRNAWYGQKLAKGELTLEMGDSIKGKGTIQGVSAVNAFYELLSQGSLSVMHPETKKAVAPVELCPILKTLYKILIKRELTTNSILQAIRDESMYDPRERIEMAQRQSLFRPSLLGLAKGDAKA

SEQ ID NO: 33975 - protein, 185 aa, Sorghum bicolor
  Clone ID: SORBI-28MAY03-C40760_1.pep
PPCSPHKLLQENYASDPWKVIVICMLLNLTQGKQVEKKVNGFFERYPDPQTAYRADPKKMAEYLAPLGFQRVKTKRIQKFSKAYVGEEWTYITELCGVGKYAADAYAIFCAGRANEVVPKDHKLVDYWNYVCFELPSIQVAVSLQGPAVTGLRHLAPCVAGSCCELLSGSNTCAALALLVFLFAT

SEQ ID NO: 33976 - protein, 59 aa, Sorghum bicolor
  Clone ID: SORBI-28MAY03-C40767_1.pep
PPKPRPKTSARTAQRLIAHGMGLKQFTNFGTDELKKQEEERKNRIAARQSMRDEAWGSD

SEQ ID NO: 33977 - protein, 110 aa, Sorghum bicolor
  Clone ID: SORBI-28MAY03-C40802_1.pep
KVKPLDEVVRNGFTDAMHEKQVAGFRKAVKNVGKHGSRLKLMDITEPFAFRADGHPGPYRSPDPNKKTQRGPDGKPPPQDCLHWCMPGPVDTWNEMLLETIQREFERDRT

SEQ ID NO: 33978 - protein, 84 aa, Sorghum bicolor
  Clone ID: SORBI-28MAY03-C40797_1.pep
TRASSANTPHLCKHPGTELKQHHKELRPSWCCYQWAIFSETSNQFIQNHGDMDEHLNRTDQTEINVYQALNPTRSPRPLFRLWA

SEQ ID NO: 33979 - protein, 100 aa, Sorghum bicolor
  unsure (1)..(100): unsure at all Xaa locations
  Clone ID: SORBI-28MAY03-C40492_1.pep
KLSKXFGNMRRISGLMENQSAHPRHGMVDQGFRPFTTTPLSSSVNAAPVMMPIWSADDGYIWKNSCLQEIPGSGSGRLICYECSQANGMVKKSVVLSADG

SEQ ID NO: 33980 - protein, 201 aa, Sorghum bicolor
  Clone ID: SORBI-28MAY03-C40532_1.pep
KLKPVVTFDCAEIRARDWCNVVTCHMDTPHAVGWRLQNFVIGEHVLTPSSSTVTPIKACVISACGNFTILGTEGGWIEKFNLQSGFSRGSYIDTSLAMQCAHDGEVVGLACDATNGSLISAGYHGDIKVWDFKTCKLKSRLDVGKSVTKIAFHRPNGLLATIAGDMVLILFDTVSMKMVRRFEGHTDRITDLCFSEDGKWL

SEQ ID NO: 33981 - protein, 115 aa, Sorghum bicolor
  Clone ID: SORBI-28MAY03-C40544_1.pep
RAKAPSRASRGAVPRPPCTQPPAALSHSHSGPRPRRRGREPPCHRPRKSTRPPAPSALKPAPRLAAPPRTGPAPRSAEPHGTRAKAHAQPPQPGLGGRPLERIEAGRPRGRRRND

SEQ ID NO: 33982 - protein, 254 aa, Sorghum bicolor
  Clone ID: SORBI-28MAY03-C40899_1.pep
ARGLDTFGKKDREILDYLTPDRIVSNGHWNCFYPSILQDNSDLLAKKRRNRFAVPLQYHQEQEKERISCLGISMEIPFMGVLRRNTIFAYFDDPRYRKDKRGSGIVKFRYRTLEEEYRTREEEYRTREEDSEDEYESPENKYRTREGEGEYEILEDEYRTLEDEYETLEDEYGILEDEYRTLEKDSEEEYGSLENKYRTREGEGEYEILEEDSEEEYGSSEDGSEKEYGTLEEDSEEDSEEDSEDEYGSPEEDS

SEQ ID NO: 33983 - protein, 278 aa, Sorghum bicolor
  Clone ID: SORBI-28MAY03-C40896_1.pep
HEAWNKFWLSLDAETESMMSGEGSQAQHTNLGSRLTSPDMHRDRINDSVAPGDSASHVGMESPPRSILPDVLEHQLPEELPFPFKFKAPSGRVHRMKITATEGIEAFVDAIASKLGAEADSIGGVPDVEDGKIVGAGFAMSFLDDEGDSISITADHDLLEAVILARQAHHDKVDLFVHDPEKPPVSAADPRHPATPSVSTGAGLRERRKWWPEENEEDEDDSEEEHPVRRRKSRAAHAHAHEEQIIAGVPNELILPGAIVTLAITIVGVFTIARLTSR

SEQ ID NO: 33984 - protein, 203 aa, Sorghum bicolor
  Clone ID: SORBI-28MAY03-C40904_1.pep
MRPSNRAPPPQMSPPSRGLTPARRLRVDVDRARRPRSPDLAASPARSPASPARRGSLSPQRRVSPAQSPTRQQQTPFRKPSGFDSAGARSRIARRAAHNAAALSPDDEASTTFSDGGSSSSLSASSRWDFEPPDSRTDRGLLERCGKLLSSIQAFTGGDAGGSDQQPSPVSVLDAAAFLADEDSPSSSSGLSKRAIDFRSSVG

SEQ ID NO: 33985 - protein, 161 aa, Sorghum bicolor
  Clone ID: SORBI-28MAY03-C40947_1.pep
TRPRSQSAQDELLEYTDEEVLEKFQPNETLEHFVLVKYTGYVFPTWMMNKLTSLPYLVNLCLFHLHNCSALPPIGHLRNLRYLHIKDMPNLRDLEMGLSGGPVSLGKLTHLKLEALNLEELSILLSANNESPCFMFPNLEELSVLSCSKLVFNHLCQSVRN

SEQ ID NO: 33986 - protein, 183 aa, Sorghum bicolor
  Clone ID: SORBI-28MAY03-C40995_1.pep
MHMSLVTKAPLSLARATISSLATPLEPQAGPGKMSSSGRQNVTWVEGVRGVASFWVVVTHLCRAWDYSLWSPRDNENAAPQLLQLPFIRLPFQGRIGVTMFAFLTGYVCAIKPLRQAKSGNIPAALETLGKSAFRRPPRLIMPATIALVIAWFFAQLGAFEIAHLSDSHWFRRSVPHNIGSLD

SEQ ID NO: 33987 - protein, 195 aa, Sorghum bicolor
  unsure (1)..(195): unsure at all Xaa locations
  Clone ID: SORBI-28MAY03-C40997_1.pep
CTRQEQESQQQQCVQTPQDQQMQQQKHLHNFHSLPDALSAFSQLSSATHSPSSTLQTVPAFSHQQNFPDTNISSLSPSSGSSMHGMLGQLPSEAASSLPCVAINTPVSVSDPWSSKRVAVESVNPSRPHVVSPQIEQLDMASCNMPQSSALAPLPXRECLVDQDGNSDPXNHLLFGVNIDSQSLLMQGGIPSLQN

SEQ ID NO: 33988 - protein, 196 aa, Sorghum bicolor
  Clone ID: SORBI-28MAY03-C41015_1.pep
MVMMSGLAAAYSVTPTGTAPAPGWKTRAPQPRVAFQRRRRTTSLTTATATATAMPREAMTAPEKADVLRSLDGWAESNLLPLLKPVDRSWQPHDLLPDSASPGFHEEVDELRARAREIPDDYYVCLVGNMVTEEALPTYHAALNSFVGYDSPSSADAWSRWSRGWTAEENRHGDLLNRYLYLSGRVDMRRVEQTIH

SEQ ID NO: 33989 - protein, 64 aa, Sorghum bicolor
  Clone ID: SORBI-28MAY03-C40669_1.pep
SVIVDSASVQRHNQRHSKRYMLHLTSVVHLVFQVRVLCLQISCLCFARLLIVYRSLRTPADYYG

SEQ ID NO: 33990 - protein, 175 aa, Sorghum bicolor
  Clone ID: SORBI-28MAY03-C40683_1.pep
HGGAAVTSKSDVYSYGMMVLEMVGATRGGGGTGATTGGASTATSTRYFPEWLYEDLDRFCAEAAAAACGRGRGPDAEEATEEVVRKLVIVGLWCIRLSPQDRPTMSRVVEMLDKTTTADLQLPSSRSGLHVDALTSPQDGPRSGARPTKLSCIGHILLMSASLRSVPLSELGLLN

SEQ ID NO: 33991 - protein, 116 aa, Sorghum bicolor
  Clone ID: SORBI-28MAY03-C40688_1.pep
DPTGAGDSFLAGFATGLLWGLSATDAALLGNFFGAAAVSQVGVPTFHPKMLQAVKEILEEKTTKRYSPCINGTSFTFEKSNLHNELHAALQEAAMLMSEQQQADKANGNGGDICSP

SEQ ID NO: 33992 - protein, 126 aa, Sorghum bicolor
  unsure (1)..(126): unsure at all Xaa locations
  Clone ID: SORBI-28MAY03-C41064_1.pep
TPAARSAAPRRRPPRRAAASAGNPTGRCRPXARSRRMALQVTSLRSAGSPXRRRRHGPPPPRARRRVGPRPRRGRRARRRGATPQAPRGTPTAAAPGPRPPRRTAAYGGAATCRLGRRRRRHAGAS

SEQ ID NO: 33993 - protein, 139 aa, Sorghum bicolor
  Clone ID: SORBI-28MAY03-C41051_1.pep
AAELSTVRIDREKERGQLKEQNRRLRIQLRDTAEAVHAAGELLVRLREAEEASTLEKERTAALLQENEKLKKQLEKLRKKHEMELETMKVHLAESRLPESALGAFYHHENERTPEYSCDAPLTHDDDQSWRAAFASAYE

SEQ ID NO: 33994 - protein, 164 aa, Sorghum bicolor
  Clone ID: SORBI-28MAY03-C41113_1.pep
NQTRPKLLLYPSVNWHCTFLMYLSSKSQVPCACTCRLTKEDGKIFRFRKRNTTRVSRQTVFISLNIEEEQSGMYAGQWMRCQSSDRIRTPKWGQNLMARSMDTTIQRMGTGATPRNSSLSVENCLFPSKKIPCQQEIRSCICTCQRHCLAISSSRIWAACCLEK

SEQ ID NO: 33995 - protein, 139 aa, Sorghum bicolor
  Clone ID: SORBI-28MAY03-C41148_1.pep
MAAPFFSTPFQPYVYQSQQGSVTAFQISGGDVQVLQVMLKSQEKLTAKPGTMCYMSGNMQMDNNYLPENDGGVWQWIFGKSVSSTVFFNSGSDDGYVGIAAPFPGRILPVDLANFGGELLCQADAFLCSVNEVSVSSTV

SEQ ID NO: 33996 - protein, 161 aa, Sorghum bicolor
  Clone ID: SORBI-28MAY03-C4115_1.pep
LASNYLGLKDHKRPPQVEEGFHAGARLSPAELGEIMLANRGSPSRALRTVISALQHVAPSPSSAQPQRTSTAARPPRLTSRWSGHLDVASAAASDEASAAEQSPRSGGGGGFAKDTPIREIKKLYGMIKYRSRKDAGVVPVDDSAASLNGRGSDVCSEKDR

SEQ ID NO: 33997 - protein, 288 aa, Sorghum bicolor
  Clone ID: SORBI-28MAY03-C41190_1.pep
MTILQPTREALEGISLARMSRYKMSSEKDNCSNTIPCYPADSNFGCSFVPTTPSWPAEQQCLATPLGQANISHQNVNSHEDVCLRENEPNGPVLQHNVISHSCRSEKPLHSCSERDKSENKIPENSLGPEVSEQAGKYDGDAQTAESSDGTINWNASCTFARPRIFCLQHALEIEKLLEGKGGVHALIICHSDFVKLKALAISIAEEIEFQFDCTDIPLANASKSDLHLINISIDDEGHEEDGRDWTSQMGLNLKYSAKLRKEKSENQEQSPLSFGGLFCCPSPVSVV

SEQ ID NO: 33998 - protein, 110 aa, Sorghum bicolor
  Clone ID: SORBI-28MAY03-C41197_1.pep
MVLGLRTKTRKDSAFHVDFNILIQEISPWPPSESLKSLRSVVLFWENGERNSGKTSTVAPSIGSGSAAGKIEFNEFINLQAVFQKEGSSKSGKWQKNLLELNLYEPRRDK

SEQ ID NO: 33999 - protein, 162 aa, Sorghum bicolor
  Clone ID: SORBI-28MAY03-C40834_1.pep
KKSSHHQVNVCPVHRGMCSPATTFCLLEAGAVEGLLGCLENDNIRVVEAALGALSTLLDERVDVVKSVVALAELDAARCVLAALRQHRQNLLWQKCFCVVEKLLEHGDDRCVREVTGDRMLPTALVSAFHRGDESTKQAAESILRRLHRMPDYSATYVSMEF

SEQ ID NO: 34000 - protein, 204 aa, Sorghum bicolor
  Clone ID: SORBI-28MAY03-C40861_1.pep
WYVHAKKEDMSSILQGSLIEMTGPKRGIQLDYDVVFEFDMRIKNGEQQENDLQLIDGVTEFDETTLPGKPFTTRINGDAGAVDMCLTNVFGVEATVEIFISEVENGFDLSICCAVSVLEEHKEFQIFGAPIGESCGLRRFVIAVERDTMMHLKFEVHQHGSNVEHCCSFEAKVHGCASHDIKLEVASLSVKVTWSTLTEYTPCL

SEQ ID NO: 34001 - protein, 112 aa, Sorghum bicolor
  Clone ID: SORBI-28MAY03-C40881_1.pep
KWIEDTTPQFIYHKCGLASNTANVHHWVCRPLCPGHIYFMIYKTRYWQQSFLACIDPYRQSYPCVRLGVMIFCPMEDELCFCFVAALCLVLYPLVGCSNSFVVVNRPRIRIM

SEQ ID NO: 34002 - protein, 177 aa, Sorghum bicolor
  Clone ID: SORBI-28MAY03-C40892_1.pep
GDENTPCSMGRSGEDDQVIIDDFDGPQQEEHKEVSNNTNANEELGSDRKSSLSISASPRLSPIQDPTLCSSPKIHNKARKSITSPGLSPSKLRVSDSPGDRNVEVCRNSAVRSSLQSSKLSPTDSLAASLQRGLHIIEYHQQNPAPRKSFIGLSFDHFAVNPRQSTAKFSTVAQALP

SEQ ID NO: 34003 - protein, 70 aa, Sorghum bicolor
  Clone ID: SORBI-28MAY03-C40699_1.pep
TPEAAILLSSGKQRNHICSRVLPLCLANEVVLNLSKKSTCASRFISELPVNVEIYRGTSFDSLPQWPKMG

SEQ ID NO: 34004 - protein, 167 aa, Sorghum bicolor
  unsure (1)..(167): unsure at all Xaa locations
  Clone ID: SORBI-28MAY03-C41272_1.pep
MATTAPLRALRRPSSEAALRLATRANVQTTNGYRHLNNRNLSVFNEFSKQLKGEAKSNPEFQKSMKEFGEKLGVVKEDLKVRTKKTTETIYKSVDDVWSEAEETSKKVTANIKEKMFAAKEEVKESFGVGKEESTSCRDGSPEASNXEKTGTSSHSDGTSEDATNSH

SEQ ID NO: 34005 - protein, 83 aa, Sorghum bicolor
  Clone ID: SORBI-28MAY03-C41278_1.pep
AKLRQLDQLQTPGRFNDMAWRGRFVRFDLSEFCLFGAWVWHPGKTQVVLQHLPQWTLFQWQHGRFMLTCCCARVEFTPMNNLS

SEQ ID NO: 34006 - protein, 84 aa, Sorghum bicolor
  Clone ID: SORBI-28MAY03-C41290_1.pep
DQHGASSFSLQYVQRMLEESLGSVQKTIHEHVRNLHIELLRQFHMQEQMEMSGVLNLVMEKVEGLTKEVQQLRRENQQLRQQLL

SEQ ID NO: 34007 - protein, 132 aa, Sorghum bicolor
  Clone ID: SORBI-28MAY03-C41302_1.pep
MVTGIWLSPSLQSIFSNKLFMWVGRNSFAVYLTHGTVMKVGLARLIYGFSTAPYYVEQPEDGQGEAIQHYIPRTTNWLVWTVAIPLFFVVEYTIAHLWTTYVDSQCAKATKWLEDTMFEKIEDEKHGAANMA

SEQ ID NO: 34008 - protein, 56 aa, Sorghum bicolor
  Clone ID: SORBI-28MAY03-C41373_1.pep
KIDKVMRGPFYMDSLKAKEFGVIDKILWRGQEKYMADMLSPDEWDKVAGVRRPDPM

SEQ ID NO: 34009 - protein, 161 aa, Sorghum bicolor
  unsure (1)..(161): unsure at all Xaa locations
  Clone ID: SORBI-28MAY03-C41321_1.pep
PPASRPRAPRRRPTPPCPRSAAPSPGASCGPPPPSPAACTRSSPAPPPPPRARSASSPRRASPSPPTSSSTAGAPPCSAPAPPARGGSPSTPPPASPTASASSPTXRPPGARAPARRPAAAAAGLPLPVAPGAARPRPAPPASAAAAPAPAASAGPLLLGV

SEQ ID NO: 34010 - protein, 267 aa, Sorghum bicolor
  Clone ID: SORBI-28MAY03-C41020_1.pep
HEDVGLQQQILTIFKKYESYIDVEIQQRAVEYFELSRKGPALADVLAEMPKFPERESALLKKAEDAEIDTAEQSAIKLRRQQQTSSALVVADHPPANGSAPPANHLTLVKMPSQTVSDTQESGVIYEEAPKPPVEAPKENGTPVEVESRDTNITEINNEIKAEPPSTSHSTSPADLLADLLGPLAIEGPPAVEQNPAQGLNANQSPVDDLALATLEDQSNSVQPTVNVEEKFHILCTKDSGVLYEDPHIQIGLKAEWRAHHGRLILF

SEQ ID NO: 34011 - protein, 135 aa, Sorghum bicolor
  Clone ID: SORBI-28MAY03-C41033_1.pep
ISPFAHFTNTHLNFVYFEKAEFMSIENLKSFDPFAEADEDTGETKQAQSYIHIRIQQRNGRKTLTTVQGLPKKFDQKKILKVIKKQFACNGTIVPDSEMGEVIQLQGDQRKDLQEFLTSKDGLELKADTIKVHGF

SEQ ID NO: 34012 - protein, 189 aa, Sorghum bicolor
  Clone ID: SORBI-28MAY03-C41042_1.pep
MARAPSVPAATAVGIVVLLTAAAAAAFRGAEGKSCTNAFPGLTSSHTERAAAQLQRGPPATALQPVVHRHGHDHDHGHEQHLTPTDESTWMSLMPRRALRREEAFDWLMLYRKLRGATAGGAPRRPGVAAGTFLSDASLHDVRLEPGSLYWRAQQTNLEYLLLLDVDRLVWSFRKQAGLTAPGTPYGGW

SEQ ID NO: 34013 - protein, 287 aa, Sorghum bicolor
  Clone ID: SORBI-28MAY03-C41430_1.pep
HEALEEQLQLVNSEAAKLRDIVTALEHDVEKEKVFSAELQMQLEALEAIKKVLESEAESAHQDAKILSQKVESLEAKLKEQMSLTDEFTANVETLQSDRMAMEHKLKTADRELIKLTNKVSMLHREIEQERLLSEEYEQKCRKLEAQLSRDSRDAKLWRLANSNGDLKVKKEKELANAAGKLAECQKTIASLERQIKSLTDLDSVVLEPERLESSRDMPLPLDFRNNDAEFAMFTDDLYDFDLPNNNASFFSPLPSIQSSSPPSEMSVFAGGLSTLSSYRSKRASRR

SEQ ID NO: 34014 - protein, 171 aa, Sorghum bicolor
  Clone ID: SORBI-28MAY03-C41447_1.pep
FKSSNILLDKDFHARVSDFGLAKLGSDRAGGHVSTRVLGTQGYVAPEYALTGHLTTKSDVYSYGVVLLELLTGRVPVDMKRPPGEGVLVNWALPMLTDREKVVRILDPALEGQYSLKDAVQVAAIAAMCVQPEADYRPLMADVVQSLVPLVKNRSNQKASNPNVQSSKPLD

SEQ ID NO: 34015 - protein, 45 aa, Sorghum bicolor
  Clone ID: SORBI-28MAY03-C41524_1.pep
IFGEIAGMSFSPDAEALFVGVADRTYGSLIEFTRRHRYDYFDSYL

SEQ ID NO: 34016 - protein, 259 aa, Sorghum bicolor
  Clone ID: SORBI-28MAY03-C41529_1.pep
RRAAAPSSRPLVDDFFPFPSSPSSSPSRPRQRGPSLEPSSSDSGADGGAAGSSASDRRRRKLKLVVKLSQLPPDQHHRRAPPPPPYSDGSDGAEDLAGDGSGDEEQVKPPKKRRIEPRADRSRHREVGGGGRSDPASAPRTKRPSVPGTARTTPLPDRKALEMILEKLQKKDTYGVFAEPVDPEELPDYHDVIEHPMDFGTVRKKLARNAYRSFEQFEVRLLGFGCIFRQRMDNEIPYCGLLAVEVLLFSSFFFCRKRI

SEQ ID NO: 34017 - protein, 73 aa, Sorghum bicolor
  Clone ID: SORBI-28MAY03-C41532_1.pep
SASYEVLLTLDKKKHNFDGPIYYYVFNSLLFSLLVLHIYWWVLIYRMLVRQIMTRNVGDDVRSDSEGEDAHED

SEQ ID NO: 34018 - protein, 68 aa, Sorghum bicolor
  Clone ID: SORBI-28MAY03-C41550_1.pep
YAVVLRIREKIKAIYFRDISCTLIRTVRTYRFLHVGSPCAIINSKMGMHCHLSYLIFGLVNLSLQPNY

SEQ ID NO: 34019 - protein, 253 aa, Sorghum bicolor
  Clone ID: SORBI-28MAY03-C41234_1.pep
HEGPPGAILVFLPGVAEIDLLIDRLSASVRFGGASSDWILPLHSLLGPSDQRKVFQSPPDNFRKVIIATDIAETSITIDDVIYVVDTGKHKENRHEPRKKMSSIVEDWISRANAKQRRGRAGRVKPGLCFCLYTRHRFENIMRPFQVPEMLRMPLTELCLQIKSLHLGDIKSFLLKAVEPPNEEAISSAVDLLYKVGAFEGHEELSPLGYHLAKLPVDVLIGKMMLYGAIFGCLSPVLSVAAFLSYKSPFLSP

SEQ ID NO: 34020 - protein, 294 aa, Sorghum bicolor
  Clone ID: SORBI-28MAY03-C41221_1.pep
LILDCQPSEVPLQQDSTTEKIDKGENAHKPCDISPQTNPQRPIANNVSPAKLAQIERESSTGSEDSSESSDEGEAIVERSRPLVRSASPRRSASPMRRVQIGRSGSRRSTAIAIKSLSYFPPSQRIPLDKDDENSTCNGETDQPPRKSDNNVRRMSVQDAINLFESKQKDQNPDSQNKKAGLFATKSVLRRWSAGMGDSLNEKSEGKVSESTSESKSNMASETEKVGAEMKAELDNTPKNFVTPEVEDSTFHPNSHDIGVPETGSTVCSNICAEQAKFGLEESSDRAMASAEWN

SEQ ID NO: 34021 - protein, 190 aa, Sorghum bicolor
  Clone ID: SORBI-28MAY03-C41256_1.pep
MAMARRSASHLLSSFRPFSLLLQPHLADSPSPAAAAAAASARRAMSAASALRARDEKDVARWRESMARMRNIGISAHIDSGKTTLTERVLYYTGRIHEIHEVRGRDGVGAKMDSMDLEREKGITIQSAATYCTWKDYQINIIDTPGHVDFTIEVERALRVLDGAILVLCSVGGVQSQSITVDRQMRRYDI

SEQ ID NO: 34022 - protein, 166 aa, Sorghum bicolor
  Clone ID: SORBI-28MAY03-C41270_1.pep
ARGRVPLWGCPSCPRVGGCTGDAPSSPGACSDGTSALCDGLPPVLGLRRSGSGGRPFDLLQRVLPVLRRPGPEPHAIVPQVSGTGVPGACQSCLCLRYPVGKAFLVPEVGAAHIPFVISPNPFSGFQNPMYILKSPRSLLPEKIKSVLGDDHMESNEETYDIYLLP

SEQ ID NO: 34023 - protein, 117 aa, Sorghum bicolor
  Clone ID: SORBI-28MAY03-C41605_1.pep
FQLNQEKLVRMLGNIQSMLLVGWRLCKLYESGKMTPGHASLGKAWNSRMAREVVSLGRELLGGNGILADFLVAKAFCDLEPIYSYEGTYDINSLVTGREITGIASFKPAAALAKARL

SEQ ID NO: 34024 - protein, 165 aa, Sorghum bicolor
  Clone ID: SORBI-28MAY03-C41644_1.pep
YARAAGLRHAAELQGYSVRSLYKALRSFGKQGSLVRVAVWCIGEYGEMLVNNVGMLDGEEPVKVTESDAVGIVEVALNRYSADVTTGAMCLVALLKLSSRFPSMSERVKQIVAQNKENVVLELQQRSIEFTSIIQRHQSIRSSLLERMPVLDEASYLVKRATATQ

SEQ ID NO: 34025 - protein, 109 aa, Sorghum bicolor
  Clone ID: SORBI-28MAY03-C41609_1.pep
MPSHGPAPMPSRAPLPDRYGAPDRYHHTPPAPVYEAGPFSSYGEPFSAPKPFQYTPGSVAASYNSSPYKVAYGGPGAPAASTYAGYGGASGPAGSSSYANYLVYRPPQP

SEQ ID NO: 34026 - protein, 49 aa, Sorghum bicolor
  Clone ID: SORBI-28MAY03-C41645_1.pep
AKTTVNMYDYEKRNFHKKVMVERTQKSCTIPILTVVVIGKTLRRYLSSC

SEQ ID NO: 34027 - protein, 119 aa, Sorghum bicolor
  Clone ID: SORBI-28MAY03-C41666_1.pep
MPGSPEHGVAAQEAFFRSEANPAPKSTARQQLGGAGDCYYYRKRRDPKCRAARSSKAVGSSKRSSSRDLSDQSEAHARRLLMDAGWRIRPRIRKDRPRVAYYFTAPQREAVLASLSQAW

SEQ ID NO: 34028 - protein, 183 aa, Sorghum bicolor
  Clone ID: SORBI-28MAY03-C41687_1.pep
ARGTIEALQLLAKGAGAVLGPQSSAVAHVISHAVNELHVPLISFAATDPALSSLEYPYFVRATHSDYYQMGAIAAIISQYQWKQVIAIYVDDDYGRGGISVLGDALAKRKCKISYKAKLPPGAAKTSIKDILMQVNDMESRVYVIHVNPDSGLNVFLAAKSLGMMSSGYVWIATDWLSAVIDS

SEQ ID NO: 34029 - protein, 159 aa, Sorghum bicolor
  Clone ID: SORBI-28MAY03-C41683_1.pep
MGYVLSAVARVLEQPTAWGAAWEMALLAGPLWAAALLGLLLGWAWRPRWAAGLVVATADGGSAAAAAQALAQPPFATLDFWKAQLPARLRAPLGYAGAAVQQREEDEDAVQGSSEMANEELAVGKDDLVNLWGLVEGRDGGPAWIKMMEKSLPTMTYQA

SEQ ID NO: 34030 - protein, 71 aa, Sorghum bicolor
  Clone ID: SORBI-28MAY03-C41388_1.pep
MVIQHQTGVVVIDGWLRLSAAAQTAVLFKQLRITLDAVLKELTRKPEMATFVDNEVVRSIIHLLLEEGKAR

SEQ ID NO: 34031 - protein, 120 aa, Sorghum bicolor
  Clone ID: SORBI-28MAY03-C41398_1.pep
KRAKTLEKAFSSMEGVSCNKLEGALYLFPRLHLPSAAIRAAESKGVSPDTFYAHRLLDATGIAVVPGSGFHQESGSIHIRCTILPDEGKIASMIPRLCAFHKAFMNEFRGSQQRMHDLRR

SEQ ID NO: 34032 - protein, 141 aa, Sorghum bicolor
  Clone ID: SORBI-28MAY03-C41413_1.pep
PSSSCVSPLVTAQNSVQRKHYASSIQHEPIHRRNPPHTNPPALPDLWSSHSQALPRFGSAPPVNSSSVFQQRPPWLAALVTVRTAVPVCSARPNVGTAPARPASQNRSAPARAEPESRTHNGERDLNSAAISSSEFNKLHI

SEQ ID NO: 34033 - protein, 103 aa, Sorghum bicolor
  Clone ID: SORBI-28MAY03-C41437_1.pep
PFHAIISTAYLKWQLLHFTALLQRFLVGNASIEVIEPSFHSCSTHGGIIMSLYNMHVITEPSRTERDSLHKIGPSLAWHPKKASDLHLSNSSAKPCLDHTFTL

SEQ ID NO: 34034 - protein, 168 aa, Sorghum bicolor
  Clone ID: SORBI-28MAY03-C41777_1.pep
LKRKLDKITIPFPNCNFQSPVYDVKILWNLLGQGNLALDTKGDFQRPNDHQRVCPSVWGAMLYGVPLLVGLLGFSGRSLLCVWWAPYDGSAVLCSTQNPRSISIGCWMTTSWLFFFFVGTSLSCFIIGEEILFFGRRTYTFVYLYECMVYQQLISSRLRLAGNLFQTY

SEQ ID NO: 34035 - protein, 189 aa, Sorghum bicolor
  unsure (1)..(189): unsure at all Xaa locations
  Clone ID: SORBI-28MAY03-C41793_1.pep
HEGYYQPNYDSLAGAWEWARKTLMDHAGDKREHIYTREQLENAKTSDPLWNASQLEMVHHGKMHGFMRMYWAKKILEWTSGPEEALSIAIYLNDKYHIDGRDPNGYVGCMWSICGLHDXGWKERPVFGKIRYMNYAGCKRKFDVDAYISYVKSLVARAKKRKTEEYLNPRSKNPKSELGQQLNMSKALI

SEQ ID NO: 34036 - protein, 208 aa, Sorghum bicolor
  Clone ID: SORBI-28MAY03-C41802_1.pep
LLPSAYELRSDSPSSQFAHARPPPPPLRTPHAVRTRRSRERSGRRESSGSSAVSVLRGRIRIRRRSTSIGRIRIWYWLPKGSMSTISDQKKRTLEALQQQYTAAKAKKLQDEQVKSQKKSNFNTPKPKFDAPRKGKGPEITPRQTYAQPSPHKGVAFSSSNRQQKPSASSGDRPTPLSRALSGPLHHVLACVPVPHLLGTVVVHSVIY

SEQ ID NO: 34037 - protein, 190 aa, Sorghum bicolor
  unsure (1)..(190): unsure at all Xaa locations
  Clone ID: SORBI-28MAY03-C41826_1.pep
PRRPAPRRLRPPAPPAPPRGARPAAAGRRALPPAAAPAPPRRRAPPPAPAAPCRRASSPPRSSRPRTRALRRPGGSGRSPPGRRPAAARSAPPPAGLLALGAGPRGAWRRAASPLRRRMRCELPDRPAPRPGPALRAPRRPLALRKMRFTEGDXLPVGLRGVFGGVVXNMHMHWKFHETVQVCCDNFPKE

SEQ ID NO: 34038 - protein, 148 aa, Sorghum bicolor
  unsure (1)..(148): unsure at all Xaa locations
  Clone ID: SORBI-28MAY03-C41833_1.pep
MHLAAAVVPRVHACRPTAFLAHSSLPMLPIPLCGPEALERTHWPPPARLSSVRGRALTVPHXRWDARAVWASPGQAPGGWHIDGQKRWIGNSTFADVLVVLARNADTQQLNGFIVRKGAPGLKATKIENKIGLRMVQNGDIVFNKVFV

SEQ ID NO: 34039 - protein, 315 aa, Sorghum bicolor
  unsure (1)..(315): unsure at all Xaa locations
  Clone ID: SORBI-28MAY03-C41874_1.pep
ARGANPCPNGPETSEVLSSNNGSTYSERKADGPKNPGPENDSLPSTSKHDPDGKDYRSEVGQKQRTYSGPVLQSGPHDSSMTERGHIIERDAGVRSVSDKQKNGTRRARGLSGPLSLSTRASANSLSLSRTNNLSGPLSLSTRASANSLSAPIRSSAGYVGSLGDKPKRTMVEIKGRFSVTSENVDLAKVQEIPGSSTPRKLQEGPSLRKSASVGDWSVNDKTTSTNHQRKELCNSSVSTSILIPHLQNLVKQTAFQQDLITNLLSSLQXNERVDAQSRVQSTGSDTVVEAATAEREHSLLVKIXELQSRMISLT

SEQ ID NO: 34040 - protein, 271 aa, Sorghum bicolor
  Clone ID: SORBI-28MAY03-C41839_1.pep
AAVSSLAEVRQKYKVELAEILDASGSKDKKVSTSINDNNASRASEENTPASGLGEASEASPVETKPPPGLKQLCEQMDTKGLLKFLSENSRKLASLRDELSVALKCATDPARFVLNSLEGFFPPPEQTNSPGSKHNALEVQRKSCIVLMEAIAPALGTTEPGGNDPWSSEIKEQAKAIAEEWKSKLAEVDLDASNGYSLEAQAFLQLLTTFNVDSVLDEDELCKIVVAVSRRKQTAVCCRSLGLNEKIPGIIEELVKRHRQIDAVHFVQAF

SEQ ID NO: 34041 - protein, 127 aa, Sorghum bicolor
  Clone ID: SORBI-28MAY03-C41568_1.pep
IRKVLGLSNMGFVVSPKVSDEDESKRYEQEIMEFGTPSSEYVIIATIALLNLVCLVGGLYQIILASGENKMALNVFFLQVILCGVLVIINVPIYEAMFLRKDRGRIPFSVTLASIGFVMLALFVPFF

SEQ ID NO: 34042 - protein, 159 aa, Sorghum bicolor
  Clone ID: LIB3481-035-P1-K1-D7.pep
ARVRAGPAGVRDGGGHGARGAPGGSIAGGCEYNLSELRMECHMGTHVDAPGHINQAHFSAGLDVDTLDLEVLNGPALLVDVPRDTNITAKAMEFLKIPRGVRRVLFRTLNTDRKLMWRKGGDMSYVGFTEDGAQWLVDNTDIKLTGVDGLSVAAFDYLI

SEQ ID NO: 34043 - protein, 98 aa, Sorghum bicolor
  Clone ID: LIB3478-004-P1-K1-B9.pep
EFLKIPRGVRRVLFRTLNTDRKLMWRKGGDMSYVGFTEDGAQWLVDNTDIKLIGVDGLSVAAFDYLISAHVVFFKTPDIIPVEALKLDDIEAGIYMLD

SEQ ID NO: 34044 - protein, 115 aa, Sorghum bicolor
  Clone ID: SORBI-28MAY03-C41591_1.pep
PSAAVASPDWGVPFLLFVFVAVQYDLELVLTKNFHEFVHEYLQKPEFTELMRRLGALGDGRQDQSTLSQDEWEVSYLYLAFVLRKRGQPPAQRRANNANRGKMFLTEGDIEVLGI

SEQ ID NO: 34045 - protein, 98 aa, Sorghum bicolor
  Clone ID: SORBI-28MAY03-C41598_1.pep
KRSNVQTVVLMENHVYSSSSSRFPLDKYMSDTANERIDNHWSSPSCITSTLLFLEFSVTIPTFISIFLHFTNLAIAFPVVITVLTTAVEIWEIHLWGS

SEQ ID NO: 34046 - protein, 242 aa, Sorghum bicolor
  Clone ID: SORBI-28MAY03-C41949_1.pep
HEAALVRNVTLVGHLQHGKTVFMDMLVEQTHEVDTFDSEGERHVRFTDTRVDEQERQAPGKAVPMSLVLEGGNGKSYLCNIMDTPGHVNFSDEMTAALRLADGAVLVVDAAEGVMVNTERAIRHAIQERLPIVVVINNVDRLITELKLPPNDAYFKLRHTLEAINDLISSCSTTVGGTQLVDPAAGNVCFASGAAGWSFTLQSFAHLYLKIHGIQFDHEKFASRLWGDLYFHPDSRTFRKKP

SEQ ID NO: 34047 - protein, 179 aa, Sorghum bicolor
  Clone ID: SORBI-28MAY03-C41937_1.pep
HEGKQELVTFSQFLDRMWSTVCPSKLTYLAQHPLFEQIKELSEDIVVPEYCYAGGGELQSLNAWFGPQGTVTPLHHDPHHNILAQVLGRKYIRLYPAFISEDLYPHTETMLCNTSQVDLDNIDFKEFPRAENLEFMDCILEEGDLLYIPPKWWHYVRSLSTSFSVSFWWRAAVQPSGGS

SEQ ID NO: 34048 - protein, 320 aa, Sorghum bicolor
  Clone ID: SORBI-28MAY03-C41950_1.pep
MESRMDQYEIMEQIGRGAFGAAILVNHKIEKKKYVLKKIRLARQTERCRKSAHQEMALIARLQHPYIVEFKEAWVEKGCYVCIVTGYCEGGDMDELMKKSNGTYFSEEVLLKWFAQLVLAVDYLHSNYVLHRDLKCSNIFLTKEQDIRLGDFGLPEAGTHLHGPPSVVGTPNYMCPELLADIPYGFKSDIWSLGCCMYEMAAHRPAFKAFDMAGLISKINRSSMGPLPACYSVSMKTLIKSMLRKSPEHRPTASEILKNPYLQPYVNQYLPLYDSSNPMRMPEKPLPTSRNSQRSMSDSQSSSISSSDIDSAQSSDRSTS

SEQ ID NO: 34049 - protein, 192 aa, Sorghum bicolor
  Clone ID: SORBI-28MAY03-C41956_1.pep
ARGEIDASLVQPGDALKVLPGSKVPADGIVIWGTSHVNESMVTGESVPISKEVSSLVIGGTMNLHGILHIQATKVGSGTVLSQIISLVETAQMSKAPIQKFADYVASIFVPIVITLSFLTFLAWFLCGWLGAYPNSWSAESSNCFVFSLMFSISVVVIACPCALGLATPTAVMVATGVGASHGVLVKGGDAL

SEQ ID NO: 34050 - protein, 143 aa, Sorghum bicolor
  Clone ID: SORBI-28MAY03-C4199_1.pep
NPRVFPRVQKFPIQSYMGRDKNLWRRKHHNLIKCLDIRLKTVVLTNYRGIRSQVNFATFFVLNAKMLESMTFRCRRYLVTDGILAEQQRLLQLQKKASRCARFYFTTKICERNFMHINHAHDLSKTDPFECEETKVGVCASFE

SEQ ID NO: 34051 - protein, 155 aa, Sorghum bicolor
  Clone ID: SORBI-28MAY03-C42003_1.pep
MDRKVASNTELDSAVFQVSSPDNRYEAIACSKGKTELIASGPFDQLVLHLEDAKAFQSCSQSGTFKLLLTGDEKGSSWFTKSTLQRFLHIINSCDTSKSVNGVLDEMSQLEETRKFHQSLYVKEEQNVTSGALTGGLFGTGAIAQQGNDGHNSSE

SEQ ID NO: 34052 - protein, 168 aa, Sorghum bicolor
  Clone ID: SORBI-28MAY03-C44901_1.pep
MAEAVASAGRLAMEPSTSVTPGQVSAILGFLWVFAAWAYAEVLFHRKNTASIKTRHSDVNLAVMDNISVKAEDQTMLLEEGGQAVVAKPAYTSLTSQILRLIFMDQMLLLENRLTLRAISEFGGYLLYFYICDRTNLLGESAKNYSRDLFLFLYFLLIIVAAMTSFKV

SEQ ID NO: 34053 - protein, 118 aa, Sorghum bicolor
  Clone ID: SORBI-28MAY03-C4490_1.pep
MLFIFFFFQDNSARCWISHENHLEEIFVNSNFPELRESADLSEVSDRCYGLTLAPGEQMIAVVRSLDLNLLNQMYQVRTQKAVVEFIWIGGQFVGIPLDRSIDICSPESADLSSSNLM

SEQ ID NO: 34054 - protein, 125 aa, Sorghum bicolor
  Clone ID: SORBI-28MAY03-C44910_1.pep
MARPKKTAVAGLPDDLLVEILSCLPINEIHRCKCVSKGWRDLIADPLHHKKLPQTLHGFFPSYVGELGSFINLSGGSASTFDPSFAFLKKLPGIHNIWLRASCNGLLLFRHSTRLRELGYIVFNP

SEQ ID NO: 34055 - protein, 92 aa, Sorghum bicolor
  Clone ID: SORBI-28MAY03-C42121_1.pep
LLFGTSGEYAGFDPTEPTSRSGGKAKAVQKIKQDHGYKTVVMIGDGATDLEARQPGGADLFICYAGVQMREPVAALADWVVFDFQELITKLP

SEQ ID NO: 34056 - protein, 136 aa, Sorghum bicolor
  Clone ID: SORBI-28MAY03-C42113_1.pep
QFQDPCASFTLPNVICSYCNDCRDLDLCRDSTLQGQEWRCAVPQCGQPYHREQMENALLQVVRQRERLYHLQDLVCVRCRQVKAAHLSEQCSCGGSFRCKQESSYFLSKMRVFLKVAVNQKFQLLQDCVQWILEVR

SEQ ID NO: 34057 - protein, 88 aa, Sorghum bicolor
  Clone ID: SORBI-28MAY03-C42129_1.pep
SVVIAMNDALSHPLASRVWALLLNLCSFGVQVSQQVISIFVIHLPSRVVIFRSFHVQKRVWFCFSMESTWMVILFSASHMFSPCILCG

SEQ ID NO: 34058 - protein, 110 aa, Sorghum bicolor
  Clone ID: SORBI-28MAY03-C42160_1.pep
CGDDCCGGGPEFPKWLGRTSLGPTSHGHPTNQAINPKVRDQSTRRPSWITTGSNQSIESVGIVDFCGAAGHHDGGAATGCGCACCVCGWATNGCCSSRIADGRFTGFFWR

SEQ ID NO: 34059 - protein, 53 aa, Sorghum bicolor
  Clone ID: SORBI-28MAY03-C42165_1.pep
SELGIYGAYLRNKDKVILNNQSGYLMRTKVSSSNEGGVAAGFAVLDSVLLTDE

SEQ ID NO: 34060 - protein, 114 aa, Sorghum bicolor
  Clone ID: SORBI-28MAY03-C42202_1.pep
DLFLCSQVDVKGPRRPVKYLVLRDDNNFTADELQALTNNLCYTYTSGTRSVSIAPPAFYAQKLAHRALAYLAKGSDTASASSSGSAGADAAAPGDGPKQLPEIKKELKGSMFYC

SEQ ID NO: 34061 - protein, 129 aa, Sorghum bicolor
  Clone ID: SORBI-28MAY03-C42223_1.pep
ENLEVPRRHHYNDPKENLCRSVALLSPTVWFLSFHVHVHSACITHHLSFCETIKCFAGYQFGHYLPSSTTIEIPKESADCLIFKVQRCTAKQASHILISQQSEYGAEKQGSRINIQSKPPCSTSAMIKS

SEQ ID NO: 34062 - protein, 143 aa, Sorghum bicolor
  Clone ID: SORBI-28MAY03-C41880_1.pep
MVSQHGILLAVNIISDHFGPIVSKVCGCLLRHGALSLLEIGRRLELSPAQVKNSLLILIQHNCVQAYTSPRGGGDKTVTLYLAIFDNVLHRLRFSKFLSVVRVDIPESEVLLEGLLQNGRLTFEQLVERTIFKVPEGSPLPTR

SEQ ID NO: 34063 - protein, 121 aa, Sorghum bicolor
  unsure (1)..(121): unsure at all Xaa locations
  Clone ID: SORBI-28MAY03-C4191_1.pep
SADAWVLILEEKHSRGLTEITDDFCPALXMRQLYRISTMYCDDKYGTLGIPSEVISSMRIKMIEGSSTPSAHDDINSFLLDDDFSIPFSVDDFTKLIVHVDVADMDLPPLIQESNGSKLGH

SEQ ID NO: 34064 - protein, 217 aa, Sorghum bicolor
  Clone ID: SORBI-28MAY03-C41912_1.pep
MRWAAFLWEGASRASGGRRPGVSNLLLVVAAASSGGLVAYADARADAAVEKPQLPPRKKVVVLGTGWGGTTFLRNLDSRLYDVQVISPRNYFAFTPLLPSVTSGTVEPRSIVEPIRRILEKKGGEIKFWEAECFKIDPQSKKIHCRSNVGTNLEGNGEFSVDYDYLVVAVGARTNTFNTPGVVENCHFLKEVEDAQKIRRSVMDCFERASLPFLNEE

SEQ ID NO: 34065 - protein, 226 aa, Sorghum bicolor
  Clone ID: SORBI-28MAY03-C41932_1.pep
WLAEDQHKALVRPEETPKQKKRSLSKMMGKPDAAEDEAKIDSAEQLAAGKRERKKSKYLSPPYTNLVVFDKIAREPVDLPKALVPKAAEDGRNVSLLPGSIVVEDVLLLVRGLGEVPNHMGDFPKDADEFLRLFRSMTFIHGADYKSSKAHESPLMRGSRNVGMNIAVDLVSDSHAVLKQGSCVSKRGRKKDEAGSGGSSIKRKKREKTSPAATIGAGIPTTPAIP

SEQ ID NO: 34066 - protein, 246 aa, Sorghum bicolor
  unsure (1)..(246): unsure at all Xaa locations
  Clone ID: SORBI-28MAY03-C4229_1.pep
IDCATGRPEEPIRTVDWEGKVALIQCAKAMGIQKYVFYSIHNCDKHPEVPLMEIKYCTEKFIQDSGLDYIIIRLCGFMQGLIGQYAVPILEEKSRPGTDAPTRIAYMDTQDVARLTFIAMRNEKANRKLMTFAGPRAWTTQEXLLCERLAGQDANVTTVPVAVLRFTRQLTRFFQWTNDVADRLAFSEVLSSDTVFSAPMNETYQLLGVDGNDILSLEKYLQDYFTNILKKLKDLKAQSKQTDIFF

SEQ ID NO: 34067 - protein, 108 aa, Sorghum bicolor
  Clone ID: SORBI-28MAY03-C42304_1.pep
SFISTQKFGVQKALQKNFRKYMTFKKDYNELLLLLLRTLVKDALHFEEIMAGSTSRLTHVEVKVEDLKNKAQEYEIYDLKPFFSSAHFRDNSFLLDEGRGIIRHPLAE

SEQ ID NO: 34068 - protein, 72 aa, Sorghum bicolor
  unsure (1)..(72): unsure at all Xaa locations
  Clone ID: SORBI-28MAY03-C42331_1.pep
MARQSALSLARDQAKVGALKRLTLGSSKTAGRNSSGRITSYHRGGGAKRLQRKVDVKRDTSSLXIVERIEYD

SEQ ID NO: 34069 - protein, 178 aa, Sorghum bicolor
  unsure (1)..(178): unsure at all Xaa locations
  Clone ID: SORBI-28MAY03-C42335_1.pep
HEGARRRRGPDNLGYESRCLLADGTVVVSDGYNDGVEGKVGVSDSGVADLFFIGATLHLRGAKLVSQPLVAPTGSVLVYNGEIYGGIQVADDENDTQALFTSLESCCSCDCHALGRDKTCPCCGSGATSVLQLLSTIKGPWALIYWQADEVKYXWFGRDAFGRRSLLVHWPTADDSFI

SEQ ID NO: 34070 - protein, 66 aa, Sorghum bicolor
  Clone ID: SORBI-28MAY03-C4236_1.pep
INRYILYKLADQMITEQHHKDMSNITIIERLCQLLSTTAKTSHNTKMKPNLNLSVRQLADIQNLHK

SEQ ID NO: 34071 - protein, 143 aa, Sorghum bicolor
  Clone ID: SORBI-28MAY03-C42418_1.pep
LALTTHGVPSAPYPGRGGNTGSARWTWMPSASNSFHSGAAASSTTAFPAWRISAAMAGQALADARRVVIAVLVAVPRLSAARVCLVSPVVAGDPRLIDRRVGLVATAAPSATAMPRHGRNSIPSRSLRSLLRTWKRRKGNPRA

SEQ ID NO: 34072 - protein, 279 aa, Sorghum bicolor
  Clone ID: SORBI-28MAY03-C42382_1.pep
MSSPCVSHHHQVRLRAGGRLPAPAAASFAPPAALRGRRRVARAAMSAEARPGVAPAEEGAATPGQQQALLAEMVENAAVWCAVHGLVVGDRANQRSGTVPGVGLVHAPFSLLPARFPASFWKQACELAPIFNELVDRVSLDGEFLQAALSRTKQVDEFTARLLQIHEKMMPINKKEDIRLGLHRSDYMLDSETNSLLQIELNTISSSFPGLGSLVSELHRTLLNQYGKILGLDPKRIPQNWAATQFAEALGKAWAEYNNDSAVVLMVVQPEERNMYDQY

SEQ ID NO: 34073 - protein, 243 aa, Sorghum bicolor
  Clone ID: SORBI-28MAY03-C41997_1.pep
MLLRCGRRAALLLAAAAALSRGRDPDTAVYASVSPPQTLRQALPTAAPAAEGLRSATRLFSPWLLPYPYQGFPILNTFASASVSPANDRDQGSDGSSGDSRCCPGCLGRNSIAKAASAVGPAVVNISSMHDMHGWVQEQSIGSGTIIDPDGTILTCAHVVADFQSTKAIVRRKVSVTLQDGREFEGVVLNADRVSDIAVVKIKSATPLPAARLGSSSRLQPGDWVVAVGCPLSLQNTVTAGIV

SEQ ID NO: 34074 - protein, 123 aa, Sorghum bicolor
  Clone ID: SORBI-28MAY03-C42032_1.pep
KGPRVLEIIQAIDSNTDGLVDFKEFVAATLHIHQMAELDSERWGIRCQAAFSKFDLDGDGYITPEELRMVQHTGLKGSIEPLLEEADIDKDGKISLSEFRKLLRTASMSNVPSPRGVPNPQAL

SEQ ID NO: 34075 - protein, 133 aa, Sorghum bicolor
  Clone ID: SORBI-28MAY03-C42107_1.pep
RIGTWVHDIECRPGQGGNMVRAAGTYAKVVQEPGVQCVLRLPSGAEKIVDSKCRATIGIVSNPSHGTRKLRKAGHSRWLGRRPVVRGVAMNPVDHPHGGGEGRTKGGRPSVSPWGKPTKAGYRSPNVASRKTS

SEQ ID NO: 34076 - protein, 75 aa, Sorghum bicolor
  Clone ID: SORBI-28MAY03-C42112_1.pep
EEADEPASPMAACVHQSPSFSNGAEALPGHTPTVSHQISHEHVLATPGFGSVELISSWMEHHCLSVVSDHRSSHM

SEQ ID NO: 34077 - protein, 51 aa, Sorghum bicolor
  Clone ID: SORBI-28MAY03-C42543_1.pep
CGIGHIIQPHHVTLDNVSKKELMSKSTKFHIMTTLSGINFQFSKGQNSFIV

SEQ ID NO: 34078 - protein, 278 aa, Sorghum bicolor
  unsure (1)..(278): unsure at all Xaa locations
  Clone ID: SORBI-28MAY03-C42565_1.pep
MGAAVAGWTVAAVLLQVAGLSLFLYGFFPVKPTLRGFSGEESYQVPSCGSVSAGQQEPALPPDQLRSLYRVRHGLPAEFVLGRGRKPPSKEMMAPGPYTQSLLAGCKAAAYHAKAAPPTVTMPRLKAMVSGAIGGFLDVAFNFNTQAFLEDNLLDQLHMIGLKLVMLGDETWIKLFPTLFTRQDGVSSFYVKDTVEVDFNVSRHLEFELAAKDWSVLVLHYLGLDHVGHIGGRRSVLMTQKMKEMDDVIRRVHAASLLDNMNRTLFVVVSDHGMTEXG

SEQ ID NO: 34079 - protein, 199 aa, Sorghum bicolor
  Clone ID: SORBI-28MAY03-C42579_1.pep
RFRRATEYYEAGVTFRRWCSSEAGSQRRRRRPVLDVAFNNGVLSVALQDIHENTGYILRNVLAYEQKYNRTAMSPDTSYVTAYVVFMSQLLGSAEDVALLSRHGVMEHLLGDDGEVCALFRGLADGLAFDPVSDHYLSPVEVALQDHCRHRRYRWRAWIVRHRFSNPWLVAAWLFGGSAVLCTIVQTVFTVLSYLQQPH

SEQ ID NO: 34080 - protein, 298 aa, Sorghum bicolor
  Clone ID: SORBI-28MAY03-C42599_1.pep
ARGLATYLETLGADISGALWSAEILIENPSLIKQAHLDYYRAGANVAITASYQASIAGLVKHLALSEKEAKDVVQKSVQLAQEARDQHASEADANVRDQLFIAGSVGPYGAFLADGSEYRGDYVIPKEEMKSFHRGRIQALVEAGVDILACETIPSKAETEALIDLLTSEFPSSEAWFSFTLRDSSHISDGTPLSEIAALFKGVEQVVSLGFNCVPDDVALAALQTLEPLVKKGTMVVYPNSGEQWNAKAREWEGTRTEGSTLAKKTEDWRTAGAGLIGGCCRTTPEDISVMKKALAL

SEQ ID NO: 34081 - protein, 165 aa, Sorghum bicolor
  unsure (1)..(165): unsure at all Xaa locations
  Clone ID: SORBI-28MAY03-C42665_1.pep
DKTLHKQWVQVVAMQFLGMAGHFGLGNTNSLASIDVAGAFIGISSYSTVLSGILMFMITYASPLMLYLGLVLHVSVKDIDDISTLRHLKWSYILDKMVTLPCLFPLLINSLAXDFIHHCFATHEESLICLERIFTKVPLCLRSNSVHVCRSIRHSYDCSLQLRCF

SEQ ID NO: 34082 - protein, 90 aa, Sorghum bicolor
  Clone ID: SORBI-28MAY03-C4272_1.pep
LTALDNIDRLQQLQRPAATATFRGLHQFEKGAVDNLNSMKNMAWTIYSQLPCFCLPTMKQGLIFMALAYFVCPGSESDSLRATMVVSCNH

SEQ ID NO: 34083 - protein, 163 aa, Sorghum bicolor
  Clone ID: SORBI-28MAY03-C42666_1.pep
EFAATSSGYTKEVEDMLKVLSPMMVSFIKNLPAIEGPSPDIDVVLSVLLQSTLPVAQSAGKAGGVSELSGIGKAGLNQNGSVHRPPRERRKDVERQGVQEEEDASTVQSRAAVPRDIFRLRQIQRSRGLGVGAAAAASQSGSSAFSFSGGGSAFSGDHSASTD

SEQ ID NO: 34084 - protein, 103 aa, Sorghum bicolor
  Clone ID: SORBI-28MAY03-C4331_1.pep
MSRLAPHGYRIPFVVLQEATNNFDEKMVIGVGGFGKVYRGVMQDGTKIAVKQGKANQMSGQGLSEFRTEIDVLSKLRHRHLVALLGYCNEHNEMILVYEYMEN

SEQ ID NO: 34085 - protein, 97 aa, Sorghum bicolor
  Clone ID: SORBI-28MAY03-C42250_1.pep
LNSRVRVIHQYLVAMQKGDIPVDNSLLRQVSSLVRRLPAMESQKFQDDFLMEYSATLLMTYLAMFTNCSSTMNELVEKINPSYESPTARRGGRGAFM

SEQ ID NO: 34086 - protein, 136 aa, Sorghum bicolor
  Clone ID: SORBI-28MAY03-C42264_1.pep
VMMATLLARSNRYAEIALFVSNKILEPRRLRARLLTALGRRRPPSWLLAIVMLRERGLHHDYVTAMLQEGYYLEALRYARKYKVITVQPALFLEKAVAKNSAHNLAAVLSFFCEFTPSFKTTSDFGRYRHILSEMV

SEQ ID NO: 34087 - protein, 119 aa, Sorghum bicolor
  Clone ID: SORBI-28MAY03-C42267_1.pep
SLDYPKHVRKEIVKQLKECNSLYEGYVPMKYKHYCKKMKKSGEWGDHVTLQAAADKFAAKICLLTSFRDTCFVEIVPQYQSPQREIWLSFWSEVHYNSLYDARDLPSKYKPRKKHWLLF

SEQ ID NO: 34088 - protein, 169 aa, Sorghum bicolor
  Clone ID: SORBI-28MAY03-C42886_1.pep
MEVEEPLPTSKNPRRARRRDLNALDPSMEESDGEDIGVPEVGMVFNNHTEVNRFYRKYARRVGFGVSVRRSSFSQEGTCLYLELMCCKGGRPRYEPKFRKRASSTTNCPAKIRVKLWGDKLLHVELAILDHNHPVSPAMARFLNSYKQLSGPAKKRMRMGGPGAMPIEE

SEQ ID NO: 34089 - protein, 106 aa, Sorghum bicolor
  Clone ID: SORBI-28MAY03-C42818_1.pep
LGVSLHTSSSGLDLPMKVVDMFGCGLPVCAASFSCIEELVKVNKSARLFSTSSELADELMMLFKGFPEECNALKSLKEGAMKSASSSKWSTEWETNALPLVNQVIG

SEQ ID NO: 34090 - protein, 98 aa, Sorghum bicolor
  Clone ID: SORBI-28MAY03-C42938_1.pep
RGRRVVTFHNQRDYIFFRHHRYIFDTKEKKVASKDKKAKTSESKSESEKQVICRLQECGPRFVLKLLTLQHGTFDTKSGEYEWVHKPDMDTSRRRFFL

SEQ ID NO: 34091 - protein, 86 aa, Sorghum bicolor
  Clone ID: SORBI-28MAY03-C42942_1.pep
EGPIRIRGEGRHRFRPFRYRHLGQFAPLGGEQTAAQLPGDWISIGHSTQWLWYSVYATKQISWRTRMLVVSDWTRRFIFGRDSSCI

SEQ ID NO: 34092 - protein, 114 aa, Sorghum bicolor
  Clone ID: SORBI-28MAY03-C42998_1.pep
KLDISGTAKAVISCFQKLGVSFDMNEVKQVRDPEEQVALVGVPEEHLGGHAFHMYHLTSPDGTVSFEFQHNVCGRSIYAEGTVDAAMFLYTKIKSGASKKLYDMIDVLREGNMR

SEQ ID NO: 34093 - protein, 111 aa, Sorghum bicolor
  Clone ID: SORBI-28MAY03-C43001_1.pep
HGYTSGLKLEQFIFDVFNYSPSTALFEVLREEEFAPVKNANGATYDTPDSARLMLLRLHSRWVVAAGGFLTHSVPLYMTGVEVSPLCSYAGENLEAICRGRTFHAPSEISF

SEQ ID NO: 34094 - protein, 82 aa, Sorghum bicolor
  Clone ID: SORBI-28MAY03-C43008_1.pep
SPSTTMEWRINCHCLMGHVVVQSLTFSISLLPTMVQTTNNCAVGFRKQFSTENLQTHGRYGPKSNHANCDAYHLKMDTDFPQ

SEQ ID NO: 34095 - protein, 287 aa, Sorghum bicolor
  Clone ID: SORBI-28MAY03-C42472_1.pep
HEVYTHESRLILLASGMQCTMFTGYQFSAGGIVKIPKFEMMMSKSEANNKPVLAADDVHIVTVYGRIYCLQLDRVSMSLNLYRFYRDAVVQQCTLPTYSSRIAVSAVDNIIMVHQIDAKVVILYDVSLDSYAPVSAPLPLLVRGLPINSRQVSQTADSQSSAYGGTIYGEGWNFLIPDLICDAENGLLWKLHLDLEAIAASSSDAPSILEFLQRRKSDPSMVKTLCLAIVRTIILERRSVPTVAKAMDIVLDSYTRLMKMGGAFPGVRRTHEQNQQSGSQPNEGSHV

SEQ ID NO: 34096 - protein, 103 aa, Sorghum bicolor
  Clone ID: SORBI-28MAY03-C42475_1.pep
MTHMFPREGASSSSTSMSSQRSETDDDRMIAMVLSEEYAKLDGAMAKRLTNLTSIPHVPRINTYFPTYSDATMDHYRLLDRLNAYGLFEVRVSGDGNCQFRAL

SEQ ID NO: 34097 - protein, 160 aa, Sorghum bicolor
  Clone ID: SORBI-28MAY03-C42531_1.pep
TRGITALELAHGHAPFSKYPPMKVLLMTLQNAPPGLDYERDKRFSKSFKDLVATCLVKDPRKRPPSEKLLKHSFFKHARSAEYLARSILDGLPPLGERFRELKCKEAELLLNNKLGQESKEQLSQKEYIRGISGWNFNLEDLKNAAALIDNLNGTCHLDV

SEQ ID NO: 34098 - protein, 195 aa, Sorghum bicolor
  unsure (1)..(195): unsure at all Xaa locations
  Clone ID: SORBI-28MAY03-C42540_1.pep
TRLKSSPSLKESDMNTKSGHPNVGFRDIVKDSINRDPGGLTVKTSVQEARRNGQYKDSPRPLLLSKSMDGTCIIGIDRTTKVPANVTESRRCLQEQSRFSCDDRRLLRPAETQESKRPPSRPKELPRLSLDSRKESLSPGSRQKNLSYRRTDDILLDTLRPQDSPSHRRANSVIAKLMGLEEAXNATGVLTAENC

SEQ ID NO: 34099 - protein, 107 aa, Sorghum bicolor
  Clone ID: SORBI-28MAY03-C46190_1.pep
KETRRRLLDVWLQPLMDDYRWLQHGCRWFDRAVVEDGIGQAILTLPLEDQQAVLLAWLGRFLKAGDGCPNLQRAFEVWWRRTFVRPYAEQQQQQLGGGSSSSRSGRH

SEQ ID NO: 34100 - protein, 259 aa, Sorghum bicolor
  Clone ID: SORBI-28MAY03-C43116_1.pep
HEALEVKLKAPNGVNFTAKGTSAHDGPVTSSLEGKKSLSNGISITQSWNTANMLATKVELNDTFASGLKTEVLSNFSPAAGNKGQKVNLHFKQPAFHGRAFVDYSAAGAIGTTADAVVSHEGMVVGGEVGYDVQKAAITKYSAAVGYTTPLYNAAVTATNSLSVFTASYYQRVNPAVEAGARAVWDSKSGNNVGLELAAKYKLDPASFAKAKINNLGIASLAYNTKVNSGLTFGIGGSFDTQKLNEAGHKLGTSFTFEG

SEQ ID NO: 34101 - protein, 155 aa, Sorghum bicolor
  Clone ID: SORBI-28MAY03-C43126_1.pep
RAAEEILIGKISTGAQNDLEKVTQMTYAQVAVYGFSEKVGLLSFPQKGFEMSKPYSSHTASIIDTEVREWVAKAYQRTVDLIKTHKEQVAQIAELLLEKEVLHHDDLVRVLGERPFKTAEPTNYDRFKQGFQAEVVDKSSEVADANPSPLGVVPT

SEQ ID NO: 34102 - protein, 179 aa, Sorghum bicolor
  Clone ID: SORBI-28MAY03-C43153_1.pep
MDGHPARQVRVRFVTKLPPPLRAPPAAIAVPADLTRMGLSEIVNSLLAAAEPDHQTQPFDFIVDGELVRLPLQEFLLAKGISAERVLELEYVKAVAPRMLEGPAPPVASASAVDGSSAAVGCPRGVAGSAGWSLRLYKCDTSVSMDYPKRVGAYKILRGHTASVKSISVDPSGDMLCSG

SEQ ID NO: 34103 - protein, 268 aa, Sorghum bicolor
  unsure (1)..(268): unsure at all Xaa locations
  Clone ID: SORBI-28MAY03-C43163_1.pep
MCGILAVLGVADVSLAKRSRIIELSRRLRHRGPDWSGLHCHQDCYLAHQRLAIIDPTSGDQPLYNEDKTVVVTVNGEIYNHEELKAKLKTHEFQTGSDCEVIAHLYEEYGEEFVDMXLDGARAFVLLDTRDKSFMAARDAIGICPLYMGWGLDGSVWFASEMKALSDDCERFITFPPGHLYSSKTGGLRRWYNPPWFSETIPSTPYNALFLREMFEKAVIKRLMTDVPFGVLLSGGLDSSLVASVASRHLNETKVARQWGNKLHTFCI

SEQ ID NO: 34104 - protein, 80 aa, Sorghum bicolor
  Clone ID: SORBI-28MAY03-C43160_1.pep
MTSCGCLVLEKVEGDAAAKARVKAAPGAGAGAGCGSCAGDWRGRSEAIFPIYVMGSSRGSTVAAARGIVDSPEDPIWGAR

SEQ ID NO: 34105 - protein, 122 aa, Sorghum bicolor
  Clone ID: SORBI-28MAY03-C42763_1.pep
KEKASKACTMHGARGQTKLKKDQSYEREKRRYAIASCNDHFVVSKIESCSFSVSGSIVSDVWLQHTARCFLCLHHTTVSTGNLSFRPFMFFVLESLVSWLLPFCTCETPTGPVATTPNHSIP

SEQ ID NO: 34106 - protein, 81 aa, Sorghum bicolor
  Clone ID: SORBI-28MAY03-C4279_1.pep
RCPLPGACCLRCPDAVVVRIDVLLTMSKHRVQLRKLPPCLIYIWVFFWIHSFGHMVGICVRIELLSVCIICFYDYSLLILL

SEQ ID NO: 34107 - protein, 180 aa, Sorghum bicolor
  Clone ID: SORBI-28MAY03-C428_1.pep
MASLSVSAPGAASTSSFWGNRLATYSAPQPGVRFMVKICPIEMKLKRWERKKCKPNSLPVLHKMHVRIGDTVQVIAGREKGKVGEVTRLFKHNSTVIVKDLNLKSKHKKGTDDEPGEIVMIEGPIHSSNVMLYSKEKSVASRVGHKFLEDGTKVRYLVKTGEVIDSVEKWVKVFKEGNSE

SEQ ID NO: 34108 - protein, 243 aa, Sorghum bicolor
  Clone ID: SORBI-28MAY03-C43199_1.pep
MSSESPPTESPDAPASGSRSGSGSPSKDAVGTEGGAAAGGPETNTLRVGNLPLHVTEGDLLALFGPHGALDCALARAGSRSYAFLLFRSPAEARAAVEATRGEKVKGAAMRTEFARPAKAVRNLWVGSISPSVSKEELEEEFQKFGKVEGVAFSQDQTSAYIDFEKLEDAISAHRSLNGKTLGGKELCVDFQRSKGRAEWSDASSFNGRVSGPVGDKRGSGPPKGSAGIRMREAQPTNVLWVG

SEQ ID NO: 34109 - protein, 329 aa, Sorghum bicolor
  Clone ID: SORBI-28MAY03-C43235_1.pep
LHLAILAVFDSWDSARAKKYRSINRITGLKGTAVNVQCMVFGNMGIRSGTGVLFTRNPSTGEKKLYGEFLVNAQGEDVVAGIRTPQELDAMKECMPEPYAELVANCKILESHYKEMMDIEFTVQENRLWMLQCRTGKRTGKGAVKIAVDMVNEGLIDHHSAIKMVEPRHLDQLLHPQFEDTLSYEDKVIATGLPASPGAAVGQIVFTAVDAETWHSQGKSVVLVRTETSPEDVGGMHAAAGILTARGGMTSHAAVVARGWGKCCVAGCSSIHVNDAEKVVVVGDQVLCEGDWLSLNGSTGDVILGKLPLSPPSLSADLEIFLSWVDEVK

SEQ ID NO: 34110 - protein, 161 aa, Sorghum bicolor
  Clone ID: SORBI-28MAY03-C43241_1.pep
MASTSSSRYAKHRRIGEDEELEEAEEEEEEAEEELERFDDFTIASSWERLISEIEAICRQWLADGVKILMQKGAEGVPPFENLYMIKRELKHGKRVYSMEYHFMKSAKGQNSYWDDDTHSMQLSFGVDELLIIAPLSASGVILDDPESTKLLSSVAIALSN

SEQ ID NO: 34111 - protein, 152 aa, Sorghum bicolor
  Clone ID: SORBI-28MAY03-C43290_1.pep
MAMDDVAGSSSMAAAAASDPSHGWQTVSYPKRNRKQAPRAAAPDLALQANGKGAAGGVFDAVEKRSQERHRALQQQLASRAADLDDARIAAATGAGAYSDDEDSDEAAAPRQEGEVKKPKKPKVKKPKVTVAEAAALIDAENLAAHLIEISA

SEQ ID NO: 34112 - protein, 233 aa, Sorghum bicolor
  Clone ID: SORBI-28MAY03-C43295_1.pep
HEAPPGWWLLPLPVLGSHRAAIKNPLPCYHGDLEQAYSSCCRLAAVAAYMDTLFRLVSLQASEQQQQQQQQSASYNSRSTTSSGSRSSSHQTNASYNYYYHSTSSGGGGGGGGQYYYGQQHQHQHQQYYLEPYQQEECGNAHHLYMDEDFSSSSSSRQHFHSHGAAVQPPTSSAATPTAPTPPLSTSSTAAGAAHALFEAADLSFPPDLNLDFSSPASSSGGGAASSAAVGVG

SEQ ID NO: 34113 - protein, 182 aa, Sorghum bicolor
  Clone ID: SORBI-28MAY03-C43298_1.pep
TRPRSRGSPESRAGRVCCLRLSSGDDWATAAAALREVPRSLFSGPSPATSIRQDNMLFTHEANADQFDLLSYGNLRGVEASRNSEESNFGNDLKDGSSVFSENFSSSCLPCENYQSATIDHEKRPFSDVRPCQVACKRPKQTDHNTWLYSFEEDPLTSEVGISSPAFAPALPAVFSALNNNN

SEQ ID NO: 34114 - protein, 87 aa, Sorghum bicolor
  Clone ID: SORBI-28MAY03-C43035_1.pep
TLAPVFQFSSHSGWITACKWHPSSCFHLVSSSFDGRVMLWDLRTAWPLASVDSHEDKVLCADWWKGNSVISGGADSKLCISSGIHIV

SEQ ID NO: 34115 - protein, 136 aa, Sorghum bicolor
  Clone ID: SORBI-28MAY03-C43045_1.pep
GYGIMLLELVTGQRATDASRFAVERVALLLGPGGEPPCVRELDPIGVAVLRQLFGCVGLGTTLPVPLLGSPASPEVRPACPVGVWMPGGPGLAGPSGERLPVGAARGLEYERMQRRFDWGEDSVYNQEAMELSAGR

SEQ ID NO: 34116 - protein, 73 aa, Sorghum bicolor
  Clone ID: SORBI-28MAY03-C43064_1.pep
TTNLDGPNAESLAAALLRIMEAWKGQENFQLIVITHDERFAHLIGQRQLAEKYYRVSKDENQHSIIESQEIFV

SEQ ID NO: 34117 - protein, 115 aa, Sorghum bicolor
  Clone ID: SORBI-28MAY03-C43094_1.pep
NLKLSTIPPPRSPCCNQWVRELAIPYYAYAAPKPYMREPFSFQDEQGGAIERPPYTCTCARSNAWIDASTPARHGGWRLASPVAHAVFHVRVLTELEFASTSSKFDLDHGLHALA

SEQ ID NO: 34118 - protein, 173 aa, Sorghum bicolor
  Clone ID: SORBI-28MAY03-C43105_1.pep
AIKLIDFGSTTFESQDHNYVVSTRHYRAPEVILGLGWNYPCDLWSVGCILVELCSGEALFQTHENLEHLAMMERVLGPLPKHMIVRADRRAEKYFKRGVRLDWPEGAASRESMKAVWKLPRLQNLVMQHVDHSAGDLIDLLQGLLRYDPNERLKAREALRHPFFTRCIRRCGF

SEQ ID NO: 34119 - protein, 306 aa, Sorghum bicolor
  Clone ID: SORBI-28MAY03-C4338_1.pep
KRSRNIGSKSRRFLIDAEDAMELKLTWEEAQELLRPAPTAKPTVVMIEDYEFEEYDEPPVFAKRSIFTIRATGEQDQWIQCDECSKWRRLPLNVIVASKWTCTDNSWDPKSCSCSAPEELTPKELQSVMQQYEEMRRRKGSYGLKLNVAEMRAATREALATAAVFGEVGNQGTASVATTTKHPRHRPGCTCIVCIQPASGKGPKHNPSCTCNVCMTVRRRFKTLMMRKKQRQSEREEAEASKKITWVNREEPEGSNLSRSPQTLDTTRDNSDVTMFDKVADMNKGHIDLNFHPAPDDRGDHGQHGV

SEQ ID NO: 34120 - protein, 85 aa, Sorghum bicolor
  Clone ID: SORBI-28MAY03-C4339_1.pep
VPDPVILEFLCNIDLCMRCLNWNNAKLLISEPLSSYSASVPLLLSVYYWSWEMNLVTIYNWEMNLVITGQDMQLHVFFVCFHLGI

SEQ ID NO: 34121 - protein, 153 aa, Sorghum bicolor
  Clone ID: SORBI-28MAY03-C43461_1.pep
GSDDQWEFVGETSTSRSFERSSEVDGTQDHTHQVVKAGTDSSASNSLPSNMPTETAEENPVTRSNKTDNSDHVVTTTAYSAEDNQSDLPEANHLFEDEHYGLDDLEKIMSEIGNVRSNLRLMPDFQRREMAAKLAMKMAAMFGGDEEEAFEDI

SEQ ID NO: 34122 - protein, 226 aa, Sorghum bicolor
  unsure (1)..(226): unsure at all Xaa locations
  Clone ID: SORBI-28MAY03-C43498_1.pep
ARGSPDFKVRFTLEVKQGGGRNSQFYLMDMGSCWKNDGRACDGDTATDVTRYSEMIINPSTPAWCTPSRIDQCPPWHTFRNGSRVHRTDGARFPYGAYHVYCSPGNAASAEQPTSYCDAYSNPQAQEILQLLPHPVWGEFGYPTAKGXGWVGDPRAWELDVGAMSQALYFYQDPGTPPARRRWTSLDVGTEIYISDRAEEAEWTLSGFDVLVPDIKSQQRASNSCW

SEQ ID NO: 34123 - protein, 114 aa, Sorghum bicolor
  Clone ID: SORBI-28MAY03-C4351_1.pep
LLDAGWGPDGVLKDEEALCLDATFCGNVGRFINHRCYDANLVEIPVEVETPDHHYYHFAFFTTNVRPRVRELTWDYGIDFDGDKHPVKSFECLCGSRYCRGRKHSRRLGKAASK

SEQ ID NO: 34124 - protein, 90 aa, Sorghum bicolor
  Clone ID: SORBI-28MAY03-C43560_1.pep
RKIEFPLPDRRQKRLVFQVCTAKMNLSDEVDLEDYVCRPDKISAADIAAICQEAGMHAVRKNRYVILPKDFEKGYRTNVKKPETDFDFYK

SEQ ID NO: 34125 - protein, 175 aa, Sorghum bicolor
  Clone ID: SORBI-28MAY03-C43510_1.pep
SRIATIIDGTNLSDQRGFDLPPKERLKTLMKSIICESVFDIFGMFDILHQLEVSLLSDKVKSGGKKICLLIIDSISSLLAPIIGGKYPQGRSMMISVAMILKKLAYEHNLSVLVTNHMVSAGNGAVKPALGESWKAVPHVRLVISREHDSNICTATVLKHTQLASGRTTKFVIPS

SEQ ID NO: 34126 - protein, 150 aa, Sorghum bicolor
  Clone ID: SORBI-28MAY03-C43169_1.pep
MGWSVMEVRPEWDLGKMRELRFVVLVLVISLPCFSASDRQGDALYDMKQKLNVTGGQLSDWNQNQVNPCTWNSVICDNNNNVVQVTLAARGFTGVLSPRIGELQYLSVLSLAGNRITGTVPEEFGNLSSLTSLDLEDNLLVGEVPASLGN

SEQ ID NO: 34127 - protein, 138 aa, Sorghum bicolor
  Clone ID: SORBI-28MAY03-C43170_1.pep
MANAAAAAACAASDDLYLQELIRGSVPGPSSSRARVAPLTDDEIGWFCCGICTERRLVLDRFRAGGSVLDARCAHDFCIECVVRYIEGRVANGAVPVPCPAPECRDGVMHPEACKKLGDIDVFDAWCVALCERAVGPA

SEQ ID NO: 34128 - protein, 182 aa, Sorghum bicolor
  Clone ID: SORBI-28MAY03-C43178_1.pep
NGAVSMIKDVSESCPDNWSSHSSSAGNPDLPYVVVSKSSILTAVCKEILGCYRKLLAIPDLLNQPNMSILKQLLQTLQPTKNFDDVLSEFQPSLAPCNVDYLYCGACKMLEDIMDPVSSFSYLLSSDVLITLQSIANSVVVLLEKSGEPNGKNIHMGCSKAIIPFLRKRLGYSAHKLLSADF

SEQ ID NO: 34129 - protein, 306 aa, Sorghum bicolor
  unsure (1)..(306): unsure at all Xaa locations
  Clone ID: SORBI-28MAY03-C43197_1.pep
MSDLLGSRYDKQEDFQVLLSKKDPGEPPRHKHYLWMAHWTKASSSAEARNNNGSNPLEDINKGTTTKDGETLPYEFMKSTVAERLMVGVSRGSASMQHARQFNSSMWGMARHVSNELAPGNSEQVDESFEKSMKHDAVNLRARAVVSETYSIHQLSELPLDFQDLGSSDDPSPDWSHFPMFEINRKIDSILNRKRKSAALGPAPLNLNVSASHVMALSSQEYMMHSHQIADKNMDTCKPAEGFASHIEDPAGLNSDPSGPKLKGQLLDTMSCSCSKDDNNSADCPIDEQHTSHYFANSXHELPYVS

SEQ ID NO: 34130 - protein, 263 aa, Sorghum bicolor
  Clone ID: SORBI-28MAY03-C43671_1.pep
ARGNKPYGLLLDTKNEVFGLIRKGSFSLFRCLEGVEMLIYGSSEEFPNIDDLGMNLLDDISDFELLKEVLRCMGHIHHLLGRSSTAVYYECLISSIISSDEIASHIVKILETGFSPQSSSSLITLLGTDTYVERRQAAHRSQRKFSVEMLLSFHKLQSRSASWSAVFDVIEKFMKCLNTNMSIQEHGSKRVCNVNYVLLVQATSQVARTMFECAFDLFLFLSYLVGVGGQVSLLQSDVARIKLKLFPTIQDILGQWIVLHFVG

SEQ ID NO: 34131 - protein, 198 aa, Sorghum bicolor
  Clone ID: SORBI-28MAY03-C43674_1.pep
IRTCGGGPRGPPFLPVAAARAVAPAARSQAWFLDQFGVLHDGKKPYPGAILALEKLAGNGAKMVIISNSSRRSSVTMEKLKSLGFDTSCFLATITSGELTHQHLQKRNDPWFAALGRKCIHITWGDRGAISLEGLGLQVVNNVDDAEFILAHGTEALGSPSGDPLPKSLEELEQVLMLGLEKQLPMVVANPDYVTVEA

SEQ ID NO: 34132 - protein, 247 aa, Sorghum bicolor
  Clone ID: SORBI-28MAY03-C43696_1.pep
ARGEAGKHAVMARTGLPARDLRVLDPLLSYPSTILGRERAIVVNLERVKALITATEVLLPNTKDPALARFVRDLQTRVLASSSDQAAELTDMEGESSMVASPFPVPSSSKGHEVEMTKKTTAIVPEMTSSSSMPNLAVAKDGNTKVLPFEFRALEVCLESACRSLEEETSTLEQEAYPALDELTSKISTLNLERVRQIKSRLVAISGRVQKVRDELEHLLDDEMDMAEMYLTEKLTQQEISEASSRA

SEQ ID NO: 34133 - protein, 120 aa, Sorghum bicolor
  unsure (1)..(120): unsure at all Xaa locations
  Clone ID: SORBI-28MAY03-C4370_1.pep
CAHASAHASGSXXAXPXPAAPGXARXAPXPEXXXLFDCKQTNFRSRLRWRGARLRCLISRARMKRRLVRFVLEASQEHQPTCPRPLSMGVCSGAAGQRQHGSCSWLRHSSFSLDVLPVPH

SEQ ID NO: 34134 - protein, 158 aa, Sorghum bicolor
  Clone ID: SORBI-28MAY03-C43722_1.pep
MSATAVAPTPPAAAFAVAAPPSYPAAFSAAAAPTEGHDGDFYCHYKSLRRHHEFLEIQEDYVKDELRNLRREELRGAEEVKRCRATPLEIGQFMEMVDADHGIVAPTTTGGSFYVRGLSTIGRELLKPSASVALHRHSHALVDVLPPEADSSISLLGS

SEQ ID NO: 34135 - protein, 145 aa, Sorghum bicolor
  Clone ID: SORBI-28MAY03-C43727_1.pep
MSDALINGLAGAGGGIIAQLLTYPLQTVNARQQTERDPSKPAFKDGAARQLYLVVKNEGWERLYGGLMPSLVGTAASQGVYYYFYQIFRNRAEAKALERSRRGLGDGSVGMLQSLTVAALSGCVNVLLTNPIWVVVTRMQTHRKA

SEQ ID NO: 34136 - protein, 145 aa, Sorghum bicolor
  Clone ID: SORBI-28MAY03-C46158_1.pep
PEYFMHGIINEKTDVFAYGVLLLELVTGRKAVDSSRQSLVIWAKPLLDANNIKELVDPSLGNEYDPEEMVYTLAVASLCIHHSSTSRPSMKSVVCFLKGDRESLELVRRPKIVKPLMFDSCDSEDYTRSSYLNDLNRHKQLALEQ

SEQ ID NO: 34137 - protein, 109 aa, Sorghum bicolor
  Clone ID: SORBI-28MAY03-C46159_1.pep
GNDDTLQNQRSTSAKEDSKILSEVLETYRSRFGKLEISLLSSEKMMTLHDMASELQDLERWYIVYQLAKCHGYAKNSGLEPCTATVKKHDGAAAAPVDSLSSIKCRLLN

SEQ ID NO: 34138 - protein, 93 aa, Sorghum bicolor
  Clone ID: SORBI-28MAY03-C46187_1.pep
AVQKDYIISKSIYSNLHIYIVTPQYKSTRIRSVTIYAKGKESKHTRDYQFIEPSMPHQKEKKRRKKKRKRGMPQIPMVQQYKIVGSHIYAILS

SEQ ID NO: 34139 - protein, 148 aa, Sorghum bicolor
  Clone ID: SORBI-28MAY03-C43781_1.pep
MAPGLYTDIGKKTRDLLYKDYNTHQKFSLTTCSPHGVAITAAGTRKNESIFGELHTQIKNKKLTVDIKANSESDLLTTITVDELGTPGLKSILSLVVPDQRSGKFELQYLHEYAGVNASIGLNPNPMVNISGVFGSKALSVGVDVSFD

SEQ ID NO: 34140 - protein, 171 aa, Sorghum bicolor
  Clone ID: SORBI-28MAY03-C43795_1.pep
ARGMNKIFQFWEDTFQTLYNFRAELVSLSPGSLVEICTKICGDDVHFDKLFFALEQCIDGFKTGCRPDIALNYTDLDGIYSGKLACACALDGHNWMYPVAWAIFDSASNENWTWFMEQLKKAIGNLPGLAISADVGDNNLTGSFYEWTMNIKGMPLVDLIDKMRQMTMGGL

SEQ ID NO: 34141 - protein, 245 aa, Sorghum bicolor
  Clone ID: SORBI-28MAY03-C43811_1.pep
MEQSRNTLLFASCAKEVVTNAQVNVVMSDKALVKQLQKELARLESELRCPTSYSGLEALVKEKDNQIRKMEKEIKELKLQRDLAQSRLQDLLKVVGDSHSSKHPLASSGRNFTFDVPQPCEDERSTTSEVVSSGQNFRLQGRQTIQRDYRSQQSENDVQFATPLSYSVSSPPFSGMPPTNGRDDNSQISNEDSEDLCKEVRCIETNETEENECLESSAVGSNSLQDSNVASSMQGGNHPNRSVNS

SEQ ID NO: 34142 - protein, 171 aa, Sorghum bicolor
  Clone ID: SORBI-28MAY03-C43812_1.pep
MEALGARSSVLSSPGTAGDASPSLSLPLRRASAAFPGLRRSPSALAISTRWLRAPPRIGGRLLAGAGEDGSLDPADDTTDQAGDFQLLESNVTLRGSNDMDTTKHDDAGTSGSGGTNTGGSRAGLFRTPISGGVHSATAVHDLPPPALAVRNLMEQARFAHLCTVMSRMHH

SEQ ID NO: 34143 - protein, 66 aa, Sorghum bicolor
  Clone ID: SORBI-28MAY03-C4383_1.pep
PLYPGRKTATKNATISIQVFHQNCLGWTFCRNWMIPNVVLDHCNNLNGSKYTMFLLFFLQTLLRVG

SEQ ID NO: 34144 - protein, 270 aa, Sorghum bicolor
  Clone ID: SORBI-28MAY03-C43830_1.pep
MDSAAAALLDSSASASSSAAANGNAKEMPARLLAHRTAHNMSSSSLRKKSDLALLRKVPCATLRRLLDNFQEVLLATKLALLFPAVLLAPAARIFQFGQEWVFVLSLIGLVPLAERLSFLTEQVAFYTGPTVGGLLNATFGNVTEVIIAIFALYEGKVVVVKCSLLGSVLSNLLLVLGTSLFLGGLANLGTEQLYDRMQVDVSTGLLILGVLCHSLPLMLRYAVSSGEHAVSSWDSELELSRACSIVMLLAYVAYLFFQLKTHRQLFEPQ

SEQ ID NO: 34145 - protein, 170 aa, Sorghum bicolor
  Clone ID: SORBI-28MAY03-C43833_1.pep
ARGHYVADSDRLIPAGETEFAKDAAFGYKSSNLRQWVARGTRGRVSENQVSTISITLLRKQGPTAVCEHLCSLAKGSVCIVNAASDRDMAVFASGMIQAELKGKRFLCRTAASFVSARIGIKPKPPICPNDLGLKRALTGGLIIVGSYVPKTTKQVDELRSQCGQSLRVI

SEQ ID NO: 34146 - protein, 161 aa, Sorghum bicolor
  Clone ID: SORBI-28MAY03-C43592_1.pep
FQAYYLRVQYPVEKATTEKLTSLGNGVSIFHLLDYPVSGFLFKGGASLEDLSDVVSKVCIFLQENNRPFNVLISESGKRVFLLPQCYAEKQILGKASQEFLDMRINPAIWELSGHLVLKRRKDYDEASEANICRFLVEAALSETEFQELNRCLLDFVTSWL

SEQ ID NO: 34147 - protein, 187 aa, Sorghum bicolor
  Clone ID: SORBI-28MAY03-C43626_1.pep
MEGSLEARPGVLLVGAPGVGKRTILSRLLAAEIPDVHDLSSGVLCQGWTIQTKYYSADLSIWTANLGEEFSLGSLPHLDRLAALVMVFDMNDESTLLTLQSWAANVDIQRFEVLLCIGNKADLVPGHSAHIQYRRRMQKLGESSSDLHPDYFDFGINESEGCSLLSEEEPCIEIRNSTAQWCIEQNI

SEQ ID NO: 34148 - protein, 115 aa, Sorghum bicolor
  Clone ID: SORBI-28MAY03-C43647_1.pep
SIPQTSAVHHKQEQPLPLLSTMASVFNSFVSVVYLSENLQQEKCNIILKGSIWLPIPRKFQIDFARPHVNIICLISSLLVWHKGHAALSIIAAANKYSPLVLDAQMAETYALSLV

SEQ ID NO: 34149 - protein, 205 aa, Sorghum bicolor
  Clone ID: SORBI-28MAY03-C43649_1.pep
ARGSELPLPAPPSERFPERFHGAPRAGGQSPSAATLVEAAAAAAKRKGKETVGLSRRGSSGGRPPLSPRAASVSRSRELSSAGGKAPLSPRPMSHAEVVARAKWTRSRRTIDMAVDQTAEADELPSQSMKQVKSPTTWPGKVYKKSLWRKVLDRIGKSSGNYTRVDPHVSYQTVNMSGIIRHYNLIEMVARQVECGSNALNFCRG

SEQ ID NO: 34150 - protein, 101 aa, Sorghum bicolor
  Clone ID: SORBI-28MAY03-C43876_1.pep
MGSGSLLKVVANNFDVLAGPLVALAYPLYASVKAIETKSPVDDQQWLTYWVLYSLITLFELTFASIIQWLPFWPSMKLIFICWLVLPYFNGATYVYQNYVR

SEQ ID NO: 34151 - protein, 203 aa, Sorghum bicolor
  Clone ID: SORBI-28MAY03-C43888_1.pep
MGIVNYLYDETNSSFPKEKVQELKQFSQLGSKTPGPPENFVTPGVEVTTGPLGQGITNAVGLALAEKHLAGRFNKPDSEVVNHYTYVILGDGCQMEGISSEACSLAGHWGLGKLIAFYDDNHISVDGDTEIAFTEDVIARFEAYGWHTLWVKNGNTGYDDIREAIKEAKAVTDKPTLVKVTTTIGYGSPNKANSYSVHGGALG

SEQ ID NO: 34152 - protein, 182 aa, Sorghum bicolor
  unsure (1)..(182): unsure at all Xaa locations
  Clone ID: SORBI-28MAY03-C439_1.pep
MATTVMAAAVSFPSSSAASAGXEASPTSPCAAPHFLSYRPRPARAAIRAQASATDTAVEAPAKSKESKKQEEGVVTNLYKPKEPYVGKCLLNTKITGDDAPGETWHMVFSTEGKIPYKEGQSIGIIADGVDKNGKPHKLRLYSIASSALGDFGDSKTVSLCVKRLVYTNEAREIVKGVCSNF

SEQ ID NO: 34153 - protein, 304 aa, Sorghum bicolor
  Clone ID: SORBI-28MAY03-C43913_1.pep
TRESKEDGKMHACGHDAHVAMLLGAARLLQSRRDLFKGTVKLVFQPAEEGHAGGYYVLKEGVLDDVHTIFAVHVDTALPVGTVGSRPGPFLAGSARFTATITGKGGHAAGPQLVVDPIVAASSAVLSLQQLVAREIDPLQGAVVSVTFIRGGEAFNVIPESVTLGGTCRSMTTEGLSYLMKRIREVVQGQAAVGRCTAVVDFMEEKMKPYPATVNDEAVYGHAKAVAESMIGEANVRLCPQFMAAEDFGFYSQRIPAAFFSVGVRNAETGKIHHVHSPHLDIDEAALPIGAALHAAVAIEYLNK

SEQ ID NO: 34154 - protein, 177 aa, Sorghum bicolor
  unsure (1)..(177): unsure at all Xaa locations
  Clone ID: SORBI-28MAY03-C43982_1.pep
MSETESAAVAAALDPAATAEPKPRRLRGHKKGAGAPSVAPAARPGGGAAPGEDGCLCWFDLRTKDVLLTMEAANKPISSICFKPGNEDCVYISAGNEILSFDVRMWLSYXGAQSKPLETYNYNRDEINQIAVSSKGFLAAADDSGDVKIVNTIQKRLYKRLREAHTSVSLSGVTGCC

SEQ ID NO: 34155 - protein, 158 aa, Sorghum bicolor
  Clone ID: SORBI-28MAY03-C43975_1.pep
MAELKRLSESRDLTRIERIGAHSHIRGLGLDSSMEARDASEGMVGQLPARRAAGLILQLIRQGKTARPAGLPAALPAAAPSAPAAASALSPRALSPSAALAPAVRRALGLPIKEEAEIIEGEVVEISIDRPLSASGAGGSSAAPSGATAAGKSGRLTL

SEQ ID NO: 34156 - protein, 134 aa, Sorghum bicolor
  Clone ID: SORBI-28MAY03-C44200_1.pep
HEAGAGGHLPPGPPGLPILGALPLVGPAPHAGLAALARKYGPIMYLKMGTTGVVVASSPCAAKTFLKALDAKYANRPAVASAADITYRRQNMVFADYGPKWKLMRKLASVHLLGARALADWACVRRDEAGHLLR

SEQ ID NO: 34157 - protein, 144 aa, Sorghum bicolor
  Clone ID: SORBI-28MAY03-C43741_1.pep
TEPPWTSRGPPACPWRRSAPAAQPCWADPQRRRLLPAPPMASRYPPPRTQPWRASGAATTRHRQPLPDPPPGPPWAPAPAMPARPCPPAPPPPPGASPRRSASSRPSRTSGDGDARTRRERKRRRGRRTAGEKNTKLETSSPSC

SEQ ID NO: 34158 - protein, 240 aa, Sorghum bicolor
  Clone ID: SORBI-28MAY03-C43743_1.pep
SSRRRLLEMGKAAAAVVLAVNGKRYEAAGADPSTTLLEFLRTQTPVRGPKLGCGEGGCGACVVLVSKYDPFTDEVTEFSASSCLTLLHSVDRCSVTTSEGIGNTKDGYHPVQQRLSGFHASQCGFCTPGMCMSIFSALVKADKAADRPAPPDGFSKLTSSEAEKAVSGNLCRCTGYRPIVDACKSFAADVDLEDLGLNCFWKKGDEPADVSKLPGYNSGAVCTFPEFLKSEIESSIEQDN

SEQ ID NO: 34159 - protein, 185 aa, Sorghum bicolor
  unsure (1)..(185): unsure at all Xaa locations
  Clone ID: SORBI-28MAY03-C43754_1.pep
IXCGKQSWILGVKRARRQPKGPPEHTMAVDGAGTGAGTGPGSSAEASPATGKLKSTSTGHRQVEGGLGPTRGRRAGSIEPAVGRMLRPRRALQVAPKLRRPGSPDETRAPTCGRPTPHDVRAAQATKRQRRAGAGQDPWRPGRAKLEPSKDRKEAAMAAQGAGGHGAPGPGQRLPARSRTEAGLV

SEQ ID NO: 34160 - protein, 174 aa, Sorghum bicolor
  Clone ID: SORBI-28MAY03-C43759_1.pep
MQFLSASASVSVSSPVPPSAHLLRLSRPPPFPHLRRRCSPPKPLALTPRPPLLLASRPSLLFTPRAHGGHGHGHGHHHHHGHDHHHHHHGHGHGHGHGHHEVDVHGGGGGAAVMRVARAIGWASVADALREHLQACCISLGLLLIAAACPHVALLNSVGRLQAALIAVAFPLVG

SEQ ID NO: 34161 - protein, 215 aa, Sorghum bicolor
  Clone ID: SORBI-28MAY03-C44081_1.pep
MEASEAAPAVATAAVMEAEDVSGGKGSWYVLGERALMVPYMREHVPRYHDWMQDPALLEATASEPLSLSQEFEVHRSWTLDPLKHTFIFLDKELIEGEFVPGNPHTEAMVGDVNIYMNDSDDMQIAEIEIMIAEHKSRGKGIGQEAILLMMAFAVEKYGIHTFRAKISESNTASLKLFRKLGFKDASYSAVFKEVTLEAPTDSLPLRFPLTIGDW

SEQ ID NO: 34162 - protein, 99 aa, Sorghum bicolor
  Clone ID: SORBI-28MAY03-C44107_1.pep
IIFIHHDPDIWGKDASEFNPERFANGISNATRHQAAFFPFGGGPRICIGQSFALLEAKMALCTILQRFSFELSPSYTHAPYTVITLHPQHGAQIRLKKL

SEQ ID NO: 34163 - protein, 118 aa, Sorghum bicolor
  Clone ID: SORBI-28MAY03-C44112_1.pep
MSIPGAEDQIDPATFEQILEMDEDEDEREFSKSIVYDFFGQADQTFKKMDKELEKKEGKYLKELSELGHFLKGSSATLGLTKVKDSCEKIQNYGQLKDDAGLKDITEEQAQENLAKII

SEQ ID NO: 34164 - protein, 132 aa, Sorghum bicolor
  Clone ID: SORBI-28MAY03-C44116_1.pep
TRLVSGSQTSSTPEMGLVHRKRCAGREDGGGRCTTGSRCHCSKKRKLRIRRSIKVPAISNKVADIPADEFSWRKYGQKPIKGSPHPRGYYKCSSVRGCPARKHVERCVDDPSMLIVTYEGDHNHNRVLAQPA

SEQ ID NO: 34165 - protein, 103 aa, Sorghum bicolor
  Clone ID: SORBI-28MAY03-C44122_1.pep
APTWSSARSCASSLCAPPALVCRLAVTPRRCFVASTARRSMRIIIHSHPPQVSSSSQQIDEEIMHHCCCYTYTHTYIHRCKYSTGGGRKNMRTQYLAASVLAV

SEQ ID NO: 34166 - protein, 205 aa, Sorghum bicolor
  Clone ID: SORBI-28MAY03-C44192_1.pep
ARGDRGFLPGMSKEEREKVARSETLAIRLSNIANMVLFAAKVYASVRSGSLAIIASTLDSLLDLLSGFILWFTAFSMQTPNPYRYPIGKKRMQPLGILVFASVMATLGLQIILESIRSLASDGDEFSLTGDQEKWLVDIMLSVTLVKLALVIYCRSFTNEIVKAYAQDHFFDVITNIIGLVAALLANYIEGWIDPLGAIVLAIYT

SEQ ID NO: 34167 - protein, 158 aa, Sorghum bicolor
  unsure (1)..(158): unsure at all Xaa locations
  Clone ID: LIB3481-039-P1-K1-A3.pep
CAYLRKAIVFGYGPIRPWMSIAHCLIXHLDLKKFTPNEVPRVKISLACVFAFMAIGXPLIILKSGLAGWFKFWFMPRMVYHFWMSTFTMVHHTAPHIPFKSSQEWNAAQAQLNGTVHCNYPQWIEILCHDINVHVPHHISPRIPSYNLRAAYDSIKQN

SEQ ID NO: 34168 - protein, 66 aa, Sorghum bicolor
  Clone ID: LIB3478-029-P1-K1-F5.pep
HFWMSTFTMVHHTAPHIPFKSSEEWNAAQAQLNGTVHCNYPQWYVFMLHCTHTKNKVYLLDICDSY

SEQ ID NO: 34169 - protein, 147 aa, Sorghum bicolor
  Clone ID: SORBI-28MAY03-C43844_1.pep
KKKKKKKKKVVPVPSPPAHRLRRPRLRPPRAGRAPSGAQPLRDQGQWQVRLRRLLHLCCHLRSRAHLQGQSPPFPGLPQGHARQQRELPERHLRGRQRHAGGNGVRPRHVPRGRRGVRLRRLPRRGGRRVARDAVREPQGHGALVPA

SEQ ID NO: 34170 - protein, 184 aa, Sorghum bicolor
  Clone ID: SORBI-28MAY03-C43856_1.pep
GDFFDFCGARGGSRREEERNEKIIRGLMKLPPNRKCINCNSVGPQYVCTNFWTFICLSCSGIHREFTHRVKSVSMSKFTTQEVQALEQGGNQRARDIYLKDWDWQRMRLPANTNPDRIREFIRSVYVDKKYAGGSSNKPATDSESIKGNGNDMRRPSSYHSYSQSPPYDFQYEDRRYGKQVDTL

SEQ ID NO: 34171 - protein, 270 aa, Sorghum bicolor
  Clone ID: SORBI-28MAY03-C43857_1.pep
YVHKRGWQGYFKSYCIPEDLVPRILSPAYFHHYNAQTPEASFINKTGVKSEETMEASAERPKGNNGEQLVLGVGPARGSLWRLSKLVPLEGVRKSLSVIQKQTNIFGKAPSQLDSYLQSKVDESEEPPQSLEIQESSQGIALTPLSDKDGGNTEDNNRTEKINASEAGNSKRWSRVPSLPSYVPFGELYLLGDSSVNTLSDSEYSKMTSVQSVISELRERLQSHSMKSYRARFQKIYDSCMCVNAPVFTGIEQLPQFSHLQELIGLTATD

SEQ ID NO: 34172 - protein, 72 aa, Sorghum bicolor
  Clone ID: SORBI-28MAY03-C44299_1.pep
AFLRLQIEIFEASKDDNREASSECSICLDGFYDGDELIRLRCGHRFHSTCLEPWVRKCADCPYCRTNIRSRS

SEQ ID NO: 34173 - protein, 107 aa, Sorghum bicolor
  Clone ID: SORBI-28MAY03-C44296_1.pep
ARGNDLSIMTNVIMLNITENWSDEEEQWEMCTSKTKTCADKYAMESAQLACDVAYAGVKQGSVLGDEYFFSALPVVRKRIAQGGVRLAAILNRIFSESGSSSRLQSS

SEQ ID NO: 34174 - protein, 271 aa, Sorghum bicolor
  Clone ID: SORBI-28MAY03-C44327_1.pep
HEEYLEVAENAANFIKEKLYDASSKRLHHSYRNGPSKAPGFLDDYAFLISGLLDLYEFGGKTEWLLWAVQLQVTQDDLFLDKQGGGYFNTPGEDPSVLLRVKEDYDGAEPSGNSVAAINLIRLSSIFDVAKSTGYKSSVEHLLAVFETRLRQLSIALPLMCCAADMLSVPSRKQVVLVGQKGSEEFQDMVAATFSLYDPNRTVIQIDPRNTEEMEFWDCNNADIAQMARSSPLGEPAVAHVCQDFKCSPPVTSPGALRELLNKTLVAASSA

SEQ ID NO: 34175 - protein, 132 aa, Sorghum bicolor
  Clone ID: SORBI-28MAY03-C44337_1.pep
SPPAASPKSPVEIKIEELTEERKALIKGSFRDRHFNAGSILLGLGVLESVGGALNTWFRTGKLFPGPHLFAGAAITVLWAAAAALVPAMQKGDETARSLHIALNAVNVLLFVWQIPTGLEIVGKVFEFTTWP

SEQ ID NO: 34176 - protein, 174 aa, Sorghum bicolor
  Clone ID: SORBI-28MAY03-C44349_1.pep
MAKVCDELATVIGPRKNIEESDIGRLPYLQAVVKETFRLHPPAPLLLPRHAQTDVKIMGYTIPEGSRVFINVWAMGRDEETWPEPERFMPERFLGKTVDLRGGDFDLIPFGGGRRICPGMPLAIRMVHLLLASLLNQFPWRLPDEVERNGVDMAENFGLTLTKAVPLCAIATAI

SEQ ID NO: 34177 - protein, 208 aa, Sorghum bicolor
  Clone ID: SORBI-28MAY03-C44363_1.pep
TRLFFPSHPTQVICLVCDTEQPIAQVCCNCGVCMGEYFCRKCNFLDDDVDKEQFHCDDCGICRVGGKDNFFHCQKCGSCYSTTLRDKHCCIENSMKNNCPICYEYMFDSLRETSVLRCGHTMHLHCFHEMLKHDKFSCPICATSIFDMDKFFKALDAEMEASYFYMGKGWIVCNDCRDTTQVFSGVAGHKCCHCQSHNTCRVAPPVLP

SEQ ID NO: 34178 - protein, 197 aa, Sorghum bicolor
  Clone ID: SORBI-28MAY03-C44529_1.pep
ASTTTESPTSSSTTSVTTPTVRPSSSSSKKKLNREAPTPSKDQDSAYRMDKKSSYTPLTNRQHNSIPAAPTTATTTAATKASKKTSGNKSQPSKEAKNVARLDKAPKNVTATATKPRLNAGAKDQKVDAVITRRLSCPAAATTDNVQVTATLKGRSRAATGVVPTARKGASATDAVLKGRRAGEKQQRPKLGSHAKK

SEQ ID NO: 34179 - protein, 77 aa, Sorghum bicolor
  Clone ID: SORBI-28MAY03-C43993_1.pep
MEQQTVILYPSPGVGHIVPMVQLAKVILTHGYDVTMVIAEPAVSSPDFRIVDVGRVAASNPAITFHVLPPVPYADLA

SEQ ID NO: 34180 - protein, 202 aa, Sorghum bicolor
  Clone ID: SORBI-28MAY03-C44043_1.pep
MAAAAARSRAAAAWARLLSLRPHSLAESTALPRHCHHLGSRITPPRRHLAFSASSGGARPNQNIQSERVVHELLAQVERERQDRRAKDAKDQEEEEPKEEEEEDYMGVKPLIEKLERRKAKEAAADEGFWEPTDSDSDEDDERYTPDAIKRRVDEFERKCKRHEEYLQSFAEADTLDEAHKWMTKINKFEERHLKLPLEYRV

SEQ ID NO: 34181 - protein, 129 aa, Sorghum bicolor
  Clone ID: SORBI-28MAY03-C44021_1.pep
MSTNPDEPKSRARTDFLLNNESEVQKFWDENKVFEADPGNEPPSPGEKFFGNFPYPYMNGLLHLGHAFSLSKLEFGAAYHRLRGSNVLLPFGFHCTGMPIKASADKLAREIQQYGYPPVFPVAEDSGAA

SEQ ID NO: 34182 - protein, 290 aa, Sorghum bicolor
  Clone ID: SORBI-28MAY03-C44092_1.pep
MADTASADQRGGRGSGERGFGGRGRGRGRGREGAEGGAGGRGRGRGGPRRDKGDKEEPWVPATKLGRLVKAGKVTKLEQVYLYSLPVKEYQIIDQFVSGLKDEVLKIMPVQKQTRAGQRTRFKAFVVVGDFNGHVGLGVKCSKEVATAIRAAIILAKLAVVPVRRGYWGNFIGKPHTVPVKVTGKCGSIRVRLIPAPRGTGLVASQVPKKMLQFAGIEDVFTSSSGHTATLGNFAKATFVAITRTYQFLTPDLWKSGRFQKDLYHANTDFIASYGEKHAAEEKQARPDRD

SEQ ID NO: 34183 - protein, 196 aa, Sorghum bicolor
  Clone ID: SORBI-28MAY03-C4457_1.pep
RTRPQSSTRPMRKSKRKALLDSWDELLTQMPSLLDIDHPCAQKQIMEARKVVESLEEDPDDPAPQSNALGESEVSQWNVLQFNTGTTAPFIIKCGANSSSELVIKADLRVQEPKGGEVIRVVPRPTVLADLSFEEIKGVFEQLPEAVSLLALARTADGTRARYSRLYRTLASKVTALKEIVAEMEKGGVFKDVRSS

SEQ ID NO: 34184 - protein, 120 aa, Sorghum bicolor
  Clone ID: SORBI-28MAY03-C44588_1.pep
GPRRRRLLLLLLERLERREHVAAADLRLLRRAAAAPATPAARHRHPQRARGEKKDKNSDLPAGDVRPRDLRRVGEGRRGRCGAEREATALGFCGIGRIGFELDGFAAREGRERLTAAAGV

SEQ ID NO: 34185 - protein, 218 aa, Sorghum bicolor
  Clone ID: SORBI-28MAY03-C44593_1.pep
MAPADLPPGFRFHPTDEELVNYYLKRKVHGLSIELDIIPEVDLYKCEPWELAEKSFLPSRDSEWYFFGPRDRKYPNGCRTNRATQAGYWKSTGKDRRINYQNRSIGMKKTLVYYKGRAPQGLRTNWVMHEYRIEESECENTMGIQDSYALCRVFKKNVALGEFQKQKQGECSSSQANEKQEQFTSVRDAGQSSGSNEHGKDNTWMQFIADDLWCNKTK

SEQ ID NO: 34186 - protein, 197 aa, Sorghum bicolor
  Clone ID: SORBI-28MAY03-C4462_1.pep
RAGIEELDLILTVYGNYNFPCPRLCGGTRGTLRYLSLASCQFHPTVRIGCLTSLTTLNLTFVHIEADELWCLLSSSPNLERFELRHCDSIVFLKIPCLQQLNYLEVVCSSNRLRAIESKAPNLSSVKFVGDLRIPLSLENTNRIKILDTHYYCSLAFYARADLPSTMPNLEALTIRSDGEVDTVPMVPSKFLYLKYL

SEQ ID NO: 34187 - protein, 127 aa, Sorghum bicolor
  Clone ID: SORBI-28MAY03-C44640_1.pep
VGDGINDSPALAAADVGMAIGGGTDIAIEAADYVLVRNNLEDVITAIDLSRKTFSRIRWNYFFAMAYNVVAIPIAAGALFPFTGLQMPPWLAGACMAFSSVSVVCSSLLLRRYRKPRLTTVLQITVE

SEQ ID NO: 34188 - protein, 138 aa, Sorghum bicolor
  Clone ID: SORBI-28MAY03-C4471_1.pep
GKELSKLVAFVKGTQFDLVEYLQRERQGSARLENFASALELIGQKLQMDTLQSRLDAEFLLAHMCSVKFKEWIVVLATLLRRAEVLVDLFRHDLRLWKAYSITLQSHDVFREYLDLLNILEEQLSSVSDLTLQNGPLS

SEQ ID NO: 34189 - protein, 219 aa, Sorghum bicolor
  Clone ID: SORBI-28MAY03-C44213_1.pep
TRLQAMVAGLAVTAPSIEESIRSGVRPRCLCAGVGGGSLLMSIRMGLQFDVLGVEADGVVLDVARNHFGLVEDEFLHVHVGDAIQMIEDFAQQGEPDMNFSAIMVDLDSSDAMCGVSAPPLEMTHGNVLLWVRTILHRHGVLILNVIPPPADRSFYKGMIDVLHQVFSELFEIDVGNGENFVVIATVSPIETTVTGDSGHFLTELRKLTGDFLEHIRKI

SEQ ID NO: 34190 - protein, 96 aa, Sorghum bicolor
  Clone ID: SORBI-28MAY03-C4426_1.pep
TRAMERAPALCLLTTLLALYFLVPSSAVPLSRVQRMSMQEDDQIPSVESSTLEPKIKMERFVQEDDESMVTARMAFETQDYSPPGPNNHHKPPGWR

SEQ ID NO: 34191 - protein, 135 aa, Sorghum bicolor
  Clone ID: SORBI-28MAY03-C44288_1.pep
ARGTLHPSKDSKNNCTVALQRGREIEKEIESNYGVSAHPVWQRRRPEEDEPRQWHGGAGEAAVEEAEVQLRPERGAAEAKRGEVRVRPAQLLPELRRLRCLVISGGGHGLFVARILEPGFCFFCVNNCSHDISVA

SEQ ID NO: 34192 - protein, 107 aa, Sorghum bicolor
  unsure (1)..(107): unsure at all Xaa locations
  Clone ID: SORBI-28MAY03-C44798_1.pep
MYAYAVASALHGVQHILRKDFMIQPPXDTKLGNTFIIHFTYGCDYSLKGELTYGKVGEWRFDKRSFPDGPPPRNFTLPPPGVPESVVTLVKMVNEASANLPRWDDGI

SEQ ID NO: 34193 - protein, 100 aa, Sorghum bicolor
  Clone ID: SORBI-28MAY03-C44836_1.pep
ARCHILAYESAGAHGRYICNAAVLCCGDLVALLARRFPAYPIPRSLPSVYGEQTYGFDTSKARALGLVDLKGVEEMFDDAVDSLRGHGHLPAAEDVGKHG

SEQ ID NO: 34194 - protein, 225 aa, Sorghum bicolor
  Clone ID: SORBI-28MAY03-C44872_1.pep
TRSDCWRYVLDRLMHLPDVQEDAGIGTCIRDALLYGCAEFGTAPGKVEMDRDKTVNANTARCQNILMDVLRSENFALLCSVLCRTVHQDGERTRYFDFGVIDSRMKNGNYGHEPELFMHDLKLLWEDLKVAGQDIIHLADNLSSLTEDSYEKLVGRERGSDDGELNGAVVARSEPKNLVQSNALVPLTSQGFNQLDQPGPSYLSDVYKDSICNQCGKEARVGSVL

SEQ ID NO: 34195 - protein, 163 aa, Sorghum bicolor
  Clone ID: SORBI-28MAY03-C44865_1.pep
ARGSYNDELIYLFQQNMGLGPNPVSVEPEFINMLDQPQVYSGHRNFRTVKGVSFFGPHDEYVVSGSDCGNVFIWRKKGGELMRMMNGDTSVVNCIEPHPHFPFMATSGIDKTVKLWTPASNKLMSLPKNANQIIASNERGREIDASRAGVTLSSDVVMHVLRL

SEQ ID NO: 34196 - protein, 305 aa, Sorghum bicolor
  Clone ID: SORBI-28MAY03-C44889_1.pep
TRQAAAKAQAAFRGYLARRSFRTLKGIIRLQALIRGHLVRRQAVSTLRTTWLIVKFQALVRGTNVRLSGGHTQFNVKLGQHNFGGVGSSDAWKEKLSSSAWVRKLLSSPIVLEPLHFQYDKRDPNSTYNWFERWTIGCIWKPAFQPKRVADGKPLVKKASYAMETESAKLKRNIRKGSAAVAGSFHTSGESDKVKRNPKKISSFPADSVPDSQLSELEKVKRNLRKVTDSMAEASKISSSRVDSSKVCDSTADVPKESNPVVEISTPSLMNGISDHQGIQCENTREASFPLETQEYSDSDHLLRY

SEQ ID NO: 34197 - protein, 297 aa, Sorghum bicolor
  Clone ID: SORBI-28MAY03-C44892_1.pep
MLAALCIQALRHLRQIAQETSGEVVYALGRQPAVLRTFSQRLSRGFNDAISGFNDDGWSVMGGDGIEDVVVACNSTKKIRNNSNAGITFGAPGGIICAKASMLLQSVPPAVLVRFLREHRSEWADYNMDAYLASSLKTSACSLPGLRPMRFSGGQMIMPLAHTVENEEILEVVRLEGQPLTHDEALLSRDIHLLQLCTGIDEKSVGSSFQLVFAPIDEHFPDDAPLISSGFRVIPLDMKTDGVASGRTLDLASSLDVGSAAPQASGDASPDDCNLRSVLTIAFQFPYEMHLQDSVAT

SEQ ID NO: 34198 - protein, 137 aa, Sorghum bicolor
  Clone ID: SORBI-28MAY03-C449_1.pep
MAMASSASALLLAVSLAALHLCCRHGQAADAGSGNGITAIYSLGDSITDTGNLVKEAPPGMFETIKHLPYGVTFGHPTGRCSDGLLMIDFLAQDLSLPFLNPYLGKNKSFDHGVNFAVAGATGVDPTDQYNVTVPVP

SEQ ID NO: 34199 - protein, 202 aa, Sorghum bicolor
  Clone ID: SORBI-28MAY03-C44555_1.pep
TRVGVSMGVSGSAVAMETSHITLMSNDIRRIPKAIQLARRTHRTIIVNIIFSVITKLAIVGLALSGHPLIWAAVLADVGTCMLVIMYSMLLLRSKGGRKAKKCCASSQHGSHAKKHCVSRHCSDGPCKSTGCSKESSAGKHGCHDHGHAHTHCKEPSSQHPTEKHACHDHGHSHNHCKEPSSHVVTEKHVCHDHGNTHNHCK

SEQ ID NO: 34200 - protein, 110 aa, Sorghum bicolor
  Clone ID: SORBI-28MAY03-C44537_1.pep
MEYDFRGSRSGSGPGPYGAPPGAAPGGGSSLYPRVGQPSHGGGGASTASPRAAPYHHGSGSGSSAPVVTPLAPISSSSSSKVGIQVTIKPEFRIDPPPQLPPQMVEIPRS

SEQ ID NO: 34201 - protein, 185 aa, Sorghum bicolor
  Clone ID: SORBI-28MAY03-C44564_1.pep
TRLSTALGRPVAAVTYSLSRLSEFLSPIRTVRLSRDRATDAAMIRDLLAEGDLVICPEGTTCREPFLLRFSALFAELTSEVVPVAMENRMSMFHGTTARGWKGMDPFYFFMNPSPAYVVTFLNKLPPELTCAGGRTSHEVANYIQRLIAATLSYECTSLTRKDKYRALAGNDGVVATPKPPPTGC

SEQ ID NO: 34202 - protein, 203 aa, Sorghum bicolor
  unsure (1)..(203): unsure at all Xaa locations
  Clone ID: SORBI-28MAY03-C44568_1.pep
RQDLLQLTLNNNNDHWTCIWNSGFTVAKAYKHLSGHRTIHWSFKXIWNCSCQNKHKVLXWLILVERLSTRELLRRENMALEDHNCVLCTSSTEESLVHLLIDCXFLGLQINPQANIFQNLESFRRQLQVPFFTEIILMCWSIWETRNGIIFNNKQPSNQDAKRTFNTEFALLLLRAKRSYFPSVGFWLNILVPRKKKRLNILV

SEQ ID NO: 34203 - protein, 63 aa, Sorghum bicolor
  Clone ID: SORBI-28MAY03-C44931_1.pep
RGLTSKSHCQIGQWHFRCIYTSINQKNKNQLQTPQGSSLNFHTFHQHTKEKDNLYYRINFKST

SEQ ID NO: 34204 - protein, 75 aa, Sorghum bicolor
  Clone ID: SORBI-28MAY03-C44972_1.pep
QVHGFPDATAYGQPAGFPYGYGHGHGHAFHGGHAGGHAHAAAAPRHGQQQQQADVYLKALLILVGFLVIASLITF

SEQ ID NO: 34205 - protein, 103 aa, Sorghum bicolor
  Clone ID: SORBI-28MAY03-C44989_1.pep
LEHLAMMERVLGPLPEHMTRKASSSAQKYFRRATRLNWPEGAVSRESIRAVRKLDRLKDLVSRNAVHSKAALVDLLYSLLRFEPSERLSAQEALDHPFFRNPT

SEQ ID NO: 34206 - protein, 154 aa, Sorghum bicolor
  Clone ID: SORBI-28MAY03-C44994_1.pep
LMQKTGFDMDDVVRKYIRYTLNEKQFNPDVVVDLIHLRKASMLEDAEVAEILNEISRRIVREKGPVVMDLSGFTEQGFKRKLAVQALFGKILYLSELPEFCSRDSSLVVKEIFGVTDEDADSLRIHTLSATGDIESIQKMVDDLDIEQGPSSSS

SEQ ID NO: 34207 - protein, 146 aa, Sorghum bicolor
  Clone ID: SORBI-28MAY03-C45044_1.pep
HEETVSSPLMLPATEARGGGVSVVEMVTGALRRSLILCSSSAGAGVREPEELEEDGAAPPPGMQIGGPTDVRHVSHVTFDRFVGFLGLPADLEPDVPRPVPSASVSVFGVSPTSMQCSYDRRGNSVPTILLTMQRKLYSLGGLHAE

SEQ ID NO: 34208 - protein, 157 aa, Sorghum bicolor
  Clone ID: SORBI-28MAY03-C45050_1.pep
MAANVGESTSGSSSGADAGGSFECNICFELPQEPIVTLCGHLFCWPCLYKWLRIHSHSPECPVCKAIVEEDKLVPLYGRGKDRVDPRSKNVPGAADIPNRPAGQRPATAPQVDPNTHFPNANPNPWFMGGGIPLANARWGNYTFSAAFGGLFPLLSF

SEQ ID NO: 34209 - protein, 213 aa, Sorghum bicolor
  Clone ID: SORBI-28MAY03-C45054_1.pep
ARGPAEVHSLTCDSIRGNPSLQPCGLSTLSSPLVNARALSEGDNNSPPDNTAPDGNGSGGGFSKIEIASITSASAIVAVLLALVILYIYTRKCASRPSRRSLRRREVTVFVDIGAPLTYETVLRASGSFNASNCIGSGGFGATYKAEVAPGKLVAIKRLAIGRFQGIQQFQAEVKTLGRCRHPNLVTLIGYHLSDSEMFLIYNFLPGGNLERF

SEQ ID NO: 34210 - protein, 100 aa, Sorghum bicolor
  Clone ID: SORBI-28MAY03-C44741_1.pep
MPPTPEQAGAPAPPQKMTSALFHNRLLCLLTDILYQGQKQTRHFLEGGLYQALQVMVTNQMARDPDRRHAPPPDLVCLSGEPPRGRRRGPSGQPPRGGRR

SEQ ID NO: 34211 - protein, 247 aa, Sorghum bicolor
  Clone ID: SORBI-28MAY03-C44755_1.pep
MSSDKKTGTAVPVPETLLKKRHNKEQTLARLEKRKAEAAKARRAKRKLIFKKAEKYVKEYRSQERSLIRSRRTAKAAGHFFVEPEAKLALVVRIRGIMGVDPTTRKILQLFRLRQLNNATFVRLNKATINMLHRVEPYIAYGYPNLKTVKEMIYKRGFAKVNKQRIPIVDNSIVEKSLGKYGIICVEDLIHEIYTVGPNFKKANAFLWPFKLSNPRGGFTKKGTHFVEGGDAGNRETHINTLIRRMN

SEQ ID NO: 34212 - protein, 73 aa, Sorghum bicolor
  Clone ID: SORBI-28MAY03-C44756_1.pep
HEDPMAYCLAVMKSEGVNLIGENFMSGLKVVFDRERKVLGWKKFNCYSVDNSSNLPVNPNPSGVPPKPALGPN

SEQ ID NO: 34213 - protein, 94 aa, Sorghum bicolor
  Clone ID: SORBI-28MAY03-C44796_1.pep
FFHQEPVNGKNSQKHNVNCNRNLSGSLGDGNKQQIGFAGSAPKLTSSVCWTPAADNKKNKPNIPKAKAGDPQASGLEDQGKPNLGALLNCLGVH

SEQ ID NO: 34214 - protein, 115 aa, Sorghum bicolor
  Clone ID: SORBI-28MAY03-C45103_1.pep
YRDILNLTRVLVHGPKSKEEVDTVIDRCSGAGHWREDIMHYRKVLQDCSHDDDDDDDEEHSYLTDMGTKALRRYFFLITFRSYLYSKRSCEATFTSWMKARPELGHLCDNLKLDK

SEQ ID NO: 34215 - protein, 154 aa, Sorghum bicolor
  Clone ID: SORBI-28MAY03-C45118_1.pep
MHKVRMTVENNSKKSVAESTRSLSAMDLGDVSGSHSTGKETTRKGNESDGLWRKISNGLGFARPSDNQRTLEVNGTDSGVAFFLHFSVHTSESSTAKEEYNDTRILPVHYSDNYFSLTPGEKMAIDISFEAPQGSNPKVVLRGWNHHLDHAVMI

SEQ ID NO: 34216 - protein, 127 aa, Sorghum bicolor
  Clone ID: SORBI-28MAY03-C45125_1.pep
TRAIRNPGSLHLMPFWILFENVMSMHRMRAAVTGLLETARANDWVVTEKVGDLVKDDLDVPLLEPVKPTECVERIYFPELLLALLLLICASYDFVLGSHKYYLYLYLQAFAYVVMGFGFVGTKTPCS

SEQ ID NO: 34217 - protein, 173 aa, Sorghum bicolor
  Clone ID: SORBI-28MAY03-C45131_1.pep
MYSLYEALSSGVTLRGWWNGQRMWIIRRTTSYLFAMVDTVSRLLGLSAMAFAVTPKVSDDEDQSRRYEQELMEFGASSTSSPELVIVAATALLSLVCLAGGLSRVLASGCGSASCLSEFCLQIVLCGALAAVNVPVYEAMLLRKDRGRVAFRISVAACFGLVLPACLIWVNVF

SEQ ID NO: 34218 - protein, 162 aa, Sorghum bicolor
  Clone ID: SORBI-28MAY03-C45128_1.pep
HEADDDDNSSSCSNSGATATSPRSCNAFQLISSMSSGFDLSGLFENEQKAATVFTARAAAATVVEKLESVARTLGFEITRGKESGKVRMEAKAEGTNGRLAVTAEVLEVAVDVAVVEFAHDAGDALDFNKFCAVDVRPGLAEIVWAWQGDSPPAPAAAVGTA

SEQ ID NO: 34219 - protein, 54 aa, Sorghum bicolor
  Clone ID: SORBI-28MAY03-C4514_1.pep
SKRAYVKLDPLKPPAPFFFFFFFFFFFFFFFFFFFFFFFFFFFFFFELQKQHKL

SEQ ID NO: 34220 - protein, 144 aa, Sorghum bicolor
  Clone ID: SORBI-28MAY03-C47595_1.pep
ASDSSWGLFLVSLLFICTLTELVSMWNLTKVEIQLCNMLSPEGPKVSLDSYNWGLVFIAVLVDNFLYPVSAFRSHFSQSINWSGIRYYLRDGKISKIERENSSKYTDLGGKHLYGKRTYPSNKSLLGYLSRTLVQWHQPKKYDV

SEQ ID NO: 34221 - protein, 162 aa, Sorghum bicolor
  Clone ID: SORBI-28MAY03-C4761_1.pep
VRGNFMMPMNMNQPLIPNAPFNYPLQQDGNPQYFSAPFQMQLPDTGSDQGSMPSVQPPAGPMSFPEGLQRPWAMGLMPFQSMALGQGMADGAGDPQGGGGLAFMQAGFGGMPDGSMNTGMPDRGDGRGILAQMPIQMQMQMSLPPPPPTQPPSGSQQTFNRS

SEQ ID NO: 34222 - protein, 131 aa, Sorghum bicolor
  Clone ID: SORBI-28MAY03-C47613_1.pep
NVNTASEECPLRETVWKNLPRKVEKKRIEVPQQENDYDCGLFVLYYMQRFIQEAPERFKKKDYSMFGKRWFRPEEPSQLRDQIRHLLHLCRETEVKKGVTGSCGESQPKIENDGTDPSDASEPTTPKHLSE

SEQ ID NO: 34223 - protein, 81 aa, Sorghum bicolor
  Clone ID: SORBI-28MAY03-C47653_1.pep
RILQVARPPFIPTPSPQDESGDEALDVEKVVHEVFASNEAEAATKAGEGGKASPVADGARVGGDGDGRRDQSKDGDFSVFF

SEQ ID NO: 34224 - protein, 127 aa, Sorghum bicolor
  Clone ID: SORBI-28MAY03-C47668_1.pep
MLVRLEYQDVRHKPAPLILGSVMGEDSCRRHCNVIYNELVCATFGHNNDAQQNSCNLYSVGDGGLLRAAYVRVLTSYHAFLFGVANIVMTAGSNVGSNVELRIFLPSTKQNSSAGLWQHCSNDSAIC

SEQ ID NO: 34225 - protein, 151 aa, Sorghum bicolor
  Clone ID: SORBI-28MAY03-C45243_1.pep
MATILENIQKARFLPTRPLKDELPTFQGGGGGKEESHLMGLRKRLSSLSGKIQPISSASAEWAFRRSKSAPSLGAAFAAGGGSLRQWWQWGVGWPPSAGPAGAGDLEMNEEEVAALGRQSRGSWGHILYKMRSGVRRLVMSTHSLPTRTSS

SEQ ID NO: 34226 - protein, 149 aa, Sorghum bicolor
  Clone ID: SORBI-28MAY03-C45246_1.pep
MSPAARRLLLAGAARRRRFSTDAAASDPSRPSQQLPKDKRWDAVVIGGGHNGLVAAAYLARAGRSVAVLERRGILGGAAVSESDLVPGFRFSRCSYLLSLLRPAILRDLELERHGLKLLPRSPSSFTPCLDGRYLLLGPDAELNFSEIS

SEQ ID NO: 34227 - protein, 169 aa, Sorghum bicolor
  unsure (1)..(169): unsure at all Xaa locations
  Clone ID: SORBI-28MAY03-C45249_1.pep
TRVPHLLGVFLDNRGIHHQNAHVSRRAGYLFMRAVKSLKAKLVPYLDTILQSLQDVLSQFTSMDWANKDTKFPSSEDGSQIFEAVGLLIGIEEVSPEKQAQCLTAFLNPLCHQIESLVLDAKARGLEESSPRAISLQQIIVALNMVSKGFNERLVMVNRPAIGVMFKXT

SEQ ID NO: 34228 - protein, 157 aa, Sorghum bicolor
  unsure (1)..(157): unsure at all Xaa locations
  Clone ID: SORBI-28MAY03-C45269_1.pep
QGKYVYVDGDGSVPTESAKADGFDAVARVGVAADHRGIVCSHHVFRIVQHWLHAGEPDPFYDPLTDYVILPALYDIEXHCEKHGDVMSVTEDWEIISQSDGRTTRPGELPPMISTLTTSREGKEGTLEEAQATVVVHPEKQGRQHVEVRAVGVSHGG

SEQ ID NO: 34229 - protein, 82 aa, Sorghum bicolor
  Clone ID: SORBI-28MAY03-C45283_1.pep
SVWYVLSYMEAQGRLRKGDRVLMVTFGAGFKCNSCIWTVENPATDAGVWKDRIHLYPLKDVSNPFMEKYGFLKDLTIDGPMM

SEQ ID NO: 34230 - protein, 106 aa, Sorghum bicolor
  Clone ID: SORBI-28MAY03-C45278_1.pep
PYVDESVIIDINPDNKDMSPDFLRWLRERNLSSDDRTMRLKEGYIKEGSTVSVMGVVQRNDNVLMIVPPSEPISTGCQWTKCVLPTNLDGLVLRCEDTSNIDVIPV

SEQ ID NO: 34231 - protein, 88 aa, Sorghum bicolor
  Clone ID: SORBI-28MAY03-C45286_1.pep
LALMLPLLDFNINAVRARCCCFLLGPPTWPTPLCLLTHPVQLLATVESRRRRWRAWSPVLFVGTVVGRLAYCTSLARCRVLFQVSSLI

SEQ ID NO: 34232 - protein, 249 aa, Sorghum bicolor
  unsure (1)..(249): unsure at all Xaa locations
  Clone ID: SORBI-28MAY03-C45059_1.pep
ARGRAAGLKVISCIVQRDEARMPMRHTFLWLDEKSCYEEEQILRHVEPPLSALLELDKLKVKGYNEMKAPPSRDRQWHIYTLRNTENPKMLHRVFFRTIVRQPNAGNKFTSAQVSDTEVGGPEDSLSFTSNSILRSLMTAIEELELHAIRTGHSHMYLCILKEQKLLDLIPFSGSTIVDVGQDEATACSLLKSMALKIHDLVGARMHHLSVCQWEVKLKLDCDGPASGTWRVVTXNVTSHTCTIDIYRE

SEQ ID NO: 34233 - protein, 48 aa, Sorghum bicolor
  Clone ID: SORBI-28MAY03-C45063_1.pep
QCVEFELVANLSRFQGRCLMLELRLKHKACSCLCNAHQHPVVMHCKKL

SEQ ID NO: 34234 - protein, 163 aa, Sorghum bicolor
  Clone ID: SORBI-28MAY03-C45072_1.pep
MATTSFFHPLAASMASGGVRLHRCPFSLTTPARTAPRRPVPLLVVCAKRAGSRAPVAAASHQPANPSAVPKREVEEEVEEVEEEMPWIQDKALDLVEFTGTVTQAIPGPRVGSSPVPWLLAVPLAYVGVSFVLAVVRTVRRFTSPRTKKKRRVGKNIFLLKSL

SEQ ID NO: 34235 - protein, 147 aa, Sorghum bicolor
  Clone ID: SORBI-28MAY03-C45098_1.pep
EPVPESNDGDVKMVVGKNLDLIVLDESKDVLLEIYAPWCGHCQSLEPTYNKLARHLRGVDSLVIAKMDGTANEHPRAKSDGYPTILFYPAGKKSFEPITFEGERTVVDMYKFIKKHASIPFKLKRQESSTQMEEGVKSSDTNLKDEL

SEQ ID NO: 34236 - protein, 185 aa, Sorghum bicolor
  Clone ID: SORBI-28MAY03-C45416_1.pep
LHAPLSPADRLGRQRLKASLVPVLDQVDRRYNHYCDQMQMVVNFFDSVMGFGAATPYTALAQKAMSRHFRCLKDAIAAQLRTTCELLGEKDAGTSSGLTKGETPRLRAIDQSLRQQRAFHHMGMMEQEAWRPQRGLPERSVNILRSWLFEHFLHPYPSPAATPPAPTPRTLRPPPAQRSSRNSNS

SEQ ID NO: 34237 - protein, 165 aa, Sorghum bicolor
  Clone ID: SORBI-28MAY03-C45422_1.pep
MAAAAASFSALPFLLLLLLVPSLDAASNVTYDHRSLIISGRRRLIISTSIHYPRSVPEMWPKLVAEAKDGGADCIETYVFWNGHEIAPGQYYFEDRFDLVRFVKVVKDAGLLLILRIGPFVAAEWNFGGVPVWLHYVPGTVFRTDNEPFKSHMKSFTTYIVNMMK

SEQ ID NO: 34238 - protein, 107 aa, Sorghum bicolor
  Clone ID: SORBI-28MAY03-C45445_1.pep
MEMLTGKAPLQSQGQDDVAIDLPRWVHSVVREEWTAEVFDVQLMKYPNIEDELVQMLHIAMACTAWSPDRRPTMAEVIRMMEELRRPASESRTPSIGNPKESSPLSA

SEQ ID NO: 34239 - protein, 60 aa, Sorghum bicolor
  Clone ID: SORBI-28MAY03-C45495_1.pep
LQSHYLHLCHTLKSRANPCFSISFAQNRKCTLLHWLFAFSVKDTIRHDKPIMHLYNSFQK

SEQ ID NO: 34240 - protein, 47 aa, Sorghum bicolor
  Clone ID: SORBI-28MAY03-C45531_1.pep
YGNTSAASIPLALDEAVRSGKVKNGDIIAASGFGAGLTWGSAIVKWG

SEQ ID NO: 34241 - protein, 60 aa, Sorghum bicolor
  Clone ID: SORBI-28MAY03-C45525_1.pep
ISVPLDNLVPYALVRSLALVKRVLRSVDHSSQLRLGAIGCLQEVIEGAGRWKLYCRTWFR

SEQ ID NO: 34242 - protein, 140 aa, Sorghum bicolor
  Clone ID: SORBI-28MAY03-C45144_1.pep
YLAEVITASCLFTCNKTEFLFLQCKEVQNRWRRPHRTTRMTMISEETSILPVLLFRRRIYVYIVRGITTPDVPCGTHAHTYRRFSLRIGGAVSVSQRRRRRREVAAAAAEEAGVPSRGAPSVPGPVVGGEVDAVEAEAEP

SEQ ID NO: 34243 - protein, 163 aa, Sorghum bicolor
  Clone ID: SORBI-28MAY03-C45175_1.pep
MQNVVEVEPGRPAADGRPSVGPTYRSAYARDGFPPPVPGMDCCYDIFRMAVEKYPNNRMLGHREIVDGKAGAYVWKTYNEVFDIANKIGNSIRSCGLAKGSRCGIYGANCPEWIITMEACNAHGIYCVPLYDTLGAGAIEFILCHAEVEIAFAEEKKIELLVK

SEQ ID NO: 34244 - protein, 200 aa, Sorghum bicolor
  unsure (1)..(200): unsure at all Xaa locations
  Clone ID: SORBI-28MAY03-C45235_1.pep
ARGEISAKMKAEMKEKTMRAFLLSQKHIVYTEPLEVRAGTTVDVLYNPSNTVLNGKPEVWFRGSFNRWTHPSGPLPPQKMVKTENGSHLRTTVRVPLDAYMMDFVFSESEEGGIYDNRNGIDYHIPVSDSVAREPPMHIVHIAVEMAPIAKVGGLGDVVTSLSRAVQDLGHKVEVILPKYDCLNLSSVKDLHYQQSFTXG

SEQ ID NO: 34245 - protein, 68 aa, Sorghum bicolor
  Clone ID: SORBI-28MAY03-C4522_1.pep
LPKSEHTVRHKLVPLGSGSQQLPKITVTSVRYSAALTPSASAATVLWAPSEPKFNLETNHSTSDEIVS

SEQ ID NO: 34246 - protein, 71 aa, Sorghum bicolor
  Clone ID: SORBI-28MAY03-C45649_1.pep
AALAQDKIFKDAHQEALRKEIERLRQIYQQQSLKSGGGEAPAPDAAPVCGDKDDMIGSSEGTAAPALGPPS

SEQ ID NO: 34247 - protein, 175 aa, Sorghum bicolor
  Clone ID: SORBI-28MAY03-C45686_1.pep
ILVPVARKFTGREKGFSELQRMGIGLALSILAMVSAALVELKRLEIARSEGLIHEKAAVPMSILWQIPQYFLVGAAEVFTCIGQVEFFYDEAPDAMRSLCSAFALITVSLGSYISSIILTLVSCITTQGGDPGWIPDNLNEGHLDRFFWLIAGISFVNLIVYMGCAVRYRYKKAS

SEQ ID NO: 34248 - protein, 141 aa, Sorghum bicolor
  Clone ID: SORBI-28MAY03-C45732_1.pep
MGDLNHGSSLPLLLCLHLLLPLLPFAMADIASEKQALLAFASAVYRGNKLNWSQNIPLCSWHGVICSPDRSRILALRVPGAGLIGTIPANTLGRLVFLQVLSLRSNRLSGSLPYDVASLPSLQAIFLQHNELSGDLPPFLS

SEQ ID NO: 34249 - protein, 95 aa, Sorghum bicolor
  Clone ID: SORBI-28MAY03-C45750_1.pep
MGNCCAAPLTEESGKNRPKKHKANPYNVAYNRGAAPPPARPGLLVLRDPTGRDLGAQYELGGELGRGEFGITYLCTESATGARYACKSISKRKLR

SEQ ID NO: 34250 - protein, 183 aa, Sorghum bicolor
  Clone ID: SORBI-28MAY03-C45753_1.pep
TRHKSRQLPATPSSRRSAKTPTKDDTAIATPKSTSSPNNPKDSTEKPSRVRNTSVSPSPSKHDSNGTSTTASTKRKIQDDAQTASTPSKKQKRLMHTKSYVALFSTGQGQPESQVLAPLRQDKEKASDVQPEGDGAVLAHEESNALEQPNQEPSNVSAGKVLGGHSSDLHETEVILEGDGLKI

SEQ ID NO: 34251 - protein, 134 aa, Sorghum bicolor
  Clone ID: SORBI-28MAY03-C45298_1.pep
ETWCLQLPQADTGHELVGSSSHLRQLPVRRHNRLKIMEIEGFNCTKSLVELTCSIVKSAVSLACLKLYTLRYGKSPCCWDGFCIPYGKSEVEEASRAAAAIRRYIEDKVAPTTKLTIMEPCPRCIATAMDDGLA

SEQ ID NO: 34252 - protein, 139 aa, Sorghum bicolor
  Clone ID: SORBI-28MAY03-C45335_1.pep
PSGNILVIFEEKGGDPTKITFSRRAVTSVCSFVSEHFPSIDLESWDGSATNEGTSPAKAQLSCPIGKNISSVKFASLGTPSGTCRSYQKGSCHHPNSLSVVEKACLNTNSCTVSLSDESFGKDLCPGVTKTLAIEADCS

SEQ ID NO: 34253 - protein, 67 aa, Sorghum bicolor
  Clone ID: SORBI-28MAY03-C45329_1.pep
GGDAHVGGGADDLYGRFEPGVRVRYGPAAAGAAAGDVSLTLGLQHAGAGNAGPDSTGRFSLRDYSGC

SEQ ID NO: 34254 - protein, 123 aa, Sorghum bicolor
  Clone ID: SORBI-28MAY03-C45344_1.pep
MSTELLTKFLTLLFGYAMPALECFKAIEQRPRRADQLRFWCQYWIILVLLVMFHEIAGVLISKIPMYYELKLAFLVYLWYPKTRGTDIVYETFLQPLVMQYQPNIEARLQYLRANAGDILVFY

SEQ ID NO: 34255 - protein, 157 aa, Sorghum bicolor
  Clone ID: SORBI-28MAY03-C45813_1.pep
MNGLVFDVRPSQVVTLEESTGFESATSFKQEEQDPQCSVFTSRGQRPLHEIIFACDDKPKLLSQLTSLLGELGLNIQEAHAYSTSDGYSLDIFVVDGWKYEADILRSALREGVDKIKYKAWPLVPSMSARMDHQPLEVSPSSDFVQIPADAADVWEV

SEQ ID NO: 34256 - protein, 184 aa, Sorghum bicolor
  unsure (1)..(184): unsure at all Xaa locations
  Clone ID: SORBI-28MAY03-C45836_1.pep
ARGIRTVSLSPTAEELKKNVSMNLKPPSKIELHKSFDENDPTNKXLPHEKVNVSSIRATAYTVADLQVATKSFSADNLVSEGRFGCIYRAQLCDQKILAVKKINFSALPGHPSDFFIELVGNIAKLNHPNLSELDGYCSEHGQCLLAYEFYKNGSLYDLLHLSDGYSKPLSWNNRVKIALXSAR

SEQ ID NO: 34257 - protein, 211 aa, Sorghum bicolor
  unsure (1)..(211): unsure at all Xaa locations
  Clone ID: SORBI-28MAY03-C45848_1.pep
TRLMFFLWSAYLLADSTAIYTLGHLSVDSRSDEHQLVAFWAPFLLLHLGGPDNITAYALEDNALWLRHLQTLAVQVLGAAYVIYEYIVNRGALLLLASMSMFVAGLLKYGERIWALKCGNISSIRSSISIRKVKTDPYQLLALSTSEEDLLLGAHSQFDICKGVFADIIMLPNPSLRSQSKPRSVISYLXDDLYKLVEMELSLMYDFLYTK

SEQ ID NO: 34258 - protein, 180 aa, Sorghum bicolor
  unsure (1)..(180): unsure at all Xaa locations
  Clone ID: SORBI-28MAY03-C45850_1.pep
TRHIPRPQSDLRYSKQTDVGVTHFRSGMSHEEDQLIPNLYRYIQPWESEFIDSQRVWAEYALKRQEAQSQNRRLTLEDLEDSWDRGIPRINTLFQKDRHTLAYDKGXWRVRTDFKQYQVLKQNPFWWTHQRHDGKLWNLNNYRTDVIQALGGVEGILEHTLFKGTYFPTWEGLFWEKASG

SEQ ID NO: 34259 - protein, 195 aa, Sorghum bicolor
  Clone ID: SORBI-28MAY03-C45859_1.pep
TRPDLFTFNIFLHTYCNLGKVEQILHLLDQMKSEGLKPDIVTYGTIIDGYCKAKDMHKANEYLTQLMKNGLRPNAVVYNALIGGYGTNGNISDAIGILDTMKYNGIQPTPVTYNSLMYWMCHAGLVEEVKAVFAQCIVKDIELGVIGYTIIIQGFCKIGKIDEAVMYFKEMHSRGIPPNKMTYTTLMFAYSKSGN

SEQ ID NO: 34260 - protein, 171 aa, Sorghum bicolor
  unsure (1)..(171): unsure at all Xaa locations
  Clone ID: SORBI-28MAY03-C45871_1.pep
ARGVVQAVGNAGPDANTVVSFSPWILSVAASTTDRKYRKSIIIGNGKVFSCGALSAPTPXETMYPLAWADDVVNENSSDGSVNCQDPRMFIRPLVQGKVIICMFDSSHYYEDDPDLASVIDTIERIGAAGVIITDRSSGDIDIDFEPTFPTTVPSAIVLRGSDMRALFRYX

SEQ ID NO: 34261 - protein, 143 aa, Sorghum bicolor
  Clone ID: SORBI-28MAY03-C45851_1.pep
TRLSSLDPPLVFEVGIDMLALADVPGGKPEWASAAIIAILTLWDRQEFSSMRETIVRAVVTNLHLLDLGMQVSLFKRLLQMVRNLRAESHRMHALACICRTALCVDLFAKESVRRGQKPVPGTDVISLFEDVRVKEDLNSVTS

SEQ ID NO: 34262 - protein, 62 aa, Sorghum bicolor
  Clone ID: SORBI-28MAY03-C45538_1.pep
LLMLLLFLDFIQQLTSDSMEVLNILELVSDSKLQLALFLAEDEAWVRCFAGYKVMLSSFRFS

SEQ ID NO: 34263 - protein, 132 aa, Sorghum bicolor
  unsure (1)..(132): unsure at all Xaa locations
  Clone ID: SORBI-28MAY03-C45554_1.pep
KSLAETFPEIRKALKENEPXKCLFNDCVHLGEHGCVVKGEWERYPYYLQMLDEIKIREEIQLRTFGTKREGDVRYKTGVMGLKQAEPRLELKKHRRVSRKKINQSIIDEIEDDIDDLDDDYQFDVKQRTRKR

SEQ ID NO: 34264 - protein, 122 aa, Sorghum bicolor
  Clone ID: SORBI-28MAY03-C4562_1.pep
RDVGIDEKFWEQDFEIPSCHQCGGVLKPDVVMFGDNVPQERADSAKEAARTCDALLVVGSALMTMSAFRLARLAHEAHAPIAAVSIGETRADSILSLKINARCGEILPRILQMGSLVVPNIS

SEQ ID NO: 34265 - protein, 87 aa, Sorghum bicolor
  Clone ID: SORBI-28MAY03-C45631_1.pep
ITEYFHGDSAKEEAHPFRIFMVVRDFLTVLDQVCKEVGRINDRTIASSVRHFPVPVNPMMPQLFPRLHALRAGFSDDESSAASVSSP

SEQ ID NO: 34266 - protein, 86 aa, Sorghum bicolor
  Clone ID: SORBI-28MAY03-C45625_1.pep
AMIRKWLLMHLMLMTVPTTRVQCLQADHFSAIISKCWPEMEAATNLTRQTEASPPALVGFTCASSVTTTGSSYKMDAAQVAGSNIT

SEQ ID NO: 34267 - protein, 202 aa, Sorghum bicolor
  Clone ID: SORBI-28MAY03-C45926_1.pep
ARGAAAAEEAGMGPGAGRPPLPGGRGFTHTQSHHVAARKEKQLETLRAALGLDVEDAKKKGDVESDVESGELVPGKYYEELDTAWQKDSKDSKDAKKSKKKKESDKRSRHKSSRKSKYDSDSDDDHDTKTKRKSSRHDSEDGSETDYDEKKEKKHKKKPRLGSDDDSENDRKNAKRVKNSRHDSESDTDSGYGKNKAKHAKN

SEQ ID NO: 34268 - protein, 88 aa, Sorghum bicolor
  Clone ID: SORBI-28MAY03-C45917_1.pep
MPSPRQFLQLLLPILLATCCVDGGNGPDDALATARRQLHQPFFVPDQPGQPSAPPPFFSAMPVTPPPPMPTGQNQPTYPALVLPTPAP

SEQ ID NO: 34269 - protein, 233 aa, Sorghum bicolor
  Clone ID: SORBI-28MAY03-C45960_1.pep
ARGNNPVLIGEPGVGKTAVVEGLAQRIVRGDVPSNLLDVRLIALDMGALVAGAKYRGEFEERLKSVLKEVEEAGARVILFIDEIHLVLGAGRTEGSMDAANLFKPMLARGQLRCIGATTLEEYRKYVEKDAAFERRFQQVFVAEPSVPDTISILRGLKEKYEGHHGVRIQDRALVVAAQLSARYIMGRHLPDKAIDLVDEACANVRVQLDSQPEEIDNLERKRIQLEVELHAL

SEQ ID NO: 34270 - protein, 175 aa, Sorghum bicolor
  Clone ID: SORBI-28MAY03-C4597_1.pep
LKARKTVLDPPWEGTNLIPGDVLWSDPSLQMGLSPNKERGIGLLWGPDVTQQFLQTNHLKLIIRSHEGPDARDKRHDLLEMDNGYTIDHEVECGKLITLFSAPDYPQFQASEERHNNRGAYIVLNPPDFATPVFHSFEAVKPRPAAHPFYDFEEVIDSDEELNLDAMDSGTSSLS

SEQ ID NO: 34271 - protein, 190 aa, Sorghum bicolor
  Clone ID: SORBI-28MAY03-C45974_1.pep
TRVEPIIPIIFQRTKATCFAYGQTGSGKTYTMQPLPLRAAQDMVRLLHQPVYRNQNFKLWLSYFEIYGGKLFDLLSDRRQLLMREDGKKQVCIVGLQEFEVSDVQIVKEYIERGNAARSTGSTGANEESSRSHAILQLAVKKHIIVKDTRRQRDRDANEAKNTKAVGRISFIDLAGSERGADTTDNDRQT

SEQ ID NO: 34272 - protein, 100 aa, Sorghum bicolor
  Clone ID: SORBI-28MAY03-C45989_1.pep
MTAPVALPNDLETVSHSARVDLFRDTSCNIEKEVLASLGNGQNSTAAGTNPGFRVGEIRFANGDIYSGTLLGNTPEGSGQYRWSHGCTYEGEWRRRMRHG

SEQ ID NO: 34273 - protein, 90 aa, Sorghum bicolor
  Clone ID: SORBI-28MAY03-C46011_1.pep
ESENGDGPAGGFTRALRERIEPQDKSTEAGALISKLTEEKNSAIQQNHRLRQELDLVRQEISKRRGGGFSFIIVIIVALIGIILGYLMKS

SEQ ID NO: 34274 - protein, 177 aa, Sorghum bicolor
  Clone ID: SORBI-28MAY03-C45758_1.pep
HEAFAAYGSDIAVFKRTDQVATWSRHEEKVNMLYLFGEYVLSADAKGNVFMWAFRGAQPNTEPVGSISLGDKFTPTCIMHPDTYLNKVIVGSEEGPLQLWNISTKKKLYDFNGWNSPVRCCVSSPALDVVAVGCSDGSVHVHNVRYDEELMSFNHQIRGAVTALSFRTDGQPLLASG

SEQ ID NO: 34275 - protein, 188 aa, Sorghum bicolor
  unsure (1)..(188): unsure at all Xaa locations
  Clone ID: SORBI-28MAY03-C45791_1.pep
MTVIAEGGRVNGTSXGEKFRSAVSARKANVLREIFQLDTRGLLLEKAKAEVREKLQGWNISTSSQLAKKGKSERREKQVENNIKVNGILSDNPINRCKKYSSKDADVEIPVTDVVNPEQMRVPMSIDVPDPDFHDFDKDRTERAFGNDQIWATYDSEDGMPRLYAMVQKVISMKPFRIRMSFPHSKSN

SEQ ID NO: 34276 - protein, 180 aa, Sorghum bicolor
  Clone ID: SORBI-28MAY03-C45809_1.pep
HEAKSARNIMLLELKKLIEANPLFRDKLNFPPFKASRLRTLINQSLNWQHQLCKNPRPNPDIQTLFTDHSCAAPTNGARAPPPANGPLVGSIPKSAGFPPMGAHAPFQPVVSPSPNAIAGWMTNANPSLPHAAVAQGPPGLVQAPNTAAFLKHPRTPTSAPGIDYQSADSEHLMKRMRVG

SEQ ID NO: 34277 - protein, 116 aa, Sorghum bicolor
  Clone ID: SORBI-28MAY03-C45810_1.pep
HEDKNGNPPGIIRTIVSDPMPDLFKTMIKRLVRWQVLPTTCVPDSCIVNIYEPGDCIPPHIDSHDFVRPFCTVSFLSECNILFGSNLKASAPGEFTGSIATPLPVGYIFCHILSAC

SEQ ID NO: 34278 - protein, 113 aa, Sorghum bicolor
  Clone ID: SORBI-28MAY03-C46103_1.pep
VATKAYVDQFSRCLYVEYKSKGIDVQCQVPIQVATKLASIRKPTFLAPSPETYARAAVRYIGYEPRCTPYWGHALVWLLISLVPEPIADRMFLNRSVTIRAKGRAKEAKKKAQ

SEQ ID NO: 34279 - protein, 40 aa, Sorghum bicolor
  Clone ID: SORBI-28MAY03-C46105_1.pep
SVPLHVVLQDWIRHTDGKLSFLGFVKLLHGMSSRSLSKMR

SEQ ID NO: 34280 - protein, 81 aa, Sorghum bicolor
  Clone ID: SORBI-28MAY03-C46115_1.pep
FLRSKLGGDKYNYHLSVTGGNVNIDHNRKPTTSLQLAKYTGGSSSGYNIYSHIHARTNIIIALALAQPPQLYKSNFMTKHR

SEQ ID NO: 34281 - protein, 48 aa, Sorghum bicolor
  Clone ID: SORBI-28MAY03-C46126_1.pep
RADNPGVWFMHCHLEVHVSWGLKMAWLVLDGDRPNEKLLPPPSDLPRC

SEQ ID NO: 34282 - protein, 52 aa, Sorghum bicolor
  Clone ID: SORBI-28MAY03-C46130_1.pep
HLPNSQYIVNTERGRKLFTIKKNVAKWYDKLSKLETWKQVVKMQKEHPGACE

SEQ ID NO: 34283 - protein, 84 aa, Sorghum bicolor
  Clone ID: SORBI-28MAY03-C46145_1.pep
YRPFGTIFAFTDEERVRQRLALYQGVCPIQMEFSDDAEKTFGNALSYLLKHGMVKDGEEVALLQSGNQPIWRSQSTPNIQVRKI

SEQ ID NO: 34284 - protein, 171 aa, Sorghum bicolor
  unsure (1)..(171): unsure at all Xaa locations
  Clone ID: SORBI-28MAY03-C45874_1.pep
MLESATSTGLMNNQVLEKIYSFIGDESANQLGVHTQLRFLHXSLSSMRGALEDVADMEDLDNGTKAWRNEVSGLYYDAEDCIDDFRHRVDSGPSHGGQGFMRRAGHLLETLMARYQISRKIKELRTRAQEANDRRTRYKLDECVSRSARVSVDPRITALYAETSSLVGIDA

SEQ ID NO: 34285 - protein, 156 aa, Sorghum bicolor
  Clone ID: SORBI-28MAY03-C4588_1.pep
RPSVLELGALKLSAAASRKRRRPIGTAPALLDGGVQEEEEEEQAADDDPTATQALFAELDERGTTSELENLALNIQGLGSSKRRQGGGGARSQQRAAAVGGGETAELTDDFWEELLNEGMRGGAAAELLPPERRRPGWYVDALAQKLSSMSNTTAK

SEQ ID NO: 34286 - protein, 217 aa, Sorghum bicolor
  Clone ID: SORBI-28MAY03-C45898_1.pep
ARGQSCSPGKQSRPPFAKRVHPAGDGNDSGGKVAQQEGLALTSKLDSSSNDLIGKVGDNGAFDVALGQHCHSDNLISEHSQPVAASAGTHKMQESRSDLNVSSSAGDPILMSQPASGVSYMSVQTTKSSMASDPLQSHPQSLCPPEHMSSSNMIQPPGQPTFTTSEFPQMQFQHKVIAPANEFLQNQMRSYPPQDVSHPRPFNFHHHTLPPAIPSNQ

SEQ ID NO: 34287 - protein, 180 aa, Sorghum bicolor
  Clone ID: SORBI-28MAY03-C46211_1.pep
ARGRGLAPGADTLLGLPANVRHRLRPPLPRTFFGNAVVRDLVTAPVSTVLDSSLGSVAETIKKAVDRVDDAFARSVLDYLELQQNNAGGGGQQAQAAQAPSREQLVPATDLWAVSWLGMAMYDADFGTGAPRFVAPAQMFGVGTAYMTPRGPDRDDGIAVLISLEPEYLPSFEKVFFYNE

SEQ ID NO: 34288 - protein, 47 aa, Sorghum bicolor
  Clone ID: SORBI-28MAY03-C46194_1.pep
PTDIDVTKRETYLSLSEFREKFGMTKEAFGKLPKWKQNRLKIALQLF

SEQ ID NO: 34289 - protein, 69 aa, Sorghum bicolor
  Clone ID: SORBI-28MAY03-C46214_1.pep
QVPCSSSERGMRLWRSISYTGGKASGQCGFCFRNMKFTILALGFYARFFFWPMVQPFRRLCTKILVFYV

SEQ ID NO: 34290 - protein, 166 aa, Sorghum bicolor
  Clone ID: SORBI-28MAY03-C46289_1.pep
RAVPCLCLPGVVEDSRGATLPAYRGTLPESPRYLIRHARMSLSRGGLQSLASKGKAIGRLKSLFFTTSIILVVGAGGLLLVLCFLLFSCMCSTMQYVKKKNPAVSGSRRSSLRPCNGARHGLRKRSRLLPPLWRCGFQFQQQQACASDAAGIAGGQVLSHSRRRQP

SEQ ID NO: 34291 - protein, 168 aa, Sorghum bicolor
  Clone ID: SORBI-28MAY03-C46298_1.pep
TSVGRSWFLRNKAKNGLGSPTAAAGTKQSKSNQTGIIAYAETEEYLNSESTVVAYDNQSVAEYFYNGDLWVSFDGAQVVQQKLEFAARSQLLGYFLWTVGFDDSNSTISKKASESWHQYTQGGFGIMHAGGSNQYVAFNSSSVSLGSWYSKSLSCLLSSVLLLVILFH

SEQ ID NO: 34292 - protein, 50 aa, Sorghum bicolor
  Clone ID: SORBI-28MAY03-C46301_1.pep
GYPEPEDHEEGVPLSRNPPWIWCCLKSYYRDKSDIWGSRAYQIFATEIKD

SEQ ID NO: 34293 - protein, 82 aa, Sorghum bicolor
  Clone ID: SORBI-28MAY03-C46026_1.pep
RASPVIDLNEACELGYEEMEIDEHHGYRAPLGINKSKRYPMEGDAAAGPSQVRMPVFWDVQNPAGRSGKRKISWQDQLALRV

SEQ ID NO: 34294 - protein, 159 aa, Sorghum bicolor
  unsure (1)..(159): unsure at all Xaa locations
  Clone ID: SORBI-28MAY03-C46056_1.pep
AGTMKNSTACCKAMLTYVAHXQKQSFITNLQALNCASFLGAKLQKTNVSSNVYSSCQITLKDFSLQVGSQESGCLLPSMPSDASFDSTSGISFTCDLNDNIAAPWPSSMQAPSSSCNKSVNIPERPAATSAQNGVNHKNLKLRLLASLVSLLLVLLVQV

SEQ ID NO: 34295 - protein, 82 aa, Sorghum bicolor
  Clone ID: SORBI-28MAY03-C4607_1.pep
MVTSLRLAHGIMTTASAMSCVIAILTFYPSFVDCNISWLLFDFKMLMLGTSMYNPTSSYVHIYLIMCCSLLLYSFVNDKQNI

SEQ ID NO: 34296 - protein, 114 aa, Sorghum bicolor
  Clone ID: SORBI-28MAY03-C46073_1.pep
LLSDAKQGQYAPRNVLPRLVSRTVAVALATTVAAMLPFFGDMNSLIGAFGFLPLDFAVPALFYNVTFKPSKKGFLFWLNTTIAVVFSGLAVIASVAAVRQIALDAKTYKLFANV

SEQ ID NO: 34297 - protein, 166 aa, Sorghum bicolor
  Clone ID: SORBI-28MAY03-C4635_1.pep
RRRNAVLSVESDKTDEVELQRAVDRASAALLRPLGAAVADYTARTCAETVPGHYVVYWELQLPLGAADVVVDGGDVLDRCCLEMEEALSSVYRQSRVASGTVGPLEIRVVRPGTFEELADHAVARGVSVGQYKVPRCVTAPPDVELLDSRVVSNHFSPALPKWVPG

SEQ ID NO: 34298 - protein, 104 aa, Sorghum bicolor
  Clone ID: SORBI-28MAY03-C46354_1.pep
MAWRRVLTQIARHRPTKAIYNELGASSPLGTLRSDITAGARIKNLQERNQSSYIGSLARRVRDLESPSETSLLKEIYRSDPERVIQIFESRPSLHSNPAALSEY

SEQ ID NO: 34299 - protein, 164 aa, Sorghum bicolor
  Clone ID: SORBI-28MAY03-C46363_1.pep
MGNMMDNLLVRSLTSKSKGRTDDIAPPSPVKAPDDEADKAEEEESPMMETVRSKCITQLLLLGAIDSIQKRYWSRLKATQQIAIMDILLSLLEFASSYNSPSNLRTRMHHIPPERPPLNLLRQELAGTTIYLDILHKSTVEQDEKDSTEETNGLNVESGDQEKI

SEQ ID NO: 34300 - protein, 230 aa, Sorghum bicolor
  Clone ID: SORBI-28MAY03-C46366_1.pep
MAPAGRLLAVAALSFLCLQGLWGDSGSALPQGQPPLHRIVRAEANDGGGGGLMPELPPSGFMPMPDLSPSPSGSPRPFVPFLAPAPLAPFFNNSTPKLSGKCTLNFTAVDKLMTTTAVDCFTSFAPFLANVICCPQLQATLTILIGQSSKQTGSLALDPTVANYCLSDVQELLLSQGASDNLHSLCSVHLSNVTEGSCPVSTVDSFESVDDSAKLLEACRKIDSVNECCS

SEQ ID NO: 34301 - protein, 119 aa, Sorghum bicolor
  Clone ID: SORBI-28MAY03-C4643_1.pep
GNSCFLGEKYENYYPLVGLQMFIDVGRVWFSYSLAALNPSWSRIPSPAEAGRIGSPEQARKKLDSTETRQMVKNPKFQTVWILSRQAEASAGEETKRACCPSTNCKFSYGAGQKMSRPV

SEQ ID NO: 34302 - protein, 285 aa, Sorghum bicolor
  Clone ID: SORBI-28MAY03-C46468_1.pep
PPPPPPGGRAPGAPAPPRAPGVPPPPGSNPSLGRGRGAVRPLGSAYGAAASRKSTLKPLHWVKVTRALQGSLWEELQRNDDSQSVSEFDISELESLFPAAVPKSDDSSKSERRRSLGSKPEKVHLIELRRANNTEARRTKVKMPLSDLVSAALALDQSTLDVDQVENLIKFCPTKEEMELLKNYTGDKQNLGKCEQFFLELMKVPRMESKLRVFSFKIQFGSQVADLRRSLNIIDSSCNEIRTSLKLKEIMKKILLLGNTLNQGTARGAAVGFRLDSLLKLTDTR

SEQ ID NO: 34303 - protein, 238 aa, Sorghum bicolor
  Clone ID: SORBI-28MAY03-C48920_1.pep
TREEAAYVAGRASATEDARRGLGLPLIRMLPVVKFTAAACDDAGGLAPRISVSECAVCLSEFVERERVRLLPNCSHAFHIDCIDTWLQGSARCPFCRSDVSLPALPSARRALAAATAALPRRRDDGLASDSIVIEVRGEHERWFSSHGTTTTTGARPAGGGGRGPRHPKQPPRRSKAESVGDEAIDTRKTTDVEFAVEQPLRRSLSLDSSCGKHLYVSIQELLATQRQVRERDPSVHS

SEQ ID NO: 34304 - protein, 182 aa, Sorghum bicolor
  Clone ID: SORBI-28MAY03-C48939_1.pep
IWQIKNILIDNCTVQIQKGDFSIWSTPWCSIWKEIHSHLRLPVTVPNLPHNISELWTANSHDWDINFISQVFDTAATTAISNVITVPSNDKDEIKWKPAPKGNCTSREAFKLLNSQMQVHLPTQGSRSVTTQSMEILRRVWAHKSLSPNMKTFTWRLIRRAIATGVRAGSLSTKINKNCEIA

SEQ ID NO: 34305 - protein, 79 aa, Sorghum bicolor
  Clone ID: SORBI-28MAY03-C48951_1.pep
VKVPTVDGMVDLKIPSGTQPGTTLVMSKKGVPLLGKSNARGDQLVRVQVEIPKRLSSDEKKLIEELANLNKAQTANSRR

SEQ ID NO: 34306 - protein, 154 aa, Sorghum bicolor
  Clone ID: SORBI-28MAY03-C46616_1.pep
MELAWFIRSSIISLAGFLSVVSASTSQQQCGGIGGPAGVRAGYWSPSSSRYSPVSSIDASLYTHLYYSSVSIDEASYAVAPQPTEEEGSLLAAFSGTVKSGSPSTKTMLSIGTNEYRVDASNAAFSTMASDKDLRGVFINSSVELARANRFDGL

SEQ ID NO: 34307 - protein, 229 aa, Sorghum bicolor
  Clone ID: SORBI-28MAY03-C46622_1.pep
HEGELDSEALIALAAGFPADSLSEDEIVAAVLPRIGGAEQANYLVVRNHIVALWRSNPLSPVAANAALASIRAEHAPLVAAAHSFLSEHAYINFGLAPAGLSLPPQPPPSSPTPSILIAGAGLAGLAAARHLIAFGFKVAVIEGRFRPGGRVFTKTMRSSAVEYPDTVAAADLGGSVLTGINGNPLGVIARQLGFPLHKVRDKCPLYLPDGRPVDPDMDARVEAAFNQL

SEQ ID NO: 34308 - protein, 100 aa, Sorghum bicolor
  Clone ID: SORBI-28MAY03-C46619_1.pep
KREAVLQGAWGEDDLYQLDQGGSCKGSAGKFLSLVVNQTAPSGPGFACSTLQSITPRLWRRQQRESGRGCARATRLLPPRRRRPGTLSTHTCLSPTPSRF

SEQ ID NO: 34309 - protein, 101 aa, Sorghum bicolor
  Clone ID: SORBI-28MAY03-C46629_1.pep
NIYQTLSIVMDIFDNHENSSESCISLASSIFTQDLERFSTYGFDSDVPDDADGDIDDDHQPYGPPTYSSLMLENATVRSDADFFSVTGWTTATVGSSTGST

SEQ ID NO: 34310 - protein, 187 aa, Sorghum bicolor
  unsure (1)..(187): unsure at all Xaa locations
  Clone ID: SORBI-28MAY03-C46656_1.pep
KRRELCLSASRATTAWAPPLPPPTARLVAFDSSRAATSLAPACAASPPRSSXPALPLLPLSAARAARPPLCHPFCRSLPRPRLPAALLAASLPRRYGAGCRPASGRPRAVWPPPPSCPRRVASAACGAPLCVCATARRRRAGRGRDGAAAATARRPPSPRTCPAPPSPVRVRSGPARPSGAARPAVR

SEQ ID NO: 34311 - protein, 169 aa, Sorghum bicolor
  unsure (1)..(169): unsure at all Xaa locations
  Clone ID: SORBI-28MAY03-C46692_1.pep
MGAPDVLSRKSGVIVGDDVLRLFEYAREHGFAIPAINVTSSSTVVAALEAARDXRAPVILQSSQGGAAYFAGKGVXNTDQAASIAGAIAAAHYVRALAPAYGIPVVLHTDHCAKKLLPWLDGMLDADEAHFKATGEPLFSSHMIDLSEEPVECNIETTAKYLKRAAPMK

SEQ ID NO: 34312 - protein, 107 aa, Sorghum bicolor
  Clone ID: SORBI-28MAY03-C46321_1.pep
MATPAPATAGELLRVEPLELRFPFELNKQISCSMQLSNHTNDYIAFKVKTTSPKKYSVRPNTGVVLPRSTCDVVVTMQAQRLAPPDMQCKDKFLVQSIVAPSGITVK

SEQ ID NO: 34313 - protein, 322 aa, Sorghum bicolor
  Clone ID: SORBI-28MAY03-C46343_1.pep
HEAEYVHDQSHLEALTYSAIYLKWIYTGQIPCFEDGGHHRPNKHAEISRQIFREIERIYYGENTSAQDLLVIRKIHPCLPSFKSEFTASVPLTRIRDIAHRNDIPHDLKQEIKHARRNKLHRNAGPEDLIATEAMLARITKTPGEYSEAFVEQFKTFYSELKDFFNAGSLLEQVQSIEQSLDESGLEALSSFLKTKKNLDQLEDAKDLDENGGVQVLLKALLSLSYLRSILMKGLESGLRNDAPDSAIAMRQKWRLCEIGLEDYSFVLLSRYINALEALGGSASLAEGLPTNTSLWDDALDALVIGINQVSFSGWKPNECTA

SEQ ID NO: 34314 - protein, 220 aa, Sorghum bicolor
  Clone ID: SORBI-28MAY03-C46348_1.pep
ARGASKRNFSRVVEGTNRGHQGQSEVESGLLSTANINMLEQFLVFCKSKKMNEHNVAPKGINGGPNDGAKVHGESNSFRDKLNMYFGEFLPANVVDDLCKLVHENSYGKCSFCLMPTESLVLSVLQILLDAAKTADQMKEKNGAAPVVENNHAVCNDNSVPSILRDNRRSSSVKEQSNRRIVEGNFEVRKPIGDPKNDGTTVAHAQNSIASRGPSLFADD

SEQ ID NO: 34315 - protein, 165 aa, Sorghum bicolor
  Clone ID: SORBI-28MAY03-C46349_1.pep
ARGPSEDQNTTKMVKDMELQKLHGTIKALQKVVSDTGVVLEQERLHFNSNLQDARKQIEMLKLKEILDSDASDVNYERMMKDIQLDLVQTPSRRAAVSHGRHRKKNSVAAAAAQSDDKMLALWSVDRVSSGSRRYDVDLRPPQSEAAENDKAKKRSSSEPVVTVK

SEQ ID NO: 34316 - protein, 183 aa, Sorghum bicolor
  Clone ID: SORBI-28MAY03-C46749_1.pep
HEEPRFEAHENEDSFVLYGELPGMNKEHVTVEFPEPRKLVVSGRVERFTEEPKAVETTPTTTEEAAPAPVTDSDNEDTRSRSSYQATVEDDVDDDEFEVLSHTSEKSKTVSQPEPETISEKAQEKQPEQPEQPKRSGYSKEFSRYFTFPTYINHDAVTADLKDGLLTIVIPKATPKSQRIIIN

SEQ ID NO: 34317 - protein, 150 aa, Sorghum bicolor
  unsure (1)..(150): unsure at all Xaa locations
  Clone ID: SORBI-28MAY03-C46770_1.pep
MPAAGDGPRAXRVGFYDTSCPNAEALVRQAVAAAFAKDAGIAAGLIRLHFHDCFVRGCDASVLLTVNPGGGQTERDAVPNNPSLRGFDVIDAAKAAVEQSCPGTVSCADIVAFAARDSISLTGSVSYQVPAGRRDGRVSNSSDTVDLPAP

SEQ ID NO: 34318 - protein, 163 aa, Sorghum bicolor
  Clone ID: SORBI-28MAY03-C46807_1.pep
RDRGAGHVDGEGRVRYAPSREDVEELRNGLRQALRILVAAGAAEVGTHRSDGLRLRCDGGLRDEDLEAFLDEVTVGEGPMLPGPDKWALHCSAHQMGSCRMGSSPKDGAVDGRGESWEAEGLYVCDGSLLPTAVGVNPMITIQSTAFCLSKGIAESLARGKGQ

SEQ ID NO: 34319 - protein, 155 aa, Sorghum bicolor
  Clone ID: SORBI-28MAY03-C46832_1.pep
YRCSQPFSGTQVVTTFSGTQAVTTFHSTQAVTAFSGTQAVTTFHSTQAVTAFSGTQAVTTFHGTQVVTTFSGTQVWTTLCLPSGSVNSSMSRSRASSWSGTLPEQLSSTAATRSPDGQIMQSPSMPGKRPPHSRSSSTSSAQFNGLGEELHEVEL

SEQ ID NO: 34320 - protein, 123 aa, Sorghum bicolor
  Clone ID: SORBI-28MAY03-C46867_1.pep
ASDESITREIESDLQGWLDDITDGAVEYMPEDEVKSAAAERLKISMERIALLKAAKPKVPPAKTEQEEEEERKQSEELDGFGNPKGPSTLSKLTAEEAEHRALQAAVLQEWHQLCKEKAMKAQ

SEQ ID NO: 34321 - protein, 172 aa, Sorghum bicolor
  Clone ID: SORBI-28MAY03-C46849_1.pep
INYALFKPNKGIVDPNTSLHYDNMCDAQIDAAYAALHAAGYDDMEVRVAETGWASSGDQNEAGASSENARTYNFNLRKRLFLRTGTPLKPKSPVKAYIFPLFNENQKPGAGSERHYGLFLPDGRISYDIGVSGLLPFFASSSMLFIKKVRAGGWILHYWATVLLGIFFLWGP

SEQ ID NO: 34322 - protein, 210 aa, Sorghum bicolor
  unsure (1)..(210): unsure at all Xaa locations
  Clone ID: SORBI-28MAY03-C46545_1.pep
MGEEAVHFSVVDAKDCKQSAVDVGDKTYVICRSDDDSKTSVVKIHDKLTHTWVVPTILGKQPLLTKSQSAIPVGDEKILVIEKGVPLNESIWFLEIDTPFVKQQRKIKGTEVVSWSKGVIGVGQKPVVISGPSGVGKGTLIAKLMKDYPSKFGFSVSHTTRSPREKEIDGVHYHFTERSXIEKDISEGKFLEFAHVHGNVYGTSIEAVES

SEQ ID NO: 34323 - protein, 181 aa, Sorghum bicolor
  Clone ID: SORBI-28MAY03-C46556_1.pep
TRVSSAPRLKTASVADGATGPATLDTGTAWAPTTTPPPPPAAWRRERGRRRSRRPCAPASRHFKKQADSLTLEGVRRALEKDLGLDIYSLDAHKKFIKQCVDKIFAESDDENANDNASDDPEAKNDHLSKEGTDIAKPMPVSNKTSSNADVVTSSKTGKDLEGEKDQTSSGDISEDMIKEA

SEQ ID NO: 34324 - protein, 162 aa, Sorghum bicolor
  Clone ID: SORBI-28MAY03-C46469_1.pep
MPGTLSKSCSNDSSECADRSSPRAVLDISVSGSMDSDDSVSVEQSAESNHNVQWRNLISSLILRRKKSMGRAVTFPQRSKSRGIRGYLERMRSGKNQMDCSAIAPEILPEIGKWRPSWRSFDYNELCAATDSFSSEKMIGKGGHAEVYKGQLADGQFVAVKR

SEQ ID NO: 34325 - protein, 175 aa, Sorghum bicolor
  unsure (1)..(175): unsure at all Xaa locations
  Clone ID: SORBI-28MAY03-C46570_1.pep
TREKITDQFSCAAFVSVSQKPNMISLLWELLSQIGSHXWRFRIDGNRILXEKQLIDRLRSDLENQRYLVVIDDVWTKSPWEIIQCALPNNGHTSKVIMTTRINSVGQFSSTSDEGFIYQMRPLSRNDSENLFLKRTLCAEDKFPVQLTGIKNDIIEKCDGLPLAIVTLASMLATK

SEQ ID NO: 34326 - protein, 213 aa, Sorghum bicolor
  unsure (1)..(213): unsure at all Xaa locations
  Clone ID: SORBI-28MAY03-C46605_1.pep
MAIVAVLVAPTASSVGPRRRWRAAAASSSAASGVDLKGLQAAIDKESGGGGTAGADQLRELGWAKRWSSQPYVSRRTTSLRELTTLGIKNAENLAIPSVRNDAAFLFTVVGTTGFLAVLAGQLPGDWGFFVPYLIGSISLIVLAVGSVAPGLLQAAIGAFSTVFPDYQERIARHEAAHFLVAYLIGLPILGYSLDIGEEHVNLXIDEQLQKLI

SEQ ID NO: 34327 - protein, 100 aa, Sorghum bicolor
  Clone ID: SORBI-28MAY03-C46937_1.pep
STNTDDSDDIDMATSDSSESDALWQLNVQSMNNSISDSGSKVKKPQIKLRDGSDARTPIHSQIPSASRKVASGSNRSVRQPLSRSDSRRLSSNGRQTGAK

SEQ ID NO: 34328 - protein, 124 aa, Sorghum bicolor
  Clone ID: SORBI-28MAY03-C46963_1.pep
KNQGKQVHVFIMRKRTQSSELLELLGLSSDLGLRKLGLDGAEVLAARVAAACSEAARSCSSAAWSCSAAARSCSAAARSCSAAARAAAAWLIGRGSLTWQAPGVLNRTSTTVMLSLPLGCDRQC

SEQ ID NO: 34329 - protein, 229 aa, Sorghum bicolor
  unsure (1)..(229): unsure at all Xaa locations
  Clone ID: SORBI-28MAY03-C46976_1.pep
RSQRRAKYSLLSVVTKXRISSLDTGSIKGTSSTKEAVLALNSRPLELAQCPPASLAEEAGNGALFVLANVVGSRPKVVEDSMSNVLLNQPVTDFSRKEVDPAQSISEIVREQEAIEVSPAIPVHNRKEINSEAIWEQMQKVQSECGALWAAPAAGRLGRAAVLVRVSRRLNDWLSWLVRRATALVAPTRRASFVAAQGACTSSIVEAPSTFLTRLCSQILRLYQINTLL

SEQ ID NO: 34330 - protein, 78 aa, Sorghum bicolor
  Clone ID: SORBI-28MAY03-C4704_1.pep
SSVLQAPIVLCSAIFVWEQQKAQQLSTGMKLCFMPYIKTLLHAPRQTRLKQIVLSHRNDLLHVPTSIFNSSCTMATCT

SEQ ID NO: 34331 - protein, 103 aa, Sorghum bicolor
  Clone ID: SORBI-28MAY03-C47039_1.pep
MAALEAATTSTVPRALLAACLVLLVLGGGPSSSVQAQGGGGLCLPQLNGLLACRAYLVPGAPDPSADCCSALSAVSHECACSTMGIINSLPGRCNLAQVNCSA

SEQ ID NO: 34332 - protein, 96 aa, Sorghum bicolor
  Clone ID: SORBI-28MAY03-C47059_1.pep
SAKIRWEIFRGKSGVVVLWIEGEGLFTFSLGDRSMRKIDNEHVTKKYRFCPYEIDWLSCLAVTNLVSDGLLSLDTEREKAQCRWTSLVADNIPKSR

SEQ ID NO: 34333 - protein, 305 aa, Sorghum bicolor
  unsure (1)..(305): unsure at all Xaa locations
  Clone ID: SORBI-28MAY03-C4671_1.pep
WNKEVQLWQEKNRELCGVVGSLQVAIEGAKVVKGELEKKXTRLIEQCSSKDDEILLVEADNEALQSEVEQREREFVVLMDDAITSSVNSAVYEEKAFELMMNGKATENRAISLKELLMKEISSRDAHVEELQKKLAGIQEEHAELKAELNTHLALIASLSDHVSVLEEDTRSLSKPCSTEGKEETAWVHHVQEGNDGLESHCLPKGTPKLQGLIARIEALQVVVLNAKDRQDQESAKSAAKLAAASTEIQELKARGSSRMEAKEIYSDLEKQDVEVSKGKQVQIMKDIELDKISTCPPYGAGAAL

SEQ ID NO: 34334 - protein, 128 aa, Sorghum bicolor
  Clone ID: SORBI-28MAY03-C46721_1.pep
MATAMSVSAVTPAAAAVARPRTMVCVPATARAPREMAEELAAAAALGADVAELRLDCLAGFAPRRDLPVILAKPRPLPALVTYRPKWEGGEYEGDDESRFEALLLAMELGAEYVDVEFKVADKFMKLI

SEQ ID NO: 34335 - protein, 179 aa, Sorghum bicolor
  Clone ID: SORBI-28MAY03-C46724_1.pep
ARGHRKNVPFVKVPYKLCQSFQSGTRPTSPVEIVYHCPEEEIAFGPSCWLWDYLRRSQASGFLLPLSGGADSSSVAAIVGCMCQLVIKDIEKGDEQVKADALRIGHYKDGEIPTDSRELAKRLFYTVYMGTENSSEDTRSRAKRLAEEIGSFHLNVPIDSIVSAFLSLFETLTGKRHAT

SEQ ID NO: 34336 - protein, 151 aa, Sorghum bicolor
  Clone ID: SORBI-28MAY03-C46761_1.pep
MKLFRSIGAVAAALMLLPGHALAGQYKGFSMGANRADGACKYTADWKKDFQTIKSWNKGFNAVRLYSADDCNTLVKAVPAAKQTGMKILVGVWATDDAHFRRDKAALLKVIKQYGTDWIAAISVGSEDLYRKDISPDKLAQQIYDVRGMVR

SEQ ID NO: 34337 - protein, 137 aa, Sorghum bicolor
  Clone ID: SORBI-28MAY03-C47170_1.pep
MRSRRTATPAAGILLLVALVAVAEADTDAADVAALGNLYSSWNSPAQLTGWSASGGDPCGAAWTGVSCSGSAVTSIKLSGMELNGTLGYQLSSLQALKTMDLSNNYLHDAIPYQLPSDLTYLNLAKNNFSGNLPYSI

SEQ ID NO: 34338 - protein, 175 aa, Sorghum bicolor
  Clone ID: SORBI-28MAY03-C47164_1.pep
RGKAVIEILQFLKQATTKMPPVQEKADWTTRWRSPSSSSSSSSCREKENRVECKKGGNFLPSNRKKTSSSSSASESRTARRQKPPKKRRAFAANRGNTPGVDLNQRPSSATGLQQQQLRLEGVWGLRPPGWVGSARRAQRRRKKMEMRKRGGVAASQVTRKKRGVLLVMVGCASC

SEQ ID NO: 34339 - protein, 61 aa, Sorghum bicolor
  Clone ID: SORBI-28MAY03-C47179_1.pep
PTQLEAHSHACEIKLPLDYASQIKQRYNLFSRYLHFCRIILEVFFLLSYYLMFVYLLCDYG

SEQ ID NO: 34340 - protein, 83 aa, Sorghum bicolor
  Clone ID: SORBI-28MAY03-C47232_1.pep
MGSFLRKQPSYLFVLIVLHLVAHEARTLSSDGEALLAFKKAVTNSDGIFLNWREQDADPCNWKGVRCDSHSKRVINLILAYHR

SEQ ID NO: 34341 - protein, 179 aa, Sorghum bicolor
  Clone ID: SORBI-28MAY03-C47182_1.pep
ARGKDIHTEAEVTGRKDQRSRSFGKVSGGVNPKPKASSNSRANVKGSSGRDEITSTETEFRDVSLQRNRLVRKAEDVGRKVTAGSDSDCSGRQGTNLSRQSSITDQELNLQARVMRPGKGNQDRHGELQMKANELEKLFAEHKLTSSRRGKPTDVQADSTPTVSEVKQTMVLHETIHTK

SEQ ID NO: 34342 - protein, 114 aa, Sorghum bicolor
  Clone ID: SORBI-28MAY03-C47244_1.pep
MSFVFRGSRADIEAGGFPGFAPERRAMRIHAGSRPVNSNSLAFLLTVLVLFMGLNSHQMSPNLLLWLVLGVFLMATSLRMYATCQQLAHAAAANNFLGHTELRVHVPPTIALAT

SEQ ID NO: 34343 - protein, 145 aa, Sorghum bicolor
  Clone ID: SORBI-28MAY03-C46869_1.pep
ARGSLTGTFLPGPAPPGSTGLTVYLAGGQGQVVGGSVVGTLTAAGPVMVMASTFANATYERLPLDDAEEEPAGQAPPPQLPPGPGGGPPLIMGGMADPSAAMPMFGGSVGGVPPSLMPGGGAASGAGLQLGHEGLAWAHARPPPY

SEQ ID NO: 34344 - protein, 253 aa, Sorghum bicolor
  Clone ID: SORBI-28MAY03-C469_1.pep
MGRGPVQLRRIENKINRQVTFSKRRNGLLKKAHEISVLCDAEVALIVFSTKGKLYEYSSPRGREGILERYQRYSFEERAVLDPTIEDQANWGDEYVRLKSKLDALQKSQRQLLGEQLDSLTIKELQQLEQQLDSSLKHIRSRKNQLMFDSISELQKKEKALTDQNGVLQKLMEAEKEKNNALMNAHLREQPNGASTSSPSLSPPVVPDSMPTLNIGPCQPRGAGKSEPGPSPAPAQANSGNLPPWMLRTVSNR

SEQ ID NO: 34345 - protein, 62 aa, Sorghum bicolor
  Clone ID: SORBI-28MAY03-C46874_1.pep
EPDLDVAATSCNGQIKCRIAMRQQTVSRAHSSGHPLSPNQDQINMILAPYHLRSGLYYSFEL

SEQ ID NO: 34346 - protein, 165 aa, Sorghum bicolor
  Clone ID: SORBI-28MAY03-C46918_1.pep
RPVLDTVAMVSYELDDAEYGENEVNDPWVQKLILAVNTNVAWLQPVMTSNNYDSFVHLIIDFIVKRLEVIMMQKRFSQLGGLQLDKEVRSLINHFSEMSQRPVRDKFSRLSQMSTILNFERVSEILDFWGDNAGHLTWLLTPAEVRRVLGLRIDFRPEAIAALRL

SEQ ID NO: 34347 - protein, 116 aa, Sorghum bicolor
  Clone ID: SORBI-28MAY03-C46935_1.pep
FKYKVQAQQGNAPAQKSDGPSQLSVSSTGSGNEKKQDGLKSDGTSKTPEDELTCSVCLEQVAVGDLLRSLPCLHQFHVNCIDPWLRQQGTCPICKHQVSDGWHATGNGEEDASYMV

SEQ ID NO: 34348 - protein, 125 aa, Sorghum bicolor
  Clone ID: SORBI-28MAY03-C47365_1.pep
DGVVFVLSGFVNPERSTLRSQALDMGAEYRADWTSDCTLLVCAFVNAPGFRQVQADNGTIISKDWIFESYKQKKLVDIEPFLMHAGKPWRKNKEPVETDQGDRYFHQKYLLWAHNLVFGCCYACP

SEQ ID NO: 34349 - protein, 123 aa, Sorghum bicolor
  Clone ID: SORBI-28MAY03-C47372_1.pep
MTQVKPAPGGRMLTVLRVHLPSEIPIVGCEITPYVLLRRPDGGVFTDDVSEAAPVDGYFMRYKWYRIQSDRRAAICSVHPTEQATLQCIGCLKSKIPVAKSYHCSAKCFSDAWQHHRVLHERA

SEQ ID NO: 34350 - protein, 255 aa, Sorghum bicolor
  Clone ID: SORBI-28MAY03-C47370_1.pep
HEASDPNLSASHTFPLRAQPELVERRLADGQPSPTAATNRSYKQAVMEEEEEPHLPLDIIYKIPEYISDPVSLARVASSSKLWRSIIKETAFLDGLMTRHLDHDFTSSLLLGFFYQDNAEAPDHLWQHHRDKNRCLAPSFMPTSELLPFAGCKEGYSPTSPLSLGNFIQGINSTLNFYEPVASQDSFLVLCHHSKDAEGDPKPDVVCVCNPLTGKVFHLPGLPYKPPHHYALLVTDDINLDGRMTQSFRLVALWN

SEQ ID NO: 34351 - protein, 65 aa, Sorghum bicolor
  Clone ID: SORBI-28MAY03-C47395_1.pep
ALDWAVNEKLKSGEDGEVTANHLLLGIWSDKESAGHKILESLGFDDEKASLLAKTANEEAAMSPR

SEQ ID NO: 34352 - protein, 73 aa, Sorghum bicolor
  Clone ID: SORBI-28MAY03-C47399_1.pep
WVHTLVKESPPEKQVTTAESINSVGPSPLMPPGMNSGEGSGLNTQLDAHDQAAVIGALLEQMQLDQQIGSLAT

SEQ ID NO: 34353 - protein, 148 aa, Sorghum bicolor
  Clone ID: SORBI-28MAY03-C4741_1.pep
PVVFGAGTPPLVVTRERNYTAGDMSEFLTAIGVPPLGVTLYETRALPVQLGFRAPVVPTTCINGIGVSTMRQLVYWDGNFSETPEVVYGDGDGLLPSASILALDTVIGGDPRQEYYKSIKLAASHAGVVSDAAALKRVVDEILWSNPM

SEQ ID NO: 34354 - protein, 134 aa, Sorghum bicolor
  Clone ID: SORBI-28MAY03-C47060_1.pep
LKHIYCISSIMSISHPKMYHFIYYYRLWISGCIIPQDKNLLLSQQVLPQVCKAWSRAVKFCVSGWDYGLVVSSCKDLAGPFDHIHTVSLNLPPSKCRCPQRHNTLWLTIKHVRILPPPLCHPDDTPFAMVPVPA

SEQ ID NO: 34355 - protein, 104 aa, Sorghum bicolor
  Clone ID: SORBI-28MAY03-C47067_1.pep
NHQEMFALMHHVVMGDDPEVKAGKPSPDIFLAAMRRFEGDIEPSKCLVFEDAPAGVAAAKNAGMSAVMVPDPRLDVSYQKGADQVLSSLLDFKPTEWGLPAFSI

SEQ ID NO: 34356 - protein, 174 aa, Sorghum bicolor
  Clone ID: SORBI-28MAY03-C47131_1.pep
MPPLRRFCQFLPRSTPSMARHVPTPTTASTCTPETAEGRHLFEVTGYSKHRGMGHDKFIRSGNFSVGGHQWSIRFYPDGFVKGKDYISVYLELMGGSKVRASCDLKLVDLTTGLSASVHRTEPRMFNSGDVSRYAPQNSSFMERSGFEASVYLRDDRLVIECIVTVMAEPKVSA

SEQ ID NO: 34357 - protein, 221 aa, Sorghum bicolor
  Clone ID: SORBI-28MAY03-C47158_1.pep
QERQEAAAKEQHRSRHHHRSPEIDQRGAGIKQETATMDTSSVRGAGKQRLAEHFGSGPGRGTEAASSIDGLGPSKAGHGGCSPHAAAACAVARERIGSDGKRRTESTRISDPSLHTHRDSRAAAITNKTTNNGNKKGEEGILTPAPPSLTLRTTAASSQAAKQGGGSMPGGKAGNFLLAHLARGRGVKMVCLARTRDRSGEKGVGGRSRLANQRSGDAGRE

SEQ ID NO: 34358 - protein, 70 aa, Sorghum bicolor
  Clone ID: SORBI-28MAY03-C475_1.pep
WSRRSCPRRGSWTPRAAAIDRPPIDVLAAAAQSSTPWIDRRWFRGEEATTMERRRRTAPLPSDSCLRVHS

SEQ ID NO: 34359 - protein, 110 aa, Sorghum bicolor
  Clone ID: SORBI-28MAY03-C47541_1.pep
TINYEEFIAATVPLNKIEREEHLMAAFTYFDKDGSGYITVDKLQRACGEHNMEDTFLEEIILEVDQNNDGQIDYAEFVAMMQGDKVGLGWQPMETTLNVTLRDAPQVHCH

SEQ ID NO: 34360 - protein, 66 aa, Sorghum bicolor
  Clone ID: SORBI-28MAY03-C47560_1.pep
THKKETVKSIAISIQNKKRLKKLRTQKPKYLTYPSSNWYSTLFYIQIGSLDTGLYFPKLMQLYSIF

SEQ ID NO: 34361 - protein, 104 aa, Sorghum bicolor
  Clone ID: SORBI-28MAY03-C47594_1.pep
VRFLAREADESRLREVCENFLGPPMGMLGSASSMDSKNPSWDPDVLGMKKHKLLMEDILPSMASNRKVQRLLNEFMDLLSEYEAAKSKVDPMDVTRAPQPAASQ

SEQ ID NO: 34362 - protein, 166 aa, Sorghum bicolor
  Clone ID: SORBI-28MAY03-C47564_1.pep
KGKAEDFEIVYVPMDKEEDGYLRSCRDMPWLALPYDGVPSRALARYFDVREIPTLVVVGPDGKTVTRDGRNLVNLYFDMAFPFTDAQIRLLQEAEDEAAKEYPQSLRHRGHRHELSIVSDKSGGGPYICCECEEQGLGWAYQCIACGYEIHLRCGQNAEGGGAGTA

SEQ ID NO: 34363 - protein, 67 aa, Sorghum bicolor
  Clone ID: SORBI-28MAY03-C47575_1.pep
IWPELPLLGNRVCSLPLSHHFVCHLVGHNLVFTTCLLGTWEWRGFGELYSFAVCRSEHIMINLLSSL

SEQ ID NO: 34364 - protein, 139 aa, Sorghum bicolor
  Clone ID: SORBI-28MAY03-C47271_1.pep
MALAVPVTLKTTEEGGNERFDYAVSAMQGYRQNMEDAHAIVLNLDAATGTSFFGVYDGHGGPAVSKYCARHLHTELLRHESFRDNLQTAIEGTFLRMDEMMKDRSAGWELSGYGGNDNWKAYKKALRWSLLLPFFCQRP

SEQ ID NO: 34365 - protein, 254 aa, Sorghum bicolor
  Clone ID: SORBI-28MAY03-C47300_1.pep
MAAVLDSFVKRCTASLEDFASQEACVALGIGDDVRGLLATLSRIDAIISHEERRRVLSAKADAWVVQVKDAMYEIDNIFDVCMIEGAKVLADDRPPTPKVRCFSCFKPSGPRKFPRGIGFTIRDIDLRLREVEEEMPRLPAGSVHSDAKRDSFSHNVCKNCSDAMKPQAVGSQVQKAVGGLVPRMLREGKKKVDVFAIVGAVGIGKTTLAREIYNDDRMTENFPICVWVDMSKDLSELDFLKMIIRGTGANVGD

SEQ ID NO: 34366 - protein, 92 aa, Sorghum bicolor
  Clone ID: SORBI-28MAY03-C47320_1.pep
ARGGEEVAPRATPPRAFPPPLPSLARRKAESTMEMRQERQDGRLLVRVVPVASSTLFRAQRRGGRLLLSFADTAAPPAPASDEGDRSRAHPE

SEQ ID NO: 34367 - protein, 141 aa, Sorghum bicolor
  Clone ID: SORBI-28MAY03-C47347_1.pep
MDGPKRSQLRVRLRVTARRRGADGDGAGGAAGPGGRKRRMEAPVLNSAAKLQRREIGGRQLAARGGGPAAAVPERFRNMQLQEEFDTYDANAHLFVKLQFLKRRSKIIEIVAAKDIIFALAHSGLCAAFNRVTNKRIAFLD

SEQ ID NO: 34368 - protein, 105 aa, Sorghum bicolor
  Clone ID: SORBI-28MAY03-C4767_1.pep
MMLGKQRSGRPSPASRQQHHMRRTTSLTEFAAPDVLADVAEEEEEDEELQLLPAHAAAADEVEAVEPVEWAVGGAAAAGRADWLAAYRARAAPALAGLRRNSADF

SEQ ID NO: 34369 - protein, 168 aa, Sorghum bicolor
  Clone ID: SORBI-28MAY03-C47684_1.pep
ARGLAAATLLPGAAVAEGVTPSEARRLRDEVARGFYHAFDGHMKYAFPLDELRPLSCQGEDSLGGYPLTLIDSLDTLALLGDKEKFGAAVEWVGKNVRFDINKTVSVFETNIRILGGLLSAHLIASDYATGMRIQSYDDQLLHLAADLAQRLLPAFDTPTGSLPFLLL

SEQ ID NO: 34370 - protein, 199 aa, Sorghum bicolor
  Clone ID: SORBI-28MAY03-C477_1.pep
FDKDRIEASVVIWHRKICHKLSWAPAGVSLEKREEFEERAQTALLILKHRFPGIPQSSLDISKIQYNTDVGYALLESYSRTLESLAFAVLSRIEDVLHADAVACDPNKRTKSRRRPSLEFPVPDAAAAAAEAEAEAETAAAHHSSCVHWQEEDGEKHPGAAPDGNNGRKLRKIHRVVTKKFLHTQQIDSVTSGFKSFTH

SEQ ID NO: 34371 - protein, 224 aa, Sorghum bicolor
  Clone ID: SORBI-28MAY03-C47721_1.pep
MPVRKEPQALLEYSMNSSELGPSTQGILMSGQNRGFPVSMTKVDGFKLPADQETPVAGNMYTNCVGAAALFMGRSFRVGWGPNGLLVHSGSLVNNPGTGLSSVIHIEKVASDKLVRDDKSKIKDDLTELCFSDPMGLHKSLDHEILETESDSFRLKLQKVMANRLVLPDICRSYIDIIEKQLGVSDLSMSTRVLLMHQVTVWELIRVLFSERATGNQLEPVGDD

SEQ ID NO: 34372 - protein, 170 aa, Sorghum bicolor
  unsure (1)..(170): unsure at all Xaa locations
  Clone ID: SORBI-28MAY03-C47740_1.pep
TRPPRPPPSAGGGGRPPPPPPPPPPPPPPSPSPPAAPPXPPPPPPPPLPAPPAPPAPPXPPPPPSXPPPPPPPAPLRRPPPPXPRGGPPGCGGWWCPPPATSAXPPPYRPPHPPXPPAGSPLPPPSPPSXPPEQRCFCAPPPPAGRRWRLAAQLPGPLMSCWRYLLLRRI

SEQ ID NO: 34373 - protein, 153 aa, Sorghum bicolor
  unsure (1)..(153): unsure at all Xaa locations
  Clone ID: SORBI-28MAY03-C47746_1.pep
WPRRREVKRAPPVPSFPTQMWRLPLAAALLRRSLAATARLSASGYLMRAWLAEQPTGRTNSPITVHCLQQCGSDNTVDDRVSQAFKRCCSTSASSGVSDASPCASYIENLCRSGNLVDAVRVLRQLHDEQVHVSLHTFNMLLQHTAEAXIFTL

SEQ ID NO: 34374 - protein, 118 aa, Sorghum bicolor
  Clone ID: SORBI-28MAY03-C47423_1.pep
PQWFPWREIAVMPVQWHALALGLFASIIAPFGGFFASGFKRAFKFKDFGDSIPGHGGFTDRMDCQMVMAVFAYIYYQSFVMVQDLSVETILEQILRNLTFEEQHELYEQLGKLLVRAN

SEQ ID NO: 34375 - protein, 228 aa, Sorghum bicolor
  Clone ID: SORBI-28MAY03-C47440_1.pep
NRWHRAPDMLRRRQCFDVCVMGNRLYVAGGESGSGGGLRSAEVFDPVKNRWSFVAEMAAPMAPFVSAVHGGRWYVKGIGAQQQVLSQAYSPEADAWSVVLDGMVTGWRSPSACVDGRLYAADCKDGCRLRAYDEAADAWTTCVDSKQHRGSSQAAEAAAIVALHGRLCIVRDDMSVSAVDVAPGAGNQRWQTLAGKAHTKSFVTGLLANLAGRRRAKNNILHCQVLEA

SEQ ID NO: 34376 - protein, 47 aa, Sorghum bicolor
  Clone ID: SORBI-28MAY03-C47450_1.pep
TCNDTGSRGPADLNGSFWLHDFKQPHGSREILRFTKLEYLEAASVTH

SEQ ID NO: 34377 - protein, 130 aa, Sorghum bicolor
  Clone ID: SORBI-28MAY03-C47473_1.pep
DWSRSRSSSSKVWLVGDKLTDEEQRRARGGVHFVPYSQFPPDAVRGDCVYHSTPALVVPDAFENLHACENWLPRRVMSAWRAAGIVHALQGWDDHECGARVTGVDKAWRAALAHGFRPYDRHHTAGGASK

SEQ ID NO: 34378 - protein, 81 aa, Sorghum bicolor
  Clone ID: SORBI-28MAY03-C47802_1.pep
MEELQDCNSKCLVALPGSLALHLFRLFGQQDQSSWQKYILAYCLLVRNDYFSGESKKHSDLFCDISELDFFPYATDLDSEE

SEQ ID NO: 34379 - protein, 315 aa, Sorghum bicolor
  unsure (1)..(315): unsure at all Xaa locations
  Clone ID: SORBI-28MAY03-C47820_1.pep
HEEPDNGNIPHKDQKTNPSAVKGSKQQPSLNNASNGDASYKAKQIEKAVIENLETRKQVTLNGDASNLTSASVLLKEARDLKHLSKRLKEKGDDFESTSMCFEAGLKFLHVASLCEAPNVDSSKQGDSVQAMKLYSETGNLCGFCAHEFERLKKMANAALAYKCVEVAYMKAAFFKSPGVIKDRHALQAASLMVAPAESPSSSASDIDNLNNQSTVTKAVSARGVYSPQIASNPISRNNHHLMGLLSYTEDINNAFEGTRKSQSSFSAYLSGIGKTQXXGVVLVREVLDFSFHNVKGLLQLIRHSLESINHESGK

SEQ ID NO: 34380 - protein, 145 aa, Sorghum bicolor
  Clone ID: SORBI-28MAY03-C47824_1.pep
TRADGGGAAGGAAEAAPVIEFSGREDVERLLAEKMKGKSKNDFKGRVDQMSDYIKKLRACIRWYIELEDAYLVEQEKLRGAMDSENARHTELETQLSNAIEELKAANLDLTRRCESLEESFNKEKSEKLIAMESYEKEKHERESA

SEQ ID NO: 34381 - protein, 149 aa, Sorghum bicolor
  unsure (1)..(149): unsure at all Xaa locations
  Clone ID: SORBI-28MAY03-C47826_1.pep
MSGFVGVVVSDPSLQGQFTQVELRSLKAKFVSLKRDSGHVTTKNLPGLMKKLRGLNEVVSEEEIAAFLSESYPDSDQEIEFESFLRAYLNLQARVSAKQGGAGGGGGGKSSFLKSTITTLLHNLNQAEKSSYVAHINTYLREXPFLKKY

SEQ ID NO: 34382 - protein, 117 aa, Sorghum bicolor
  Clone ID: SORBI-28MAY03-C47847_1.pep
MVGLGSMAGYGIQSMLKEGHRHLSGLEEAVLKNIDACRELSAITRTSLGPNGMNKMVINHLDKLFVTNDAATIVNELEVQHPAAKILVLAGRAQQEEIGDGANLTISFAGELLEKAE

SEQ ID NO: 34383 - protein, 269 aa, Sorghum bicolor
  Clone ID: SORBI-28MAY03-C47872_1.pep
ARGSATKGSGERSDLSSSKQKSISRHNRLENSKKARQDDVVVPEDESKEYFHQSDVQRSDLSSKKRIVKEWEESQYNPIAPRGKGAIKETYRDQNLKEAKLKSLNSEELFSMTSSKPPKGQHADQVLSHDGGRMNSELVEDNTLFSAKRGLPEQEKSLSDQALDFGEPASDVAYIQTSAVTSSSSKASVSQKKKQTTQAMKTSPIESLSSSPQRNSNIDKVSVSHNRISGNDQRSSEPVLVGSSRRKSDRDNGQVQLTQGHASDGIHLE

SEQ ID NO: 34384 - protein, 84 aa, Sorghum bicolor
  Clone ID: SORBI-28MAY03-C50053_1.pep
CKWVQIHCCEFQFLSSRPQPTPTKTSSSSVDLLCFLSRHIVSTSLSQHLASGMKPASANPYNAIVASAMRPASHRPINRLFDAA

SEQ ID NO: 34385 - protein, 116 aa, Sorghum bicolor
  Clone ID: SORBI-28MAY03-C50068_1.pep
ATKVNNEQKELQKQLLSKQLNKDSLRIRQLNDRLMQTERAFTSREGIFKLEWFKHLVYGPSDQNDWDTAVYPGIANAIASARSSNTSESWKFVQHEVYRVARAVTQASAILSGRLT

SEQ ID NO: 34386 - protein, 136 aa, Sorghum bicolor
  Clone ID: SORBI-28MAY03-C50083_1.pep
HRWRAAHIIVIALVQSTANGILYAFGRILLLDASPPGKEGAFSVWYAFVRVTGAMIGFAASSAGPGRAGGSFAAAFLGSFLGIIVLIFGNVSNIGALKAAGHLKGMDDEKRMGGLGEKGEGMGSAVADSGESRGRV

SEQ ID NO: 34387 - protein, 225 aa, Sorghum bicolor
  Clone ID: SORBI-28MAY03-C47904_1.pep
MEDEEMEKKVQQYLQRKGFRLTELALQEERNRLSTSAISDVALAPPGNDPARYHDGYSRLRTWAYSSLDQYKHELLRVLYPVFIHSFMDLVAEGHMQEARSFFHTFREDHEVMHSRDLQKLEGVLSPSHLEEMELARSFRKNKFKIKLCEYSYELLLQYLQKTQALVVLGVINEHITFEVSPGQPSLISDDADVVALIGTSKDLAKQINQKEVHWGLLEDSVEER

SEQ ID NO: 34388 - protein, 73 aa, Sorghum bicolor
  Clone ID: SORBI-28MAY03-C47913_1.pep
IKRRHHTCIKKSYKLLNQNKTYNAMHNRSCAKSITIITDSHRSRGRSFLRHTCRNKQVLRMLLFPCKKGIISQ

SEQ ID NO: 34389 - protein, 197 aa, Sorghum bicolor
  Clone ID: SORBI-28MAY03-C47916_1.pep
MAAMEAAADAMLAAASRAFTSTFAIAIQIQGCRVGLVLALGWAAASIVRKRVIKNMRRNIVDGNSFAFLCDNIDELEHSVQENLPRVSVIMPLKGFGEHNLQNWRTQITSLYGGPLEFLFIVESKDDPAYHAVSRLIAEYKDHLEAKVVVAGLSTTCSQKIHNQLIGVKKMHKDTKYVLFLDDDVRLHPGTIRALTK

SEQ ID NO: 34390 - protein, 129 aa, Sorghum bicolor
  Clone ID: SORBI-28MAY03-C47944_1.pep
MAGDPGDAPEVGEGGIRSVLTMGSLVDPSGNEVQFPEIDGKMIGLYFAANWYPKCEAFTPVLAAAYEQLKERGAGFEVVLVSCDEDRPSFERFHRTMPWPAVPFGDLRCKKRLSERFQVEGIPRLVVLA

SEQ ID NO: 34391 - protein, 122 aa, Sorghum bicolor
  Clone ID: SORBI-28MAY03-C47971_1.pep
PLRKLRFRARSDGPVPSVLCSDRARRPVGDRCEASRPAGVVLGSVPFLPAQISSFLVQIWILGARLGVSRVFRLRFRRFGAGFGGFGPHSLDLGRRSSAKSPQIGDFLPEEAFQARGLQQLF

SEQ ID NO: 34392 - protein, 203 aa, Sorghum bicolor
  unsure (1)..(203): unsure at all Xaa locations
  Clone ID: SORBI-28MAY03-C47952_1.pep
MAGDPAAGGGGDAHPASGSKSSRSSTRHRQFRDRAKVRVDDLQEMFCGLQSARKESRSADAAVLEEQVHQMLREWRAELSVPSPASSLQNSQGNNREASDPPSDTLRLLQLVVPEEEDDATSKLLVPQSAQQAPPPHQSHDHGQDSRMANTDQQCEAMDGGTAPAQHSLGQGVEAGCGEVAAVANAMXHDQMYYIDQELSIDD

SEQ ID NO: 34393 - protein, 196 aa, Sorghum bicolor
  Clone ID: SORBI-28MAY03-C47977_1.pep
MKKIVVLYPGLAVSHFIPMMQLADVLLEEGYDVVVALIDITMEHNIALAAAVDRVIASSKPAVTFHTLPRIHDPPTVTNDVNLLLGYLEIIRRYNEHLREFLCSIPPPSIHAVIVDSWSDAALDVTGHLGIPAYSFFASNASALAVCLQLPYWARRRAEGQPSFKELAGDATVNFHGVPPIPASHLIREVLEDPNT

SEQ ID NO: 34394 - protein, 238 aa, Sorghum bicolor
  Clone ID: SORBI-28MAY03-C47767_1.pep
MASKPGPLSRWPWQDLGNYKYALVAPWAVRSTYRFVTSGERDLLAFAVLPVLLLRLLYSQLWITVSRHQTARSRHRIVDKSLDFDQVDRERNRDDQILLTALLFYVVNAALPAAQSLPWWNSKGLVMVSLLHAGPVEFLYYWLHPALHHHYLYSRYHSHHHASFVTEPITSALPPFPAGCVHVPLFAVPLLSMLASRSAAVAVANGYLIYIDFMNYLGHCNFEVVPKLLFDVFPPLNT

SEQ ID NO: 34395 - protein, 115 aa, Sorghum bicolor
  Clone ID: SORBI-28MAY03-C47768_1.pep
MGASRKLQGEIDRVLKKVQEGVDVFDSIWNKVYDTENANQKEKFEADLKKEIKKLQRYRDQIKTWIQSSEIKDKKALMDARKQIEREMERFKVCEKETKTKAFSKEGLGQQPKTD

SEQ ID NO: 34396 - protein, 181 aa, Sorghum bicolor
  Clone ID: SORBI-28MAY03-C47787_1.pep
TRPLRRSSASLPRAPRPRPAPSRRRGRRSAPPPSPHVHPSPPTTPPALLCSPPPGSPPPLPATPGRPPPPARAPSAAAHGRSLVPPPEGVVPLQLHGRAATRGLAVAAVLREPVPLSLPPTEASAAAFSAALLFGVLPVRGWRVSLSVARDPPLSPQLLLFPLARGITSAGHDIVQFGLAS

SEQ ID NO: 34397 - protein, 168 aa, Sorghum bicolor
  unsure (1)..(168): unsure at all Xaa locations
  Clone ID: SORBI-28MAY03-C47786_1.pep
IQCGKSAAVFACAKEQGFNVIEVNTSDMRNGAYVRQKFEEXYTKSHGLEKWSHEEVMNPLRDDSLDPDSRTPDRTEYQHLMSCTTRVMIDCDQPKSPVRCYSRLKACDEPPKQVANKTLILFEDVDTVFDEDRGFISTILKMAETTKWPIILTSNRKDPSLPNLLDQL

SEQ ID NO: 34398 - protein, 73 aa, Sorghum bicolor
  unsure (1)..(73): unsure at all Xaa locations
  Clone ID: SORBI-28MAY03-C4803_1.pep
AAESGSRPARTCAASRASSAPSSAPAPAPXAPPPPPATAAAVAXAAPGRRSSYPSPPPAPPAGSSPSPLVAPP

SEQ ID NO: 34399 - protein, 92 aa, Sorghum bicolor
  Clone ID: SORBI-28MAY03-C48043_1.pep
VAESRFQPQLILYNAGTDILDGDPLGSLKVSPDGVITRDEKVFRFAKDQSIPLLMLTSGGYMKSSARVIADSIITLSNKNLIDIDTHCIEIE

SEQ ID NO: 34400 - protein, 128 aa, Sorghum bicolor
  Clone ID: SORBI-28MAY03-C48047_1.pep
QAGVVEQILDLGVLGYRAPELAASKKPSPSFKSDVYAFGVVLLELLTGRCAGDVVSGSEGGVDLTDWVRLRVAEGRGSDCFDVAMASDSENPQAVKGMKEALGIALRCIRPVSERPGIKSVYEDLSSI

SEQ ID NO: 34401 - protein, 156 aa, Sorghum bicolor
  Clone ID: SORBI-28MAY03-C48065_1.pep
QFLEHIHVIQQQLTIAGIIYAGTYSPMPLASKRSALMKFQEAPTCMALVMDGTAALGLDLSFVTHVFLMEPIWDRSMEEQVISRAHRMGATRPIHVETLAMRGTVEEQMLRLLQDSSACRKIVNKGTGSTDNEGGRSHRSLHDFAESSYLLQLSSV

SEQ ID NO: 34402 - protein, 121 aa, Sorghum bicolor
  Clone ID: SORBI-28MAY03-C48076_1.pep
TRAARESVTRARRRIPCVLCWVPASRHVASRGAVPSHPCASWLVRRRSVRPDSSLPPLASHLALLCLLLRDPRGTARRRRRRVRRHTHTHTQCSFSDWLRYTVTVQEVVRDTIMCCVCFFI

SEQ ID NO: 34403 - protein, 40 aa, Sorghum bicolor
  unsure (1)..(40): unsure at all Xaa locations
  Clone ID: SORBI-28MAY03-C4808_1.pep
ILEIIRSVPSFSSLWLTMNLVVKFYSCMLNLTIYTXRAAK

SEQ ID NO: 34404 - protein, 185 aa, Sorghum bicolor
  Clone ID: SORBI-28MAY03-C48128_1.pep
TRPPPRPRPPPPPPLPPSPPRSPRPHRPRRRSPPPRTRRRSPRPPPPPPSSPRHPPAPRSPRLRRLRPAKPMHPARSAMAPPPTPRVLEGPWQAESWRWRWASWPCSPRHGAHADGARERVAPAPAAPAPHGQPAGSPRDDDEQSSDADACSRCAVPFGVGPRWRSRPLTATRLRRGCVQFLSVV

SEQ ID NO: 34405 - protein, 111 aa, Sorghum bicolor
  unsure (1)..(111): unsure at all Xaa locations
  Clone ID: LIB3481-048-Q6-K1-H3.pep
VIGENGRRGGNDVSILHGVTXLEARXKESGDRHPKVGDGVLIGAGASVLCIVRIGAGAKIGAGAVVLRDVPEGTTAVGNPAKAVGKKAVPQRRPEEQPGVTMEQGWSDYVI

SEQ ID NO: 34406 - protein, 92 aa, Sorghum bicolor
  Clone ID: LIB3481-060-Q6-K1-A10.pep
LGTGGSGDGGGGRALARASCSTTPRASSSARRPSSGAGAKIGAGAVVLRDVPEGTTGGGDPAKAVGKKAVPQRRPEEQPGVTMEQGWSDYVI

SEQ ID NO: 34407 - protein, 186 aa, Sorghum bicolor
  Clone ID: SORBI-28MAY03-C47885_1.pep
MPMAAASPEKLHCGEVGTGDEEKEDAERADAEVIAQQLSNQSLREKAQRLQGLLTEGTSERLPDRGRKLRATLVAIYREQDRRQARGDRARAPGNEACERRVRSRCIESSGLRSDLSRVEVSVADFMSSFGADKEAGINISSLGIKSWSPNQPSTLIGDKGKLCEEKDSCEASLQPMNSVHEEWHL

SEQ ID NO: 34408 - protein, 240 aa, Sorghum bicolor
  unsure (1)..(240): unsure at all Xaa locations
  Clone ID: SORBI-28MAY03-C479_1.pep
CMHWQWRNCRWAWKGQYTRGDQCGPTVMLEAVASHDLWIWHAFFGVAGSNNDINVLNRSPLFTDVVQGRAPEVHFTVNGNEYNMGYYLADGIYPEWAPFVKTIHLPQCGKDKLFAEHQEGARKDVERAFGVLQARFAIQRSPARMWQVRSLAEIIYACXILHNMIVEDERDSFRVRYDDNYEHENHESSSSAPLLYGHGPIHGFARALEIQEGIRDRDMHRRLKADLIEHIFQRFGGALV

SEQ ID NO: 34409 - protein, 198 aa, Sorghum bicolor
  Clone ID: SORBI-28MAY03-C47903_1.pep
HEGLPPLVTRRLLELCTWLASNHPSVADLLIHFSPSASSNCLTLQHNKETSQESPTPNRMQPSSEGYTPILLFLKLLNKPLFLRSRVYLEQVMCLLEVVVNNAASQIDCPPHSAQITNSSDIELVDGTPSQTHVEPSTLEQGHIPDNNQSRDVEVPPTCAKQNDNVHEILTQLPDAELHNLCNILALEGLPDKVYSLA

SEQ ID NO: 34410 - protein, 89 aa, Sorghum bicolor
  Clone ID: SORBI-28MAY03-C48246_1.pep
ASGSNTSYGAAAVRPYGSAQAQPSYGQTQAPSAYGHTQLPSSFSLAQSQSPFTAAQGSSPYGLAAHPPAYGSGRAGPNAGTYEASHGRK

SEQ ID NO: 34411 - protein, 133 aa, Sorghum bicolor
  Clone ID: SORBI-28MAY03-C48260_1.pep
LSDEDRKAQLKLHGGQAVKGKDYAGASKFYTEAIMLDPADATLYSNRSFCHLKIGGARDALVDANACISLQPDWPKGYYRKGSALMSLKEYKEARDAFMDGLRLDPSNLDIQNAYWEADEAMIKKHSTGQSAD

SEQ ID NO: 34412 - protein, 132 aa, Sorghum bicolor
  Clone ID: SORBI-28MAY03-C48268_1.pep
AKLFNIQLHALCTKLRGEFAGASITYVDIHTIKYNLIANYSRYGFEHATQACCGYGGPPLNYDGNVPCGQTVSVNGKLVTAKGCSDTTEFVNWDGIHYTEAANFHIASQILTGKYSDPPFVDKMPFVLKPRF

SEQ ID NO: 34413 - protein, 243 aa, Sorghum bicolor
  Clone ID: SORBI-28MAY03-C48293_1.pep
MAAPRVEKFSAAAEKARVKSNVLTKEASVPKDANGNAISAQTFTFRELATATRNFRPECFLGEGGFGRVYKGPRESTGQVVAIKQLNRDGLQGNREFLVEVLMLSLLHHQNLVNLIGYCADGDQRLLVYEYMPSGSLEDHLHDLPLDKEALDWNTRMKIAAGAAKGLEYLHDKANPPVIYRDFKSSNILLDESFHPKLSDFGLAKLGPVGDKSHVSTRVMGTYGYCAPEYAMTGQLTVKSDVY

SEQ ID NO: 34414 - protein, 118 aa, Sorghum bicolor
  Clone ID: SORBI-28MAY03-C48294_1.pep
LCNDCPAGGVGIYNPGFWGMNIEDGKAYNLVMYVKSPKNTCLTVSLTSSDGLQNLASVNIIVAGKSKWIKVEKKLVAKGTNRTSRLQITSKKKGVVWFDQVSLMPADTYKVYYVFVGS

SEQ ID NO: 34415 - protein, 122 aa, Sorghum bicolor
  Clone ID: SORBI-28MAY03-C48296_1.pep
KKIPSSMLAPSLSPLFLSLLYPLSKRLDTERGKHIERKGRREEEHQPSRAWFLRTSWAVELSPGIRSGFDEIHTETQFLIFFPLSFAQEFTCTGETACLCFVFPVLFSGDFPLVRSSSPVRW

SEQ ID NO: 34416 - protein, 103 aa, Sorghum bicolor
  Clone ID: SORBI-28MAY03-C48303_1.pep
ARGRHPPPPPRRRPPSPIPRHSHRNPHPKSRLPDRSPPLSPCVNPSGHGSRDSRDSPPAAASLPSTDGGAALLHLRTMALLPWRHALRRPLLPSHGRGQTEGW

SEQ ID NO: 34417 - protein, 161 aa, Sorghum bicolor
  Clone ID: SORBI-28MAY03-C47980_1.pep
HEASSACPSSSGVPVPGCPRPAVPAVAPRRRLRSLCPYFLCLPAVFCRADSWVAAARRACRRASPSFAASAGYRAGQIAPPCFVVSVSGLPRPGVRAAVAVSRRPSVSRAVEFSRSVVRPVHSFLFFRLDRPVGLYSRFVLCSFINSCFLCAIDLRSCTMQ

SEQ ID NO: 34418 - protein, 121 aa, Sorghum bicolor
  Clone ID: SORBI-28MAY03-C48001_1.pep
LASQQYDPNTALASRKPGGDQRSRPGENGRVVSRNDETGSSGHKSPGKDREDSPRDLPAILNKDLERERMVAEAKMWGDRERMVAEAKMWGDRERMVAEAKMWGENWRDKRRAENGQGSLD

SEQ ID NO: 34419 - protein, 111 aa, Sorghum bicolor
  Clone ID: SORBI-28MAY03-C48002_1.pep
SLAASAITWKDSENNSFLRVKIVNFESDAARVTISTTGLESSIDVLRSTATVLTSTNVMDENSFSNPNKVVPVKSQLFEAGAQMQVTLAPHSFTSFDLALAPSKFATLADV

SEQ ID NO: 34420 - protein, 72 aa, Sorghum bicolor
  Clone ID: SORBI-28MAY03-C48003_1.pep
GGALNLFMLPPEKLSLLVPPEYADSDQDLLLEIPLNARHPEAELLCQPSQLMSSITRSSTSGAEGEGCLKLP

SEQ ID NO: 34421 - protein, 252 aa, Sorghum bicolor
  unsure (1)..(252): unsure at all Xaa locations
  Clone ID: SORBI-28MAY03-C48379_1.pep
ARGKTALSRTFSRSSHNPGWVQKFLMHPMAQLPWARDAKSRSEGSQNGLEPGIPEPEYNVTTSLQWAHGKAGEDRVHVVLSEEQGWLFIGIYDGFSGPDAPDFLMSNLYKAIDKELEGLLWVYEDSSERCDHVSNLEEGESASASVDAPHDDNGQFQSDNGKQEQLGNFGKQNVSPGKGCDESVLQVQPNCTSCEEKDLAAQDSSSQKLGRDEIVEEMAGADLGNDLXSRESHNSNSGLSGTDLNTSCTCAT

SEQ ID NO: 34422 - protein, 105 aa, Sorghum bicolor
  Clone ID: SORBI-28MAY03-C48385_1.pep
MTELFDTAVTSLLHLPEVLDRLAAADGDRRSGGHHAAHHHGHARVHGLGGGGGGGAPVDIVETPGEYTFVLDVPGLSKSDIQVTLEEDRVLVMKGGSGKRKREEE

SEQ ID NO: 34423 - protein, 133 aa, Sorghum bicolor
  Clone ID: SORBI-28MAY03-C48386_1.pep
NAELLNFFAASFSPSSHAFTCSSSSTHRSSSSTHRSSSSTICCFMEDTTDLGLGFCMVTSRSRSCRACGSFMPASHLESWWGGAARAMGNDGAELGRGELRSWATTAGMQRCLCWYAEGRGVSCGGEIFERGS

SEQ ID NO: 34424 - protein, 214 aa, Sorghum bicolor
  Clone ID: SORBI-28MAY03-C48393_1.pep
HEGQIGLPVGPPWFWAVGRYSGTGGSSPRCGSRLCPGRPLLHPSPGSLGRRPPGSPRRNGPGNRIPCLRPPPCLGHPPPRPPACALAAASPPGCGGFADLPPAAGGQVLARLGAMHRGFAPWPPSRRPARPPVRLGWSEFHCRPRGLPDLPDALNGPLLPGAPLDGKSWKTFFVEREFRSKSFMGRFNVDILRGHNEDVRAVFLLVSANLIFTG

SEQ ID NO: 34425 - protein, 210 aa, Sorghum bicolor
  Clone ID: SORBI-28MAY03-C48398_1.pep
TRPGRAMPPSVDAPPAPPPRPAPAAPPARVASPAPRRAHAAAAGLGRSISADVLRAPPSPPHLPGAVPPLVSLAAPGPPHPPAADLPPSARPLLRRFFVGRLSDYTVSPASADYRRLLAQLSSAGLFERVGPTPKVQLALMAVLFYAALYLVLACATASAHLLAGGLIGFVWIQSGWMGHDSGHHRITGHPLLDRVVQVLSGNCLTGLSI

SEQ ID NO: 34426 - protein, 165 aa, Sorghum bicolor
  Clone ID: SORBI-28MAY03-C4841_1.pep
RTPLHLAAWAGHVDVVRCLCKHKADVGAAAMDDTAAIHFASQKGHVEVARELLASGASVRAKNRKGFTALHFAAQNSHLDLVKYLVKRGIDVTTKTKGGQTALHVAEDDEVRAFLKECEQSMKKGAELPSEKKDDSAEKEGDSKSSGEVMKEGEGGGQGHKPENE

SEQ ID NO: 34427 - protein, 285 aa, Sorghum bicolor
  Clone ID: SORBI-28MAY03-C48539_1.pep
MSRFKPAAGLPPYHHRALPGPGPGHGQGPVPTAHGMMHREVRDPYGPPGPGMHLPPPGQGPGPFPYDMLPPPEVLEQKLVAQRGEMQKLAVENDRLAASHASLRKELAAAQQELQRLQAQGEAAKAAEEQEMRGLLDKVGKMEADLKACENVKVELQQAHAEAQNLVTVRQSMMANVQKLSKDLQRNLGEAQQLRALVAERDAARQENQHLRNTYDYERKLRVDHSESLQTMKRNYESMVTELEKLRAELRDTSNLDRSGFFYNNTTQNADGISSQLSVGQISYD

SEQ ID NO: 34428 - protein, 53 aa, Sorghum bicolor
  Clone ID: SORBI-28MAY03-C48154_1.pep
GLAIYTNKFFCSITTQKELKSVLLTVRVSPEEKKLEHYCTNRMKWGNPSPLPG

SEQ ID NO: 34429 - protein, 69 aa, Sorghum bicolor
  Clone ID: SORBI-28MAY03-C48184_1.pep
VLPAVKRNKEGLEEVIARMHEALERKKKEIPEFELKYKIRIRKADNDAEDEGGKKEGTAQGVLVGPPCQ

SEQ ID NO: 34430 - protein, 121 aa, Sorghum bicolor
  unsure (1)..(121): unsure at all Xaa locations
  Clone ID: SORBI-28MAY03-C48225_1.pep
QKLQAEDCFFVYRMVVVLFRRELTFEQTVCLWEVMWADQAAIRAGIGRSTWGRIRLRAPPTDDLLLYAIAACVLQRRKLIIXKYSSMDEILRECNSMAGQLDVWRLLDDAHDLVVNLHDKI

SEQ ID NO: 34431 - protein, 168 aa, Sorghum bicolor
  Clone ID: SORBI-28MAY03-C48447_1.pep
VSSGFVPPFGPGPPGAGLAAFCKLVSFVSGGGGVDADACGSLLPLVSFDGDCNGACCPAAEDCPEPVGAGACSPELGSSPSGRLLPEAEAGAGSSAEASSSSTTTTVNPQAPIGWEPGGRETSYRVSRFVADSGSAAGMLLIASAVAAPRRLPRRQIRDPRRGRRGLV

SEQ ID NO: 34432 - protein, 95 aa, Sorghum bicolor
  Clone ID: SORBI-28MAY03-C48464_1.pep
LNALHIARHFNNNNLSGSFPHESSLLRNLKSLWIFDNNVEGLIPEFIQNLTSLTDLRIYGTKLQGPIPKKISNLTNLEVLMLGDLGGNHSYFDVI

SEQ ID NO: 34433 - protein, 133 aa, Sorghum bicolor
  unsure (1)..(133): unsure at all Xaa locations
  Clone ID: SORBI-28MAY03-C4848_1.pep
TTIRENIIYARHNATESEMKEAARIANAHHFISSLPHGYDTHVGMRGVDLTPGQKQRIAIARVVLKNAPILLLDEASSAIESESSRVVQEALDTLIMGNKTTILIAHRAAMMKHVDSIVXLNGGRIXEQGSXD

SEQ ID NO: 34434 - protein, 274 aa, Sorghum bicolor
  Clone ID: SORBI-28MAY03-C48502_1.pep
RKLRAQIRELEEEKQRLNSRIQVEEAKVESTKRDKAATEKLLQETIERNQTELAAQKEFYTNALNAAKEAEALAEARVNSEAKVELENLLREAGEKENMLIKTIEELRHSLTRQEQEAAFREERLKRDHDDLQKRYQASELRYNELVTQVPESTRPLLRQIEAMQETAARREEAWAGVERTLNSRLQEAEAKAAASEEKERSINERLSQTLSRITVLETQITILRTEQTQLSRSLEKERQRASESRQEYLTIKEELVKMTEQCEKLRTEAAAVP

SEQ ID NO: 34435 - protein, 116 aa, Sorghum bicolor
  Clone ID: SORBI-28MAY03-C48509_1.pep
MASPETSAGNTQRGDTLPNGDIYVGNFAGLVPHGFGKYMRTDGTLYYGEWDTSKMSGRGVIQWPSGASYDGDLCGGFIDGTGTFKGVDGSVYKGSWRMNKKHGMGTMVYANGDTYE

SEQ ID NO: 34436 - protein, 227 aa, Sorghum bicolor
  Clone ID: SORBI-28MAY03-C48532_1.pep
VALANVSDVAFQQISSTNVLSKAGSQLMIPGATQSVLTEEIPSCSTSPPAANNGNHLAHPTIGRNEHCKVNMEKVPQSSALMSIPTSSEAVTTPIMMKESSKLNHNLKENVITSKSPTVGTGHDNLLNIVPSTENLETASSATSLWPTQTDGLLHQGFPTSNLNQQQMFKDALADVEIQEVDPTNNAFFGINNDGPLSFPMETEGLLVSALNPVKCQTNLSTDVENN

SEQ ID NO: 34437 - protein, 199 aa, Sorghum bicolor
  Clone ID: SORBI-28MAY03-C48304_1.pep
MRRPPIAARVRRSLFLLLLCCCLTAWSPPPPAVRALPLCTDGRAPVPLNRTLGFCSAYGGASSRSSCCDAAADAALRKRFVAMNISDAACAGVVKSVLCAECNPFSAELFNSSSKVQMVPLLCNYTSSASSAQSKDSTQDYCTLVWETCKNVTIVNSPFEPPLQGSARLPSSSSKLTDVWQSEDDFCTSFGGSSGDQSL

SEQ ID NO: 34438 - protein, 94 aa, Sorghum bicolor
  Clone ID: SORBI-28MAY03-C48316_1.pep
MDADEVHRKKRFTERMSRLEEEEKNQADIRKRKFFAEILNASREHQVQLATTFKQRKQRNDGVHAWHVRARQRISRPEKSRLNLLKIGDQESYM

SEQ ID NO: 34439 - protein, 183 aa, Sorghum bicolor
  unsure (1)..(183): unsure at all Xaa locations
  Clone ID: SORBI-28MAY03-C48369_1.pep
LNSLCSLRPAAVRRAPTTCLLPIPLFHSPASAPPPAHPPSLPNPSNSWRPPPPPAASSQHTPPRPPPPTLLLPPPPSPRXAPTPPLPLHLPPHNPRPPNRARHNPPRPLPHRPQSPRPNHASTSRSSSSCPCTTRTRRPSRTTPAATRTSPTAAPTSGPRRSTRDGSRAAATGTSASPSRSRP

SEQ ID NO: 34440 - protein, 176 aa, Sorghum bicolor
  Clone ID: SORBI-28MAY03-C48329_1.pep
MGCSMSGLNALYDATTGGSDVWINDRRFRILRQIGEGGFAFVYLVREHQPASDAAVARRDTAHVSEDGTYAMKKVLIQSKEQLDLVREEIRVSSLFNHPNLLPLLDHAVLAVKGDWSHEAYLLFPVHLDGTLFDNANIMLSRKEFYSTADVLQIFRQMCEGLKHMHSFDPPYAHND

SEQ ID NO: 34441 - protein, 184 aa, Sorghum bicolor
  Clone ID: SORBI-28MAY03-C48554_1.pep
MAAWSSREHDKQMAASLRMIASAMGGTGISSQTLDEMKRTVAKADCDASNVVEVLERMAEDSDEEEHLGPLHDAAGAGKMDVCKHLVENLGFDVDVRANDGSGKTPLTCAVSRGKVIAVRYLIAKGADLNKQDAMGFTPLHYAVKKGYSGIARLLLSRGANVDVESSEGTPLHVSAARGKFGVM

SEQ ID NO: 34442 - protein, 171 aa, Sorghum bicolor
  Clone ID: SORBI-28MAY03-C48573_1.pep
HEVLLCLRDEDGGFYMVYNTKAKANSIAVVPRRVCCSLTHFPIARVRWQFQGVTILRLSTSEEHDQYLLAELLFRTEDRSGLDPTNKATLFLWRSITASDQAARGPICNPYICLTPDKVPPFPQCLDMYPQQWIPMEVELPLPTDRDHHPSFRADMTLATGAATLYWVDLL

SEQ ID NO: 34443 - protein, 293 aa, Sorghum bicolor
  unsure (1)..(293): unsure at all Xaa locations
  Clone ID: SORBI-28MAY03-C48605_1.pep
TRTWLGYTYLFIRMKTNPLVYGITXEEVMGDPSMGAKQRTFIIDAARALDKAKMMRFDEKSGNFYCTELGRIASHFYLQYSSVETYNEMLRRHMSESELITMVAHAAEFENIVVREEEQDELETLARKACPLEIKGGPTDKHGKISILIQVYISRAPIDSSSLHSDAQYISQSLARIMRALFEICLRRGWSEMSSLLLQYCKAVDRKIWPHLHPLRQFDKDLSPQILWKLEERNVDLDHLYEMEENEIGALIRFSHQGKLVKQYAGYFPYVNLSATVSPITRTVLKVDLHITP

SEQ ID NO: 34444 - protein, 175 aa, Sorghum bicolor
  Clone ID: SORBI-28MAY03-C4870_1.pep
GLKRFKGDEEKLADFVRRYVARLLKADKLAVLGELERQEEVDLAVKMFRIIQKEDWYKPDIYMYKDVIIALAKCKKMEEAMVIWGNMRDENLFPDSQTYAEVIRGFLRYGSPSDAMNIYEDMKKSPDPPEELPFRVLLKGLLPHPLLRNRVKQDFEELFPERHIYDPPEEIFGMH

SEQ ID NO: 34445 - protein, 87 aa, Sorghum bicolor
  Clone ID: SORBI-28MAY03-C48790_1.pep
VLVTEVLIMYLAICYDGETICQRLNRVHEATAASVLQVHCSFHVDLEGSKFTGLDMSFLTFMSGSLVTQECAGTCKSKHAGIVSGRK

SEQ ID NO: 34446 - protein, 75 aa, Sorghum bicolor
  Clone ID: SORBI-28MAY03-C48915_1.pep
CYIYFTRVVVYALQTITSYRYLWTSVVAGELATLAFYVFTGYKFRPEVHNPYFAIDDEEEEAAAEALKLDDEFEL

SEQ ID NO: 34447 - protein, 174 aa, Sorghum bicolor
  Clone ID: SORBI-28MAY03-C4886_1.pep
LEVSGTEAAKLPETIKNLEAQLERALEEKSVLEDQMKQLEQVMSESLEKHSHEQSSLTADLLKLSEANASLENKLSAVAAELMQVYADKEEESLENEKRISVLNQDIADLRRKLELLSSEKATVDDELAKLLADITTRDEKMKQMDDHLTQLQFEHAKLMAEFDTAHRSLSELR

SEQ ID NO: 34448 - protein, 191 aa, Sorghum bicolor
  Clone ID: SORBI-28MAY03-C48419_1.pep
MHPRAASGATGKSTAPYGSWESPISAAVVSAAGRTAEGFAIAGDGRLVWVETRPEDGGRAVLVKEAAEPGGKALDVTPQGFAVRSLAHEYGGGAFAVQGDTVVFSNYTDQRLYKQTIGDNSPLPLTPDYAGSVVRYADGVFDPHFHRFVTIMEDYRHNSSDPITTIVAVRISDHDVKESTMLVSGNDFYAF

SEQ ID NO: 34449 - protein, 142 aa, Sorghum bicolor
  Clone ID: SORBI-28MAY03-C4843_1.pep
HASAHASGQLVLTYLYLLIYICLSSGVILFNKWVLSPKYFKFPFPITLTMIHMAFSGIGTFFLVRVFKVVAPVKMTFHIYATCVIPISAFFASSLWFGNTAYLYISVAFIQMLKALMPVATFIMAVLCGTDKLRWDLFLNMG

SEQ ID NO: 34450 - protein, 187 aa, Sorghum bicolor
  Clone ID: SORBI-28MAY03-C48438_1.pep
HEVNFLTSISGRVSKKTKLVFRFLDERSIEPSTSQTYGSMLKNLTFVKTFASGILVPKSYIWPVTPDNYLLPYTSVVDDAHKAGLEIYAADFANDFTISYNYSYDPLAEYLSFIDNGAFSVDGVLSDFPITPSEAVDCFSNLNNSKIDHAKPLVISHNGASGDYPDCTDQAYEKAVADGADVIDCPV

SEQ ID NO: 34451 - protein, 100 aa, Sorghum bicolor
  Clone ID: SORBI-28MAY03-C48442_1.pep
ARGSAASAPLPPPPPPPFSARPRRVLAAPPPPRPPRPLLGSAAGSPCRPPWPALAPSGWWVSVARGPPPAPCGSCGTEGPRPLPWGRDTCWGLLSCSLPC

SEQ ID NO: 34452 - protein, 138 aa, Sorghum bicolor
  Clone ID: SORBI-28MAY03-C48959_1.pep
PNWHIGMRGTQHRAVMWRVWKEGGTGFLYWGTNCYEKAMIPSAEICFRRGLPPGDGVLFYPGEVFSSSHEPVASTRLERILSGMQDIEYLKLYSSRYGREEGLALMEKTGMYLGPDRYTLDHGPVDVMRGEVYRTCRS

SEQ ID NO: 34453 - protein, 70 aa, Sorghum bicolor
  Clone ID: SORBI-28MAY03-C48980_1.pep
PKPPSPGPPKPRPPSPGPPKPPAPKPKPKPCPPAPKPKPKPKPKPPTPKAPPPPKKPCPCPPGSDEVNKN

SEQ ID NO: 34454 - protein, 100 aa, Sorghum bicolor
  Clone ID: SORBI-28MAY03-C49050_1.pep
IIVADGAEDVTIKISDEGGGIPRSGLSRIFTYLYSTAENPPDLDGHNEGVTMAGYGYGIPISRLYARYFGGDLQIISMEGYGTDAYLHLSRLGDSEEPLP

SEQ ID NO: 34455 - protein, 174 aa, Sorghum bicolor
  Clone ID: SORBI-28MAY03-C4906_1.pep
MAKQGAKKMKDENKKRLELLLRIILVSNAIYIVVRMAIMHSSFTWKHWIGLMVTSAAYFLPYKQLASMAKPVYSDNGELLDGGFDLSTGGVCEYLYDVIYITVFVQLMSIISEKFWWTYLVIPAFAGYKIFGLLRGTFFSGGSEGEVEDEKTRKKREKMEKKASRGKMIKTRTR

SEQ ID NO: 34456 - protein, 97 aa, Sorghum bicolor
  Clone ID: SORBI-28MAY03-C49063_1.pep
PPYANGPGYVISGDIAKFIVSQHANQSLRLFKMEDVSMGLWVEKFNATKPVQYSHSWNFCQYGCVFNYYTAHYQSPRQMLCLWDKLIRGQPSCCNYR

SEQ ID NO: 34457 - protein, 104 aa, Sorghum bicolor
  Clone ID: SORBI-28MAY03-C49070_1.pep
GNEVVHLVRWVQSVVREEWTAEVFDGELLRYPNIEEEMVEMLQIAMACVSRTPERRPKMADVVRTIEEVRRSDTGTRPSTEASTPAAIEAAQNWAESSSAAQER

SEQ ID NO: 34458 - protein, 123 aa, Sorghum bicolor
  Clone ID: SORBI-28MAY03-C49073_1.pep
AEPDDNAEPDDIAEPLITVDDSIEESLWSPCMDYELDTMSRSNFGSSINLSEWFNDADFDSNIGCLFDGCSAVDEGGKDGVGLADFSLLEDFSLFEAGDGQLKDVLSDMEEGIQPPTMISVCN

SEQ ID NO: 34459 - protein, 201 aa, Sorghum bicolor
  Clone ID: SORBI-28MAY03-C48543_1.pep
MASFSSLAATSSSTSTPSFTLPTKTSPGTASLSFPRARESLKSRARMVTVRAEAVDTTISPRVSALRPSKTMAITDQATALRQAGVPVIGLAAGEPDFDTPAVIAEAGMNAIRDGATRYTPNAGTLELRKAICKKLEEENGLSYTPDQVLVSNGAKQCITQAVLAVCSPGDEVLIPAPYWVSYPEMARLAGATPVILPTSI

SEQ ID NO: 34460 - protein, 171 aa, Sorghum bicolor
  Clone ID: SORBI-28MAY03-C48545_1.pep
MAGPDCCLQSFELYEAESKFYILGTNTNKTIWRLLKIDRMEPSELNVDEDSTVHSQSDYLDLLKNLDQEHRSTGGVKFVTNCFGIIGFIKFLGPYYMLIITEQRKIGDIFGHPVYQVTKTAMIELSNSKTRPKLINSKDENRYKKLLQTIDLRKDFFFSHSYQIMRSLQKN

SEQ ID NO: 34461 - protein, 135 aa, Sorghum bicolor
  Clone ID: SORBI-28MAY03-C48547_1.pep
ARGEKPSNQSSAIIVKSYTSRLPVGNPDGTIIIRTDQYNRDDLPIDYTYAKLFVIKSIGEADVHKSIKYGVWSSSSNGNSKLDSAFRDADRISRRHSTKCPVFLFFSVNGSGHFCGMAEMVGPVDFHKDMDFWCQ

SEQ ID NO: 34462 - protein, 198 aa, Sorghum bicolor
  Clone ID: SORBI-28MAY03-C49114_1.pep
MAAAPRPKSPPASPDPCGRHRLQLAVDALHREISFLEGEISSIEGVHAASRCCKEVDEFVGSNPDPFLTIQPEKGSHDQSQQFLKKFRAKSCLSYYLSWICCCGGGGGGGSGGWCPPSLQLKRPAAPSCSCAPRLRKLCCCCCCCRCRVVYAGGAGGCGCCAPCPRCSCDCTCACPRCCSCPRCSAACCCAPRCCLCL

SEQ ID NO: 34463 - protein, 100 aa, Sorghum bicolor
  Clone ID: SORBI-28MAY03-C49121_1.pep
RSQMVSLPQRSDYHTCRCNNPQELFISIVTPWYRLFNPAYIYPYMKTETSYHHAQRLHHLLFDGSLTSCSEAKVACVALHHSRRQEQRVSSLESWRDRKD

SEQ ID NO: 34464 - protein, 92 aa, Sorghum bicolor
  Clone ID: SORBI-28MAY03-C49149_1.pep
GYIRLFCWSCVSPCALLCSACFAGWARPGSAVRPVLAPSCGLRPLCSVPQVPRIFFWLPRCRNALSHCWLGSSSCMQFACALSIWILIVLCV

SEQ ID NO: 34465 - protein, 87 aa, Sorghum bicolor
  Clone ID: SORBI-28MAY03-C49161_1.pep
RTIKLSNQSMCNIFYVCLGSKHKSKLVTNIICYQSNLKFCNFNTILVGTIVIFVTFPYMKNTAAVGTKQDEPPYGKHRLDNPECILL

SEQ ID NO: 34466 - protein, 141 aa, Sorghum bicolor
  Clone ID: SORBI-28MAY03-C49167_1.pep
PIWYRIRPVCQSIDATPEISQDEDATLATILQRNGSCVSPNDICAQMTYVLLTTEIIREIHRPHIFQVAYPDAVTILNACAFTNIQINGPPLGRQTFQTEAPNLRSAHSLNLYIHQPACIIPPYINRTNHYVQIYVPMIYV

SEQ ID NO: 34467 - protein, 146 aa, Sorghum bicolor
  Clone ID: SORBI-28MAY03-C49177_1.pep
VHATTTTTDAAVPWGSIRAAPSKALVTVAVQRSMWPLHVMAGAEWRVADLVAAAVGLYVREGRRPLLPSADPSAFGLHYSQFSLESLDPEEKLMELEGRSFFLCPRATAAPSTRPATEASKATPTSADRQNMLPPWLSFMHFWPLL

SEQ ID NO: 34468 - protein, 125 aa, Sorghum bicolor
  Clone ID: SORBI-28MAY03-C51131_1.pep
FSICRNPSLNQMSRRSKREMASPPQISSPSVPMMPAARPREMAPPPQISSPSASDFLSGPGCFPTPPASINTTMGSAAPSPWWCGPPVPQQGMSWWPAPSCGGGATASSSQSVQRDDIDSDPKEC

SEQ ID NO: 34469 - protein, 110 aa, Sorghum bicolor
  unsure (1)..(110): unsure at all Xaa locations
  Clone ID: SORBI-28MAY03-C5115_1.pep
ARSIMKLHGANSTEFDPTTKTPCVIFMPEGSKTHMGATMRLGSRRTFFQVTNCKFFKLYGGVSYIDERHRHRYEVNPDMVPEFEKAGLSFFGRDESGKRMEIIELPTXRV

SEQ ID NO: 34470 - protein, 158 aa, Sorghum bicolor
  Clone ID: SORBI-28MAY03-C51156_1.pep
TRISTGDVGYGICSIDFFPCSFGSLHFARALQMFGRNIHDGETEEKDGEKEDGDGEKLTSHMFCKTLTASDTSTHGGFSVPRRAAEDCFPPLDYEQLRPSQELIAKDLHGMKWRFRHIYRGQPRRHLLTTGWSSFINKKKLVSGDAVLFLRGSDGELR

SEQ ID NO: 34471 - protein, 218 aa, Sorghum bicolor
  Clone ID: SORBI-28MAY03-C49240_1.pep
ARGDRKHFSIKEQIQEVNFNVESLQSLAQEVRDGNVELKETIKNHEGVKALYVDNLMLLERTLEKNAHLERSLSAATTEIEALREKKAPLEESCKRLHSKVNGHQSERAMFVARIEGISHTREKISEKNVFWENLLSDNNTELELLRRKLKVSEEFTHTFRSQNSVFRSEKRTLMREVDSINSALLSLETQYAELEGRYLDLEQDKDKALNEVIRLRE

SEQ ID NO: 34472 - protein, 96 aa, Sorghum bicolor
  Clone ID: SORBI-28MAY03-C49247_1.pep
MQEVHSIINNMRANAAPGPDGLNAAFYNASWDWIANDVYDLVASFYRSGYLPAEINYTRITLIPKINAPLTPKDYRPISLCNVAYKIIAKSLADRI

SEQ ID NO: 34473 - protein, 230 aa, Sorghum bicolor
  Clone ID: SORBI-28MAY03-C49250_1.pep
WNYYNMARIRLVWARIAPGLAQHFIAAGSHHEEKVAMYAIDSLRQLGMKYLERAELNNFTFQSDILKPFVILMRNSHNSKIRGLIVDCIVQLIKSKVGSIKSGWRCVFMIFTAAADDEDESIVESAFETVEQVILEHFDQVVGDCFMDCVNCLIGFANNKCTPRISLKAIALLRICEDRLAEGFIPGGAVKPIDVVPEANSDVTEHYWFPMLAGLSDLTLDSRPEVRHCA

SEQ ID NO: 34474 - protein, 132 aa, Sorghum bicolor
  Clone ID: SORBI-28MAY03-C49259_1.pep
MALVQFNGALVPQLGEKPRLLSSSPAVARATYADARFLTPKTGSRGRGKHLLSPSYSLHSQTSSEQLNHVPSSRFRQKRGSRFVVRAEADFYSVLGVSRDASKSEIKSAYRKLARSYHPDVNKDPGAEQKFK

SEQ ID NO: 34475 - protein, 163 aa, Sorghum bicolor
  Clone ID: SORBI-28MAY03-C4927_1.pep
PTRPAAPTECALIPLLVPNGDQLDGTTEDKTRIHDHISNLKFSISPTAFFQVNTLAAERLYTLAGDWANLNSDTLLFDVCCGTGTIGLTLAHRVGMVVGIEMNESAVSDAHKNALINGIKNCRFVCSKAEDVMGPLLTEYLGSPQQQAAASESNSEIDDTNKN

SEQ ID NO: 34476 - protein, 182 aa, Sorghum bicolor
  Clone ID: SORBI-28MAY03-C49287_1.pep
STFFCREEKRGESAAGTPAVRWMEGCNGHNSSGSRSLERAISRKAMQAGSSAPCKTWLIGFFCGVCITCLFGVVALPPLRVIQSQSVYPLPLRRAILSNFTFTQPADGAAAATDELPSAPEKMEQQKENENITEDARIMYLYNEWSTLLSTGRDEVTKSSDGISNKDSDLPRPPHLEDCRTN

SEQ ID NO: 34477 - protein, 189 aa, Sorghum bicolor
  Clone ID: SORBI-28MAY03-C49289_1.pep
MQNMLGGEAGHAVIFDGVDAILEVPWCSPSLRKLVFMVFPMSRVPRWMKSLVNIEELMLRIKNLGEESHCILGDLPALVHLTLEIINNVEGVHWTDKQRLVVSNRYGYRSLRHFRVAIIGLRFVRHSIPMLTFEAGSMPELEVLHIDFDADMTISVSNGHLDFGLKHLSQLTEIEFYIFGTKLNGLRVQ

SEQ ID NO: 34478 - protein, 163 aa, Sorghum bicolor
  Clone ID: SORBI-28MAY03-C49093_1.pep
GLRVRPAVRTADLGLPLRRRRLPLPGLRFGSSLRTTNFSPPLPLRCPPLPGLCTGPSFAASLSISVVLCLSLFPLRCVSAYCTAHASVSSSHLLCSLSSCFGAGCPPPGARDPVVVFLLGYYVSLSLCWSSQRFVTYFSNTAGRKNYSPPLPKMCSGKTDECT

SEQ ID NO: 34479 - protein, 74 aa, Sorghum bicolor
  Clone ID: SORBI-28MAY03-C49079_1.pep
PVCRSYSGAASSNLQVISMDQFATCHICLGSVHTLHLFVYVIKSYPPVCLQSVAMDAADAYSFIHTVLVERCVQ

SEQ ID NO: 34480 - protein, 131 aa, Sorghum bicolor
  Clone ID: SORBI-28MAY03-C49098_1.pep
CISFTTYPVQCRLHGSIQCGSFQDPRNSRPGIMAQTRFMAFTGHLVPCDYTKDNQRTNHCRSVLAAPELPLLLPFLDNFLNQRPQEQWWHASIVSIYSDLIILPPISCTVLLCFYYLLASISTWEKNFLGS

SEQ ID NO: 34481 - protein, 249 aa, Sorghum bicolor
  Clone ID: SORBI-28MAY03-C49109_1.pep
TRIGRCHLDNDELRVHRPLPRLLYLNVAYCAISKIEFIAMNLQTFVFQGSWINFYLGTALALKDVKLYLIGKITLNLAMTVLPFLFPRAQNMILHCSLPLKMPWPQGNGSKFSLLKYLQLKFLVLPEDLLNLLSLASFLSAAPFIEKLEIHFAIRTLPQGSELIRRLPGSTYRYLKNLSITGFAGCTGQVELLLHIVENAPNLEALTIDRANHYGSIEEHVWQSRSKALDIARRHLDGRLSENTKVSIM

SEQ ID NO: 34482 - protein, 128 aa, Sorghum bicolor
  Clone ID: SORBI-28MAY03-C4936_1.pep
REREREREETTSGGRRKTTRHLRARSLPTSYLYLVLPSLIAMALPACCTTRPALRLLATSDWCAWKPSVVRSRKKPPPPSIISSSHDDDDQSTAPWILFRRGAAARAASFSIQREDRRNSEEEEDSSR

SEQ ID NO: 34483 - protein, 133 aa, Sorghum bicolor
  Clone ID: SORBI-28MAY03-C49370_1.pep
MDFDMDDYIDPYEEAEAEAAAGEDDDSDDPDEDDSDAESDYEEKSFGLLKSGKHRVRNPDGTFRCPFCPGKKKQGYKIKDLLQHADGIGVSSKHRRHGRERANHRAFARFVRTDPDFAEDLVGITGIQGAITT

SEQ ID NO: 34484 - protein, 138 aa, Sorghum bicolor
  Clone ID: SORBI-28MAY03-C4938_1.pep
DSYHGLGMEIHGYKDELKALGVTVELKRGARFVITGVSIPSDPSKLSKTTILSLLGCIKSYFTLAAGPPKGFQENMCKKWLRTSMGYQCPNDCILFDPMQSSVCIEDGPFIDEAFYGSEIALFKDALTRIGVTMDIKP

SEQ ID NO: 34485 - protein, 156 aa, Sorghum bicolor
  Clone ID: SORBI-28MAY03-C49380_1.pep
MDMERSQQQKSPTESPPPPSPSSSSSSVSADTVLPPPGKRRRAATTAKAKAGAKPKRARKDAAAAADPPPPPAAAAAGKRSSVYRGVTRHRWTGRFEAHLWDKHCLAALHNKKKGRQVYLGAYDSEEAAARAYDLAALKYWGPETLLNFPVEDYSS

SEQ ID NO: 34486 - protein, 162 aa, Sorghum bicolor
  Clone ID: SORBI-28MAY03-C49386_1.pep
PSGGGGGPGSPAGLSPTSTSSNDAARSNISGAGVAPPPLVDVFSNAAPAPVQVKPQEIAAEGRAPQANPHPHPEVATHPHPEATRYRQPLSQLPPLPPVFMNDHRDAIQGLNQQPPGHGPRFDDCHMCLKALPHAHSDPVVNEYGNEVHGGAAPEPGPVFMS

SEQ ID NO: 34487 - protein, 159 aa, Sorghum bicolor
  Clone ID: SORBI-28MAY03-C49394_1.pep
HEGRGRGKREGSREGYPSEPLARGSGSPHCVGDSDGSDNFEWDSDGDGEEAASFNAAGASSSAMASTNADAPGPSTRVANGNGKAGPSASLVHKYMDMGFPEEIVLKAMKDNGDNGADSLVELLLTYQELGNDLKVDNGFASGCVPQNVDDSDDDDILE

SEQ ID NO: 34488 - protein, 160 aa, Sorghum bicolor
  Clone ID: SORBI-28MAY03-C49196_1.pep
HEAGAAACLELWHACAGPVAPLPRKGTVVVYLPQGHLEHLGDAAAAAAGGAPAPAALPPHVFCRVVDVTLHADASTDEVYAQLALVAENEDVARRLRGGSEDGSAGDGDDGEAVKQRFSRMPHMFCKTLTASDTSTHGGFSVPRRAAEDCFPPLDYSQQR

SEQ ID NO: 34489 - protein, 159 aa, Sorghum bicolor
  Clone ID: SORBI-28MAY03-C49204_1.pep
MGGGRAQVNKAHKSRFASKASRHAHKIDKVRSGKSETSHRAAVKGARAARIQQSKAIRDKKRAALLKEKRSSNGPSSAPRVIVLVGLSSSANVGSLAKDLLALAEGSDGKLESSTVASPTYKFRTTVLQAPYGDLTTCMELAKVADLLAFVLPANSFYC

SEQ ID NO: 34490 - protein, 214 aa, Sorghum bicolor
  Clone ID: SORBI-28MAY03-C49199_1.pep
KVLECAKEDLIAELNQVFTNTWIRRGRRGRPHVPTPSLVDVRPLKVVPSVVSSSSSQRSVTAFKKKVENPKLHANQDNLRPNQDNLTEVGHMYTDPSQPVHKSDIHYHNLPRAVNPSVTHVQHQKNYTPQGNAKVSEQLERNNSAGLMQSERDKRVPNGLFVNDRNGQNRSRFARTRSSPELTDSSAEGFRGRRNNAVGMEKSLGVDHSSRRNI

SEQ ID NO: 34491 - protein, 153 aa, Sorghum bicolor
  unsure (1)..(153): unsure at all Xaa locations
  Clone ID: SORBI-28MAY03-C49208_1.pep
ARGFLLDALGHRVSALERALALTPAPAPAPPRRKYTYAAEAHGRKVKWTAEDRPSGGRNLKWEAELRTPHHDGFDRKWKWESKASAAGAATKVKWEKEIKGKGFLEPWSNSYSVEETYGDDDHDDDXEKKPTDVNVKRKVKEDKQQHKKGNVE

SEQ ID NO: 34492 - protein, 141 aa, Sorghum bicolor
  Clone ID: SORBI-28MAY03-C49503_1.pep
QQGSRAAMWCPATAPWQIKTLMTSAGLYWLKCRPTAPCRTLATWPPERWALAAHWSASRRLLSGQELTQESFGTKEHGTTVSSLRSRSCSEICWGAQLVARRSCARGLHHQFFVARGLGCKQLTLCSDLGSLLFSGGKPRH

SEQ ID NO: 34493 - protein, 103 aa, Sorghum bicolor
  Clone ID: SORBI-28MAY03-C49505_1.pep
VHPKLNRVAYHIVIRGYCKMEDFEKAIECLKEMRKDGLLPNVDEYDKLIQSLCLKAMDWRRAEKLLEEMEDSGLCLRGISHSLIAAVKELEGEEMQSKASQEA

SEQ ID NO: 34494 - protein, 115 aa, Sorghum bicolor
  Clone ID: SORBI-28MAY03-C49526_1.pep
MASGPSHNYTKPRGTGGPNRYPQGGNQGGGYQNRGGQGGGYSSGSYPQQGRGPPPYPGGGMGGTGGPRGGNGSGYGVGRPNYQQVGPYGVSGPGRGSNYPQQGGSRNQQQHGNWQ

SEQ ID NO: 34495 - protein, 108 aa, Sorghum bicolor
  Clone ID: SORBI-28MAY03-C49530_1.pep
IEERGINSFIYSRRGDINRKEARRGPIVFIVVDSQFVSYKQAKSFNKQRPSILGKCLHAFHVVWHLAISWPAGALCHVQINDTYSNKLYNKRMFLYPKSKMTGFSFAP

SEQ ID NO: 34496 - protein, 168 aa, Sorghum bicolor
  Clone ID: SORBI-28MAY03-C49542_1.pep
EPTSARSMSFVGTHEYLAPEIIKGEGHGSAVDWWTFGIFLHELLYGKTPFKGSGNRATLFNVVGQQLKFPESPSTSYSSRDLIRGLLVKEPQSRLGVKRGATEIKQHPFFEGVNWALIRCSTPPEVPRPVEAELPVKYGVAEAIGSNSKRIAGADVKSGGKYLDFEFF

SEQ ID NO: 34497 - protein, 130 aa, Sorghum bicolor
  Clone ID: SORBI-28MAY03-C49551_1.pep
LDTEIDKLSIRSSPLGKDRQYNRYWFFKCEGRLFVETADSREWGYYSTKEELDALMGSLNVKGIRERALKRQLEKFYNKISNALEKRSKDIANKMLLEEGVLRRSTRVRANPKDNPSMAFLKYVNKWKDN

SEQ ID NO: 34498 - protein, 134 aa, Sorghum bicolor
  Clone ID: SORBI-28MAY03-C49561_1.pep
ELITGKKALNLEGPESERSLSVSFLCALKEGRLMDVIDDHIKGEENVGMLEEVADLAKQCLEMAGENRPAMRDVTERLGRLSRVTHHPWMQRDPEEMESLLAVREPSVDAVEMVSTSFLTMERTVGRALLEFGR

SEQ ID NO: 34499 - protein, 225 aa, Sorghum bicolor
  Clone ID: SORBI-28MAY03-C49292_1.pep
LLYVRDKRQHDDKFSDERVARGHESDRADYKSAKARRRSSESHYRKDAVQDVDHYEDYGNRYKESRGKKRPPEENDDQYDLKPPSTRDQRVHLEKSSGSGRLDSLIERARPDRSSSPSKIHSRSSPSPSSYHDKDQSRHGSKVIDHGKREMTYDERNSRPRTSSGRERTPGSRLRDRDAENWSSERLKQKDDHQPRDVALEISTSSHYDRTPRKDKHTSPKQLSE

SEQ ID NO: 34500 - protein, 76 aa, Sorghum bicolor
  Clone ID: SORBI-28MAY03-C4930_1.pep
DLKPGLNSLSLVMDSCVMLLLPFQIIRYFGFSRYVAFAMSTIVYRKTKTSYSLKQMEYKAGKMQGVGAVSDQESQP

SEQ ID NO: 34501 - protein, 131 aa, Sorghum bicolor
  Clone ID: SORBI-28MAY03-C49320_1.pep
HEAAVESSKGVLGHGSQKEHGGATGVGDWNPHNQQVQNLGNGATDKAVSSIGRLRSEGLLANDQSTSARDGGASQPNKGQKERHKKNYDPNVFFKVNGKLYQKLGKIRSGGSSEVHKVISSDCIIYALKKI

SEQ ID NO: 34502 - protein, 143 aa, Sorghum bicolor
  Clone ID: SORBI-28MAY03-C49358_1.pep
MASEPVARAVAEEVARWGAMRQTGVSLRYMMEFGARPTERTLLLAAQFLHKELPIRIARRALDLDSLPFGLSTQMIKMIRVRHTNVVPAIALGVQQMKKDLGGPKAFPPGIQEIHQFLDRFYMSRIGIRMLIGQHVALHDPDP

SEQ ID NO: 34503 - protein, 69 aa, Sorghum bicolor
  Clone ID: SORBI-28MAY03-C49658_1.pep
SVGQRYYTGSLVSGLQPLLDLDIDLRIMEDNIHFNQWGVIFLVKLQASVVLFEPPCLQSLKDYHSQTLF

SEQ ID NO: 34504 - protein, 121 aa, Sorghum bicolor
  Clone ID: SORBI-28MAY03-C49668_1.pep
DLVLAIPLVLYDKGYAFALKDGSTYSFRFSFTVSNNIVSGLIYTHTVWKTGVRVEKQKVMLGTFSPRQEPCIHEAEEDTTPSGIFARGSYSAKLKFVDDDGNVYLDMNYCFEIRKDWPATA

SEQ ID NO: 34505 - protein, 146 aa, Sorghum bicolor
  Clone ID: SORBI-28MAY03-C49672_1.pep
RLSHRMLDEFTRLTPYLSGYNDRLAGQSYIVKHGEVNANVTIEHYLQVVKTEIVTQRSSKELKVLEEYEYTAHSSLVHSFYVPVVKFHVEPSPMQVLVTEVPRSFSHFITNVCAIIGGVFTVAGILDSIFHNTLRMVKKVELGKNI

SEQ ID NO: 34506 - protein, 68 aa, Sorghum bicolor
  Clone ID: SORBI-28MAY03-C49686_1.pep
HEAKNSAPHQQGNLQMPPTHQPCQERIRRGRPWPPSPALPRYRSSSSRSQRILRTEHGSQRPRTLTLK

SEQ ID NO: 34507 - protein, 107 aa, Sorghum bicolor
  Clone ID: SORBI-28MAY03-C49717_1.pep
TNAYTQQSLVSWALVIMKGTFWPSKHKHTEQKTDDPLICHPRIVVSDFQYLGIINASTEATSVGTVSQLDLSTMQLSSLAPLILICVKQKLLPWLNPRQIFFQVVLP

SEQ ID NO: 34508 - protein, 177 aa, Sorghum bicolor
  unsure (1)..(177): unsure at all Xaa locations
  Clone ID: SORBI-28MAY03-C4969_1.pep
GTPVRQSARSAGKMLKRYTDLSSGGDSSDNDNETAEVPEDLDDKEMVSPEIKDESESEXVKPADSSTVALSSKEPLVQATLSSMFKKAEEKKRSTRSPKGSPATKGAAAKKQRASLMAKQSAGVKKASGTRGKKKPKVEEDEIEELSSSSQDNGTDDDDDTMMIVTRTGPSNALVVD

SEQ ID NO: 34509 - protein, 165 aa, Sorghum bicolor
  Clone ID: SORBI-28MAY03-C4972_1.pep
VFLPPQVHQTAIPWRQVRQSRKALCTPGGRRGGLWTPWHAAWTTRAPSAAASSLDGIHRWCYFGLGAMGAAAGDSDTHGHARELELFVPKCMESPVSEASTAAATDRTMQKDAAAMPGELDELLMSLWDDSDKELAGGFNSCGALKETSATISSQYDDHSDLSSL

SEQ ID NO: 34510 - protein, 190 aa, Sorghum bicolor
  Clone ID: SORBI-28MAY03-C49400_1.pep
LEVHFFLHLFLVHPPCRRCHRAVDAGALLDQCPPVAIRPRRSLPPWRSPCPRPAASGLRTCSGQAPATFPWMRRRWGGKGSGEPDPPDPAIAGVAEVAAGAGELTGAGTKLADARDGCGVVPPGGAVRGEPRRRMWDCLALSSARNRVTDAEDGGRREAPGAWREAAGGSPGEEGKRGQAAPRESAWRKS

SEQ ID NO: 34511 - protein, 159 aa, Sorghum bicolor
  Clone ID: SORBI-28MAY03-C49405_1.pep
HEGGYGKKKTEHARNDRGERKKMPVKSSRHDSESDTDSEYGKKKMEHAKSERDERKKVPVKSSHHDSDSDTDSGYGKKKVEHAKNERDKRNKIPVKSSRHDSESDTDSDYGKKKMEHAKNERDERQKVPVKSSRHDSESDTDSDYGKKKMEHAKNERDE

SEQ ID NO: 34512 - protein, 132 aa, Sorghum bicolor
  Clone ID: SORBI-28MAY03-C49409_1.pep
MRRATLPLALGLSIVALFAARGADASIHEYAAGGFAPRANSFFFHGGSEGLYASDPSSNSSASFIRFDTVVFRRTLESASRHEEMQQKTGLVEAIIVEIQDRDKIGGLYLHSGAICCTPELDKEKSCRVGEV

SEQ ID NO: 34513 - protein, 219 aa, Sorghum bicolor
  Clone ID: SORBI-28MAY03-C49478_1.pep
ARGSASALFKHSATLSAAGPRAGSGTRVYPLRDFPGGDAAALGGAFRDNVRWLLKQWSCAPGSGSAWRALLSDERTGALVPIVAVEELAAASSSPLCDLCRCAGWSHHWVSKRKYHFIIPAAGDWDQPFSADALLGHTDHLLHGLIHSNGFGHLVTLHGRDGGSTFLSGCQIMDIWDQLCAALRVRAVSIVDLTQKHSVDLRLLLGLAQRKTWFTRWGY

SEQ ID NO: 34514 - protein, 139 aa, Sorghum bicolor
  unsure (1)..(139): unsure at all Xaa locations
  Clone ID: SORBI-28MAY03-C4978_1.pep
MAAKQRQRQRQLRLLPLLAAAVAWSLLRACGTAAEVTGTGTLGLRHSKPARQHNGTRHGGGNQRGRGRGGAAPGTGMASCNLFQGSWVYDDTLPMYDTAGCPFVEPEFDCQKYGRPDKLYLKYRWRPTFCDXPRFDGQE

SEQ ID NO: 34515 - protein, 129 aa, Sorghum bicolor
  Clone ID: SORBI-28MAY03-C49795_1.pep
MSGSPPKPWERSGAEGTSGPAPFKPPSGGSTSDVVEASGTAKPGENVTATERNVSANVNSTVSRPVPQRPWQQTGYGNTYGGYGGSNMYSSYGGFGNTYGSGGLYGNSMYSSYGGGYGGGMYGGGMYGG

SEQ ID NO: 34516 - protein, 103 aa, Sorghum bicolor
  unsure (1)..(103): unsure at all Xaa locations
  Clone ID: SORBI-28MAY03-C49800_1.pep
HEGRSHIKQVTSCLQHLPGLQFGSQLREEHAVQMLLARLASATFGRLWTEVEERHACNILMLAAATVIPPFENISPKMLAESMALRKDGGHIXEPAEQSYSEE

SEQ ID NO: 34517 - protein, 115 aa, Sorghum bicolor
  unsure (1)..(115): unsure at all Xaa locations
  Clone ID: SORBI-28MAY03-C4981_1.pep
MSILQLSGAIVAAEAFTRGGLVYQPECLHLCSTRLSGLALHAKAATGVTTKCTSLKPPXDRVPLKLGPRGRATVGGILLPSTGQTKQQGGYAVACAKARTIGYITLLCDLKTGVH

SEQ ID NO: 34518 - protein, 289 aa, Sorghum bicolor
  unsure (1)..(289): unsure at all Xaa locations
  Clone ID: SORBI-28MAY03-C49821_1.pep
PSSARALPFRRCWGHSPPRRRSPSRADAPPPRGAASTVGSRPRGGSSPCRIEVFVGRILGQMPLFDKKPFSLLEPPKDLDSKEKVFQIRFTKEIFRDYEEYLKRLNLYRQRVWTCKISGKSNLTFEEALVSEHKAMEKAQNLPTELMAHVLRMTQYSTIGLRARVNKIYASLLEEVFEGIELHANKDGAVAPCKILKILDSGCTKMCEVGWIRQGKAVTNTSVIKAADLFYRRAPVSRNTLKIFIXDATSQSNPWVIHENLAKKFGISMDPPDSIMKKGRKRQEDGTIE

SEQ ID NO: 34519 - protein, 145 aa, Sorghum bicolor
  Clone ID: SORBI-28MAY03-C49811_1.pep
ARKGLWAQQSCLQPPFSLSITSAQPPTGSFLDESPKQFSPTACFLAPGEQISAQTALHPASTLILGATKHRRSQGPATLGSRPGSHGTAEAGGKREVRTQGRRQVRGGRRRVARGGRGSRRRRSRAWEWGRSRRSRRRGAEDYAQ

SEQ ID NO: 34520 - protein, 84 aa, Sorghum bicolor
  Clone ID: SORBI-28MAY03-C49573_1.pep
AMLVIINLLSCLTGLLMEIRVCVQTVGLCPRHFGALLSMLTWWVNRVFKSEANAAAPELELLMEGSTDMRRAFLFPSLFCIYSC

SEQ ID NO: 34521 - protein, 89 aa, Sorghum bicolor
  Clone ID: SORBI-28MAY03-C49626_1.pep
TGALYLVSTSGKHGQTTFNQKLQRRNLAWLPHRSTGQYWLGSRDETMTFNIFSLNLWRRKTTRKGEWVLLYSQATQNVIMQTTTEGWSV

SEQ ID NO: 34522 - protein, 83 aa, Sorghum bicolor
  Clone ID: SORBI-28MAY03-C49591_1.pep
RSIVSKKAGPFEQGMVQGCITGISSTASVISPLIFTPLTAWCLSEATPFYLKGFSLACAGFATLVAFATSISMRPGEVQTDRK

SEQ ID NO: 34523 - protein, 118 aa, Sorghum bicolor
  Clone ID: SORBI-28MAY03-C49897_1.pep
NTTPASIATASLPGAHMERRLLEAAMVGSATSMKEMAAQDPSLLLGTTPQGNTCLHISSIHGHEGFCKDVLTLNNSLLTVTNMDGETPMLTAMTNGHMSLASTLLECCCTLGFSEAIL

SEQ ID NO: 34524 - protein, 77 aa, Sorghum bicolor
  Clone ID: SORBI-28MAY03-C49938_1.pep
MDNEENKETSVSISNNDTDTNGLDDDDYDDDDGKHTVMLGPQVPLKDQLELDKDDDSLRRWKEQLLGDVDTNKLGET

SEQ ID NO: 34525 - protein, 176 aa, Sorghum bicolor
  Clone ID: SORBI-28MAY03-C49953_1.pep
FPNGVGEYVDLMQGLIPGMRDGTVRTALDTGCGVASWGGDLLGRGILTVSLAPRDNHEAQVQFALERGIPAILGIISTQRLPFPSAAFDMAHCSRCLIPWTEFGGLYLLEIHRVLRPGGFWVLSGPPVNYENRWHGWNTTAQAQKADFDRLKKMLASMCFKLYNMKGDIAVWQKSC

SEQ ID NO: 34526 - protein, 93 aa, Sorghum bicolor
  Clone ID: SORBI-28MAY03-C49985_1.pep
TRAVSFLDGLDKRQQAHAADALVRKLSAVDNLDAASLFLKNVLDKHYAVDHATYTSFINSCYESNRYALASEISEKISKRISGFKKKDVAVIA

SEQ ID NO: 34527 - protein, 173 aa, Sorghum bicolor
  Clone ID: SORBI-28MAY03-C49988_1.pep
TRLQLLNSRTTLRISHCTSVLWPTEGENDSPFEFPVEQLQISDCGATVKELVQLISYFPNLSTLDLRRCGNKQAGEAEEIEAATGEQLSMPLQLKELLQNQSSLRSLEIEAATGEQLSIPSFYCPFPTSLQSLVLEGVKDGMLTLAPLTNLTKLDLYDCGGLRSEDLWPLLAQ

SEQ ID NO: 34528 - protein, 90 aa, Sorghum bicolor
  Clone ID: SORBI-28MAY03-C50035_1.pep
MMKLKSRRLLFYKDVEPEDCHSGSGHPHLTAQAKFAAMNMQTEDVKTRRPVQVKRSRWVLGDVTEVLDHNSWRLGKITEVLKNDCFVIRL

SEQ ID NO: 34529 - protein, 155 aa, Sorghum bicolor
  Clone ID: SORBI-28MAY03-C50000_1.pep
MGETNEQPPPPPPVAAPPPMMAMMVPPVGAGAIHPPHEQFHHLNYCVHSNPSWVQVAALAFLHYLVMLGSTVMLASVIVPAMGGNAGDKARVIQSLLFMSGINTLIQTLIGTRLPTVMNASFAFVVPVLSIAREIESNNDLLNDHERFKHTMRTA

SEQ ID NO: 34530 - protein, 55 aa, Sorghum bicolor
  Clone ID: SORBI-28MAY03-C49761_1.pep
NVHELELQAYQSTVRAFHAAGPLTWEQESLLTNLRLSLNISNEEHLLQLRHLLSI

SEQ ID NO: 34531 - protein, 63 aa, Sorghum bicolor
  Clone ID: SORBI-28MAY03-C49773_1.pep
DSSNVAAAFQTVVKEIYSILSRKVFQSLEQKKSELQSLSNGKAVVLQGETNQTSSGGRWCCSS

SEQ ID NO: 34532 - protein, 88 aa, Sorghum bicolor
  Clone ID: SORBI-28MAY03-C49775_1.pep
TRGKGKDSGSVGWVMHEYTIAEPPCPSPVKICHISFSGHGRKRMRVPDGRQVCQSSAHARVASSNAASALPCSWAMLDHGSSVPYDSG

SEQ ID NO: 34533 - protein, 138 aa, Sorghum bicolor
  unsure (1)..(138): unsure at all Xaa locations
  Clone ID: SORBI-28MAY03-C49777_1.pep
LAAAAAEDDGXMWRSRARALLLLRSTIPRSPPPPPPPWATRTLTHLPPXPRPLSRFLASSPDPIPDASSSAAADPFPEAFSSPTEASQDDATEAGEDNLSSMWEEAGDADDIFVSPSGADAVADDEEVARVCAAVEST

SEQ ID NO: 34534 - protein, 66 aa, Sorghum bicolor
  Clone ID: SORBI-28MAY03-C50093_1.pep
EREKALETMLMEKEQKEAELQRKVEESKQKEAFLESELANMWVLVAKLKKSQGYDHEDPEAKNDGS

SEQ ID NO: 34535 - protein, 170 aa, Sorghum bicolor
  unsure (1)..(170): unsure at all Xaa locations
  Clone ID: SORBI-28MAY03-C50094_1.pep
MKGDSIMSEAEESSLLPLLPLLHGTPSQDYEQYTCNGSVDIRGNRASKRHTGNWRACYSILGGEFCGAMAYYGVGTNLVSYMTKVQKQSNVAAASNVAFWQGTCYLTPLLGAFLADSYLGRHRTILVSLMIFTMGMLLLTLSAIIPASIXCSXNSHSQDALSSLGLFLTA

SEQ ID NO: 34536 - protein, 79 aa, Sorghum bicolor
  Clone ID: SORBI-28MAY03-C50099_1.pep
RLLQYRSINFAHFLDTRFGEQAASLMLGCCVVVLLEGHKHVDSISKDPSTIAIVCWRGKGTMNVMVSPSDRKDLLERMV

SEQ ID NO: 34537 - protein, 187 aa, Sorghum bicolor
  Clone ID: SORBI-28MAY03-C5010_1.pep
MFSTHPFISRYFEKQSLKAAFATAPADPTVDLNMQMTKLGHGLLSGKYSAPAKEGQEGIRPRMFKSVIAANHPEFSSMRQQDALDFFLHLIDRVEKANPGNHELNPCSGFKFIVEERVQCPSGKVSYNKRSDYILSLSIPLHEATNKEQLEAFNEKKAAMDLDGKEVSNEDIVRPRVPLEACLASFS

SEQ ID NO: 34538 - protein, 158 aa, Sorghum bicolor
  Clone ID: SORBI-28MAY03-C50101_1.pep
KDSKDYYGLAPGKSVMLRYAFPIKCTDVIYGDSPDDVVEIRAEYDPLKTSKLKGVLHWVSEPAPGVEPLKVEVRLFEKLFMSENPAELEDWLGDLNPHSKEVIKDAYAVPSLATAVLGDKFQFERLGYFAVDTDSTPEKLVFNRTVTLRDSFGKAGPK

SEQ ID NO: 34539 - protein, 147 aa, Sorghum bicolor
  Clone ID: SORBI-28MAY03-C50109_1.pep
ILQQTDTLDVLTSKRETIQEARDEEERIQQQTEPRGGPPTRGEQLQTHRAGEGEHETRTGARGRSQEGAQEHPAHPPGWGDRARREGARGRTQEDPRAPPAHHPEGPPQGTPCTRGNRSGGGRRRGGKGGRGRRGGTAGRRRRAGRG

SEQ ID NO: 34540 - protein, 176 aa, Sorghum bicolor
  Clone ID: SORBI-28MAY03-C50117_1.pep
VIHGEDYICLGFLFGRKSKVAYISDVSRFPPSTEYAISKCGGGQLDLLISDRLVTSGSLYLLLRSVPTLDPASWSSPICAFPIGLSLDMDHHKDNQTLEEWSRRQGLLPRLARLGLRADIAPSPSVHLAFLSPPRPPSCLSSSSSPSWPDSAIRAGFFGGRPLPGLFLRALQVDLS

SEQ ID NO: 34541 - protein, 84 aa, Sorghum bicolor
  Clone ID: SORBI-28MAY03-C49844_1.pep
HEAAASPRGSCRAQPPSAPPLPQPDPILPPGKQYWTMLIRADGGHATRRSKKNKITCNDDRDTTEPLISGDIHQDSEQGIWSEL

SEQ ID NO: 34542 - protein, 158 aa, Sorghum bicolor
  unsure (1)..(158): unsure at all Xaa locations
  Clone ID: SORBI-28MAY03-C49875_1.pep
ARGASQSSHAPGFGPPAARCPSPSLLLPSASSGLTHRRRRASVATTFVVDSMDAARIIAYFKGKCILVTGSTGFLGKILVEKILRVQPDAHKIYLLVRAIDAPSAKQRVQQEVIGTELFGKLREKHGEDGFQQFMQEKIVALPGDIIYDNLXLDAPTL

SEQ ID NO: 34543 - protein, 67 aa, Sorghum bicolor
  Clone ID: SORBI-28MAY03-C49883_1.pep
MALAGTGVFAEILDGEVYRYYADGEWRSSASGKSVAIVNPTTRKTQYRVQACTQEEVNKVMDAAKVA

SEQ ID NO: 34544 - protein, 237 aa, Sorghum bicolor
  Clone ID: SORBI-28MAY03-C49937_1.pep
QQREAGSPRSPDLYDLSDDSDYAAAAAAARRTVMRTDPADRGSEETARVDVVYEKERVTIHPSQYGSGRISGKLRLFLQQGSLFLSWGPNEGADSLSTSSVGVEIEKYRNLYTIKALPLSDVRFIRRYTPTFGLDYIIIVLSSGLAFPPFYFYNGGIRELFATLKQHVFIIRSDDDPNVFLVNDFQDPLQKSLSSLELPGVASVANAMSRQNSLSFTGSNDESRHGATSSMSQYSSQ

SEQ ID NO: 34545 - protein, 154 aa, Sorghum bicolor
  Clone ID: SORBI-28MAY03-C51163_1.pep
TRDLSSNRFSGPIPSELTKLAGLGYLNLSSNDFRGALPLGFRNLRKLKYLDLHGNGFTGKLDDVFVQLQSPVHVDLSCNQFSGSLASISDNSSVVSTLQYLNVSHNVLSGTLFESVPMPLFDSLEVFDASFNMLSGNIPQFNFVISLQVLRLQN

SEQ ID NO: 34546 - protein, 65 aa, Sorghum bicolor
  Clone ID: SORBI-28MAY03-C50241_1.pep
TRPVILKRIPAFLDTGVVIVLHWAGLRGNPGIHLIDAFRFGLDSWDFISSDLIQKTIQFREHSIL

SEQ ID NO: 34547 - protein, 83 aa, Sorghum bicolor
  Clone ID: SORBI-28MAY03-C50248_1.pep
STLTLKVSSSSPTFTIGLGPGSSFLCTAYAAGPGLLPTRPSTAGSSTTSWTTWTPVASPTTAGSASSRTCPTTPCPRRLWPSC

SEQ ID NO: 34548 - protein, 56 aa, Sorghum bicolor
  Clone ID: SORBI-28MAY03-C50260_1.pep
MFAKTKYEKPGLELTTKAAVAKGKHGFLPLPKKSYGKSDAFVDTIPRASHPSPFLS

SEQ ID NO: 34549 - protein, 183 aa, Sorghum bicolor
  Clone ID: SORBI-28MAY03-C50296_1.pep
MEEMRDMAQSTLAVASAAVISLVLGDDNLLGEILLRLGFATDLVRAAAVCRRWLRAASDPVFLRRFRDLHPPRLHGFYIDSYPNPTLKRRFYAEFVPMQPQPPELAAVLRRGRFSLDTYDSQSTRILDCRNGRVIVSLFCGGDFKRGVHSPLHPARDLVIFPQLPKKDVPDSDSYSSKIRIFY

SEQ ID NO: 34550 - protein, 46 aa, Sorghum bicolor
  Clone ID: SORBI-28MAY03-C50313_1.pep
SVSQEGRIYMLVLRLPRIREGDLGRSERVGTVTSRMTPKSGAEHMS

SEQ ID NO: 34551 - protein, 213 aa, Sorghum bicolor
  Clone ID: SORBI-28MAY03-C50315_1.pep
ARGLEQPSFSTAATTSGALQHINSAASMAGISDMTMATANNENASFQSAHAAQRYQVNAPVDKPADDGYNWRKYGQKVVKGSDCPRSYYKCTHPSCPVKKKVEHAEDGQISEIIYKGKHNHQRPPNKRAKDGNSSAADQNEQSNDTTSGLSGAKRDQDNIYGMSEQASGLSDGDDMDDGESRPREADDADNESKRRNIQISSQRTLSEPKIIV

SEQ ID NO: 34552 - protein, 90 aa, Sorghum bicolor
  Clone ID: SORBI-28MAY03-C5252_1.pep
CILNPPPPPQKKKKKSSVFYTLPRLCTFFGSETQSFQFVLCFGGACKLAVCCILLCRTTFLSTSLVFFKVFFLKKNLFFFWGGWAPDNTL

SEQ ID NO: 34553 - protein, 166 aa, Sorghum bicolor
  Clone ID: SORBI-28MAY03-C52537_1.pep
MLEGGTHNLAMQTNHQNTKYGELARNIRENQLGGVIFGCKHDTIEECFRKQLFGLPSVHYSYVRNVKPGMPLFLFNCTGRKLHGIFEAASPGEMYIDPYAWSNDGSLRTAFPAQVRICTKTQYPPLLESQFKTLLGDNYYNHHHFYFELDHAQTRALISLFKSLAP

SEQ ID NO: 34554 - protein, 132 aa, Sorghum bicolor
  Clone ID: SORBI-28MAY03-C52555_1.pep
ATPDHRRQPPSRCCSWAALAAAAFSAPPCASAATLQCAQVAQLMTPCMPYMTGAPGMTPYGICCNSLGVLNQLAATRADRVAACSCVKAAAAGFPAVDFARAAGLPAACGLSISFTISPNMDCNQVTEEPSH

SEQ ID NO: 34555 - protein, 74 aa, Sorghum bicolor
  unsure (1)..(74): unsure at all Xaa locations
  Clone ID: SORBI-28MAY03-C52592_1.pep
MNTVGVPVVAVANGVPVVDVADGIGEVERKVQKSYWEEHSKDLTVESMMLDSRAADLDKEERPEILSLLPSYXG

SEQ ID NO: 34556 - protein, 78 aa, Sorghum bicolor
  Clone ID: SORBI-28MAY03-C50388_1.pep
LQQYMSKTAVCKLICFNETKSRSRHNCRSVCLATLVVTNITRPHVFSLETVLQVIKSCNHLMGVKRFLICSIDLTECS

SEQ ID NO: 34557 - protein, 73 aa, Sorghum bicolor
  Clone ID: SORBI-28MAY03-C50382_1.pep
FHGDSAKEEGHPLRIFMVVRDFLTALDHVCKDVVKMNERAAAGGSSRRVGNMHVPAVFNSVRSTSSSEESSSP

SEQ ID NO: 34558 - protein, 149 aa, Sorghum bicolor
  unsure (1)..(149): unsure at all Xaa locations
  Clone ID: SORBI-28MAY03-C5040_1.pep
MKPHQLEGFNFLVKNLIGDKPGGCILAHAPGSGKTFMLISFIQSFMARYPSARPLVVLPKGILGTWKKEIQRWQVQDIPLYDFYSVKAEKRVEQLQILKSWEDKMSILFLGYKQFATIVTDDGGSNVTAACRDRLLKGPNLXILDQGHT

SEQ ID NO: 34559 - protein, 100 aa, Sorghum bicolor
  Clone ID: SORBI-28MAY03-C50413_1.pep
AAAEQKASVAGSAILSNQYVSAGASWLTSAFGMVTKAAGDMTSMAKDKVERAEEERKAIMWEERNGLVSDYAKIHLDEPSSWEPAVLPLESVDEQKLQAV

SEQ ID NO: 34560 - protein, 124 aa, Sorghum bicolor
  Clone ID: SORBI-28MAY03-C50424_1.pep
IASNNRITSLPSSIGDCESLAEVDLSSNLLTELPEAFGYLCNLKVLHIRNNGLTSLPATLFKKCSQLITLDLHGTEITNDVLRQVEGWEEFDERRRQKHQKQLDFRVGSSGVFDEGADDDNRRR

SEQ ID NO: 34561 - protein, 89 aa, Sorghum bicolor
  Clone ID: SORBI-28MAY03-C50487_1.pep
INHNLEHRLEERFNQRTLKSDLAYLVRSGPKDINAIEIKNLTRQKRRIQEVGGLPTPVYMTDTNAWRQGSGVIVFETTSSRQKQKVERR

SEQ ID NO: 34562 - protein, 142 aa, Sorghum bicolor
  Clone ID: SORBI-28MAY03-C50484_1.pep
SSQSEAMYGQLLSKYVDDPKNFFSVSSDFCHWGSRFSYTYYEEKHGAIHKSIEALDRMGMEIIETGDPVAFKEYLQEYENTICGRHPISVFLHMLKHCSTKIKIGFVRYEQSSQCKNFRDSSVSYASAAAKVDASGEEEKQD

SEQ ID NO: 34563 - protein, 67 aa, Sorghum bicolor
  Clone ID: SORBI-28MAY03-C50128_1.pep
QTKELLLACCLQITPLHHTDEGKIINLWTALHTNNPFTCTDTIRDATLSAHCHTNRGSYKKKTLPHS

SEQ ID NO: 34564 - protein, 122 aa, Sorghum bicolor
  Clone ID: SORBI-28MAY03-C50192_1.pep
SAPYLAACNWQWRNYRRPGQQKGQDERDHSLLIGHGEHLVQCPAPNIQIENISIHLQEYILCIAPHHMYISIKVIPIIRVIPIFSGAAIRYFQISTQIMQRNGINQQPVSYAAIAIHVQPDA

SEQ ID NO: 34565 - protein, 100 aa, Sorghum bicolor
  unsure (1)..(100): unsure at all Xaa locations
  Clone ID: SORBI-28MAY03-C50200_1.pep
FLAHDWRETLEKTLAWFAPKAHNMIRWQAERNFEQQQIVFNGNVLLLQTLYXADREKTEAVICELLVGLNYICRYEQQQNALLDCSSSLDFDDCVEWQLQ

SEQ ID NO: 34566 - protein, 45 aa, Sorghum bicolor
  Clone ID: SORBI-28MAY03-C50240_1.pep
QETGNICELIYIREVLPYPLFFLKRNQLPQSQLGQTHNHVLPECC

SEQ ID NO: 34567 - protein, 171 aa, Sorghum bicolor
  Clone ID: SORBI-28MAY03-C50504_1.pep
ARGSQLPPKIRLSPSASQQQTSSSSTTFQVQSHSQSQSSPPPPPPPPPPPPSAVAADSPRLNAAGKVVFNGLGRSSSSPSSLAGGRRHRNAGPGCGMERSYSAHVRVAPVLNVPVCSLRGSRKSVSVFGIDRLFSPSNAGSTSSSSAAGAARKNKDAKKDAPPAAAAAGGQ

SEQ ID NO: 34568 - protein, 75 aa, Sorghum bicolor
  Clone ID: SORBI-28MAY03-C50511_1.pep
HDIRRVAVRAAVAMGEQGDVVVITGKGNDTYQIEGDKSEFFDDREECREALQYVDQLHRAGIDTSEFPWRLPESH

SEQ ID NO: 34569 - protein, 192 aa, Sorghum bicolor
  Clone ID: SORBI-28MAY03-C50530_1.pep
GRQQHARRWWCWLRWIAPDGGVPDTGRLRPHSQALPGVGGDSEQPHRLHRGAHQGGGLWREQSPAVTLLNQTVFLSFALKEQQILELSSVGSQERTSDSPCHVVLIVWVIFRLVFPEFLGIIPFQSPKKMSHHYARVVGSGIDFLFMLASRMLLPLNLGFFFFSCGVQNRYLACNLCCCCSCSDFQYPGFPK

SEQ ID NO: 34570 - protein, 128 aa, Sorghum bicolor
  Clone ID: SORBI-28MAY03-C5056_1.pep
MASAAKTLARAGSSLFGRILPSPSPSPSILRAGLPALARLQPHVPPPAPAGVDAYEAETVARLSSLPGEISFPCGLPSLRFFIDDVEDPVANDPLQLLPKRTYQPSTIKRKRTHGFLTRKSTKGGRKV

SEQ ID NO: 34571 - protein, 114 aa, Sorghum bicolor
  Clone ID: SORBI-28MAY03-C50562_1.pep
YNSPHNLSNEVYLATSFHGLRSCLVMVSQSCQRMQPMPGFEHTMRIPWPCLVNFMSLLDFFVQYVTIGNHENQRFRLTVFRPHFLYRSRACKCSAIGDICCIYVCFFISCSVTC

SEQ ID NO: 34572 - protein, 135 aa, Sorghum bicolor
  Clone ID: SORBI-28MAY03-C50565_1.pep
KAEKDKERAEFKARKEAEEREKKKAKKDKKIGTTPAESSAIADSNAAALATADTDSNASDNPREADVSQPAAPKRLSRPAAAIKQLNRLQPMPAPLRNRGRRKLRQYILIAAAVLSVLALFVAGNYIPRLKSVHS

SEQ ID NO: 34573 - protein, 67 aa, Sorghum bicolor
  Clone ID: SORBI-28MAY03-C5072_1.pep
RRATHYRDSDAATWREGRDGAHVNQADQPLVRQERDANPHRGTKTPPERPPSYTRSSSERGDHHPQN

SEQ ID NO: 34574 - protein, 94 aa, Sorghum bicolor
  unsure (1)..(94): unsure at all Xaa locations
  Clone ID: SORBI-28MAY03-C50318_1.pep
HEAVSWFEQQRQQLEPPMQLDLPPPPPPQMPVSVPVQAPHRNGGXRRPKPKAREPNKREMDEEEKQKLRVEIENLPEEKMLNVLQIVQKRNSDP

SEQ ID NO: 34575 - protein, 67 aa, Sorghum bicolor
  Clone ID: SORBI-28MAY03-C50340_1.pep
GGIPIGIGKNAHIRKAIIDKNARIGENVKIINFDNVQEAVRETEGYFIKSGIVTVIKDALIPSGTII

SEQ ID NO: 34576 - protein, 220 aa, Sorghum bicolor
  Clone ID: SORBI-28MAY03-C50359_1.pep
LGIFTRPWFAAGTFLCKDDHRKIVACTNDHQVRLYDTALQRRPAISVDFRESPIKAVAADPNGHDVYIGTGTGDLASLDMRSGKLLGCYIGKCSGSIRSIVRHPELPLIASCGLDSYLRIWDTNTRQLLSAVFLKQHLTTVVLDSHFSLEEPEEIKSKQLEFSVEAEAEVRKEKKQKSKTTEDETEAQVRKEKKKKKSETIEEDEEQVGVVDHSNINGEI

SEQ ID NO: 34577 - protein, 66 aa, Sorghum bicolor
  Clone ID: SORBI-28MAY03-C50368_1.pep
FICVHRASFNLHLEKFDTDFINQRVTYPSKKILNVQKKTIPQQKQGEITKKLTPVQTVVLKKKRGK

SEQ ID NO: 34578 - protein, 185 aa, Sorghum bicolor
  Clone ID: SORBI-28MAY03-C50379_1.pep
LMVVAGEALRTNITTLGPLVLPMSEQLRFLATVVLNRVFRANVRAYLPDFKLAFDHFCIHAGGRGVLDELERSLKLSAWHMEPSRMTLCRFGNTSSSSLWYELAYCEAKGRIRKGDRVWQIAFGSGFKCNSAVWKALRSLDGGEEGNPWPPEMDVLPIHVPKVSPIDESTYTFPVGATYKVSSLG

SEQ ID NO: 34579 - protein, 76 aa, Sorghum bicolor
  Clone ID: SORBI-28MAY03-C50634_1.pep
WLLRQIRLYRLQNEAAIPFTASKLYYYNNPVGQQNGKTKGIDLTYFYWITNISTMPMTNINERSFLEYMSFFVYQE

SEQ ID NO: 34580 - protein, 78 aa, Sorghum bicolor
  Clone ID: SORBI-28MAY03-C50637_1.pep
VEEGGETMFPYENGENMDIGYDYEKCIGLKVKPRKGDGLLFYSLMVNGTIDRTSLHGSCPVIKGEKWVATKWIRDNIV

SEQ ID NO: 34581 - protein, 102 aa, Sorghum bicolor
  Clone ID: SORBI-28MAY03-C50639_1.pep
YGVINDTAMLWGIKYYNDLLMTAGPDGNVQSELLFRKEPSTFTFQKGWAFPRRVYFNGDNCVMPPPDAYPWLPNASPRLSASLLLPFVAAWTAFAILLMTHP

SEQ ID NO: 34582 - protein, 76 aa, Sorghum bicolor
  Clone ID: SORBI-28MAY03-C50670_1.pep
ESVTWICTGFSSHYQTRPDLCESDMYNSLSRTPSTGTGGHGRMGAARQGRAAFGSSLIGSTHPSYSTSAQDSLSLE

SEQ ID NO: 34583 - protein, 99 aa, Sorghum bicolor
  Clone ID: SORBI-28MAY03-C50707_1.pep
VQMILFVFLDCIVMLLSRLMTSFTSYHHQILSRAQAHGRICSFESFPSDPSLTMMVQLSLQSFHLGIYLAKSYCQMSRNVNLWMVQPQANYKLKMTKMD

SEQ ID NO: 34584 - protein, 108 aa, Sorghum bicolor
  Clone ID: SORBI-28MAY03-C50493_1.pep
HEGNAGMKPPSPFALPGGSSGSYGRLPTAQVLPQAAPVRSTPSSGSSGARVPIDDVIEKVATMGFSKEQVRATVRKLTENGQNVDLNVVLDKLMNDTDAQPQRSWYGR

SEQ ID NO: 34585 - protein, 68 aa, Sorghum bicolor
  Clone ID: SORBI-28MAY03-C50499_1.pep
QQGSQTCLNRYDERRLGSSIDGLSWSQLLKSGQVSMCVTTFWFHFMRRDRYSFLELYMVVLMNGFVRS

SEQ ID NO: 34586 - protein, 155 aa, Sorghum bicolor
  Clone ID: SORBI-28MAY03-C505_1.pep
VKAFPDGSSPGRRPWAHHAHRRRRDRGSDMPGGVQQRPARQLRLLRVGAEQAPRQPGRRHPGPGQGGGQRRRQQRRRRGQRHRGPARRQAAAAAGRQDQRRAAPVRAALPRHGARLRGGLRRDQRAQLHGGEADGRRRRLAGAPVHRRLCRGRAR

SEQ ID NO: 34587 - protein, 108 aa, Sorghum bicolor
  unsure (1)..(108): unsure at all Xaa locations
  Clone ID: SORBI-28MAY03-C5080_1.pep
LPQKYLLGERXVVDIDNGKLLNEDSDIRSVLQFLMDDVSDFLSTHFSSSVERSKTDEKGGASTLQAFIDYISXRETENFRSRKEENKNSITLTTIHQSKGLEWDVVFI

SEQ ID NO: 34588 - protein, 131 aa, Sorghum bicolor
  Clone ID: SORBI-28MAY03-C50807_1.pep
SLGKCSGSSSARKKPISRVRTKPSEPSPEVLKPIKNVILHEKYIDQLSRREYTKRPRKSTQGSKAADSEKALSEQKAGSLKAAKNALISEATDFISSFKKVQACSLAHVVENSEDDEIECDASDYSHDDKE

SEQ ID NO: 34589 - protein, 76 aa, Sorghum bicolor
  Clone ID: SORBI-28MAY03-C5083_1.pep
CSLNEFQLPSYALPPCPPPCNLLPHTPLYFINFRLYFPEHTQAYFHIKRLLLSHCFDYYAIFFRLPPLFILYLCSF

SEQ ID NO: 34590 - protein, 168 aa, Sorghum bicolor
  Clone ID: SORBI-28MAY03-C50846_1.pep
VCSVAEFIRSGSSKLNGMPVEFDEEQHMAVVRSNSIRMLEEEATTVEKTVGPSHASREIQSPSPSPSPSPATPVVVPKKRVRFVLPAASPKPNAGVQEELQELSDAREAGMAFILGHSHVKAKSGSSFLRRFVINFCYDFLRRNSRGPNYAVSIPHASTLEVGMMYYI

SEQ ID NO: 34591 - protein, 128 aa, Sorghum bicolor
  Clone ID: SORBI-28MAY03-C50866_1.pep
TELFMEWKRKKAEEREAGQAALKAERAKNDRMSGRELFMADASVFVDDAEAYEVYEREEEPEANEESSNKSQAAGPSSSACNGKEVEEPDDEDIDVDDDLDIDELNELEASLSRTSIQIREPGEGTSS

SEQ ID NO: 34592 - protein, 232 aa, Sorghum bicolor
  Clone ID: SORBI-28MAY03-C50884_1.pep
TRLLADVNDSNEHLDASQQEVFGLQTTIDVLRNKIDAAELAASEALDNERTAITKIEGLTEEKTKLISELDDARDREEREKRAVEDLTAALDKASCEAQEAHDRFQKREDDYEHALAQIGDLKMALKSMEESYEVMLDEAKHDITCLRETVEKLEAEVSKYREECESKELDLITASKQSEQEIAALKEEAEHVSASLRGTELELEAVSEEKERLQEKLACAESAVAEANDAV

SEQ ID NO: 34593 - protein, 81 aa, Sorghum bicolor
  Clone ID: SORBI-28MAY03-C5089_1.pep
VTIDEVVQIFVLFTYSVYMILTKGYGDAVEKNKLRCFLITDCSICDANFLPLAKSDFLPTFVFLLDHMGPSSLAHWLLSSS

SEQ ID NO: 34594 - protein, 157 aa, Sorghum bicolor
  Clone ID: SORBI-28MAY03-C50563_1.pep
QISFIQIGLVQGWAAIVMGILSGSIPWYTMMVLHKKWSFMQRIDDTLGVFHTHAVAGLLGGTTTGLFAEPVLCNLFLSIQESRGAFYGGDGGSQFGKQIAGALFVIAWNIVITSIICVLIGLVLPLRISDEQLLIGDDAVHGEEAYAIWAEAELNDV

SEQ ID NO: 34595 - protein, 60 aa, Sorghum bicolor
  Clone ID: SORBI-28MAY03-C50603_1.pep
SRRARVVSVQLEKTDNGEWRGVKSIKTWKRLDDKHLSTIDSEVLWNRGSNGRRRKNPGGS

SEQ ID NO: 34596 - protein, 82 aa, Sorghum bicolor
  unsure (1)..(82): unsure at all Xaa locations
  Clone ID: SORBI-28MAY03-C50590_1.pep
QKVQRARSWNGCSFPENILSLRSLSCALCRFDIFQLLPSKIQVGVFSATXPPEALEITNRFMNKPVRILVKRDELTLEGXQQ

SEQ ID NO: 34597 - protein, 132 aa, Sorghum bicolor
  Clone ID: SORBI-28MAY03-C50631_1.pep
NEDTEETDDQKPRLEVATADMNSNGESKHEEKDDSKVEQEELKTELSLQESDKVSFEKEAQTENKRQETESSNDELDSKKDSSTESANGTTVSEDTATTKVAAMSPTKPQQPKKNKPLLKKFGSLLKKKNSK

SEQ ID NO: 34598 - protein, 195 aa, Sorghum bicolor
  Clone ID: SORBI-28MAY03-C50633_1.pep
HEAFSVIGQRSIHLAGYYMTDVCEDRSDSDSGSDSLQGSDEDGLLEEDDDGNMVMGYSDSEDDDSEYDSESDDEEMAYNQGRGKSSVVIEEIEEDDKAAVAGVQKGSKKKQCRENGDESQLQLAVRNPPTESLESEDEDGFPVSFSESKKSSESVSNKKGGKDKETSNEDRKRKSGAISDRGDSSGEVNAETDGA

SEQ ID NO: 34599 - protein, 150 aa, Sorghum bicolor
  Clone ID: SORBI-28MAY03-C50963_1.pep
TRAAARRLQARYDLYMGFDDADAGGDDVTDPRGGGAEPYNCPFCGEDFDFVSLCCHIDDEHAVEAKSGVCPICATRVGMDLIGHLTMQHGSYFKMQRRRRVRKVSTGSHSLLSLLRKDLRNGSLHSFLRGSSYVSNPPAAAPDPFLSSLI

SEQ ID NO: 34600 - protein, 140 aa, Sorghum bicolor
  unsure (1)..(140): unsure at all Xaa locations
  Clone ID: SORBI-28MAY03-C50939_1.pep
MASSHIILPKEEEAGETLPPPGPRAAVAVXLAADHDSPAQRPYQEQAPGKAALPFSATCVRISRDSYPNLRALRNASTMALHDDDAAFVKIEEGDFGYVLDDVPHLTDYLPDLPTFPNPLQDHPAYSTVKQYFVNADDTV

SEQ ID NO: 34601 - protein, 165 aa, Sorghum bicolor
  Clone ID: SORBI-28MAY03-C50968_1.pep
HEAEPSPDDEFWMLSGETEDTISDGRIVQVTVRNIQENKIICTFDSGLKAIVMADNYSDEGFDLESSQLREGDVLTGKIRNVNKNRFMVYLTCKATEMRRRPFSRGDQDPYYHERDMISQTVEDKARKQKELAKKHFKPRMIVHPHFQNLTAEEAMQFLSDKEHG

SEQ ID NO: 34602 - protein, 181 aa, Sorghum bicolor
  unsure (1)..(181): unsure at all Xaa locations
  Clone ID: SORBI-28MAY03-C50969_1.pep
MAGLAAQLQHIKSLYFGPSPAKGVMQDLEYAMRTKGGLTPEEEKTLRVYKFLPAFSFFAGSVXALWVGWFSFGKGLRLLGLPLPPNPRLVRFCATSGCAYFVGKGSAREIMHQCPAMLLNTEEGRMKMELANIILNKHSDDAYLGNAVKRHFFAEHLFDDLHQDQPLFRWHPRRSYIDGTF

SEQ ID NO: 34603 - protein, 176 aa, Sorghum bicolor
  Clone ID: SORBI-28MAY03-C50979_1.pep
TRGKTAAFCFPIISGILKSRDLRPPQTQRQRARAACPLALILSPTRELSMQIHEEAKKFSYQTGVRVVVAYGGAPIHQQLRELERGVEILVATPGRLMDLLERARVSLQTIKYLTLDEADRMLDMGFEPQIRKIVEQMDMPPRGVRQTMLFSATFPKEIQRLASDFLADYIFLAVG

SEQ ID NO: 34604 - protein, 65 aa, Sorghum bicolor
  Clone ID: SORBI-28MAY03-C51022_1.pep
DIVMCKLMDCVCIYSFWVRSDIMAAWLNSIYVIGNWLPHCVFDHFPALVSCLVALPTEDNPQSNK

SEQ ID NO: 34605 - protein, 174 aa, Sorghum bicolor
  Clone ID: SORBI-28MAY03-C51004_1.pep
RRGYANHKTTNVVARRTGLDDNVDLPKHVVPSNRRSFPDGHLSATMARVNNQISFEKHTSSAEDVEYKDVYEVGYQPPRGDEYPRRRPNEDHDKRRMDLVRQKFVEAKRLASHDNILQSKEFHDALEALNSNKDLFLKFLEEPNSLFTKQSGGHNSAPTSPQRKRITVLKPSKS

SEQ ID NO: 34606 - protein, 85 aa, Sorghum bicolor
  Clone ID: SORBI-28MAY03-C50737_1.pep
TLIKHNQLFQFCTPNKQLILYRNLGGFLVYNFMKLRDGVTLPSINNLSTSLRTEFLADILTSRANESYDNIPEDIQYPIKKLENM

SEQ ID NO: 34607 - protein, 76 aa, Sorghum bicolor
  Clone ID: SORBI-28MAY03-C50781_1.pep
RVMIVDNSPQAFGFQLDNGIPIESWFDDPNDTELLKLLPFLESLVGVEDVRPYIARKFNLKEKVATASSLAIDMQM

SEQ ID NO: 34608 - protein, 110 aa, Sorghum bicolor
  Clone ID: SORBI-28MAY03-C50791_1.pep
YPLRHVDVECTRSLGISEVKCRKWLLSLTSFVRNQNGAIAEAIRTWKSNFDKEFEGVEECPICYSILHTSNHSLPRLACKTCKHKFHGACLYKWFSTSNKSTCPLCQTPF

SEQ ID NO: 34609 - protein, 128 aa, Sorghum bicolor
  Clone ID: SORBI-28MAY03-C51056_1.pep
TLPTPNPRRRRRRKGLLGFLVSSGIVMGCFLSCFRGGSDPSGDLRDPLVRESRLGDAFLNDEKKFDEATGKPDAVAAYGHGVDEELRREANYLKSCGTISQTPPEILDSVPINSEDADEVRNSSASLS

SEQ ID NO: 34610 - protein, 111 aa, Sorghum bicolor
  Clone ID: SORBI-28MAY03-C5108_1.pep
PPRPAVVAADGVLVDITYVESAVAKGAVCLDGSAPAYHLARGSGSGENSWLVHFEVCFLGGVKGNGHNLLQLVIHFYMFSSTQCSSALIAFFFSIRGISPISIDFQRPFEH

SEQ ID NO: 34611 - protein, 276 aa, Sorghum bicolor
  Clone ID: SORBI-28MAY03-C51081_1.pep
ARGRLYQFDLPWDAGKVLDASVIPSAEDRDEGAWVVLTEKAGVWAIPEKAVLVGGVEPPERSLSRKGSCNGTRAEEKRRSQGFSASVVPRRVSSEAWSAGERQRPALTGIAQQSVVDEESEMLLNRLFHDFIISSAVSEALQKLRAAGAFEKEGEMNIFVRTSKSIVNTLAKHWTTTREAEFLASTIVSSLVEKQQKHEKFLQFLVLSKCHEELASKQRAAMLTVMEHGEKLSGMAHLRELQNALIQQRSSTHLSPQSKTQGTGALWNLIQLVGEK

SEQ ID NO: 34612 - protein, 270 aa, Sorghum bicolor
  unsure (1)..(270): unsure at all Xaa locations
  Clone ID: SORBI-28MAY03-C51089_1.pep
TRQTFLLSLSLSRPSFRGGDDWRRLATPSAGSSSAPSPATDAALCQVIVRPPSPATGDHQVLATNIRTSLLALSRSRPSFRAGVVWRSPDVNSSFIGGAQLQPSRSMNTDSFMRVPASPISFSSNNISGSSVIDGSVVQQSPPQDQVQKRRSSSVTSHPMIEASGALHAXQRXSRIDVRQDELQQQLIPQLLHGQSSLHLQGQQNPQLEALIQQHKLAQLQQRQQQLLQPFAQIQPSQIGISRQLQLRPPLAQPGIAGPIRTPVDTGLCS

SEQ ID NO: 34613 - protein, 57 aa, Sorghum bicolor
  Clone ID: SORBI-28MAY03-C5109_1.pep
ISKIVAFKEKLADSSIHGVSLFLTYRAVVSTMIIFCLSEHYHEVYCLQLYTHAPLSI

SEQ ID NO: 34614 - protein, 210 aa, Sorghum bicolor
  Clone ID: SORBI-28MAY03-C51119_1.pep
TTRLLGRFPNGRVEEFIHARTLSAADLRDPEISALVASKLREFHNLDMPGPKSVLIWDRLRNWLRTAKNLCPSEEAKEFRLDSLENEITALENECSGDYQWIGFCHNDLQYGNIMIDEETNVLTIIDFEYASFNPVAYDIANHFCEMAADYHSSKPHILDYSRYPDVDEQKRFVKTYLNISGEEPDAEVVENLLQRIDKYMLASHLVWGL

SEQ ID NO: 34615 - protein, 180 aa, Sorghum bicolor
  Clone ID: SORBI-28MAY03-C51106_1.pep
MELRGHGSGNLQLGAGQVQQRRPSVGHGHGALEAGRRRAAAAFTLCRPAWRPAAPAGSLAAPGGRSQREGRPGPPSAPGEPEAELLAGRGAGGGSLGLGAGQEQQRGGPVRPGQGGGGGWRRRAAAGMATGGPGGGAGAPAWWVAARGGRRQPQPGAAGEAVAGTPEEEGAPTGSGGEPG

SEQ ID NO: 34616 - protein, 121 aa, Sorghum bicolor
  Clone ID: SORBI-28MAY03-C50890_1.pep
RDATRATSPLVAGSSSSPLARSGMKGGGVIRAAGGGAGGSGLMRTRLRLPVVLLSCSLFFLAGFFGSLLFTQDPEEADMPVPRERLLETAWPEMPYRESGEAAPSLIPYQILSWQPRTLYF

SEQ ID NO: 34617 - protein, 124 aa, Sorghum bicolor
  Clone ID: SORBI-28MAY03-C50891_1.pep
MATPRPALLLPAVRFASTTIALLLLVAFSSLMRSSDAYDPLDPNGNITIKWDVIQWTSDGYVAVVSLYNYQQYRHIQAPGWKLGWVWAKKEVIWAMTGGQATEQGDCSKFKTNIPHCCRKDPEV

SEQ ID NO: 34618 - protein, 175 aa, Sorghum bicolor
  Clone ID: SORBI-28MAY03-C50917_1.pep
MRRGLGSEASLRRRRGPARLWVAVAALVVGTVCLFSSSSVGLFGASYRGPGVDVNKLWRTADSTGWRASCAPRTYWPPPPTESESNGYLRVRCNGGLNQQRSAICNAVVAARIMNATLVLPELDTNSFWHDESGFVCIYDVPHFIKTLKYDVRIVMSIPEITTMGKSKKLKGHQI

SEQ ID NO: 34619 - protein, 81 aa, Sorghum bicolor
  Clone ID: SORBI-28MAY03-C50792_1.pep
LIISMKDWSEYLHHLDKYLLISPFWGEMGYNISARLNTVQPVYISLPIFIILTREIFSIGSSGVSTMCPCLLSHTTYTLPL

SEQ ID NO: 34620 - protein, 191 aa, Sorghum bicolor
  Clone ID: SORBI-28MAY03-C51178_1.pep
HEAGVVGEYGTNEMISSKVTHSQPRLQHQETTQNFKAYEPDSGYGMSFITKVVDGEAAQSIAYSSEAMVLHSVNAYQLPASTATQQPVPQMFSQQFQVPHYPNFLPYRQVFSPQFGSPMVVPNYSSNPAFPQLPHTSSYVVMPNGASQLSANGMKYGSNHQYKQVFQGAPAGYGYANHNGYPVSNGVIGGT

SEQ ID NO: 34621 - protein, 134 aa, Sorghum bicolor
  Clone ID: SORBI-28MAY03-C51189_1.pep
MMSSSSSSSAAFPLDHLAPSPTEQLCYVHCNCCDTILAVGVPCSSLFKTVTVRCGHCANLLSVNLRGLLLPPAAPPANHLNFGHSLLSPTSPHGLLDELALQAPSLLMEQASANLSSSTMTGGSNSSCASNLPA

SEQ ID NO: 34622 - protein, 158 aa, Sorghum bicolor
  unsure (1)..(158): unsure at all Xaa locations
  Clone ID: SORBI-28MAY03-C5119_1.pep
GVEEVELAKIGVEVKERARKLLLDDIRALSTCGESSHDQSQSPKADDAAWIVTGSRLMRGEXLKKRLVNVRNGRKEAYSMLRTAMQKAAQLRLMEKEKNKSPSFAMRISVRIKKIVWSMLADGKSFSEAEINDMIFDFDRDYKDIGXAQLTTKLFVLK

SEQ ID NO: 34623 - protein, 110 aa, Sorghum bicolor
  Clone ID: SORBI-28MAY03-C51192_1.pep
HEVGYFPEIPQPGFSTCLVIPSNKESAVANENLESDAESVGDLIDGNNFVSGPNIANMVVDEVGFKMAPADKSSPGDHSDDSCVIPESRTQDYAGKSHEGVGDCGVNWSV

SEQ ID NO: 34624 - protein, 103 aa, Sorghum bicolor
  Clone ID: SORBI-28MAY03-C51233_1.pep
NESTIPRRKSNPNNEYSRGLHTHHPKILAIVSIPSKFPQADVSTRCTLSRTNGHDDRDKRSSNTVRISGLSDADRIHRIAMRSMPSSAFGVPSELSTSVMCRS

SEQ ID NO: 34625 - protein, 79 aa, Sorghum bicolor
  Clone ID: SORBI-28MAY03-C51204_1.pep
FWHKATHHSGLRTFTAAIYCKTVYQPESGCVVLHQLYSYSAESLLKYNEPVIDQFNELVECLHSFFTSSLIQLKREDHN

SEQ ID NO: 34626 - protein, 78 aa, Sorghum bicolor
  unsure (1)..(78): unsure at all Xaa locations
  Clone ID: SORBI-28MAY03-C5104_1.pep
PSHVAPEECLECYGPXADVWSAGVILYILLCGVPPFWAESEAGIFRQILRGKLDLESEPGGGISXXAXDLXXKXLIXX

SEQ ID NO: 34627 - protein, 230 aa, Sorghum bicolor
  Clone ID: SORBI-28MAY03-C51043_1.pep
ARGLNHLCNIQEAENSQSVQLIRSGDYAESSDKMLESILRLFLASGGSGAIAKSCSEEASSVIGSSRHAYLHFWELVASFIKNAPLQIRKSALESMELWGLTKGSVSGLYSILFSSQPIFHLQLAAFSLLLSEPFCQLSLVKNCSMGENCSSVQQSGISQSAELMPDSEKTVHLRDELSDLIEFPTYELLKTDLTARDRVDVFIAWALLLSHLQILPASSSIRGDVLQYI

SEQ ID NO: 34628 - protein, 189 aa, Sorghum bicolor
  Clone ID: SORBI-28MAY03-C51044_1.pep
HEARGWMLSIRSFEWIASRMDEDLHYPTDLFYDSENVRSLFGSVAPYAVPQVSSSSLKKAIGFKTEVSYCDALMVLKYWITSKVPFRASMSQMCKFYTFLSEGVADSKIDIKREFMSSPSIFTPLQRPRASEVIPGSFLAPEDLYWHDPTGCFEITEDFIATRNRSMFPRRMLSAAYPNLCELFTLTCG

SEQ ID NO: 34629 - protein, 193 aa, Sorghum bicolor
  Clone ID: SORBI-28MAY03-C51444_1.pep
GEVARGFKLPARPARRSFSVVEEPTSGLLACLPAADMGSGLKYRAGLCLIVAVVLIWVLSAEVTQGIFTKYKHPFAITYLGASLMVIYLPLSFLKDFIYNSMRRHSGNTSALKIASKSSFGGSAPLKNGEFQKVLEMESQKTIVINCTDVSIPVVEETKPLIYGITEMNDGAFKDKQLSTKEIATYGLYLCPL

SEQ ID NO: 34630 - protein, 195 aa, Sorghum bicolor
  unsure (1)..(195): unsure at all Xaa locations
  Clone ID: SORBI-28MAY03-C51484_1.pep
TRKRQIMSVRREQREKENRSKMRMAKAPPRQHSVSLQSSVGPSVNKRAAPSSGEVKKKVSSGSAITVEGKIVDYAESSVPLMGDTASMDLIGPPSTNAETHTNCFANQPIQIQTSTDLVSSSPANLVSGLSEDNNKGASISTPFNMVSXDNSQINQQVMPLTQTQLEEAMRPAKFEQQAGAGFSLEXNNALSPTV

SEQ ID NO: 34631 - protein, 170 aa, Sorghum bicolor
  unsure (1)..(170): unsure at all Xaa locations
  Clone ID: SORBI-28MAY03-C51502_1.pep
MAKSRPPKRILESYTIKGSDKVIKPGDCVLMRASDASKPPYVARVEAIEAAGSRGTNVRVRVRWYYRPEESIGGRRPFHGSKEVFLSDHYDVQSADTIEGKCNVHSFRSYTKLDSVNAEDFFCRFEYKSATGSFVPDRIAVXFCKCEMPYNPDDLMIQCEECSDWFHPAC

SEQ ID NO: 34632 - protein, 165 aa, Sorghum bicolor
  Clone ID: SORBI-28MAY03-C51503_1.pep
TRVEQVRDGSTVRVYLLPSFQFVQIYVAGLQAPSMGRRPSVPTVIAETDDTANGVNGEDSEGTPAQLTTAQRLVASAASAEVPPDRYGREAKHFTETRVLNRDVRIVVEGTDSFSNIIGSGHYPDGETAKDLALELVENGLAKYVEWSANMLDVEVKIKLKNAEL

SEQ ID NO: 34633 - protein, 82 aa, Sorghum bicolor
  Clone ID: SORBI-28MAY03-C51540_1.pep
AKYPAFRMIVQSYQIQGVKLGAAAYCLEPKDSCRATTTRSTIPVTCTFKKNCVSAIMYALTFYAYKGWSFIISLQVESEILS

SEQ ID NO: 34634 - protein, 163 aa, Sorghum bicolor
  Clone ID: SORBI-28MAY03-C5425_1.pep
TATSSGSPAAGPCSPTAPTRTSTTLGSSSRSTTAPSAPRSTPKRRTRYATSRSRTTSPSLDFSVRHAAAIALDDADGTASPGASSSSATPRRYPACAAKYSEYTPCEDVGGSLRFPRDRLVYRERHCPASEREVPGCLVPAPAGYRTPFPWPASPDVAWFANV

SEQ ID NO: 34635 - protein, 136 aa, Sorghum bicolor
  Clone ID: SORBI-28MAY03-C54272_1.pep
MAAAEARAAWQRAANRCLVQEDAKRAPKLACCPPPLQPHDASDGSPPSPQDLHSPTFMPINWNLMNSSLPMETQWWLQLQPNFGCQAALARDHLNYVGGDAAEKKMEGLAAPVSKLEDVQAKNAADPFEPPWIVSM

SEQ ID NO: 34636 - protein, 206 aa, Sorghum bicolor
  Clone ID: SORBI-28MAY03-C54275_1.pep
ARGAHYGQAPPPQPYYAAPPAPAPAPAAPAAADEVRTLWIGDLQYWMDESYVLGCFLSTGEVQNVKLIRDKNSGQLQGYGFVEFTSRAAAERVLQTYNGQMMPNVELTFRLNWASAGEKRDDTPDYTIFVGDLAADVTDYLLQETFRVHYPSVKGAKVVTDKLTMRTKGYGFVKFGDPTEQARAMTEMNGMPCSSRPMRIGPAASR

SEQ ID NO: 34637 - protein, 178 aa, Sorghum bicolor
  Clone ID: SORBI-28MAY03-C54285_1.pep
TRDETKRAVSNKDSQLETMTGSASPNQMADNRSAVSRQGGTSPLSHQECCRSEDLNRYVCSDESKEVGHLKKSQSLGNMLQKDHDHNSSEGSEFDVTNHEHKCDPSSFERGEVVGESTKACSPENEDDFDASSDLISHDFCEPLGDHTVDSDSHHRMSYSQSKFPRSQSAIFQNDCTS

SEQ ID NO: 34638 - protein, 125 aa, Sorghum bicolor
  Clone ID: SORBI-28MAY03-C51644_1.pep
PACHTSRGWRRRAAGGGGRRRRAAAWPIGPVVAGPSRSSAASPWTAARPWEQIPLANTAARRAAPGRRSKVLQLRRSSLRPREGVTEVETGTGRACSWARVNWHAWTAHALALARAPGGGGGGGL

SEQ ID NO: 34639 - protein, 117 aa, Sorghum bicolor
  Clone ID: SORBI-28MAY03-C51629_1.pep
MAANQEEQEQRRRLLAVATRFPLPSGCRFSYGTAGFRADGATMAPAVCRAGILAALRSVKLAGAAVGIVITASHNPVGDNGVKIADPDGGMMAQHWEPFADALANAPDPDALLQLVL

SEQ ID NO: 34640 - protein, 176 aa, Sorghum bicolor
  unsure (1)..(176): unsure at all Xaa locations
  Clone ID: SORBI-28MAY03-C51682_1.pep
MGEPVPEPSYEEAVLSAEEARLWTVVTATSLDFNAWTALIEETXKNAENNILKIPKVYDSFLAEFPLCFGYWKKYADHEARLDGASKVIEVYERAVLAVTYSVDIWYNYCQFAISTYDDPDIVRRLFERGLAYVGTDYRSNILWDEYIKYEESLEAWSHLAVIYXRVLEHPIQQLD

SEQ ID NO: 34641 - protein, 112 aa, Sorghum bicolor
  Clone ID: SORBI-28MAY03-C51741_1.pep
MHPYSLKSSKGAPILPRPIFVFFIASFGFYVCYLSFNQITLESGREGNSREEQRDCRKPYVPHEELSYVHFPKPTSYSRGECSCTPVRFFVIVSMQRSGSGWFETLLNSHPN

SEQ ID NO: 34642 - protein, 78 aa, Sorghum bicolor
  Clone ID: SORBI-28MAY03-C51742_1.pep
HEGEVQYQTHVAEMEALRAGMPPVYVNHSNDGGPAVRDIHMENFSVTVGGRDLIQEATITLAFGRHYGLVGRNGTGKT

SEQ ID NO: 34643 - protein, 216 aa, Sorghum bicolor
  Clone ID: SORBI-28MAY03-C51750_1.pep
MVAAAAAATAPDPAHHSRPPLTPALDKPNSAAARRNSQRSNKPVSSRYLSAAAAASPAPAASSSTSSSSSSSSRRSLSAQRTRASTPPPQHSTSPTTTTASASAASATATTMRSLSVSFQGESFFYKTSRAPRASSPSSPAARRGPTPERRKSVSSVPEAENARPSGRWPAAKPKASDPLARSLDCSLDRKDSILAGVHLLRRSMAFDSTTSLSAS

SEQ ID NO: 34644 - protein, 44 aa, Sorghum bicolor
  Clone ID: SORBI-28MAY03-C5124_1.pep
TFHRAHQSGVGCMTGFQNQSSVHALPNFEILCCCILKVTRGLYS

SEQ ID NO: 34645 - protein, 138 aa, Sorghum bicolor
  Clone ID: SORBI-28MAY03-C51242_1.pep
FQLTKPIQIRIRIPPEIFSGNQSPSNERALSAPKWVVKLEAGPSPKYVGVISNHIPQTILNNFIMLRKFTNGTIFMYFFFKERTGDDERRLWLSLRLPLLAQGRCCHACMAVSFRLSQFDVLKLNYCINYYVCVVILL

SEQ ID NO: 34646 - protein, 118 aa, Sorghum bicolor
  Clone ID: SORBI-28MAY03-C51246_1.pep
VETADVWFQGHRESANMPSAPFYNMVGQPVSPHAAYLPPHSGHTAFNPAPSHPAHLQYPSFAHALHPTSMTMVQNPQAMVHQPGAPPLAGNLGLDMAAMVPGSQVGAFQQNQWTTQSF

SEQ ID NO: 34647 - protein, 68 aa, Sorghum bicolor
  Clone ID: SORBI-28MAY03-C5129_1.pep
GCRIGGGSPPPQVGRSGVGRGGSASGWRSGVIGTARHGHGNGIKTSMKLTHRDRGGIKRVVGSRSARH

SEQ ID NO: 34648 - protein, 256 aa, Sorghum bicolor
  Clone ID: SORBI-28MAY03-C51409_1.pep
MKIDEEKAQAEAEIEILKSTIQSGEREINSLKYELHVVSKELEIRNEEKNMSVRSADVATKQHQEDVKKISKLEAECQRLRGLVRKKLPGPAALAQMKSAGESLGREYGDHRVRRSPAKNSSFHRPMSPMSPVPDYAIENIQQMQRENEFLTARLLTMEEETKMLKEALTKRNSELQSSRSMYAKTAGKLRSLEVQMLTGNQHKSPSTPNMDIHFDGALSQNGSNPPSMTSMSEDGVDDEGSCTESWANALVSELS

SEQ ID NO: 34649 - protein, 192 aa, Sorghum bicolor
  Clone ID: SORBI-28MAY03-C51802_1.pep
MEEKASSPLIPPPSEIDLEAGGGGEQLQGRICLETDGRDFIAPCKCKGTSKYVHRDCLDHWRAVKEGFAFSHCTTCKAPYYLRVHSHTDRKWRTLKFRFFVTRDILFIFALVQIVISALAYLVHFIDGYQQYWLRTAWGFDNEVSFYYICGALLFFALLGLSGCFITCYDRRVRNDLAQPCRELCLCCCQPG

SEQ ID NO: 34650 - protein, 150 aa, Sorghum bicolor
  Clone ID: SORBI-28MAY03-C51842_1.pep
MEGCSKTTAGAGVAGLPDDPVLEILSRVPAKSVCRFKCVSKGWRDLIADPNNRKRLRHAMQGLFVQTYADELDDDELGKDDLGRIRFRFINLTAVRSVPLDIDPCFSFLTEMTGIKAFLLDSCNGLILFGQCQDPSLLLLLDGYIVCNPT

SEQ ID NO: 34651 - protein, 83 aa, Sorghum bicolor
  Clone ID: SORBI-28MAY03-C51872_1.pep
MACAAAHMFVYNATLCACDPGYFLFTNSTGGSNGSSTSTSCVSLPRGGDGFGDWQVGSVGASKNQSFYFLTPVLSLDVVRRLT

SEQ ID NO: 34652 - protein, 224 aa, Sorghum bicolor
  unsure (1)..(224): unsure at all Xaa locations
  Clone ID: SORBI-28MAY03-C51885_1.pep
ARGGLEGARMRQPAFRMTLAELLDESKLVPVAVTGDQDVALAGVQRDASLVAAGDLFVCVGEGARAGLTEADKRGAVAVVADQDLNIEGTLACRALVIVDDILAALRVLPACLYRRPSTDMAVIGVTGTDGVTTTTHLVKAMYEAMGVRTGLVGVLGAYAFGSNKLDARPDASSDPIAAQKLMAXMLHNGTEAVVLETATDGIPPSGVGSEIDYDIAVLTNVRH

SEQ ID NO: 34653 - protein, 244 aa, Sorghum bicolor
  Clone ID: SORBI-28MAY03-C51904_1.pep
ARGLVSLEYLNLSHNSLFQEIGELFGSLNSLSELDISFNNLTGNLPFSMGSLSKLSSLYMQNNQLSGTVDVLSNISLATLNIANNNFSGMIPQEFSSIPNLIVGGNSFGTRPASPPPTLKPPPNPHDQPNDPQGPSASTIPETPIDQDDKKMQTGPLIGIAVGSIAAASCVLFVLVFCLHNARKRNDDESSEPKDNVGSLAVNIERASNREVLNNNHENAVVATSDLQPAGKMTPDRVHGTNGS

SEQ ID NO: 34654 - protein, 124 aa, Sorghum bicolor
  Clone ID: SORBI-28MAY03-C51524_1.pep
MLEDFFTLTEMKDGISTVARIAELISEMHKLENSADINTSDVIRQCSTAANTLASTKNEECLQHFVQLNGVSFLNRWLQDAQKCVGDVRSSAEDLIVAILTALECLPISNEQSASCRSMPTVDH

SEQ ID NO: 34655 - protein, 174 aa, Sorghum bicolor
  unsure (1)..(174): unsure at all Xaa locations
  Clone ID: SORBI-28MAY03-C51561_1.pep
HEGALLACADVGFLKLGKSIHGFILRRLEFQCILGTAVLDMYSKCGSLESARKLFNKLSSRDLVLWNAMIACCGTHGCGHDALALFQELNETGIKPDHATFASLLSALSHSGLVEEGKFWFDRMITEFGIEPTEEHCVCVVDLLARSGLVEEXNEMLASMHTEPTIPIWVALLS

SEQ ID NO: 34656 - protein, 70 aa, Sorghum bicolor
  Clone ID: SORBI-28MAY03-C51589_1.pep
YYTVQFLDMILSLYDMMSLSLDDSPHLKPESIRSLYIFIIYKLFHSLFSSFLSSLRSYFSCFLCDSVLFI

SEQ ID NO: 34657 - protein, 328 aa, Sorghum bicolor
  unsure (1)..(328): unsure at all Xaa locations
  Clone ID: SORBI-28MAY03-C51592_1.pep
HEGALTALASVADSSQDHFKKYYDAVMPYLKSILMHATDKSNRMLRAKSMECISLVGMAVGKDKFRDDARQVMEVLMALQGAPMETDDPITSYMLQAWARLCKCLGQDFLPYMSVVMPPLLQSAQLKPDVTITSAAPGDDIESDDDSIETITLGDKRIGIRTSVLEERATACNMLCCYADELKEGFFPWIDQVAPTLVPLLKFYFHEEVRRAAVAAMPELLRSAKLAVEKGQAQGRDQSYVKQLSDYIIPALVEALHKEPETEMCSSMLDSLNECMQLSGLLLDQTQVRAISDEIKNVIIASATRKRERSERXKAEDFDADEGELLKE

SEQ ID NO: 34658 - protein, 145 aa, Sorghum bicolor
  Clone ID: SORBI-28MAY03-C51615_1.pep
ALVGVGAHRPPRLLLGGVGGRRQRRHGQHLAHQRLRHHDSSSGRVERSNQKKKNSWLLQRRQPRRKGDLKLNWNAWISCVRDWGLAALGQQQEEEAINGGARARREMSTLGDKALVLVEWKPGKREEHFSGGALGDPKVGDGPRA

SEQ ID NO: 34659 - protein, 127 aa, Sorghum bicolor
  Clone ID: SORBI-28MAY03-C51971_1.pep
MGGGGGGGLGRRRHFAYLPLLLPLLLLAVAGAAAGKEKEKGAFGKLRFRRESGTFKVVQVADMHYADGRSTACEDVLPSQVAGCTDLNTTAFLYRVFRAEEPDLVVFTGDNIYGANSTDAAKSMDAA

SEQ ID NO: 34660 - protein, 171 aa, Sorghum bicolor
  unsure (1)..(171): unsure at all Xaa locations
  Clone ID: SORBI-28MAY03-C51977_1.pep
MSSPAPAEEDGRAPTKYVLITGGVVSGLGKGVTASSIGVVLKACGLRVTCVKIDPYLNTDAGTMSPFEHGEVFVLDDXGGEGDLDLGSYERFIDVTLTRDNNITTGKIYQSVIEKERRGDYLGKTVQVVPHVTDEIKQWIQSVSSVPVDGQTRPADVCVIELGGTVGDIES

SEQ ID NO: 34661 - protein, 69 aa, Sorghum bicolor
  Clone ID: SORBI-28MAY03-C5198_1.pep
EQRCVDFMQPKINSEIDDTGSWNYQIKQNTTPVTRWQASMLLRTIELLCFLLLESKIWIYFKFHGPKTC

SEQ ID NO: 34662 - protein, 251 aa, Sorghum bicolor
  Clone ID: SORBI-28MAY03-C51980_1.pep
TRTACAHGRLSSRDLTTSLRDLVDFLPASLAAIVSYFSAESTRGIWKPVPMNGIEWPSPGASLHSIEAEVKEILASAGVQINSCYPRGVPPMLPLPMAALVSLTITFKLDRSLEYIQGVTGQALENCAGGSSWPSMPIIGALWTQKVRRWHDFIVLSCMRSPFGTDKDAVAQLIQSCFSSFLQSSPSGSDIIANRGVGALLGDSITNQGLRLPMAPGFIYLRTCRTFHDTYFVSEVILKQVIEWSHKLANG

SEQ ID NO: 34663 - protein, 156 aa, Sorghum bicolor
  Clone ID: SORBI-28MAY03-C52013_1.pep
DPVKGFNFYIKASLQNSSSIIMVESAAMALAADVTSLLNISDMSFITDNQILATFYNGDNFDQPPSWDVRPFTQRFLHKVSHLSWRVMKIGRGDNITAHTLASQALRATTQIPNQDVNNHTVVTCSNEDHVDGCPLKEALNLVNWETFSLIAASCC

SEQ ID NO: 34664 - protein, 100 aa, Sorghum bicolor
  Clone ID: SORBI-28MAY03-C52053_1.pep
IFLPNTSSWTVAACQWNKMTAFVLNLELETHQLYRRKKSTSPPELWGGVYFTPGTINQSNLPPELSKTVQITPGRFFMAVLLQYRGFDFFFFTICFAYNL

SEQ ID NO: 34665 - protein, 105 aa, Sorghum bicolor
  Clone ID: SORBI-28MAY03-C51755_1.pep
MPRFIRTRWRNRKPWKPGERAIAALRPVHRSRLSSAIGKKSSSLPLRASSYSDDRVSALADDLLLLILRRLDTRSALATAALSKRWASIPRELDALSFSVNDILS

SEQ ID NO: 34666 - protein, 125 aa, Sorghum bicolor
  Clone ID: SORBI-28MAY03-C51762_1.pep
HEEHHKKAGAMNALVRVSAVLTNAPYILNLDCDHYVNNSKAVREAMCFMLDPTVGRDVCYVQFPQRFDGIDRSDRYANRNVVFFDVNMKGLDGIQCPVYVRTGCCFYRQALYGYGPPSLPALPKS

SEQ ID NO: 34667 - protein, 190 aa, Sorghum bicolor
  Clone ID: SORBI-28MAY03-C51768_1.pep
HEGELYELLRQSVDKVSALGDFQRPLRVLRRLVGIPNCAKALVNHPKWIPKNQIMLIGEGRVMELYSVLGAFFHVSAIRDREFASKPDVGQQCFSEASSRRPADLLSSFSTIKTVMNGLYDGLKDVLLILLKNLDTREKVLEYIAEVINKNASRSGMQVDPLKCASSGMFVNLSAVMLRLCEPFLDTMES

SEQ ID NO: 34668 - protein, 129 aa, Sorghum bicolor
  Clone ID: SORBI-28MAY03-C51820_1.pep
FLLSLFLLRRDCMAEDTGMSGLLGALATKVDLKLSLLKDVMAEYTEIKRVINGLAEEKVRLQQEKERLQHEKEMLQHEEQSNGETLAAMKEDLLASKDTLVAARDALVASAEEISQKNSCLEFLKKKLQ

SEQ ID NO: 34669 - protein, 51 aa, Sorghum bicolor
  Clone ID: SORBI-28MAY03-C51827_1.pep
IIELPNIYIHKHREENAENNVARSHHLIGQLSLLCWRIAHFPPTAFKKPCF

SEQ ID NO: 34670 - protein, 145 aa, Sorghum bicolor
  Clone ID: SORBI-28MAY03-C5212_1.pep
MAAGSGGGSRRARPNVLVTGTPGTGKTTTCSLLADAAGLRHVNIGDLVREKSLHDGWDDDLECHVINEDLVCDELEDVMEEGGILVDYHGCDFFPERWFDLVVVLQTDNSILHDRLTGRGYTGSKLTNNIECEIFQVLLEEARES

SEQ ID NO: 34671 - protein, 80 aa, Sorghum bicolor
  Clone ID: SORBI-28MAY03-C5214_1.pep
EMFENDLSVELRTAVHWSKWLHEIERTGGALTEALQRIFPPDWNSSENLEASSSVSDADGESCGDSEFSDNDEDHDVDDL

SEQ ID NO: 34672 - protein, 91 aa, Sorghum bicolor
  Clone ID: SORBI-28MAY03-C52143_1.pep
FFERARETSSSAIPDDGNRNAGEMKKKKRKHEHDLVDTEANLPKAPLQHGSEKQKPSKPADEASAGSLPSMAATQTVLGLPTVFGHNQQPS

SEQ ID NO: 34673 - protein, 111 aa, Sorghum bicolor
  Clone ID: SORBI-28MAY03-C52158_1.pep
SWLQGPMAMVGGELYVLSNSCIMKQRGENFPDKMVSCASEFQSRIGFGMIGVGDNIYLVGGVIGPGPRNQCIKPLSDVDILNVTSERPTWRPGSPMTHCRGSICGCALLRI

SEQ ID NO: 34674 - protein, 24 aa, Sorghum bicolor
  Clone ID: SORBI-28MAY03-C5215_1.pep
MYIQKYSKKAVLANTSGFAQFAST

SEQ ID NO: 34675 - protein, 150 aa, Sorghum bicolor
  Clone ID: SORBI-28MAY03-C5223_1.pep
QQMRVLNYGVDIVVGTPGRIIDLLRRGVLNLSQIQFVVLDEADQMLAVGFDEDVEVIMEQLPQNRQSMLFSATMPSWIRKISNKYLNDPVIIDLVGDSDQKLPEGISLYSIASDNFRKQSILGPLIKEHANGGKCIVFTQTKRDADRLAY

SEQ ID NO: 34676 - protein, 97 aa, Sorghum bicolor
  unsure (1)..(97): unsure at all Xaa locations
  Clone ID: SORBI-28MAY03-C5224_1.pep
DAWVEKQEFGLKPMNCPGHCLMFANRVRSYRELPLRMADFGVLHRNELSGALTGLTRVGGGXXDXAHIFCRENQIKDEXKAXXDFINYVYEIFGFKY

SEQ ID NO: 34677 - protein, 200 aa, Sorghum bicolor
  Clone ID: SORBI-28MAY03-C51914_1.pep
TRVVARLLKLAKIRNVKIYDAEHKVLDAFRGTGLNLVVAIPNEFLKDMAANPAKAMDWLNENVQPYYPSTRIVGITVGNEVLGGADTGLAEALVGAVLNVHDALRMLRLDAKIELSTPHSEAVFANSYPPSACVFKDDLMVYLRPLLDFFSKTGAPFYVNAYPFLAYMSDPSHIDINYALFKPNAGIVDPKTGLHYDNMF

SEQ ID NO: 34678 - protein, 233 aa, Sorghum bicolor
  Clone ID: SORBI-28MAY03-C51916_1.pep
TRLNPKPIGKRVNYGYRKGFSESEINLLRENKTLQARILQSKSDNKLFLDIEKGVNRRPLYESHPLSSFSWTRTDSIDMGGWSKKCKEALSNFELLKEGKSKDDIVYEKAVQILPRAKDEVHDIVQTALKSSDLKGLHAQCLTDIWIGRERFAFVDLSAGPFAWGPSVGGDGVRTELSLPNVAKTVGAVAEVTEEEAEEKLQDTIRERFSSFGEDYHAVDILLAEIDVYELFA

SEQ ID NO: 34679 - protein, 187 aa, Sorghum bicolor
  Clone ID: SORBI-28MAY03-C51928_1.pep
HEASLSSSSKSALMTSIIKDDVDDSNSDFVEEFAMVSGSHSSTLDRLHAWERKLYDEIKASENVRNAYDEKCNLLRRQFARGLNAQLIDKTRAVVKDLHSRVSVAIQAVDAISKRIEKIRDEELQPQLVELIQGLIRMWKLMLECHHKQFITITLAYHVKNSTPVHQGEHRRQAAMHLCNEMDSFSS

SEQ ID NO: 34680 - protein, 289 aa, Sorghum bicolor
  Clone ID: SORBI-28MAY03-C51937_1.pep
TRIDAGTQQSRPQPPSAVVFSRPGSTPSSSSSSVPLAPLWRSGDPLIRKGKQSYFTGTKRIRTKDYFCSKEGLKEGEKLTDTNFNDPHTRTNCRAMVRFRVNDQGEWKVIRLVPEHNHNLAKPEERHLLRSARSLIAGRSSSVEAMLYGGYQVQPQLPAGSTSATNNVENPKQDLLLGYGATAKTLTVGTADVQSLVSHLKSRANEDGMFYWDVQLDRGGRMTNFFWRDGRSRTDYDCFGDVVVFDSTYRLSKQNLVFAPFVGVNHHWQTTMYGCALLADDSTSSFVWL

SEQ ID NO: 34681 - protein, 64 aa, Sorghum bicolor
  Clone ID: SORBI-28MAY03-C52292_1.pep
MATAARDRRLPPALPLATLIGRELRAGGSERPALRYGHAGFAKRGEDYFLVKPDCLRVPGDPAS

SEQ ID NO: 34682 - protein, 153 aa, Sorghum bicolor
  Clone ID: SORBI-28MAY03-C52297_1.pep
HEGHPSGTQTQPPRNLGMFSPQTGQLATVPPKQRTPEAIARAVEAMSQVPDAALRGGFILEKVLGPQSTGHLVLRNLNPDDNPSVRFNYFAHPDDLRRCVAGISAIERVIRSRAFSRFTYPNFAFPAALNVTGEFPVNTLYRRGGGDPRALEQ

SEQ ID NO: 34683 - protein, 111 aa, Sorghum bicolor
  Clone ID: SORBI-28MAY03-C52327_1.pep
LDQDLLVVLIFMAPCYSVSVFSACPFPIFAFVPFHLSTSHRSLSVAGFALRMHRCYSGLSLPCLVSLVLCRGALQSCLPDTLLFHSLTWGQCLWWMTGSILLWLQDTYLNI

SEQ ID NO: 34684 - protein, 199 aa, Sorghum bicolor
  Clone ID: SORBI-28MAY03-C52363_1.pep
ARGFRCVFVLLLAAGVLVPALFLLVPSRHRAGYLSDDHDVLAAEIKVGFTLEKPVSFLTSHIDKLGNDIFEEIGVPNSKVSIVSMHPLTSKYSTNVVFGVLPYPKDASISLPALSVLRSSLIEMMLQQVNLSLTPSLFGHPSSFELLGFPGGITVIPAQSGFTWANTDPLFNFVLNSSIYQILGNLTELKDQLKLGLNL

SEQ ID NO: 34685 - protein, 155 aa, Sorghum bicolor
  Clone ID: SORBI-28MAY03-C52359_1.pep
TRLLWCPAPAVPARGSGSPPPPTHHPSNARRSLARRPLSATVPAGNLLGIHLFQCPDAVGIVAKLSECIASRGGNIHSVDVFVPDDKPVFYSRSEFTYNPRLWPRHELHNDFLNLSRCFNAHTSTVRVPDLDPKYNISILASKQDHCLFDLLHRW

SEQ ID NO: 34686 - protein, 60 aa, Sorghum bicolor
  Clone ID: SORBI-28MAY03-C5238_1.pep
VEKTVQYLGGGGMDPGTENNPYLGFVYTSFQERATAVSHGNTARLARAHGDDVLARTWGG

SEQ ID NO: 34687 - protein, 94 aa, Sorghum bicolor
  Clone ID: SORBI-28MAY03-C52098_1.pep
QKLNEDRSLWKLGTLPPGLITFWNKTFPLSRSWHVLGLGYNPHVNSRDIERAAVIHYNGNMKPWLEIGLPKYRSYWSKYLDYDQSFLRECNINP

SEQ ID NO: 34688 - protein, 142 aa, Sorghum bicolor
  Clone ID: SORBI-28MAY03-C5210_1.pep
DAWVLNDFFLVLRERCEALQLSNTALEDQSLSKTSCAINAARYCENVLREWDEDTTFLDMGPHGSLFTDEISFLVKLGTNYLEQILSSVLLEFEDLSWEYVQNIGSWSGQTILDDQTLDEENAGVSSGFGASLECLTDRTTK

SEQ ID NO: 34689 - protein, 159 aa, Sorghum bicolor
  Clone ID: SORBI-28MAY03-C52112_1.pep
PQDNHVRRFLQRHGIPYHYLPTAPGNKREQEILELIQGTDFVVLARYMQILSESFLKAYGKDIINIHHGLLPSFKGGSPSRQAFNAGVKLIGATSHFVTQELDAGPIIEQMVERVSHRDTLQSFVVKSENLEKQCLAEAIKSYCELRVLPYELKKTVVF

SEQ ID NO: 34690 - protein, 76 aa, Sorghum bicolor
  Clone ID: SORBI-28MAY03-C52115_1.pep
HVPKAVSGPTSQMMPKPSPRRPVSQHSMPPRKKWNSRTSESSSIAPSPYALLHYLKLCLIGYLGCFDCWSCVIRKI

SEQ ID NO: 34691 - protein, 177 aa, Sorghum bicolor
  unsure (1)..(177): unsure at all Xaa locations
  Clone ID: SORBI-28MAY03-C52460_1.pep
ARGRLFRHEKHPTWVDLVVRSPGGGPDFVGRSYAGEAAVPQICEYALGVLDKASGTLRVVPITAKKILRLEPHHEVQRPAHSQHSEVASEAASAAGNDELKVQDLTMMYGAKMDRDKDNKWRSLNEQRNDPSAFEDIDLGGSETAANIIDSQEPVLTRNIPPYDPTADTSEKAYXLD

SEQ ID NO: 34692 - protein, 164 aa, Sorghum bicolor
  Clone ID: SORBI-28MAY03-C5247_1.pep
KTDLDDEQEIEIVFDEESGSDDKLPFPQPDDSLQSPPVIIGENSPGPVIETENQENERIPFSQRATSLPKDDESPSVDISSQTAMLSEPNNSLELKYSVSSPGKNSFHDHAEKSNYPSIGVSGRSSVQADHQHLSRRHEKRSPRKYSETSLSSGSHGHEHRHSN

SEQ ID NO: 34693 - protein, 183 aa, Sorghum bicolor
  Clone ID: SORBI-28MAY03-C52483_1.pep
MAMMDKWTGLGSALASFFFLWSMVQNHIPVAFRYRLSTWGSKLVSFFSPCRARTLSASAPGAARRSDVGPAAVAPLSDACARRARKLRAELGKNSKNLQVSVDDNDEVTDVFAGATIWWYACKQMAGSQVISWYPGEEVRRFYRVVFHRRHRDLVFDRYLPYVLEEGRAVTVRNRQRRLFTNN

SEQ ID NO: 34694 - protein, 47 aa, Sorghum bicolor
  Clone ID: SORBI-28MAY03-C52501_1.pep
MRGRNGSGHSKRPVVLCCVMIVCLCLLFLYFSGSKGQAGTTAFEYGT

SEQ ID NO: 34695 - protein, 111 aa, Sorghum bicolor
  Clone ID: SORBI-28MAY03-C52504_1.pep
MLQRNLPNLCLQISPPAASSAVVASDAPVAASAKPPPTQPISTATYAEGSGEVGFFANPSPGAEPPGLSLGLATPALGDNAAGRRGHHLQPQGCAFKRAAARASLPAAGSK

SEQ ID NO: 34696 - protein, 78 aa, Sorghum bicolor
  Clone ID: SORBI-28MAY03-C52242_1.pep
KLEKQLYPPHSDPNHTHSISHSHSASPPMRLPSTVAGISGENSILIYVTCNQLAPITASTCLAIGQVPSDRLSTATSN

SEQ ID NO: 34697 - protein, 217 aa, Sorghum bicolor
  unsure (1)..(217): unsure at all Xaa locations
  Clone ID: SORBI-28MAY03-C52251_1.pep
MMGTEGIAATVIEDPEPSIPPGFGPFAAPASWGIQNDVKPADAHSSSVLALQSIDDDVEILECLSSSVDRQSDTGCSISGSNTCRKSLRNRPPIDYSRFDQIAYEDSDAEVADKGASSVKHRQQFPKGVLRGCPECADCQKVIARWNPSGARRPVLDEAPVYYPTEEEFQDTLXYIESIRPTAEPYGICRIVPPASWKPPCLLKEKSIWECSKFSTR

SEQ ID NO: 34698 - protein, 105 aa, Sorghum bicolor
  Clone ID: SORBI-28MAY03-C52276_1.pep
MGSLWSLIHSYPDVCIAARGFFGLSIFRFIQQIQKSCIPLNWPVVGMLPFIVVSRHCIHDKVMGLLREAGCTFFFFGPWLLDMNFLITCDPATVNHCLNTHFEKY

SEQ ID NO: 34699 - protein, 71 aa, Sorghum bicolor
  Clone ID: SORBI-28MAY03-C52272_1.pep
IWLEREIRMLDVNNQNRIGKKSCYLDLTSSSAVDKKRDIILQTQVLLCAFLNNLVNINESTFLMGKRKYKI

SEQ ID NO: 34700 - protein, 190 aa, Sorghum bicolor
  Clone ID: SORBI-28MAY03-C52568_1.pep
ARGNSGAESVTSAYESSSVYDSESEGADLSDRDTFESHQDQEDNQDAPLVQIYDASIQQGQTGQNTEENLADLISTDLTELMSKSALESWLDEAPPEPVVQNLTQTSSARVSFTNLNFERKPKLHTLLDSSGSNGLSALYAFSSEVSPRSRLLVCVDLYFENVTTQQLTDITIEAEEASSSVDSIDQTSE

SEQ ID NO: 34701 - protein, 143 aa, Sorghum bicolor
  unsure (1)..(143): unsure at all Xaa locations
  Clone ID: SORBI-28MAY03-C52596_1.pep
APGTLALWWWTLVGVSTLCKGGGVPRVERGFSAFEKIKCIFSIALVRNFGEVTDALCGGTGSWPLASGVLSGVAECTGRTGVSLVFSVRCAGVLRTSLGMSPMSTGRSXCSASGDPKSLHTSLSFSPVWTYRVFSVLQVAVRD

SEQ ID NO: 34702 - protein, 162 aa, Sorghum bicolor
  Clone ID: SORBI-28MAY03-C52597_1.pep
QVGEEAPDARGFPRSPPGAGTSPPTGTFTGSWRFLRGSPRDLLPIHILGCNSSVGGGRRITRTRWKEPDGAWTRTRRPGKGSGGLVVIGFSVNHSVRSAGVSEVRPILPCATLSTNQSLGRLVKHSNPQPWPWTLPNRSTGSTGGSCCVRSGSTPAWPWRSS

SEQ ID NO: 34703 - protein, 262 aa, Sorghum bicolor
  unsure (1)..(262): unsure at all Xaa locations
  Clone ID: SORBI-28MAY03-C52609_1.pep
TRIAGEEDKVYRLHKALYGLRQAPRAWNEKLDATLKEMGFQQSSHEATMYRRSSGRAILLVGVYVDDLIITGTDEKEVAPGKAQMMKAIEMSDLGLLSFYIGVEVRQSASGVNLRQTHYAERIMELGGMEGCNPAATRMEERLKLSRFSTAEAVDPTHYRRLIGSLRYQVHTRPDIAFTVCFVSRFMEKPTMEHLAAVKRILRYLAGTLDYRLQFTRDPDSARFVGYCDSDLGGDIDTSKSTTGVLFXGQCLVSWQSIKQKV

SEQ ID NO: 34704 - protein, 99 aa, Sorghum bicolor
  Clone ID: SORBI-28MAY03-C52612_1.pep
QNTKASINPTERSRTHLAISAHHLPRQRKGSHSPAASPRVPRHPGRNPIQPAPAASQPPTPRPGTAVSSSATPRPGTAVSSSAGGHAAPAPPPAASASC

SEQ ID NO: 34705 - protein, 155 aa, Sorghum bicolor
  Clone ID: SORBI-28MAY03-C52615_1.pep
HEGQLEDMLWAQMNLWVSLLILVRIRVTSLMMSRLRRSLARLMMCQLKPVRARMMALGREREEKRKVGQDELDIMNGMVKAVENVGAALKAPQHNEVHKDLYGCVMNCPGYSQEALMVALVYLLRNKAEGLCFVQMSEAHMILWLRGHLSNSMGP

SEQ ID NO: 34706 - protein, 200 aa, Sorghum bicolor
  Clone ID: SORBI-28MAY03-C52389_1.pep
HEDNLKTKHDGYFVNKGKLEQIEPGTSANVAPKKRRRKDASNTYLETNHLAPVDYFNIGDVPGKSSARGTVQAGKQLASSNIGSYGQYHEDNRVVKNKTSGPGGAPKRKSSEFSGGDAAARAKIIKDVSHPPLELRDLEKHKAAALPVDYAHKSKTSETFDYAYQVYRDKGTSVQLDFQQRKVSGENQDPSNKVYRKERH

SEQ ID NO: 34707 - protein, 192 aa, Sorghum bicolor
  Clone ID: SORBI-28MAY03-C52437_1.pep
MMATTAYIDDSCSEVIDPPKTEALDVVELPGDHTQHPPKPNVVVSSSVRELLECPVCLSAMYPPIHQCSNGHTLCSGCKPRVHNRCPTCRHELGNIRCLALEKVAASLEVPCKYQSFGCSGIYPYYSKLKHESQCQYRPYSCPYAGSECTVVGDIPYLVNHLKDDHKVDMHNGCTFNHRYVKPNPHEVENAT

SEQ ID NO: 34708 - protein, 198 aa, Sorghum bicolor
  unsure (1)..(198): unsure at all Xaa locations
  Clone ID: SORBI-28MAY03-C52439_1.pep
ARGLRLQKFLESPTATCWRALVGAVRSTTFLSAFVTIFQAAICLHRKVANKDHKLVYWFAGLMSGLSILLEKKARRAELALYVLPRAGDSLWYILINRHLLPNIKNAEVALFCMCMGGIMYFLEYEPDTMAPFLRGXLIRRFLASKISXNPSPPPPDRNASYSYLQTLNALEQSRPQPGVDNGLTTSEKYNLESIPGL

SEQ ID NO: 34709 - protein, 57 aa, Sorghum bicolor
  Clone ID: SORBI-28MAY03-C5244_1.pep
VLLHYSIFLSLLVKVGSQEELAFFFIITVMLLRASSQVLCSQKLNFAICFLCLPYDT

SEQ ID NO: 34710 - protein, 169 aa, Sorghum bicolor
  Clone ID: SORBI-28MAY03-C52442_1.pep
MAAAATATATAVSSSTFPLLLLLPLLLCSCSHLTLASAEEAAPAAAAAELLGEARAPGFAEWLRGVRRRIHERPELAFQEHRTSELVRAELDAIGVPYTWPVAQTGVVATIVGAAAADGPVVALRADMDALPVQELVDWEHKSQESGKMHACGHDAHTTMLLGAARILQ

SEQ ID NO: 34711 - protein, 106 aa, Sorghum bicolor
  Clone ID: SORBI-28MAY03-C52819_1.pep
FHYLLFYFSSLSKNGNTSVRHRVQEMGSKLQKATFLYKLLMARITVSLASTNRIQIDPNGRSSHQGLGHSYTFFFLWGWGFLHVSNMITCRNPNKYDANQAIPGTR

SEQ ID NO: 34712 - protein, 149 aa, Sorghum bicolor
  Clone ID: SORBI-28MAY03-C52827_1.pep
QGDERGPLWEAWTRAMDAVHVDDMDSAYAEVLSTGDAELLVKLMEQTGPVVDQLSNEVANEVLHAVGQALLVDCFAHGAWGCRRQLTDLVMENGSDYLGIPLDAKQDLLLGLHEATAIELPDDWEGATPMQIMKQLASSWRIDLQQLIN

SEQ ID NO: 34713 - protein, 174 aa, Sorghum bicolor
  Clone ID: SORBI-28MAY03-C52839_1.pep
MTAPTAESAYDPTIKISYYTKANNGRAGFWGYMFQILFQTNAGAVMITDLVFWFILYPFLAHNQYEMNFILIGTHSINVVFIVGDAALNKLHFPWFRIAYFLLWTGIFVNVQWIIHANVSTWWPYPFLDLAFPGAPVWYLVVAVLHFPCYALFTLVLRLKHMLLESWFPQTYVK

SEQ ID NO: 34714 - protein, 256 aa, Sorghum bicolor
  Clone ID: SORBI-28MAY03-C53000_1.pep
ARGSRSGSDRSAYSPGTTTDVLVPKPLESNVMLDVSYVACGVKHAALVTRQSEVFTWGEECSGRLGHGTGTNVFQPRLVESLSICNVELIACGEFHTCAVTATGDLYTWGDGTHNARLLGHGSNVSHWIPKRVSGPLDGLPVSTVSCGTWHTALITSSGQLYTFGDGTFGVLGHGNRASCSYPKEVESLKGLRTISVSCGVWHTAAVVEVIISQSNASSGKLFTWGDGDKYRLGHGDRSSKLKPTCIPSLIDYNFH

SEQ ID NO: 34715 - protein, 187 aa, Sorghum bicolor
  Clone ID: SORBI-28MAY03-C53025_1.pep
MEPSPAAGELGAMLRAAADFASYPGLHSDDTVRQFLERCPLPKLLGALQSEADVPGMVETVTECLDKIFSSRYGASLLPSYGAFIQAGLLTDSKQIRKLACKAVLHLLDKAEDGAAVETVVQHNLFPLMINCLIEGDEEISAIILDTVKRLAQIPKGAEVIFPPDGQGSVQLGKVAAQSSSLPRIRI

SEQ ID NO: 34716 - protein, 165 aa, Sorghum bicolor
  Clone ID: SORBI-28MAY03-C53003_1.pep
AKYKHDVDEVNQRTGGREDGIEFDGTDLIGNTKHLMNAVNSLPELTERKKMIDKHTNIATVLLGHIKERSLDGYCDCENDMLTKGTVDRSALLGLLRGKGTKEDKLRLAVTYLLSFETPVASELEQVEAALREAEVDMSAFQYVKRVKSLNTQFSASSNTATRSN

SEQ ID NO: 34717 - protein, 235 aa, Sorghum bicolor
  Clone ID: SORBI-28MAY03-C55821_1.pep
MDYGNASTGSTAAPEQYNYCRSVSPPSRVSSCSPPPPPPPPPPAVLQVVGNVPPTVVLSPCAACKILRRRCADGCVLAPYFPPTEPAKFTTAHRVFGASNIIKLLQDLPESSRADAVSSMVYEAEARLRDPVYGCAGAVCRLQKQANELKVQLARAQADLLNAQAQHANLLALFCVEMANRRGGNQQQHPSSPLTTTMDGGGGSSGLFGAAYQQTFYDSDLDSANVARSRSPALD

SEQ ID NO: 34718 - protein, 159 aa, Sorghum bicolor
  unsure (1)..(159): unsure at all Xaa locations
  Clone ID: SORBI-28MAY03-C55824_1.pep
MTSSSSTLAKGKSASGSAKFEAKGKFSSSSPAAAAAATKRGTTTSSRGRGKGRGKADKKVYSLPGQKFDPPEEREPLRIFYESLSKQIPSSEMAEFXRAKKAYERKQKRQQQVRMGTPIKSSAVRKDKPESSKKPSTMDSKAKRRVDYSDDDNDFIVKM

SEQ ID NO: 34719 - protein, 115 aa, Sorghum bicolor
  Clone ID: SORBI-28MAY03-C55849_1.pep
MALEKAKEIVASSPVVVFSKTYCPFCARVKQLLAQLGASYKAIELDVESDGADLQSALAEWTGQKTVPNVFVKGERIGGCDATMAMHDGGKLVPLLTEAGAIVTASATATTTPSL

SEQ ID NO: 34720 - protein, 247 aa, Sorghum bicolor
  Clone ID: SORBI-28MAY03-C55863_1.pep
ARGAWRHRAGRPLRTQAAARRQKAPEPARQPSTARASRSGPNDGQVERSWERPVACGSAGEQRAGDGVKRRSSARYSNPELGLTAATDRSTVERGSSSSATGFGQGQGASSEAEPKGLVERVVVIFYDKEHVPIEKFVFKLAVNQSYCSKLEEANLEFALRAFLIKLTVAEPVTKPLPSDGNWEITAYFRSLPGDDDREAQLWIPTDTKLWMQPPQITPIKSVSCDPLKMQLYLEHPSITEPKDPAA

SEQ ID NO: 34721 - protein, 105 aa, Sorghum bicolor
  Clone ID: SORBI-28MAY03-C53094_1.pep
YCFYHSFSPKERVIFPSASTTVYTCWERIFHEVTSHHLVFQPGDCAQDVPGNLRDYACCQFNKVMLPSLTKASCCVFNACCTVHAGSVALSSQLCNIQILYVRGT

SEQ ID NO: 34722 - protein, 139 aa, Sorghum bicolor
  Clone ID: SORBI-28MAY03-C53108_1.pep
TRHRSLDTFFVFTLQSRSSWFDSSELKKVGRRTCIMKAVAAMTMTLLLLALVHHAAGSGHHQGHIWKHDDAGHQYRSSSPLAGLTQCVTICGSGVTSCMLDCYQPLIDLDPVELPVCLLKCTNDAMVCASGCPVNGNGV

SEQ ID NO: 34723 - protein, 35 aa, Sorghum bicolor
  Clone ID: SORBI-28MAY03-C53128_1.pep
IQVRIARIFNTYGPRMCLDDGRVVSNFVAQALRRQ

SEQ ID NO: 34724 - protein, 97 aa, Sorghum bicolor
  Clone ID: SORBI-28MAY03-C53132_1.pep
MVAKMLPSPWISASVLILLLSLHPGVHAFYLPGTFMHTYSSGEVISAKVNSLTSIETELPFSYYSLPYCKPPDGVKKSAENLGEILMGDQIDNSPYR

SEQ ID NO: 34725 - protein, 169 aa, Sorghum bicolor
  Clone ID: SORBI-28MAY03-C53142_1.pep
MADGDGAGAAATGKLAELPSGAEKGLPRRAKASSGRTLNTAQIPLVASHPDVYEPCDDSFALVDALLSDKAQLLTLQPRLCMEVGSGSGYVITSLAIMLRQLGSGAQYLATDINQHAAETTQATLEAHGVHADVIVTDIVSGLDKRLAGMVDVAVVNPPYVPPPVEEVG

SEQ ID NO: 34726 - protein, 195 aa, Sorghum bicolor
  Clone ID: SORBI-28MAY03-C53165_1.pep
HEADVNANQSTKKPPSMRMLRQAATVYTPSAFKMFEREFELYMDCMLYICGEMGTIFEYRISVEDKPRDHFVKFDSVNSMMNCTCKTFQFIGIPCRHMLKVLDTRNIKDLPIQYIVKRWRKDAKSGSSNGGCAFSFDGDPDSAHIKRYNFLCRMFSIAAARAATSAESFAYMENHSNILMDQIEQVIQTRPPGIA

SEQ ID NO: 34727 - protein, 203 aa, Sorghum bicolor
  Clone ID: SORBI-28MAY03-C53158_1.pep
AEIPSRHGPAPLQLSPPQGRPQRSRAGAPRRPVRRHRPGGPPRPPPPRPAPPGAHPDCHGGCIDGGAGAAPPPRRPRAGRAPAALPRLRDGGPDRGGGPRQPLLRKRTMNTTSQIAIVGANVCPIESLDYEVVENDLFKQDWRSRKKKQIFQYIVLKWSLVLLIGLLTGVVGFFNNLAVENIAGFQLLLTSDLMLKGRYIGAF

SEQ ID NO: 34728 - protein, 167 aa, Sorghum bicolor
  Clone ID: SORBI-28MAY03-C52632_1.pep
MDTQPVLAPAIDASASVMCQLLSPEGDPLGAALYLPQNVGTPQLQEIVNQLLHNEEKLPYAFYVGDEELSVQLGAYMRQKNANVEVTLRIVCQPQALFRIRPVNRCSATIAGHTEAVIAVSFSPDGKSLASGSCDTNVRFWDLSTQTPLFTCKGHKNWVLCIAWSPD

SEQ ID NO: 34729 - protein, 168 aa, Sorghum bicolor
  unsure (1)..(168): unsure at all Xaa locations
  Clone ID: SORBI-28MAY03-C52635_1.pep
SLLPPPHGTASHPATTPPSPRPPPVSPPPPAPPLPPPPPSIAAAACPSSPSPSDHTSTISSKXPSFPPIPWTSTPPRPPPTGTAAAAPTPGPSTRSPRPCSSPPSPPPRSSSRCRPTPPGLPRPRRSGSSRTATCSRSTPPTPRPRQPSQPPSSRRSSGHAPGILTLQ

SEQ ID NO: 34730 - protein, 113 aa, Sorghum bicolor
  unsure (1)..(113): unsure at all Xaa locations
  Clone ID: SORBI-28MAY03-C5267_1.pep
RLAAHTDAGRGGGHRTSATWPGIEHTLGDIFTYAVLVQLAMAESMPVPHIVVTNVXVGGGLILNFLNDDGWLPGTLWLLWEDIITVGGLAVLPQVMGTTIVPFIPNSVLPGII

SEQ ID NO: 34731 - protein, 140 aa, Sorghum bicolor
  Clone ID: SORBI-28MAY03-C52747_1.pep
MATTSAAHFLCAPAATTAPLAAAPSPPPPIPPRSRTTDHAAAVPEKGVAIVDSLHRPVLEDTHQAAQEKANNGQLPMGLHGCVDLLDPMATNCSSPASSSPSLASLEQLTADMYAPNLEISLGRQDWSMDRPEGLCLKYL

SEQ ID NO: 34732 - protein, 173 aa, Sorghum bicolor
  Clone ID: SORBI-28MAY03-C5272_1.pep
ERTVGALIANGAASGPLTDPTQQYPSGRTPADLASENGHKGIAGFLAESALTSHLSALTLKESQGGNVEEICGVTAPAAEDFAEPSSSQLACVNSQEESLKDSLGAVRKSTQAAARIFQAFRVESFHRKKVIEYGDDDCGLSDERTLSLISLRNPKPGHGDLHSGAGPIQNKF

SEQ ID NO: 34733 - protein, 334 aa, Sorghum bicolor
  unsure (1)..(334): unsure at all Xaa locations
  Clone ID: SORBI-28MAY03-C53244_1.pep
TRLRSAPLPIRASAVPSARSSATACGRNSSQQQQLADGGQLSLAVPEADEGDTVLPENVHKWRMVIAYDGTKFKGWQYQPSIPTIQYFLEDALICITKLDRKKLCLVGAGRTDXVAHFTTPFSYCCLNSIHSAMNGLLPPEIRVREISAARPEFHARTSTKSKVYRYKIYNEAIMDPFHNRYAYHSAYKLNPHAMQEAANYFVGTHDFTSFANAAHNDRERRSTKKITRFDVTEMGAVLQLEVEGTGFLYRQVRNMVALLLQVGKEALPPDIVPAIIAVRDRKELAKVALSAPPHGLCLMSVNYDEEILKPPEGSPPVSFGRTHHLSKCKLPFY

SEQ ID NO: 34734 - protein, 127 aa, Sorghum bicolor
  Clone ID: SORBI-28MAY03-C53247_1.pep
YHSKDPVVCDVEVLEGIVKVGTPICVRVPSKDSSADVIHALGRISSMKTSNGMQINSASNGVVSIKIIGENPQERSWVYGRHFNSDNELLSQISRKSIDVLKEHYRDEMSDENWQLICRLKKQLGIP

SEQ ID NO: 34735 - protein, 161 aa, Sorghum bicolor
  Clone ID: SORBI-28MAY03-C53273_1.pep
FLWNIDMGDKVNGAVELCGLKLGEMKNVLGKTAYDPNLCAWMSGVNLINLDKWREHNVTENYLLLMKKFKFKDELSLRAAAFPLSLLSFQHLIYPLDEKLTLAGLGYDYGIDEVVARRSASLHYNGNMKPWLELGIPDYKKYWKRFLVRGDRFMDECNVNP

SEQ ID NO: 34736 - protein, 93 aa, Sorghum bicolor
  Clone ID: SORBI-28MAY03-C53297_1.pep
GFIVFIAVWVIQEFTSFHVLKYVILFIGVMNSLFSVYDIYDDLISRRVNTSDAEKFAEICPCPCNGFAWGVIWGFISFIFLCASIYLGLVILS

SEQ ID NO: 34737 - protein, 127 aa, Sorghum bicolor
  Clone ID: SORBI-28MAY03-C53302_1.pep
KGGYIISDNSSGNKPDFILIGTGSELEIAENAAGELRNKGRTVRVVSLVCWELFEEQPEEYKESVLPNEVTSRISIEAGVTFGWEKYIGQKGKAIGIDRFGVSAPAGKIYEELGLTVENVIAAAEAL

SEQ ID NO: 34738 - protein, 352 aa, Sorghum bicolor
  Clone ID: SORBI-28MAY03-C53006_1.pep
MKAQPLLPAALKRRRGPRVAVLALVLCSLLVPLAFLFDRAPSGYVTTEERHRQEVVLPKFDHEEKRRPTGADSGKRQDALEKIIPRSRSGVIHQQTPEKNISKGSTGVIHHQTPEKNISKVLPAPKVEPSKDVTDSTKVAKAPGQEGEKADEVEKAKSCQLEFGSYCLWSIEHKEIMKDHIVKRLKDQLFVARSYYPSIAKLQGQEALTQEMKQNIQDHERILSVSTVDADLPSFISKRMKQMERTIVRAKSCTVDCKNVDRKLRQILDMTEDEAHFHMKQSAFLYNLGAQTLPKSHHCLSMRLTLEYFKSSSLDSDDSPGKFSSPEYRHYVILSRNVLAASVVINSTVSSS

SEQ ID NO: 34739 - protein, 140 aa, Sorghum bicolor
  Clone ID: SORBI-28MAY03-C53026_1.pep
TRPHPLGAACPPARSRRGIRPPPAPSPDAPPNLDYSIALEYDGPPVPYDLPRVDPVQIPAIPTAEPVSGSQVLGALPVAPVVQPIRLPVSRIARCADPVAAQPAGSSESVLHNQEFSDDDDQADDSRSQSHGSAQTSPGP

SEQ ID NO: 34740 - protein, 148 aa, Sorghum bicolor
  unsure (1)..(148): unsure at all Xaa locations
  Clone ID: SORBI-28MAY03-C53060_1.pep
QIKDAVRDGLRSVKNTIEDEAVVLGAGAFEVAAKKHLIDNVKKTVKGRAQLGVEAFAEAXLLVIPKTLAENSGLDTQDVIVSLQNEHDRGLVVGLNHHSGEPIDPQMEGIFDNYSVKRQIINSGPIIASQLLLVDEVIRAGRNMRKPT

SEQ ID NO: 34741 - protein, 93 aa, Sorghum bicolor
  Clone ID: SORBI-28MAY03-C53088_1.pep
LVALGEVVGTENRGLSADTLASLPSVTYKMQDVQDGNTEQCVICRVELEEGESLIALPCKHLYHPECINQWLQINKVCPMCSAEVSTSGNKEP

SEQ ID NO: 34742 - protein, 112 aa, Sorghum bicolor
  Clone ID: SORBI-28MAY03-C53449_1.pep
KGGCLSLLCDFFDCWCTRGLASSYCTRTSGYQGCWCIYFIGYHIDSWVHGLYPSEDHARQSHQHVDVSFTFHRYDDYYLLFVVQICMAKQLLSGRNQTRLIHVRVQLPGLQR

SEQ ID NO: 34743 - protein, 120 aa, Sorghum bicolor
  Clone ID: SORBI-28MAY03-C53479_1.pep
HSTQNDSQKLDKDLLDKRVKKKVAAVNSALRGWSNTVFDSLKLPATEVAEFFYDEPNVLELEPEILPDISWRLTSSADDKAKMAEDRLDELDQYPSLENKPVMFELRDEDKPAIPPLGVY

SEQ ID NO: 34744 - protein, 80 aa, Sorghum bicolor
  Clone ID: SORBI-28MAY03-C53482_1.pep
IIVPNNILFVQNLPHETTPMMLQMLFCQYPGFKEVRMVEAKPGIAFVEYGDEGQATAAMNNLQSFKITKENQMVITYAKK

SEQ ID NO: 34745 - protein, 113 aa, Sorghum bicolor
  Clone ID: SORBI-28MAY03-C53511_1.pep
NLNDPKLADNVNYACSMADCTSLGYKTSCGMLDTRGNISYAFNNYFQKNDQDDVACGFQNLATTTGQDPSTGTCRFGIMIEVDSAFSWRLQGHGSNLLLILLLVLLQLFLSFS

SEQ ID NO: 34746 - protein, 182 aa, Sorghum bicolor
  Clone ID: SORBI-28MAY03-C53512_1.pep
HPFFERAVAYLLLHLWHHYPLLQVAVLSRARHPNITTLVGVCPDNFALVYEFFPNGSLEDWLSCKKNMPPLTWKARTRIIGEICSALAFIHSHKPYPIVHGDLNLGNILLDANFVSKLGGLGICYFLREPDITITSLQSHPTETHKGTLYYMDQGEFKSAAELMLWSDVNSFGIIILRLLTG

SEQ ID NO: 34747 - protein, 127 aa, Sorghum bicolor
  Clone ID: SORBI-28MAY03-C53520_1.pep
TSEWFGLEASLLTLGLTIGALSFVLEPSPKTARRMFYGSLLYLPAFMAGLLLHRLPNEQKVHNLAEKTDLAEKSELDGVLYGADLQDKERSQQKPRDRKPSRLQSRPPVAYASVAPFPFLPVPIYES

SEQ ID NO: 34748 - protein, 91 aa, Sorghum bicolor
  Clone ID: SORBI-28MAY03-C53196_1.pep
KGLGSKYARIELEEMVQVALLCTQFLPGHRPKMSEVVRMLEGDGLAERWEASQHTESHKFKVPEFSFSRCHFDLTDDSSLLVQAVELSGPR

SEQ ID NO: 34749 - protein, 155 aa, Sorghum bicolor
  Clone ID: SORBI-28MAY03-C532_1.pep
MLTVCMTYDYARHQHVYHESHAAASMRVDTITLQPFTFDEWDAHARRSAGKSRQRTVKVVAMGAADGKPMAHANVSIELLRMGFPFGNAATKEITELPAYEKWFTSRFTVATFENEMKWYSTEWTQNHEDYSVADKMLSLMQRHGIKVRGHNVFW

SEQ ID NO: 34750 - protein, 143 aa, Sorghum bicolor
  Clone ID: SORBI-28MAY03-C53211_1.pep
GRVYFVILEMSPVTYIDSSAVQALKDLHQEYKARHIQIAIANPNQQVHLLLSRSGIIDLIGAGWCFVRVHDAVHVCLQHVQNSSSNALKLAVQASGELSDSVSTPKPEKQHRKYYGFFKNLWKARDYAHADGEVQPLLRQNLV

SEQ ID NO: 34751 - protein, 162 aa, Sorghum bicolor
  Clone ID: SORBI-28MAY03-C53215_1.pep
AKTVAEKEAWRLAKEHGIDLVVVNPSFVIGPALGPKPTSTILIVLAMLKGELGKYPNTTIGFVHVDDVVLCHVLAMEDARASGRLICSCDVAAHWSEILESLRERYPQYPIPRECSSSQKGDDRPHRMDTSKVKALGFPPFLSVHQMFDDCIKSFQDKGLLQ

SEQ ID NO: 34752 - protein, 111 aa, Sorghum bicolor
  Clone ID: SORBI-28MAY03-C53621_1.pep
IEVAWKSGVMPCDGRQCSKTQGEVVRVNCIMGSDKSSCSRTRSGLVRKKGIFALSRASCSRTRSGLLRAKSFVDSSDVSSSRTRSGLLRIKRFVDSRDGSCSRSQSDHVKK

SEQ ID NO: 34753 - protein, 181 aa, Sorghum bicolor
  Clone ID: SORBI-28MAY03-C53619_1.pep
TRGGPPYTFLAGSLPEAKRLLMAGRRGVPPLDAACHDIMPVLLPQFHRWVADYGRTFLFWIGPIPALLSTDLQLIKQVLTDRTGLYQKDFMIPVLKFLFGNGVILINGDDWKRHRKVVLPAFNHETIKSMSAVTAEVTKQMMRQWREQIIIQGSGDKESAEIDMIHAFNDLTAKVNGRVAF

SEQ ID NO: 34754 - protein, 285 aa, Sorghum bicolor
  Clone ID: SORBI-28MAY03-C53631_1.pep
TRVPGLLVIDTPGHQSFSNMRSRGSSLCDIAVVVVDITRGLEKQTMESLDLLKHRNVRFIVALNKVDRLYGWKTFISAPIAKALKNQTDDVQREFKWRVTEVITQLMEKGFNAALYYENKKLKQVVNIVPTSAVSGEGIPARLMLLVRWVPKIMMERLTYVNTVECTVLEVNEDKDFGTTIDVVLINGALRKGDRIVVCTKQGPVATNIRYLLTPSPMKELKVKGVYKHHEELKAAQGVKIAVLGLQHAMAGTSLIVVKPGDDMERAEAAAMQEISKAISLINGD

SEQ ID NO: 34755 - protein, 208 aa, Sorghum bicolor
  Clone ID: SORBI-28MAY03-C5368_1.pep
QETDCAQQEAIDLKSKLQSKEAEIEKLKFEHLKITEEHCDLINQNHKLSEEAAYAKELASSAAVELKNLAEEVTKLSVLNAKQAKELLVAQEMAHSRVHGRKGRATSRGRDEVGTWSLDLEDMKMELQARRQREAALEAALAEKELLEEEYKKKFDEAKKKELSLENDLAGMWVLVAKLKKGALGISDLNVDDRTVNLADITNGTKEN

SEQ ID NO: 34756 - protein, 160 aa, Sorghum bicolor
  unsure (1)..(160): unsure at all Xaa locations
  Clone ID: SORBI-28MAY03-C53755_1.pep
PRRVAGGGRSPGRRRRGRARAPAPPAPPPPAPPPPPPPRXGGAAPPSSPPPPPPPPSLLAPRLPPLAVCSAPPASSSRAALPSPPPPSSPPPPRPCPPAAARASLGPPPHYRAAPSPSPLPSPPAASPSPTPSPPVGARSAAASTGVRARPPVSQEYHSC

SEQ ID NO: 34757 - protein, 257 aa, Sorghum bicolor
  Clone ID: SORBI-28MAY03-C53820_1.pep
ARGIADVLDTFHVLAELPSDSFGAYVISMATAPSDVLAVELLQRECHVKKPLRVVPLFEKLADLEAAPAALARLFSVEWYRNRINGKQEVMIGYSDSGKDAGRFSAAWQLYKAQEELINVAKMYGVKLTMFHGRGGTVGRGGGPTHLAILSQPPETIHGSLRVTVQGEVIEQSFGEEHLCFRTLQRFTAATLEHGMHPPISPKPEWRALMDEMAIVATKEYRSIVFEEPRFVEYFRLATPEMEYGRMNIGSRPSKRK

SEQ ID NO: 34758 - protein, 98 aa, Sorghum bicolor
  Clone ID: SORBI-28MAY03-C53813_1.pep
MGSSVGCLLGGSKSRQDSSPRSGHVLSRAGNNVQVFSLNELKTATRNFHMLNCIGRGGFGAVYKGNLKDGTQIAIKKLAAESKQGISEFLTEINVISN

SEQ ID NO: 34759 - protein, 141 aa, Sorghum bicolor
  Clone ID: SORBI-28MAY03-C53333_1.pep
IPFTIFAAVYCVLFGLVAAVGLSFLQFTNMNSMRNLFIVGVSIFLGLSVPEYFFRYTMAAHRGPAHTKAGWFNDYINTIFSSPPTVGLIVAVFLDNTLEMKDAGKDRGMPWWLRFRAFKGDSRNEEFYSLPFNLNRFFPPA

SEQ ID NO: 34760 - protein, 116 aa, Sorghum bicolor
  Clone ID: SORBI-28MAY03-C53354_1.pep
GGEDMKPHQSDSDKLTCVNSSDILPCEYRLLSWQTSRSKLRKASSFVHAYNSVGSYFLCRLIRYFAHYDCQRWQCTDGTRMRVRACRLLWALACQSYTSSCSFRHWPFGSCPHLSH

SEQ ID NO: 34761 - protein, 136 aa, Sorghum bicolor
  Clone ID: SORBI-28MAY03-C53386_1.pep
LRVARDYGLVDKPSVTIPMSLWWVVPQFILSGLADVFTMVGLQEFFYDQVPDGLRSLGLALYLSIFGLGSFISSFLVYTIDKVTSREGDSWFSDNLNRGHLDYFYWLLAVLNVLGLAAYLYFSQVYTHKRKGVLAQ

SEQ ID NO: 34762 - protein, 133 aa, Sorghum bicolor
  Clone ID: SORBI-28MAY03-C53396_1.pep
MEVAQGGAEEPAMKLLFVEMGVGYDQHGQDITAAAVRACKDAITSNSIPAFRGGSIPGVNTDQMKLQIKLGVPRSTQHLLDAERVKAVFPYGKIISFEVVDGGMICSSGVCLEAMGDKNDDCYIVNAAVYVGY

SEQ ID NO: 34763 - protein, 299 aa, Sorghum bicolor
  unsure (1)..(299): unsure at all Xaa locations
  Clone ID: SORBI-28MAY03-C53438_1.pep
TRACEDFSNIVATYPQYTVYKGTLSSGVEIAVVSTMITSSKDWSKHSEGRFRKKXSLSRVNHKNYINLLGYCEEEEPFMRMMVMEYAPNGTLYEHLHVEGFDPIDWNGRMRVIMGVAYCTLHMHELSPPITHPDIKSSAILLSEDGAAKIVDMSVWHEVYSRGNMPKDDDLVDHHERVAADPAGNVYSFGLLMLEIISGKPPYSEEKGSLSNLALECIRDNRSMSCLLDPNLKDHKEKDLEIICDLVQDCIQSDPKKRPTMREVTTRLREVLSISPEAATPRLSPLWWAELEILSVEAS

SEQ ID NO: 34764 - protein, 238 aa, Sorghum bicolor
  Clone ID: SORBI-28MAY03-C5391_1.pep
RLRVALGAARGLAYLHELADPPIIHRDVKSSNILMDEHLTAKVADFGLSKLVSDSERGHVSTQVKGTLGYLDPEYYMSQQLTEKSDVYSFGVVMLELIVAKQPIEKGKYIVREAKQVFDADDAEFCGLKDMVDARIMNTNHLAAFGKFVQLALRCVDEVATARPSMSEVVKEIEMMLQSEGLSSASTSASTSATEFDVTKGAPRHPYNDPLPKKDKDVSTDSFDYSGGYSFQSKVEPK

SEQ ID NO: 34765 - protein, 184 aa, Sorghum bicolor
  unsure (1)..(184): unsure at all Xaa locations
  Clone ID: SORBI-28MAY03-C53919_1.pep
SFIAVPRFSPEFGYSSPSSSFASGLLASNRQRGAWRWLLAAVSTSPPPRPPQPAPPTGSRPPHRXRRTPATMTSVRPSSPRARRLPPPPPPPTQRRPPATCSTHGPSRGTRNHTPTSTLRWHSPLPPAPSPPLRRSPATLPCRRPPSPPAPRGPPPPPPPPPRILVLDPASLLLAPPWPVHLGS

SEQ ID NO: 34766 - protein, 99 aa, Sorghum bicolor
  Clone ID: SORBI-28MAY03-C53950_1.pep
GEDHTRRIQNFREGSTPRSKWFSSTSGNLKMITSNCTSSITCYNLYHIVTNSNAYCLQIIYITVNTQNCTSYQPYQLIGGPGVLVFCFFFPSRSNLSTQ

SEQ ID NO: 34767 - protein, 132 aa, Sorghum bicolor
  Clone ID: SORBI-28MAY03-C54004_1.pep
SDTPHLQLNKMASNGNGNLKADIEPVESIASDNVPGATGINNLASQGVSERGKRWSGFRNFWKRLCTGPQLKKFGSSTSFRFQQIAIQRDEFSRSIHSDNHVSHEHFQFIRRINWEQLWLMAKNWIKEPMNM

SEQ ID NO: 34768 - protein, 91 aa, Sorghum bicolor
  unsure (1)..(91): unsure at all Xaa locations
  Clone ID: SORBI-28MAY03-C54047_1.pep
LTTGPSRFASSTEDASPPSYFICPIFQVLYXSPHPXMAADGFTYEAEAIRGRLGGASRSPTTTLRLAHRKLTPNRALRSAILEWQQKQHGR

SEQ ID NO: 34769 - protein, 66 aa, Sorghum bicolor
  Clone ID: SORBI-28MAY03-C53559_1.pep
TPRRPALAPPLLQHSDVHMMDAVSDEFAFGSSTNGAQQAAGLVRAWEGERIHEDSGSDDLELTLKL

SEQ ID NO: 34770 - protein, 96 aa, Sorghum bicolor
  unsure (1)..(96): unsure at all Xaa locations
  Clone ID: SORBI-28MAY03-C53580_1.pep
KLFGEARRSGRLNRWRRKYKDFIKSFDIPLKTIVLKQYRGIRSQVNFASFFLLNARELESMRLEVGASXAMRLFLQNNMRCFRWRKGHREVHGYIL

SEQ ID NO: 34771 - protein, 131 aa, Sorghum bicolor
  Clone ID: SORBI-28MAY03-C53592_1.pep
VSDLSSPSELMGDSDPGISMLPVSSSGEDPRPTCNSCARTAESPRLRMDGCTRTAESLLLCCRVDVDAWTLETGDLESWTQGGMVDPPSCYLLAAVRVRSAAVALALAWSAAARLGAPLGAGAGWTDGVAV

SEQ ID NO: 34772 - protein, 159 aa, Sorghum bicolor
  Clone ID: SORBI-28MAY03-C53604_1.pep
MPEYCVTGGTGFIAAHLIRALLAAGHSVRATVRDPEDEGKVGFLWELEGAGERLQLVRADLMVEGSFDDAVSGVDGVFHTASPVVVVGKDNKDVQETLVEPIVKGAANVLRSCARAAAPDERPRRVVFTSSCSCVRYCHAATLNESHWSDADYCKSHDL

SEQ ID NO: 34773 - protein, 119 aa, Sorghum bicolor
  Clone ID: SORBI-28MAY03-C54196_1.pep
MAQGRGSATRGLALGGLLAVCLLLGVADAATHRVDWSFNADGWSKGKSFRAGDVLEFNYDPSVHNVVAVDAGGYYGCRPSGTSYGSGSDRITLGSGTSYFICSLNGHCGMGMKMIVNAS

SEQ ID NO: 34774 - protein, 90 aa, Sorghum bicolor
  Clone ID: SORBI-28MAY03-C54199_1.pep
KSTRGWKERWFTQNSTISNLGSEMRREVNAGIAAVSRMMEKLETRDGTGPSSASPANLHPGSDADSQGAVVVPLPPTAATALHNASSSTA

SEQ ID NO: 34775 - protein, 134 aa, Sorghum bicolor
  Clone ID: SORBI-28MAY03-C54221_1.pep
QKLKKLLESQSANEDDKPSDPTQDDHPSPMEFIAKQKMERTAKLNELLGKLTRARSEDDLKPCRDLIEQLFGKENCASVDKPDRMETEAGDQEPTAAVARPYSIPKLCTRMEVDEDLASKINDELSSLGHVVQL

SEQ ID NO: 34776 - protein, 140 aa, Sorghum bicolor
  Clone ID: SORBI-28MAY03-C5423_1.pep
MAAAAMRVVRDLDLERYAGRWYEIACFPSTFQPKTGTNTRATYTLNPDDGTVKVLNETWTDGGGRRGHIEGTALRADPASDEAKLKVRFYVPPFLPVFPVTGDYWVLHVDADYQYALVGQPSRKYLWILCRQPQMDESVY

SEQ ID NO: 34777 - protein, 47 aa, Sorghum bicolor
  Clone ID: SORBI-28MAY03-C54246_1.pep
IVMIGTLTGAQWGIYDAFKVMVGLPTTGGVTPAPAPATEEAALKASA

SEQ ID NO: 34778 - protein, 132 aa, Sorghum bicolor
  Clone ID: SORBI-28MAY03-C5427_1.pep
KKLFSNSPEGSKLVKRSDETVLSGRLHLGDEDEGIGVSSFKGSSDYSCASSVTDEEGREMKAPGVVARLMGLDAMPTSGVPEPYCTPFRDTRSFRDSHSLKRSPEYSMNDQFGHVPRRVDGYIRKPLDLRAP

SEQ ID NO: 34779 - protein, 155 aa, Sorghum bicolor
  unsure (1)..(155): unsure at all Xaa locations
  Clone ID: SORBI-28MAY03-C53856_1.pep
MDAAAEPLLPQPATALDHLGRPVSRHTTGRWSAAVFIIGVEISERFAFGGISGNLITYLTGPLGQSTASAAAAINAWSGAALILPLLGAAVADSWLGRYRTIISASLLYILGXLGMLTLSSIFVPQQPAQFGDSIGSSISSMGIHLAFFYVSLYI

SEQ ID NO: 34780 - protein, 191 aa, Sorghum bicolor
  Clone ID: SORBI-28MAY03-C53844_1.pep
TREYSGQKMVRELESDPHLFSCILPEGNLKVKEIYHFTQDDLMTEDVFILDCHTSIFVWVGQQVDVKVRLQALDVGEKFIVLDFLMENLARETPIFTVMEGSEPPFFTRFFTWDLAKSLMHGNSYQRKLAIVKGGGAPALDKPKRRTPVYSGRSTTQDKSQRSRSMSFSPERVRVRGRSPAFTALAANFGS

SEQ ID NO: 34781 - protein, 81 aa, Sorghum bicolor
  Clone ID: SORBI-28MAY03-C53861_1.pep
MAVWCSCSAVLPVLFCFMICQLCYGTVTDIQCLKKLKASVDPDNKLEWTFNNNTEGSICGFNGVECWHPNENRVLSLHLGS

SEQ ID NO: 34782 - protein, 204 aa, Sorghum bicolor
  Clone ID: SORBI-28MAY03-C53906_1.pep
TRKNPIEPIVYPPLKSVGSHAQAEISARAWNPKFQHIVASTSSNGMTVVWDLRNQKPLTSFSDSNRRKCSVLQWNPDMSTQLIVASDDDNSPSLRVWDVRKTISPVREFVGHSKGVIAMSWCPYDSSFLLTCSKDNRTICWDTVSGEIISELPASANWNFDLHWYRRIPGVIAASSFDGKIGIYNLEFSGLYAAGDAVGAPARP

SEQ ID NO: 34783 - protein, 165 aa, Sorghum bicolor
  Clone ID: SORBI-28MAY03-C54302_1.pep
TQSSKKKKKKKKTLCGKKIHLLSLLLSPSPPKIFHLEPSLSANSLPPDRRRFFFLDFLRFFEVFFGAGGGSIAIPRRGLPGGWAAARGHGEVSDDEAGAAAAAVTVAGETVVPSSPPPASAAGQQQQQPQQLVVGYALTKKKVKSFLQPKLLALARKKGIHFVSI

SEQ ID NO: 34784 - protein, 141 aa, Sorghum bicolor
  Clone ID: SORBI-28MAY03-C54391_1.pep
MEKHSSAAAFVEGGVQDACDDACSICLEAFSDSDPSAVTSCRHEFHLQCILEWCQRSSQCPMCWQAISMKDPMSQELLEAVEEERNAQENHARTTTIFRHPLLGDFEVPAVAVAAQCGQRLALRLAAAAAARCPHRHACHV

SEQ ID NO: 34785 - protein, 207 aa, Sorghum bicolor
  Clone ID: SORBI-28MAY03-C54308_1.pep
YTAKVSDFGASILAPNDKSQFVTVVQGTCGYLDPEYMQTYELTDKSDVYSFGVVLLELLTGKKAFNLEGPENDRSLSMRFLYAMKENKLEDIVDDQIKNSENLEYLEEIAELARQCLETGGARRPTPKEAGATRGRTRATRPAPGAHAKRGARARRRGARTGVSTPGASGRGSSTRRGATGLGTGRKRRPRTVRIPRTSPCRIPAAR

SEQ ID NO: 34786 - protein, 152 aa, Sorghum bicolor
  Clone ID: SORBI-28MAY03-C54415_1.pep
GLACRRFWPKIHFSTQILKAQSREKAPALITLNSQAVSVDPRLTPVRPFFLSPERDTTTCRRQLPPREDDATRTAGRRAAVEGTAPARPIPDLLLSDSPVALRAAAALRFAGCVQRNLTSPSAPQGSLTLTPACDAPPGLQLTPCQLVPVSL

SEQ ID NO: 34787 - protein, 138 aa, Sorghum bicolor
  Clone ID: SORBI-28MAY03-C54418_1.pep
ARGMDKAEDAEPTCISSVQKETGHKVMDALEQQDALLKKTKSLLVPSVLNHHDDIPGEADNYMDALNTLESETETESEFQTKNQGVPAPSFNAEAPQVGAIDNIVPQCPDSYVADFTDTCQESGILCASERAIDFPSL

SEQ ID NO: 34788 - protein, 140 aa, Sorghum bicolor
  Clone ID: SORBI-28MAY03-C54430_1.pep
ARGFKAISPHYIVRFFLRNKKEGWRMLGGTVLCITGAEAMFADLGHFSKKSIQIALLASIYPSLILTYAGQTAYLINNVNDFSDGFYKFVPRPVYWPMFIIATLAAIVASQSLISATFSVIKQSVVLDYFPRVKVVHTSQ

SEQ ID NO: 34789 - protein, 86 aa, Sorghum bicolor
  Clone ID: SORBI-28MAY03-C54080_1.pep
YESTALLIVSSFIHVRKKIDQQNWCLIYFTALTWYMMVVLDLSYWVFPSGRVCFARSMALACSTGLDPSKVMGVLRALVYFSAELE

SEQ ID NO: 34790 - protein, 136 aa, Sorghum bicolor
  Clone ID: SORBI-28MAY03-C54077_1.pep
ARTFTASETRIVAPLVQLLDEREPPVIKEAVVALTKFACTENHLHVNHCKAIVDDGGARHLVQLVYLGDEVQIEALILLCYIALYVPESEELAQAGVLAVLLWASKQAHMVQDTRVEVLLPDAKARLELFQSRASR

SEQ ID NO: 34791 - protein, 169 aa, Sorghum bicolor
  Clone ID: SORBI-28MAY03-C54087_1.pep
PGVNELDMEVDRHGDPDDDEVYEYDYHFGGVPLFGSAGTEASNPSSSQAHADMINIRDYTVSTTTGGYHHQEFGYSGTRPNYNRGRRGRRNRSRASTDHLLSADEMMVMPGSSGFVHNNNGSSSNVSAGAAFQPNHGWTERRGRSNRNSNSGGGRGGMQDRRRQRTHYN

SEQ ID NO: 34792 - protein, 81 aa, Sorghum bicolor
  unsure (1)..(81): unsure at all Xaa locations
  Clone ID: SORBI-28MAY03-C54162_1.pep
KEISRHHLDFYQYTCRTAVDLYHSQMQEITKQHIGFYCNICTRHQSQRLGEKVMXILXSLQNFNMNAHYLQKTAQSNHNSC

SEQ ID NO: 34793 - protein, 80 aa, Sorghum bicolor
  Clone ID: SORBI-28MAY03-C54187_1.pep
HIKCLIITLRLEVCHSCYGCSSSTTRGKKRQTTGAHLNYGKNVQAISTTKDRFWQSQSLVQQFLLWCHRGIYICIIATRK

SEQ ID NO: 34794 - protein, 104 aa, Sorghum bicolor
  unsure (1)..(104): unsure at all Xaa locations
  Clone ID: SORBI-28MAY03-C54606_1.pep
AKLYEKSGFRYPLQMPYRSLPRCRTGXDAKFQAPVFMVMGEKDYCFKFPGFETAMRSGIMNNFMPDLKITYIPEGSHFVQEQLPEQVNELLLDFLKAKGHPVAS

SEQ ID NO: 34795 - protein, 141 aa, Sorghum bicolor
  Clone ID: SORBI-28MAY03-C5465_1.pep
LGKNITLNAKTFGETKVKSMILHWDKEQASEILNTFDIIVASDCTFFKQFHEGLARTVKSLLKHSTTSQAIFLSPKRGDSLDKFLGVIKENGLCCELIENYDPTVWNLHKKYVAGEDRTWPNYDKEHCYPLLVRISYFSEI

SEQ ID NO: 34796 - protein, 156 aa, Sorghum bicolor
  Clone ID: SORBI-28MAY03-C54674_1.pep
HEGPLLALSLSPPSPAPPRPEVLNLKKDKDAKEAPLTKEEVGRATWMLLHTIAAQFPDEPTRQQKRDAKELMHIISRLYPCKECADHFKEVLKSNPVQAGSQAEFSQWLCYVHNVVNRSLGKPIFPCQRVTARWGKLHCPERSCDLEGNIDIMPNR

SEQ ID NO: 34797 - protein, 85 aa, Sorghum bicolor
  unsure (1)..(85): unsure at all Xaa locations
  Clone ID: SORBI-28MAY03-C54676_1.pep
MENSYCRWVLVCSVLALCLGSRGARCELTPNFYHSTCPQLYYIVRHHVFVAMRAEMRMGAYLLRLHFHDXFDNGCDGSILLDGCD

SEQ ID NO: 34798 - protein, 111 aa, Sorghum bicolor
  unsure (1)..(111): unsure at all Xaa locations
  Clone ID: SORBI-28MAY03-C54677_1.pep
KKHLELGYNFDPKAYIDTWIAAASRRNKTTSTSWRCRRSTATSSSSSWTHPSPPRTQAANSLVRWPTSSTATSTVGSTATRRTTTSTRTRTARTAXASTAAYXPTSTSTGA

SEQ ID NO: 34799 - protein, 252 aa, Sorghum bicolor
  Clone ID: SORBI-28MAY03-C5470_1.pep
DHEVVEVEARRNPALVAAAATEIDRGSRGGLGLEPTSVSSLRRAASAGTDTEKLGLIQVASLIESSARKGTTELNLRGKLVDQVEWLPVSLGKLQDVTELDLSENRIMALPSTIGSLRYLTKLDLHSNQLINLPDTFGELSCLIDLDLRANQLKSLPTSFGNLTSLANLDLSSNLLKVLPDCLGKLKNLRRLIAETNELEELPYTIGSCTSLVELRLDFNQLKALPEAIGKLENLEILTLHYNKIKGLATTI

SEQ ID NO: 34800 - protein, 267 aa, Sorghum bicolor
  unsure (1)..(267): unsure at all Xaa locations
  Clone ID: SORBI-28MAY03-C57175_1.pep
ARGSYSHPVQNLINQSRKYDLFPFEKVRVERSGXQTTSSTTDGTVNANTVDFHPLLRKXEVDVHNEIAEHDNNLDYHQSDNNMSEVPVDDQSTAGQASTSPSERETSIDLNIQLGAPMAIKDTNDFRSSFSRPNVQVDVFRKDKSSIPELEVVNSYFHHCIQEPNEESMQGIVMEQEELSDSEEDSQHVEFECEEMDDSEEEQVQGPETSPIQNKGISASAVFGEFHVSTDQSQIQQGSVQKDKQGASSIQKMQVPSRSVRAKLKPE

SEQ ID NO: 34801 - protein, 206 aa, Sorghum bicolor
  Clone ID: SORBI-28MAY03-C57189_1.pep
HEDYLVAWVKVCRPPELGGLGISDLKSLGWALRMRWVWLQKTEPHRPWAALPVHVPDQVRAFFSVAVESIVGNGANTLFWTDRWLHGKCIADLAPRLFSVIPKRRVKQRTVQDALTNHAWTSDIRGALTVGVFAEYFQLWDLLIGFQLLPEVEDKHVWRLSSNGQYSAKSAYDGFFLGSTIFGPWERIWKSWALPKCRFFMWLVAH

SEQ ID NO: 34802 - protein, 96 aa, Sorghum bicolor
  Clone ID: SORBI-28MAY03-C57192_1.pep
SQSIEQEDGFDWNSLLPDTIIDEILSPTPSRMPLTPKPFPPDGTISGAQALSTLMAATPSPLISSPASSPPTAYMSPHNAYGSTHHYGCLAPIPRP

SEQ ID NO: 34803 - protein, 217 aa, Sorghum bicolor
  Clone ID: SORBI-28MAY03-C57194_1.pep
MAMMSRTRDLLVEGFEGLVRDGSFKWGPRRGDTALDDGDDDDGSLSVQRSSIPGLSFKATAVVARCSRILGVSINDLRSNFDKQASDSVKQQRSYARNFLEYCCFMALAQISQVTGYLADKNFRRLSFDMMLAWEVPSSSSQLTVKVEVDSTVSLEAFTRIAPAIPTIADVVTCANLFDVLSCSTGGRLSFSVYEKYLSELDRAVKKMKTQSESSLL

SEQ ID NO: 34804 - protein, 76 aa, Sorghum bicolor
  Clone ID: SORBI-28MAY03-C54839_1.pep
TAPWTRSPASARGAGTWTAWSWPWPWSGRSRTTGRAAASRLSPATEGRLARRSRCMPARCGSELSVTVRRVHVSVF

SEQ ID NO: 34805 - protein, 241 aa, Sorghum bicolor
  Clone ID: SORBI-28MAY03-C54861_1.pep
HEAVQPDPVAADILRKEAQQESFIKMLTTPEEIPTADEIEVFKILQKCLELRDSYLFREEVTPWEKEAINDPCTPKPNPNPFTYVPEPKSEHVFQMVDGGARVYADKDCTESIYPVADATTFFTDLHYILRVTAAGNTRTVCHNRLNLLEHKFKFHLMLNADREFLAQKTAPHRDFYNVRKVDTHVHHSACMNQKHLLRFIKSKLRKEPDEVVIFRDGTYMTLKEVFESLDLTGYDLNVDL

SEQ ID NO: 34806 - protein, 105 aa, Sorghum bicolor
  Clone ID: SORBI-28MAY03-C54877_1.pep
LGSIVLQRWPRAGEEEGPASHGDESTALVAKDDLPVASTPPAAGGSSSARACVCGCRSQAVSLASLSGSHPSCQARLFFSLISSLAALQCSGSSAWMQHENNVTD

SEQ ID NO: 34807 - protein, 152 aa, Sorghum bicolor
  Clone ID: SORBI-28MAY03-C54891_1.pep
PKSVNHKFNFNFIHFANNSAIMYNSARMMKPKLSLSISAAQNATRPSLSLKSPITLKSPSALPRTPISPMSAASPSSKMFSTLQVPNYAYTNSCSSKSILKKQPSSGAAVDKRIQFQVTPTVHCVTPIENPDEYYGKHMKMSREERRWTVRQ

SEQ ID NO: 34808 - protein, 193 aa, Sorghum bicolor
  Clone ID: SORBI-28MAY03-C54906_1.pep
LDFEHNVRPAPVITEEVTASLEEMIKKRITESLFDDVEKPTMLPSKAPKEHKELDETKSKKGLAELYEDDYAQKAGIAPAPLSISDELKKEANTLFKRICLKLDALSHFHFAPKPVIEDMSIQANVPALAMEEIAPVAVSDAAMLAPEEIFEGKGDVKEEGELTQAERKRRRANKKRRYAASHKERPAKLQKD

SEQ ID NO: 34809 - protein, 101 aa, Sorghum bicolor
  Clone ID: SORBI-28MAY03-C54931_1.pep
NIVEYIEIISKVLKDGGVWINLGPLLYHFADSYGPVDVLSSEATLGAGLSAAYRLRSPLALLVLSVTACPSCTSAVLQNRYHAAFWTMRKDASRSKACKPR

SEQ ID NO: 34810 - protein, 123 aa, Sorghum bicolor
  Clone ID: SORBI-28MAY03-C54434_1.pep
MRRATPPQPQPSPSPEIRYRGVRRRPSGRYAAEIRDPAKKTPIWLGTFDSAEAAARAYDAAARSLRGPTARTNFPSAAAPVPRHRAPSASAAAAPAAAAAATSSHSSTVESWSGGAPRAPSAL

SEQ ID NO: 34811 - protein, 99 aa, Sorghum bicolor
  Clone ID: SORBI-28MAY03-C54466_1.pep
MVLITLVRGYIDRMLHDIPGMKVLVLDPQTVGMVSVVYSQSDLLRKEVFLVETMDNASSSRESMAHLKAVYFLRPSADNVQKLRRHLAMPRFAEYHLFF

SEQ ID NO: 34812 - protein, 176 aa, Sorghum bicolor
  Clone ID: SORBI-28MAY03-C54578_1.pep
MYRASNFVPDPNQVLLDAKPLRSLAPMFPAPMGVNVNQSSTPPLVCVTPVGQFPAGFGAGNLPAFGSFTTFSATANGVSYTGTSANGAIDATPISAYKTRTGISLGDDELYSGNQTLVTKRKRGRPLGSGRNGPNGKVKRPKPTYKNFVAGKELAFLSSSSDPREIVESVHMAFEA

SEQ ID NO: 34813 - protein, 314 aa, Sorghum bicolor
  Clone ID: SORBI-28MAY03-C54601_1.pep
IKSEGNMGVPQRSLPMDPSSLYGQGIIQPKPGLSGAGLNQGVSGLPLKGWPLTGIDQLRPNLGAQMQKPFLSTQSQFQLMSPQQQQQYLAQAQAQGNLGNSTNYGDIDPRRLTALTRGGLNGKDGQPAGTDGCISSPMQSSSPKVRPDQEYLMKMQQTSSQQPQEQLQQQQQQHQNQQQQQSQQQQMQQNNRKRKQPTSSGPANSTGTGNTVGPANSPPSTPSTHTPGDGLGMGGNMRHVPKNLMIYGADGTGLASSSNQMDDLEQFGDVGSLDENVESFLSNDDGDPRDIFAALKRSPAEPNPATSKGFTFSE

SEQ ID NO: 34814 - protein, 66 aa, Sorghum bicolor
  Clone ID: LIB3476-006-Q6-K1-D8.pep
QSSLGYLFGSDEAPKSAEKPAPQKPAPPSSAEKLKDIPAGIQSSKSNNYIRAEGQNCGNFLTVSIH

SEQ ID NO: 34815 - protein, 106 aa, Sorghum bicolor
  Clone ID: LIB5052-011-A1-XP1-G6.pep
LKSFGKMGRGVSTGGGQSSLGYLFGSDEAPKSAEKPAPQKPAPPSSAEKLSDIPAGIQSSRSNNYIRAEGHNCGNFLTDRTSTKVRAAPGGGSSLDYLFSGSKDGK

SEQ ID NO: 34816 - protein, 129 aa, Sorghum bicolor
  Clone ID: SORBI-28MAY03-C54993_1.pep
GLRQHFAAERKWALGLQSRAHPREIISEVLKALQELNVYWKKIGHYNMKCRWSPGCLESMMHSSDGFSAESAIIETDDLMAKSTPIVKFEIQLYKTRDEKYLLDLQRVSGPQLLFLDLCSAFLTQLRVL

SEQ ID NO: 34817 - protein, 76 aa, Sorghum bicolor
  Clone ID: SORBI-28MAY03-C55046_1.pep
DVRGVDLRLAPFGAGRRVCPGKNLGLTTVGLWVARLVHAFEWALPDGAPPVCLDEVLKLSLEMKTPLAAAAIPRTA

SEQ ID NO: 34818 - protein, 180 aa, Sorghum bicolor
  Clone ID: SORBI-28MAY03-C55065_1.pep
MVMDLDEPLDAAAAEKGEAALRRLTEADPALFLSPSVDLAAAARAASQYIYSSLAPRALAQPPPLPTLLADPAFDAEQIWSQIELLARPLLPHLRRQLRRLEQQPPSQQPPVETLAVAEGEQLEEDGESSESEELKNEEEELEGTEDEEELEGTEDEEEMGDDEEEEAELDGRRGNGVGG

SEQ ID NO: 34819 - protein, 144 aa, Sorghum bicolor
  Clone ID: SORBI-28MAY03-C55067_1.pep
QTACPPDCNGDHPLDRIPPIPVPAPAANQILPPLLTPIDWTPGLLLLFYHKVYRQPPPRRHPIPRPPHHRTPPLPAPAGLPLRASHSESSHSCTERDATVPFRRQYTTRALATHLGKKSERSRARGGRVFLASSSRALPLPLPP

SEQ ID NO: 34820 - protein, 135 aa, Sorghum bicolor
  Clone ID: SORBI-28MAY03-C55082_1.pep
TRLSLVPSAGRDGAGEPGGRPPPFPHLSHGRPLRHGVAWPAHSAWPPSATVTAPSAREFLQPDGVALLFLDPSTCWFTPLSPSPSLLMWHMRCALPSPSLLMWHMHGCMLDFALNMVFSSFFLSICIVIANIVVL

SEQ ID NO: 34821 - protein, 154 aa, Sorghum bicolor
  Clone ID: SORBI-28MAY03-C55086_1.pep
MATAMGALAATSLTPVPAAATFPGDLGLGRRRAAVSGWRAGGRRLRASPPARRPFLFSPRGVSDSRSSQTCLDPDASTSVLGIILGGGAGTRLYPLTKKRAKPAVPLRANYRLIDIPVSNCLNSNVSKIYVLTQFNSASLNRHLSRAYGNNIAG

SEQ ID NO: 34822 - protein, 189 aa, Sorghum bicolor
  Clone ID: SORBI-28MAY03-C54788_1.pep
DGDRRAAAGLAVYGGRSCTDGRRSRGGLSSRRTAASRWTGTGSRRTAAGLADGEQRPIFAADGGRGAAAGLRGGWRLRSLVAPGEQSSRRTAADRLLRSLLAPVDLARRTANGGSDSTLLRSGGRCCLQRLRSLLTVERGRGSEVSAQGQDRNVEGIGEGMPVFRLFPSLDAGEAPRTQDGQTGPNPRA

SEQ ID NO: 34823 - protein, 136 aa, Sorghum bicolor
  Clone ID: SORBI-28MAY03-C54815_1.pep
MDHGDRRSGATGRPWRGAGAGVAAGGGGPPPPKVYRVEPRDFRELVQRLTGAGTPSAAAGAPGPSPHQRATTLTPAMVTADSRRAQAAAAVPVPGPTEQFDYASWFSAPLLSPAAYGAPGFGGGHQQHQGSRGPLL

SEQ ID NO: 34824 - protein, 57 aa, Sorghum bicolor
  Clone ID: SORBI-28MAY03-C54825_1.pep
PPARDEGTLTGGFQARTLKWRRNTQRGTDDKMEMIRPIHELTALYLPFCSFLIPASE

SEQ ID NO: 34825 - protein, 212 aa, Sorghum bicolor
  Clone ID: SORBI-28MAY03-C54833_1.pep
MNRLFGSKPAGPKPTLNGAITNLDTRISSLDTKLKALNAELGAYQEKLSRMREGPGKQAMKQKALKVLQRRKAYEAEKDKLESQVWNMEQASNMQDNLKNVMTQVDAMKTTNKELKKQYGKIDIDKIERLQDEMADLMDVGNEIQESLARSYDIPEDVEEDELDAELEALGMEVEMEHEMGGAVPGFLQDEVVPEFVDEPPQTEDKVKQVAG

SEQ ID NO: 34826 - protein, 131 aa, Sorghum bicolor
  Clone ID: SORBI-28MAY03-C54835_1.pep
SCLVQRRLPPQRSACPKHGCQSVFEGPSSWDEWTEHVGRHMEKGEGGGRLGVDGLLAQWALDEGIIERKADGEYRLSTSNGMGGGNSGGVPPVFEQKESTLTSVSTPGPVTARGVLDRGDKRKTSRRQNGG

SEQ ID NO: 34827 - protein, 190 aa, Sorghum bicolor
  unsure (1)..(190): unsure at all Xaa locations
  Clone ID: LIB3476-007-P1-K1-C12.pep
EESXCSYLLGEETGTTVFEKLQQLQSTXSSNSKNYGLDKKKGSSDRVTVNQSLELWLKDVALSRFADTKDCPPSLTNFFGAPKRVLNTSKQNXAEQTPRLSPNSHLGEAVKQPAPANLGLQSSMDRQVNGSGTASVPLKRNPGSHLRTLELWGLSGDVIGKLAYSALLGFVVFSTLKLGQGSVWACEIHE

SEQ ID NO: 34828 - protein, 152 aa, Sorghum bicolor
  Clone ID: LIB3476-010-P1-K1-B6.pep
KKAKTICECLVASESTDLKFEESFCSYLLGEETGTTVFEKLQQLQSTGSSNSKNYGLDKKKGSSDRVTVNQSLELWLKDVALSRFADTKDCPPSLTNFFGAPKRVLNTSKQKLGSPRSVLLSSQPSSSASACNRTSAEQTPRLVQTAILGEV

SEQ ID NO: 34829 - protein, 175 aa, Sorghum bicolor
  unsure (1)..(175): unsure at all Xaa locations
  Clone ID: SORBI-28MAY03-C5524_1.pep
KTHASAHASARVRFVPKAKDMRPLVNLKAQSKNVLLNNCHLIIKKVRDENPDKFGSSVFDYNNVHQNLWHFISSVRSHLKEKFKIYIVVADVSKAYDCINHDMLLKVVDDALKCDDYVLRKCKKVVCNWSKNALYRFDSNVSISNGDGICDXLDQLSSRGGILVDQGKFNKIQKK

SEQ ID NO: 34830 - protein, 148 aa, Sorghum bicolor
  Clone ID: SORBI-28MAY03-C55265_1.pep
ARGLHLLAPFNPAAVSPTSATTISLPTITINNSNNNSLLQHSECLLFLLKSSSLSPRLPSLLSCLSPQPLLPHTLRSPLPALTLVRLLLDEPRLSRPAPAPAPTTATASSSLDLFTTASMPMSTRPTFMMLSFTKESHGNLCVNGVLL

SEQ ID NO: 34831 - protein, 86 aa, Sorghum bicolor
  Clone ID: SORBI-28MAY03-C55266_1.pep
CTINPGENEALVRYALDTYKYLSLVSQYPKVGGPGIVGSCELFNMTYTEEWLREDEAELVQRFDPSSSVDTIGFFIAKFNVGDKDE

SEQ ID NO: 34832 - protein, 242 aa, Sorghum bicolor
  Clone ID: SORBI-28MAY03-C55286_1.pep
TRPPTTSARVLHLHHHPTGIEAFSRVIRSWAWKKFMSGCVILLPIAITFYTTWWFIRFVDGFFSPIYVHLGIHLFGLGFVTSISFIFLVGVFMSSWLGASLLGLGEFCIKRMPLVRHIYSASKQISAAISPDQSSRAFKEVVIIRHPRIGEYALGFITSTVALRGAGVRGDQQDLACVYVPTNNLYLGDIFLMSRADVIIPDLSVREAIEIVLSGGMSVPKIISAVEGAVGLGDHGLAIKDS

SEQ ID NO: 34833 - protein, 107 aa, Sorghum bicolor
  Clone ID: SORBI-28MAY03-C54941_1.pep
ENKTNHLSGMAESGCYVLMGVLFPLLQGDMKKHFTDSGFCYMPNGVVSVIYLFAIPGSVQNKSGHNTTTLTLYYISCNWKRGKRWSSPSFVLCLVCGKIIETVAILR

SEQ ID NO: 34834 - protein, 270 aa, Sorghum bicolor
  Clone ID: SORBI-28MAY03-C54971_1.pep
MAEHHHLPPEHPDHHHHKGGRKGVYADDVKPGSRGRSRYSYYYGGYGDGGGGGAVRALCFAVLVLLLAVGITLLVLYVVYRPSHPTFAVTSAAVLDLYNATASTNNNAAAAGAAPAALLAASFQFTLVLGNPRGRSAARYDRLEAYVAYHGEALTAPTPMPPLAQDAGTAVATAPVLGAGVGGPPVPVSPDAAAALATDVANAVLPLRVVLLGRVRFVHGPFHRGWHSLYARCDVLLGVRKIGGTGAATGGGGGVPQAPILGDPNCNVDM

SEQ ID NO: 34835 - protein, 195 aa, Sorghum bicolor
  Clone ID: SORBI-28MAY03-C54972_1.pep
TREETSTRERGDLKSNQAGFNSKTQSLQESISSQEEVKVTKVSPPRRKGNRDEKSERQVNFMKKESGPEISRTVVKQQQQLKQQQLQRPSSTSASQVSSKQSEKEDMEINAILEEEALIAAHRKEIESTMEIVREEMNLLAEVDQPGSLIDNYVAQLSFLLSRKASGLVSLQARLARFQQRLKEQEILSRQKTLR

SEQ ID NO: 34836 - protein, 145 aa, Sorghum bicolor
  unsure (1)..(145): unsure at all Xaa locations
  Clone ID: SORBI-28MAY03-C5503_1.pep
MHASLDYSGTGGLDKICQESRALETSPFGMRSLPDLGSFGGYSRSTAESTSSVQPYLRSSNLAETSKQEPDIVSARSSSSGSGAASDRKKRASEERTSTVKKSKQEGSKPSPPKQQVPKVKIGEXITALQQIVSPFGKTDTASVL

SEQ ID NO: 34837 - protein, 157 aa, Sorghum bicolor
  Clone ID: SORBI-28MAY03-C55410_1.pep
RMAPNMADAAVARLSQGTKVYAEGGHDRVFYQTFGAMPGEQLRKAYACYLSTSSGPVIGTLYLSTARLAFCSDSPLCYQGPAGQQQECMYYKVVLPLSQVTSVNPSSSMRNRAERYIQITTMDNHEFWFMGFVNYDKALKNLYEALQHPHVNGHQRS

SEQ ID NO: 34838 - protein, 179 aa, Sorghum bicolor
  Clone ID: SORBI-28MAY03-C55437_1.pep
HEGGIASSAFLVELEGTLCAVLADPDAEELSIWKRENGQWHSAYTVYLEGWPGYSLGANVVVPWAIDPKDGKILLNTGRKLGFYDPARRFIENLYDLEEVLRVRSTEQSSHIGVPENLCIAKCKHDVERFCSQKSLFVQHKVSDDPSPALSGNSSACSSGEQCLDRRNSLHTEIIPLVP

SEQ ID NO: 34839 - protein, 74 aa, Sorghum bicolor
  Clone ID: SORBI-28MAY03-C55443_1.pep
KQWGPYKKLLINGRLLAKNKEYACLISKAERKWSIHLFFYLFILLAIFLSYKSDLNCHRTNKNNSEIFFYVRLP

SEQ ID NO: 34840 - protein, 100 aa, Sorghum bicolor
  Clone ID: SORBI-28MAY03-C55457_1.pep
MALRRALGWSEGEVMRPESKPCSRLMRHTAGIFSVGGGLAFWVLCRLHYGPRITVPRSLRWASCGAVSMSATSALLVRLFSPECEPQNIAAFDKPELKAE

SEQ ID NO: 34841 - protein, 234 aa, Sorghum bicolor
  Clone ID: SORBI-28MAY03-C55473_1.pep
MSVNPPWLLAAMAAHLPVPPRPRVLLLFVFLAVHVHLPASHAVSPSLPTTYDGSICSKSSMCGGVNISYPFYLSDATREIADYGYNYSCGYTDLKISCQGEWPTETAVISLGGENYTVQHIFYDTRTIILADSDVLPGGSCPALRHNVSFDELWLYNSSTFHNLTFFFGCDTVPFGLEEYKIKCPGFKGPPDAGKGDSFVLVTDEHAMNLEQELARNCNMIVTVPARADVLIAA

SEQ ID NO: 34842 - protein, 229 aa, Sorghum bicolor
  Clone ID: SORBI-28MAY03-C55087_1.pep
MGERRYTEQEEALEIKSLRRIIAAYANYQDAAERDVKRYERSFNMLPPAHKELLFHLGLKYQRLRWCISMNASFIMNMLEAFEPPFDMSQYVDADPSNLHDHSHMGCTHSSERGDCSIISISRSNLSLDGQHDSPKEDTKTHESSRETDNKKVTPRHCTASLFKLNVPPIDVDKVRCIVRNIVRDWGEEGQKERDECYKPILEELNRLFPNRSDQRPPSCLVPGAGLGR

SEQ ID NO: 34843 - protein, 259 aa, Sorghum bicolor
  Clone ID: SORBI-28MAY03-C55104_1.pep
MTTVSHLDLEAGWPGPGPGRGGGGGPPEYEQAEVGNFRKDLALAYKTLGVVFGGLVTSPLYVYPSMNLSSPTKDDYMGLYSIMCSTLTLIGVVKYVGIALNADDHGEGGTFAMYSLLCRHADIGILPSKKVYSEEEPLLQNQSARAGRPSWLGKFFERSITARRALLFMAILGMCMLIGDGILTPAISVLSAIQGLRGPFPSVSNAVVEVLSAVILIGLFLLQKYGTSKVSFLFSPIMAAWTFTTPIIGLYSIVHYYPG

SEQ ID NO: 34844 - protein, 187 aa, Sorghum bicolor
  Clone ID: SORBI-28MAY03-C55179_1.pep
SLEEAIEKLRRLYHVARTDEEQMVLNWHFANLEFSNAGCLSELSLAHWDQDDPAAGGGDLCFLAGGNSRLIHALCDGVPVLYEKKVSRIEYGVDGVSVTVEEGQIFQADMVLCTVPLGVLNSGSIVFDPELPQEKLGAIQRLGFGLLDKVAMVFPHVFWDENIDTFGCLNKDSSKRGEFFLFYSYHT

SEQ ID NO: 34845 - protein, 224 aa, Sorghum bicolor
  Clone ID: SORBI-28MAY03-C55142_1.pep
MMEGTGRDANPLSGYRIGKTLGIGSFGKVKIAEHILTGHKVAIKILNRRKIRSMEMEEKVKREIKILRLFMHPHIIRLYEVIDTPADIYVVMEYVKSGELFDYIVEKGRLHEEEARRFFQQIISGVEYCHRNMVVHRDLKPENLLLDSKCNVKIADFGLSNVMRDGHFLKTSCGSPNYAAPEVISGKLYAGPEVDVWSCGVILYALLCGTLPFDDENIPNLFKK

SEQ ID NO: 34846 - protein, 130 aa, Sorghum bicolor
  Clone ID: SORBI-28MAY03-C55198_1.pep
MVPQRIPSRSSGTPGASGASACCAVAVATATTRRRGRRRRSRSRGTRRRRAATNSRCSGPRTWPRTSTRPRRGCPAASSAPSSAAALAAPARHAAGPSPSPGRSDGMATRTYVVAASVFPTVKSLLGPWL

SEQ ID NO: 34847 - protein, 131 aa, Sorghum bicolor
  Clone ID: SORBI-28MAY03-C5556_1.pep
DAWARFREALFFYSALFDALDATTPRDSNQRMLIEENLFGRAALNVIACEGTDRVERPETYKQWQVRNQRAGLKQQPLNPDVVQIVRNKVKDCYHKDFVIDVDHHWLLQGWKGRILYAISTWVANDAPSYF

SEQ ID NO: 34848 - protein, 241 aa, Sorghum bicolor
  Clone ID: SORBI-28MAY03-C55613_1.pep
TRELWEVYNGNNVRLPWKLEEFVARSPYVRDSVVTVGSKVSTVFVVNADSGEIIYRHSIPAVLNELEGPGMHGAPSKLNARTSDGSEKIIVLVRTDYSLSASDLGKHLFNWTRTSFTANQYAKYNHPDMLDQSPCLRGDIPCIRTEGLPLALPDSDSANVIVLKDGTPFISIHGSDALEPGQTSRKLPNTAGKSNIILDDSQNQTYDGARSHVISADPEATKYPTRNTYGWLFPLFPIFLV

SEQ ID NO: 34849 - protein, 199 aa, Sorghum bicolor
  Clone ID: SORBI-28MAY03-C55616_1.pep
TRASSVPESFKFARWLLEEDLKPAEDLSSKSLLSMIVKNENPGPENIIHAPLSDAAVQNLSPRAPIHKLDSASKLISFTSPTPAEGILEQYNHPDIPEAVPVMMTCEDLEQTMLAQVSNSSSTQINATKEQLTVTDEPVAMQKVAVDNHASHHLLSLLQKGTDNKGAPSLGFQRGSTDEPQSVGANLMANGGISGSDPV

SEQ ID NO: 34850 - protein, 195 aa, Sorghum bicolor
  Clone ID: SORBI-28MAY03-C55619_1.pep
ARGKDGHHKSVRIADKVAELQIDAKISPFHQTLPFLQYLGVRFGLRPEDDFCSPHVIGKLAPLNGLFVRTIHQSNNEIFRISGITSIPAEKLTFEDRNGTMVSVATYFETVYKKKLQFPHFPCVIKKVGKDKITKKPIEMHYPFEVLEVQQGQKFPKDAMNNNQEQNMIKAAQRLPRTMIEAIRNQKNLASINQD

SEQ ID NO: 34851 - protein, 96 aa, Sorghum bicolor
  Clone ID: SORBI-28MAY03-C55627_1.pep
MHGLTLITTGLSLICPAAAILVADNSPCGTVCGNVLDATTNDDIVCQEGDYTSGAGIVFQQCLTCEQSSDYTTKNNQTDQEYYLYNLRYATSFCLF

SEQ ID NO: 34852 - protein, 122 aa, Sorghum bicolor
  Clone ID: SORBI-28MAY03-C55656_1.pep
MGAAQLVILFLALGAAMRAASAAGARPSEVTVGALFTYDSTIGRAAQLAIELAVDDVNADGKVLPGTQLNLVPQDTNCSGFIGTIEALRLMEKSVVAVIGPQSSGIGHVISHVVNELHVPLL

SEQ ID NO: 34853 - protein, 81 aa, Sorghum bicolor
  Clone ID: SORBI-28MAY03-C55276_1.pep
NEAPISMPGCGNKDFCPFEEFKEKIVKPHLKHDYNMICKIKSPAASEEPASFPSRVSSFFVGLFSQRGYHAVGAEGVKTEL

SEQ ID NO: 34854 - protein, 175 aa, Sorghum bicolor
  Clone ID: SORBI-28MAY03-C55341_1.pep
HEALLFLHRGTANPSPAALSFPSSLRGVSLRSRAAAAPPAETLSDDGIPDAPPEGEGTGIPLPSSIGDDGEQLAPKQKIRIKLRSYWVPLIEDSCKKIIEAAKTTNAKTMGPVPLPTKRRVYCVLNSPHVHKDSRFHFEIRTHQRLIDIMYPTAQTIDSLMQLQLPAGVDVEVKL

SEQ ID NO: 34855 - protein, 137 aa, Sorghum bicolor
  Clone ID: SORBI-28MAY03-C55365_1.pep
SCLRISSLPLRASPRPSRSGPVLHLPACAPPRDAGGCSRPRCPRPPHVLCHGAPLLATASPCTPTTVWLGPQASYLCHLVPFESFAASGSGTPASGTLTPSPPFALLDLRPHLPWPHSPPLWSTSCRHLLLRLPTGW

SEQ ID NO: 34856 - protein, 106 aa, Sorghum bicolor
  Clone ID: SORBI-28MAY03-C55371_1.pep
KPKSDIRQQDLLKNIVGIKPKRPKVSSPSQPTDSNKPKHGEEDSVSELSSSQNQSASGLLVGEKGSSHGIVNPDHTAPRLDNPREVKQQNTAGSLLGLAYESSDEE

SEQ ID NO: 34857 - protein, 55 aa, Sorghum bicolor
  Clone ID: SORBI-28MAY03-C55425_1.pep
TAIGKIGGVICPLVAVGMLRNCHQMEAVLVFELVLFLAGVACILFPVETKGREMD

SEQ ID NO: 34858 - protein, 128 aa, Sorghum bicolor
  Clone ID: SORBI-28MAY03-C55741_1.pep
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLED

SEQ ID NO: 34859 - protein, 69 aa, Sorghum bicolor
  Clone ID: SORBI-28MAY03-C55752_1.pep
SLYCDISVKQQISYFYNLSNIIRNTHKIFQIYCMIQLIIKNHKSLPCKHLNYYKFIYTPNNMYQYFPSE

SEQ ID NO: 34860 - protein, 158 aa, Sorghum bicolor
  Clone ID: SORBI-28MAY03-C55758_1.pep
ARGAQLEATLPPSVPDTLPRLPHARITSSPPSSPPPPSSSPQFEPCACASAVKMAYIFKVAQKVKTGLRGISTCVIRGKYEDITFPQHMFEPIVEYATRCPLVSKVPTGRLFHVASDKPNQMEEHWRRLFFSGLVHSVNCKANSDCIYKAFDLDMLEC

SEQ ID NO: 34861 - protein, 102 aa, Sorghum bicolor
  Clone ID: SORBI-28MAY03-C55760_1.pep
VSCSCTRPPAIRYIIFAQTGNPHRQSRGYTGTLLQESAMDHSYSSSQNHMDFHHTPLDRKPSAFSFDDNATLDSAILDTPVLMSPSTSNQGIFSPDTSIWED

SEQ ID NO: 34862 - protein, 309 aa, Sorghum bicolor
  Clone ID: SORBI-28MAY03-C55811_1.pep
MSATKFERKQEYFAKLSNLLDEYPKILIVQCSNVGSHHMQKIRKILRGEAIILMGKNTMIRKAIRSHIEKNADLENLLPCVKGEVGLVFTKGDLSQVRKKLLSERVAAPAKAGSLAPVDVAIKSGTTGLEPTKTSFFQALNIPTKINRGQIEIINDLVLIKKGDKVGSSEATLLQMLNIKPFSYGLQTKTVYDNGQMYDDAILEITDEQILGHFAAGLRQVASISLAIGIPNIASLPHTIASGFKNVLAIAMATDISFKLADRFKNAAANPGAVVSAPTGGSSAPVEEEKPKEEEEEAVEVGGLFGDDF

SEQ ID NO: 34863 - protein, 186 aa, Sorghum bicolor
  unsure (1)..(186): unsure at all Xaa locations
  Clone ID: SORBI-28MAY03-C5548_1.pep
TRPTPTGNKEHSAVYIVERELKLLNFQLSNTANPSLGNAGVASDAGRSRNDSIEQLIVKQTKKHISTPAPHDSYSVLSVSSSGKYVAIVWPDIPSFAVYKASDWSVVDSGTGKLFAWDTCRDRYALVESALAPRMPLVVKGGSSKKAKEAAAAAAQAAAAAASAASAATGAVRILLDDXTAHVLQR

SEQ ID NO: 34864 - protein, 162 aa, Sorghum bicolor
  Clone ID: SORBI-28MAY03-C55518_1.pep
AILVADYSFTPLEYWRGVSLKAREFIRRCLTVDPAARMTAHEALSHPWIADLGDISAEGEEDLLPTVKKNFNARRTLHAAIDTIRAINQLRAGGAAGMMDGARSGEPRRGAPANVPQPVADEDPMDIDKIDSRGNGHGQTEEMIKEQERRIHETQQGLWSRR

SEQ ID NO: 34865 - protein, 295 aa, Sorghum bicolor
  Clone ID: SORBI-28MAY03-C55522_1.pep
HEARHKRTPIISELYMLMMPNQPTNSKLRTASQLAYSRSLKRPDISVEQVNALATKLSSYECAMFRIAHIIRQFDSSSIDRVYKRAIYKYHTSPGPEQYPCLLPTDPAQRVEYYTSVDRILDNAVNMRTLLDAFIHQFAAFSGTNYIMEVELRSCNLRTRTAVLSQARDLTASYTREGRPESYDLMDEEDIPLLLPEPIPGQHSVPPFLLNMSESEDELEAVSDSNNTILNSGPLHKTFELTTKAGAKRTYTVVNTKTDSQNVAMYEFCYEDDPEFPAWVDSWRFEYMQSMSVPI

SEQ ID NO: 34866 - protein, 189 aa, Sorghum bicolor
  Clone ID: SORBI-28MAY03-C5554_1.pep
MTRVVLEVDVNGEELFFVDKDVLARFCGRIRRLVAAGAATARRHPRVALHGFPGGPEVFEIVARFCHTDGGRGAAVTAANACVLRCAAEFLRPAAADAPEAASTAAPSLVRMTEKALEEMPHWPWHTVVDAVKQCQRLLPLADSTGAFDAAVAALVSQMAVPPPAAGDTTPTGSSSESTVFRFLCDTNS

SEQ ID NO: 34867 - protein, 160 aa, Sorghum bicolor
  Clone ID: SORBI-28MAY03-C55541_1.pep
SNIEIIAEPGRYYVATAFTIACNIIARRTVEDPTLDGKGYMLYVNDGVYGNFSNIMFDHQQPIAKVLRASGKTLFETAAAHPTPEGEGFEYSVWGPTCDGIDRITESTRFDSILDVGDWLYFEDMGAYTKCSATQFNGFSNARDVIYVCSEPGAKALLGL

SEQ ID NO: 34868 - protein, 135 aa, Sorghum bicolor
  Clone ID: SORBI-28MAY03-C55865_1.pep
MATARAIAAAAAVLVAALLAPAARGVDRGEFPPGFLFGAATSAYQIEGAYLEDGKGLCNWDVFTHTHTGAIMDGRTGDVADDHYHRYMGDVEILQSLGVNAYRFSISWARILPRGRLGGVNAGGIAFYNRLIDAL

SEQ ID NO: 34869 - protein, 103 aa, Sorghum bicolor
  Clone ID: SORBI-28MAY03-C55886_1.pep
ICATVSFFQACLPKLTNMVDANLWNELTTQPFTAFVRSNWLFSSRNFLMTTKKVLGNREPGPQTGAAIVTCLRIFVFPDALSLIGCTNHAHIKMAFQRFRAKD

SEQ ID NO: 34870 - protein, 96 aa, Sorghum bicolor
  Clone ID: SORBI-28MAY03-C55889_1.pep
MVCAKCEKKLGKVIVPDKWKEGASNTNESGGRKINENKLLSKKNRWTPYGNTKCIICKQQVHQDAKYCHTCAYSKGVCAMCGKQVLDTKLYKQSNV

SEQ ID NO: 34871 - protein, 117 aa, Sorghum bicolor
  Clone ID: SORBI-28MAY03-C55895_1.pep
HHPDNFGPTSILFSMRKKRPDPKRWHKLISPRLRAQLFDSAMSCIFETIFLCSIRLMVTSTHDEFQFPAKNATSRSMSSTASPQPGLWRKKTCSLPLDSNHSTVPPRPLATRASSSC

SEQ ID NO: 34872 - protein, 200 aa, Sorghum bicolor
  unsure (1)..(200): unsure at all Xaa locations
  Clone ID: SORBI-28MAY03-C5591_1.pep
MTGATRMLSVLLLVVVVAAGGAAASHSSPSSSCPATPPDAGNTLQVSHAFGPCSPLGPGTTAPSWAGFLADQASRDASRLLYLDSLAARGKARAYAPIASGRQLLHXPTSAVRASLGTPPQQLLLAVDTSNDAAWIPCAGCAGCPTSSAPPFDPAASTSYRSVPCGSPLCAQAPNAACPPGGKACGFSLTYADSSLQAAL

SEQ ID NO: 34873 - protein, 182 aa, Sorghum bicolor
  unsure (1)..(182): unsure at all Xaa locations
  Clone ID: SORBI-28MAY03-C5600_1.pep
PETAPADGQFMRYRWYRIQSDRKVPICSVHPMEQATLQCLGCLKSKIPVAKSYHCSAKCFSDAWQHHKVLHERASSALNENGAEEEELFGRFGSGGSGVLSTAGSGSLSNFGQSPGVNNGPVPLYPSGTDKNSGETWFEVGRLRTYTPTADDIGHALKFECVAVDSEKRSXIGPXTSIMTSR

SEQ ID NO: 34874 - protein, 163 aa, Sorghum bicolor
  unsure (1)..(163): unsure at all Xaa locations
  Clone ID: SORBI-28MAY03-C5567_1.pep
RPLNKLLTELVFVEDLMEALEEAKAIGXELGDIYDYVAPCFPPRYEIFQLMVNLYTERFIQMLRLLSDRANDIQNINILKVTGWVVQYQENLIGLGVDESLAQVCSESGALDPLMNMYVERMQATTKKWYSNILEADKTQPPKSTEDGKLYTPAAVDLFRILT

SEQ ID NO: 34875 - protein, 159 aa, Sorghum bicolor
  Clone ID: SORBI-28MAY03-C55686_1.pep
MDSVMAAVPDSPPQTVVLVSAGASHSVALLTGNVLCSWGRGEDGQLGHGDAEDRLVPTVLSGFDAPGITSVICGADHTTAYSGDELQVYSWGWGDFGRLGHGNSSDVFTPQPVKALQGLKIKQIACGDSHCLAVTMAGQVQSWGRNQNGQLGLGTTEDS

SEQ ID NO: 34876 - protein, 176 aa, Sorghum bicolor
  Clone ID: SORBI-28MAY03-C55685_1.pep
MAAGQSSTPSFFNFLKEGLLLPSHNRRLFAAVLTVIAASTCLLLLGNDLAVQPLTDQLDLDTKALHSADPRTSSLADILQLIQKTKDDARALVLTSAAYPLLAAITRSAIQVVVLFAAVATYSGDKLLTFGSLLGKVKAQLKGPVLTLAFVYALEIAYVALLAAMSALLLFLMIKK

SEQ ID NO: 34877 - protein, 174 aa, Sorghum bicolor
  Clone ID: SORBI-28MAY03-C55700_1.pep
HGDPDSQNPSDLDSSPGMAVGPYTLRVSPPPRLDALLFPQLRPHLRCRVSARVAAAGTSWSPAAGDSEDGVGGWWVPEYEKPMKQGRRIGFGRAVVVGLGAPVAIALAGLAWRFPSSRKRIQQLIVAPLHYVQEKMSTMESTETIKEDASDRESDEIEVSSATHDKKAEAITDD

SEQ ID NO: 34878 - protein, 69 aa, Sorghum bicolor
  Clone ID: SORBI-28MAY03-C55714_1.pep
RFASSLANCSHSQHIRQAPLKNTSFSMFSKHPSPKMISEFRPLLNGLVIIPLIFIHQLLNTTMSSCVVD

SEQ ID NO: 34879 - protein, 147 aa, Sorghum bicolor
  Clone ID: SORBI-28MAY03-C5606_1.pep
ADADANADGSVKIVVEIKEGGKDDKKSEMGATEVVDVLVDEDAAKQTKKRKVDEDAVKQTKKRKGDAETGTNGAKRMKSSAAVEEGAVCGTPVKRTRKSGDMDAEGNGSPAVSSGRRVTRSSSVNATGADDSPARRTRSRAGADAGC

SEQ ID NO: 34880 - protein, 84 aa, Sorghum bicolor
  Clone ID: SORBI-28MAY03-C56081_1.pep
IRHRKTLGTGGPSLFGAKITGGGSGGSVCVIGKNCLKSSEEILEIQKRYKAATGYLPIVFEGSSPGACKFGYLKIRRRSTSPSN

SEQ ID NO: 34881 - protein, 159 aa, Sorghum bicolor
  unsure (1)..(159): unsure at all Xaa locations
  Clone ID: SORBI-28MAY03-C56107_1.pep
SNDLVVVSPDVXGVARARXFAKKLSDAPLAIVDKRRQGHNVAEVMNLIGDVRGKVAVMMDDMIDTAGTIAKGAELLHQEGAREVYACCTHAVFSPPAIERLSSGLFQEVIITNTIPLKEEKTFPQLTILSVANLLGETIWRVHDDCSVGHDPYSSLDID

SEQ ID NO: 34882 - protein, 152 aa, Sorghum bicolor
  Clone ID: SORBI-28MAY03-C56144_1.pep
SFNPKISDFGLAKLCARDQSMVTLTAARGTMGYIAPEIYSPNFGGVSYKSDVYSFGMLVLEMVSGRRNSDPGIENQNGVYLPEWIYEKVVGGQELTLSREIADQDKETVRQLAIVALRCIQWNPKNRPSMTKVVNMLTGRLHNLQIPPKPYA

SEQ ID NO: 34883 - protein, 156 aa, Sorghum bicolor
  Clone ID: SORBI-28MAY03-C5615_1.pep
MDCSKNEGAVAVAALPDDPLVEILSRVPAKSVCRFKCVSKAWRDLIADPHHRKKLPQAMQGLFFMVPEDLIDVSFSFIDLTARSVPPDIDPAFSFLKERPGFQFHNLGFLDSCNGLILFKNHQEPPYSDAVGYVVCNPTTKRWAAVPTCGSLDLTT

SEQ ID NO: 34884 - protein, 64 aa, Sorghum bicolor
  Clone ID: SORBI-28MAY03-C56147_1.pep
IPKDDKMFKFVLLLQHSMPTSVLSGAVANLRGCGKESAAILFWVHIFAVFSMAGWIIFYLSLLF

SEQ ID NO: 34885 - protein, 131 aa, Sorghum bicolor
  Clone ID: SORBI-28MAY03-C58229_1.pep
MSDSECAGAPQLKGKYFGLLVCFLLGNGCLFAWNSMLTIEDYYVYLFPKNHPTRVLTLVYQPFALGVTALLAYHEARINTRPRNLTGYTIYFLSSFAIIILDVATKGRGGFGAFVGICVTSAAFRIADAHA

SEQ ID NO: 34886 - protein, 186 aa, Sorghum bicolor
  unsure (1)..(186): unsure at all Xaa locations
  Clone ID: SORBI-28MAY03-C58237_1.pep
TRAACSCLKNISRSPKVLSGGRLSCDTVIGPLVHLLNDSSTSVQVAALGAICNIAVNLTPRKSVLLHSGVVSQLVHLSKSMDPMLRLKSVWALTNIMFLLTPKDKDFIVKELTLSTLSSLICDSEHFVQEQTLALVHNLVDGYVDSANYVIGEDGMVMDAIARQLINASAPGVCIXGMYVLANIAA

SEQ ID NO: 34887 - protein, 209 aa, Sorghum bicolor
  Clone ID: SORBI-28MAY03-C58238_1.pep
ARGSHYFCFACIMEWSRVESRCPRGKQRFTTITKSSKVDLGLGVRKAVIKVEERDQVYQPTEEEIRRWLDPYENVVCIECNQGGDDSLMLLCDICDSSAHTYCVGLGREVPEGNWYCGGCRLGDEGPSYTGIQRTVAYERQTYRNHVDSSSVSFGMLASSGTFERPPSINPRHSFQGIDLNLSPREFPGESHPAESQVSTDSVSTPTGR

SEQ ID NO: 34888 - protein, 188 aa, Sorghum bicolor
  Clone ID: SORBI-28MAY03-C58272_1.pep
ARGSKEGLGQQPKTDPKEKAKAETRDWLNNVVSDLESQIDNFEAEVEGLSIKKGKQRPPRLVHLEKSITRHKAHIKKLESILRLLDNDELSPEQVNDVKDFLDDYVERNQEDFDEFSDVEDLYSTLPMEKVEALEDMVSLAPSSLVKGAASVSTTAVLSTKRSVASSPTQPTISTTPSQSTSQDQTEE

SEQ ID NO: 34889 - protein, 59 aa, Sorghum bicolor
  Clone ID: SORBI-28MAY03-C5624_1.pep
RAPPTSSLVVFFFINCYKEREGTGKATPTPMQSQCGRVRERERLTDRRPTWGRKQQQKM

SEQ ID NO: 34890 - protein, 122 aa, Sorghum bicolor
  unsure (1)..(122): unsure at all Xaa locations
  Clone ID: SORBI-28MAY03-C56248_1.pep
NLLNLVDHFHRRGLYRSIFLSIMEGEESLQKFSPQVMIMQSSARSAVPLLPRIILFHGTSDYSIPSVXKDPLRGGRDKMLEEIASVIHSEDPDNSAQHLVVPVARRLVPEFMLKLAGKVSPF

SEQ ID NO: 34891 - protein, 94 aa, Sorghum bicolor
  Clone ID: SORBI-28MAY03-C56251_1.pep
FNGKKWEKFNSEKVASLAYARIQGRNALIAHFQNSSLMNEEKWCRPMLFHKDGPHAGDQEPFPVGSNVRSRSGRNRPLTGSETTKEGSPSTSPN

SEQ ID NO: 34892 - protein, 120 aa, Sorghum bicolor
  Clone ID: SORBI-28MAY03-C56423_1.pep
HPVIRLKLAHMARQIEASYAWLENLIYQCEKMGETEAMLKLGGAIASLKAQATVTFEFCAREASQIFGGLSYSRGGQGGKVERLYRDVRAYAIPGGSEEIMLDLSIRQSMRVHKALGMKL

SEQ ID NO: 34893 - protein, 106 aa, Sorghum bicolor
  unsure (1)..(106): unsure at all Xaa locations
  Clone ID: SORBI-28MAY03-C56351_1.pep
KIGNDEHLHKAFAYFDRNKSGYIEIDELRESLADDLGQNHEEVINAIIRDVDTDKDGKXISYDEFAAMMKAGTDWRKASRQYSRERFTNLSLKLQKDGSLQMTSTR

SEQ ID NO: 34894 - protein, 236 aa, Sorghum bicolor
  Clone ID: SORBI-28MAY03-C55968_1.pep
ARGPYTARYFEILEKRRTLPVWQQKEEFLRSLRDNQTLILVGETGSGKTTQIPQFVLEAEGLSNRSMVACTQPRRVAAMSVSRRVAEEMDVTIGEEARGSIRFEDCSSHKTVLKYLTDGMLLREAMADPLLEKYKVIVLDEAHERTLATDVLFGLLKEVLKNRPDLKLVVMSATLEAEKFQGYFSGAPLMKVPGRLHPVEIFYTQEPERDYLEAAIRTVVQIHMCEPAGDILVFLT

SEQ ID NO: 34895 - protein, 120 aa, Sorghum bicolor
  Clone ID: SORBI-28MAY03-C56012_1.pep
GRGHRFKGKGKEEDAQVFTLDEWEKRKAIGLKPAAVSAALATCRVGDFAGQRRVLLHRDVLQGGADVFSGGAESSDAERLRMSMFSFSGPDEAGGGRRDFRGRGRGRGRGRGRGRGRGRF

SEQ ID NO: 34896 - protein, 73 aa, Sorghum bicolor
  unsure (1)..(73): unsure at all Xaa locations
  Clone ID: SORBI-28MAY03-C56044_1.pep
HEAKKKRPGVSPGDRSGGLAKRGKEGKNRRARDSKFGHGGRKGLKKQNTAETTNDFRSFNQXGESQNKKRKRF

SEQ ID NO: 34897 - protein, 162 aa, Sorghum bicolor
  Clone ID: SORBI-28MAY03-C56049_1.pep
HEGRLQTLAPSLRRAAASSSPAAARAAPLSTSPAAAFRRTSALLSSPGDKPAPTKVEDVMPIATGLEREELEAELQGKKRFDMDPPVGPFGTKEEPAVIESYYNKRIVGCPGGEGEDEHDVVWFWLQKDKPHECPVCSQYFVLKVIGDGGDPDGHDDEDGHH

SEQ ID NO: 34898 - protein, 100 aa, Sorghum bicolor
  Clone ID: SORBI-28MAY03-C56061_1.pep
HFFHACKSEWFDSVVFYILLLQEGGSWRMKRITTSSIPRLLLKREQRLQKIWSRQMIMGATIRLRRFRSLDSSLYPTNSLPPAFFNLYQARRLNLLTKLE

SEQ ID NO: 34899 - protein, 121 aa, Sorghum bicolor
  unsure (1)..(121): unsure at all Xaa locations
  Clone ID: SORBI-28MAY03-C5648_1.pep
TVLLVXFLLEYLSKIYHSIRVLRRMQDFSGYLFGTIWWGIALNLMAYFVAAHAVGACWYLLGAQRATKCLREQCAQAGGSGCAPWALACAEPLYYWRGVTVGADRLAWAGNATARGTCLDS

SEQ ID NO: 34900 - protein, 300 aa, Sorghum bicolor
  Clone ID: SORBI-28MAY03-C56550_1.pep
SLDPEDDSSGKGPNTDLPGDGRHLIQAPLGLFPRPWPPKVDASEGSRLFKVLEHFRLIGQVMAKVLQDGRLLDLPLSTAFYKLILGQELDLFDIVSFDSEFGKTLQELRVLVERKQFLESTCGKNQLHVADLRFHGASIEDLCLDFTLPGYPDYVLKEGEGSTIVNIYNLEEYITLVVDATVKSGIKRQVEAFRSGFNQVFDMSSLHIFSPQELDYLICGRQEIWELESLVDNIKFDHGYTAKSPAIVNLLEILSEFTPEQQHAFCQFVTGAPRLPPGGLAALNPKLTIVRKHPSSAVNT

SEQ ID NO: 34901 - protein, 157 aa, Sorghum bicolor
  unsure (1)..(157): unsure at all Xaa locations
  Clone ID: SORBI-28MAY03-C5656_1.pep
SYPGAHIGPEPTTDRFVVVMSGPDERTIPGNTIAVQADMPFSGLTTFGTAFLSKFECSQMRHPLLEHITFVDTPGVLSGEKQRTQRSYDFTGVTSWFAAKCDLILLLFDPHKLDISDEFKRVIGSLRGHDDKIRVVLNKXADQVDTQQLMRVYGGID

SEQ ID NO: 34902 - protein, 176 aa, Sorghum bicolor
  Clone ID: SORBI-28MAY03-C56606_1.pep
ARGFYFGDSVLPCFESGIPLLKSRLQELPDSHNITIAFPDDGAWKRFYKQLQHFPMVVCNKVREGEQRIVRIKEGDPRGRHVVIVDDLVQSGGTLIECQKVLAAHGAAKVSAYVTHGIFPNNSWEKFQHDNGEGPEHGLSHFWLTDSCPLTVNAVKGRRPFEILSLAGPIASALQI

SEQ ID NO: 34903 - protein, 149 aa, Sorghum bicolor
  Clone ID: SORBI-28MAY03-C56619_1.pep
HEAWSLLPVSPPDATTVGATGDVAARGRPSLLSLPLLQRQSMLGRLGKTAASSSRGTVERLPRRQRRRPSSPVVSSGTSPSPSPTSSRGSSPRFLLPRSRTRHGVQAAVASRLTAAHDRCCGWRPVAGVLLCRCSRYCLQAPWASPVLT

SEQ ID NO: 34904 - protein, 179 aa, Sorghum bicolor
  Clone ID: SORBI-28MAY03-C5664_1.pep
MPYYYSYWSDYVEQYRRAQRLQQENSRLSNEKRELERQLAEKTRAAQVSSAQVFTLGHKVRELERQNTRLSGDLAKQRDDTRKAGLLFMSAADRYQEEAKKQIRAKVEELANTRKAGLMLMDTADTYQEEARKQIKEKAEELEDARKAVVALMKAADAYQQEAKKQIRDKVEELKVMGA

SEQ ID NO: 34905 - protein, 167 aa, Sorghum bicolor
  Clone ID: SORBI-28MAY03-C56155_1.pep
ADSKRPFVWAVRPSLVRSRSLESAKLQLPDGLEEEIHGRGKIVYWAPQEEVLSHPAICAFLTHNGWNSTVESISQGVPMLCRPCFGDQFGTARYVCDFWKVGVEIGVVTQLRRGNIRAAIDKLMDDKQAKEYRDRAKDLKEMAEKCATKDGSSHRALVSLVDFIISF

SEQ ID NO: 34906 - protein, 124 aa, Sorghum bicolor
  unsure (1)..(124): unsure at all Xaa locations
  Clone ID: SORBI-28MAY03-C5617_1.pep
VSRIHLTAARRACRNHSSEASEGYSSSPSPSPSPSPSQSAPESEEEEQKLVSLNTSCSKYSSSSSSPALXSGKNSPSSTTPSPRSAQSSSQVSENAHSDQSSAAAAAAASTGIISSVVTTLIVD

SEQ ID NO: 34907 - protein, 66 aa, Sorghum bicolor
  Clone ID: SORBI-28MAY03-C56171_1.pep
VGEGSQNEGPLGPLFKKSKGCSVTLGIPGKQNVVHHLICCIRLVSRHGYSSFSKSSFFFFVLESRL

SEQ ID NO: 34908 - protein, 74 aa, Sorghum bicolor
  Clone ID: SORBI-28MAY03-C56200_1.pep
DDEREHNSDCHLVADVTERLINLLAQQQEELSALQRKHKADIEDMLKTVPAQAREETLTRCRLKMEQKNRANKP

SEQ ID NO: 34909 - protein, 175 aa, Sorghum bicolor
  Clone ID: SORBI-28MAY03-C56194_1.pep
DELRTIPKEMEIVTEDDLNGLSYLKAVIKETLRLHGPAPLLVPHLSMAECDIEGYTIPSRTCVIVNAWALARDPIYWESAERFMPERFLEGGSAMSMDYRGNDFHYLPFGVGRRICPGISFAISSIEIMLANLVYHFIWELPPELKKSGIDMTESFGVTVHRTKKLLLVPVLPQD

SEQ ID NO: 34910 - protein, 108 aa, Sorghum bicolor
  unsure (1)..(108): unsure at all Xaa locations
  Clone ID: SORBI-28MAY03-C56236_1.pep
MIKECITQLKEADQNQAITMISYXASSAETAQVRRKIVYLQCSNRXEIVNNKTIGEGSDNILLVGMEGVAPGSVSIDVLHVKVEDPLHFYNQVLDSRELTRSVSFLFH

SEQ ID NO: 34911 - protein, 209 aa, Sorghum bicolor
  unsure (1)..(209): unsure at all Xaa locations
  Clone ID: SORBI-28MAY03-C56729_1.pep
TRAKLAGKSFRMRVEPLVDKAKQVGAYLVRVSFGTALIAWXVLVYTTIIAILSSSSEEDSRGTRRRSYGSTVIIPTDMFWYLDAHYYTRRPVENENGMNFIESVIXRVFSFVFGDGDPHDGLEQKRRKMIGQYISSNGGVVTAEELAPFLDVPPPSQESKAGELLPIFCPXDDESFVLPVLLRFQGHPEIDEQGNILYRFPSLQRTASS

SEQ ID NO: 34912 - protein, 199 aa, Sorghum bicolor
  unsure (1)..(199): unsure at all Xaa locations
  Clone ID: SORBI-28MAY03-C5673_1.pep
STSAAATSSRRTMPRSRGNEPPPPRVSQRAPLHLKTTAASEANGAHHRPVTDRSSPKVGDRHSPRSPLPEKKRAAGTRVAELETKLGEVQDELKKLREQLASAEAAKKDAQVALEEAKKRVGTKGGSPASTTTTTSPLSPPSAGVESAKKTEELKVTQPAAVEEESSINAPATDVFEVVRAESGDKENQSAAXDCEVVS

SEQ ID NO: 34913 - protein, 153 aa, Sorghum bicolor
  Clone ID: SORBI-28MAY03-C56735_1.pep
MDMVTAAAALPWGGGSPAWIDVPERSKSAFMELKRRKVHRYVIFKIDDRREEIVVEKTGAPGESYDDFTASLPADDCRYAVYDLDFVSDDNCRKSKIFFISWSPSDSRIRAKTIYAVSRNQFRHELDGVHFEIQATDPDDMDLEVLRGRANRT

SEQ ID NO: 34914 - protein, 242 aa, Sorghum bicolor
  Clone ID: SORBI-28MAY03-C56779_1.pep
ARGSEAQGVSLLDSILQGELPCDLERTNSTYNILALLRVLEGLNQLSSRLRLQGASDDFAEGKITTLDARGRTGAKVPSEVFVNSKLTPKLARQMQDVLALCSGSLPSWCYQMTKACPFLFPFETRRQYFYSTAFGLSRALNRLQQQQSDNHSSGGEREVRFGRLQRQKVRVSRNRILDSAAKVMEMFSSQRAVLEVEYFGEVGTGLGPTLEFYTLLSHELQSAQLGLWRSSSYDSGLHIDR

SEQ ID NO: 34915 - protein, 75 aa, Sorghum bicolor
  Clone ID: SORBI-28MAY03-C56781_1.pep
YFVSKSAVLGDITIEFVLLYAKGMVLGGYVRAVEFKGGGLLMFVIFDLLYGYSDVNHGGVKIATGLIRSLIILNS

SEQ ID NO: 34916 - protein, 105 aa, Sorghum bicolor
  Clone ID: SORBI-28MAY03-C56425_1.pep
EEHDMSASGGGQGSAAFRVITPFPNLKELYLHGLAKFRRLSSSTCTLHFPALESLKIIECPNLKKLKLSAGGLNVTQCTREWWDGLEWDDEEVKASYDPLFRPLH

SEQ ID NO: 34917 - protein, 118 aa, Sorghum bicolor
  Clone ID: SORBI-28MAY03-C56433_1.pep
KFIRIGYALLQARSSIWIQLSNYTAPGSSPAKNLRAHASRYSLPMFVKKLRCTSDSGLQRYIPTDSLSDCVSGISFSMFHRGAFGSDVGAARTGFGALSRIPTKVLFRASMFLPSCGR

SEQ ID NO: 34918 - protein, 102 aa, Sorghum bicolor
  Clone ID: SORBI-28MAY03-C56450_1.pep
GSSCSSSAAARAPASSSRGPRPGPRTPRRRARTGAPPPPPPRPPRGRRRLPARARQPTSAPDFYLRREGEKKKEGKKSTTTNSRMQCNTVLNEVLVDRDQPH

SEQ ID NO: 34919 - protein, 176 aa, Sorghum bicolor
  Clone ID: SORBI-28MAY03-C56460_1.pep
EKCRECIIHCDIKPENILLDEELGAKLADFGMAKLVGHDFSRVLTTMRGTMGYLAPEWLAGAPVTAKADVYSFGLLLFELVSGRRNNGSSQAAVYFPVHAAVRLHAGDVVGLLDEKIAGDANVKELEKVCKVACWCIQDEESDRPTMGLVVQQLEGVADVDLPPIPSRLHMLAIDE

SEQ ID NO: 34920 - protein, 244 aa, Sorghum bicolor
  Clone ID: SORBI-28MAY03-C56863_1.pep
MYIWNYGTKLKYETEVKQKLSMDLLTQLGCNLGTVRAPGIGLLYNELVRGVRAPFGHFLTTLPAMHSMIIFVCIKWVPVPVVPQNERFLFRRVCPKNYHMFRCIARYGYKDVRKENTQAFEQLLIESLEKFIRREAQERSLESDHNDDTDSEDEIASSSSRVLVGPNGSIYSLGVPLAEPGGGTDNSALGSSLSFDGSSLDNELSFVHKAKESGVVYLLGHGDIRARKESFFLKKLVINYFYAF

SEQ ID NO: 34921 - protein, 198 aa, Sorghum bicolor
  unsure (1)..(198): unsure at all Xaa locations
  Clone ID: SORBI-28MAY03-C56866_1.pep
HEAGFCRVLCRTTLQESSTSWLARTRXQPISSPGRSACLLCMLQXLIKFGAVYYALVAPQPPPYASPEHFKIFREVTEPSILRRRASIKGKTVREAQKTFRVTDPDQRLEAGTYLRVHVHPKRFPRCYEIDWKSRVIAVADEYVGLDKPAATSVGGATDNIEESCAVFTSRALGMETPLLTTHQIDNCSEGCVVLSKT

SEQ ID NO: 34922 - protein, 350 aa, Sorghum bicolor
  Clone ID: SORBI-28MAY03-C56872_1.pep
MASSLAPASWVLPLQTGGAGAAAAGPSSCRFMLAVAEPRCRWAASPRRARVLVAPRCAALDWPGGSGEEEAKIEDERKKKPARGRPVWRRILFASKKTRSIIILNALTVIYASDIPVLKEVEALTEPAVFNMVRFVVAAIPFVPFAVRALRDRRVRYAGLELGVWVSLGYLSQAIGLLSSDAGRASFITAITVIVVPLIDGLLGASIPKLTWFGAIMSLFGIGLLECGGSPPCVGDILNFFSAVFFGIHMLRTEQISRSTDKKKFLALLSFEVLVVAFSSVLWCMFKDGYVDTSESSFDSWTFGMLWDTAASFPWIPALYTGVLSTVLCMWAELVAMGDVSATETAIVYG

SEQ ID NO: 34923 - protein, 223 aa, Sorghum bicolor
  Clone ID: SORBI-28MAY03-C56887_1.pep
MADEDSSDFTFCKVISAENDGQPESPKAIPVESMTLEDVHVDSANTSKNNGLETVDSEKDRSGNNVSVSTKDNNMQAPVTQTSGGAESNVPSQAKRSSKKPAARAKVPFEKGYSQMDWLKLTQTHPDLAGLKGQSNRKLISLEEVKQHKAGGCIWTVLKGRVYNIAPYMKFHPGGVDMLMKAAGKDCTALFSILPLLFLHCNSLSCCLWTHTGRPFLLCKLVW

SEQ ID NO: 34924 - protein, 200 aa, Sorghum bicolor
  Clone ID: SORBI-28MAY03-C56912_1.pep
MPFSPPLIDWEAESYPAYPDFAAIPFFVVFFLVVRFFLDRFVFEWLARKLIFKEDEKLGPTTYAGKRKIRKFKESAWKCIYFLSGELLALSVTYNEPWFTTTRNFWVGPGDQIWPDQKIKFKLKAVYMYVAGFYTYSIFALLFWETRRSDFGISMTHHVATVCLIALSYIFRFARVGSVVLAIHDATDVFLELGKISKYS

SEQ ID NO: 34925 - protein, 179 aa, Sorghum bicolor
  Clone ID: SORBI-28MAY03-C56661_1.pep
MAVSAAPEQPQREQPQQDHDEEMLVPHQDAIEGPQQDVVEGPQPMEESASAVENQLVPDTSTSRFTWCIENFSRRNVRKHYSDDFIVGGYKWRVLVFPRGNNGDHLSMYLDVADSNLLPPGWSRNAQFSLAVVNQLDSKASLRKEAVLPVRSPVGVWGFASFRPSGDLGLSSKGYVVND

SEQ ID NO: 34926 - protein, 182 aa, Sorghum bicolor
  unsure (1)..(182): unsure at all Xaa locations
  Clone ID: SORBI-28MAY03-C5667_1.pep
CHEVVLPSKIGSMQQLETFEINATIKLSKGQSFCELPSDIVHLSRLLHLIIPNGTMLPNGINDMKSLRTLHCFDLCNSPNSIKGLGELTNLTSLEIIFSYSRQMAXMRLWRKGREVLQTCLGKLCNLKCLYMNINSPRFPYFDALSSTPASFHHLEIFHGRKFSRVPGWISQQHNLYELDLD

SEQ ID NO: 34927 - protein, 130 aa, Sorghum bicolor
  Clone ID: SORBI-28MAY03-C56662_1.pep
MSDEARRGGPAGAAQAVVRASSEDRKPVGAGSPPPAAAAAAVAAHKIQLKSADMKEEMRQEAFEIARVAFEKHSMEKDIAEYIKKEFDKNHGPTWHCIVGRNFGSYVTHETNYFVYFYIDSKAVLLFKSG

SEQ ID NO: 34928 - protein, 118 aa, Sorghum bicolor
  Clone ID: SORBI-28MAY03-C56676_1.pep
MASQWATPPPGYPAVHGQAYGNQQLATPPPQAATAVAVTATSNGVGNPYVVVTPASATPSTGQTVRKALCRYGKLLEDGTRKAADATGNIWHHLRMAPNMADAAVARLSQGTKVYAEG

SEQ ID NO: 34929 - protein, 79 aa, Sorghum bicolor
  Clone ID: SORBI-28MAY03-C56722_1.pep
MAPAVGLKRSATQTITLPPPETRLAVRDVMRSTIPSQPAEAPASTERPAPAAALQGFLCLEEVDGRRWSYVVDGGAAKG

SEQ ID NO: 34930 - protein, 176 aa, Sorghum bicolor
  Clone ID: SORBI-28MAY03-C56963_1.pep
ARGGVGIDNGARAAATEHGCLVVNAPTANTVAAAEHGIALLTAMARNIAQADASLKAGQWQRNKYVGVSLVGKTLAILGFGKVGSEVARRAKGLGMHVIAHDPYASADRARAIGVELVSMEEAMTTADFISLHMPLTPATNKMLSDEAFAKMKKGVRIINVARGGVIDEEALVRAL

SEQ ID NO: 34931 - protein, 81 aa, Sorghum bicolor
  Clone ID: SORBI-28MAY03-C56964_1.pep
MSCFAHFFKRKRGPQQQDNPSNDYFKGSENITKYSYRELVRATSNFDQSNKIGEGGYGPVYKGTLKDGTAIAVKILSLHSR

SEQ ID NO: 34932 - protein, 186 aa, Sorghum bicolor
  Clone ID: SORBI-28MAY03-C56966_1.pep
ARGEIENLSCRYIWTNPLNGNNQRSDANGNDCELGLSQRGDADDKNWEQRRNLLLMLAILAATVTYQAGMNPPGGVWSDDEAVSGKPGDPILQHNNFKRYDVFYYSNSLSFVASVVITILLVNKESCEHGIKSYALRVCLVVGLVSLLIAYSAGSCRKARESIYLIIIAVAVLISLVIQVILLSST

SEQ ID NO: 34933 - protein, 68 aa, Sorghum bicolor
  Clone ID: SORBI-28MAY03-C56971_1.pep
MSIVVPQPSAVENLEISLKHIPSRKNKTLPDQLFDLKSKEQELHDPNKDLRKKDSLTIRAMILRCRSG

SEQ ID NO: 34934 - protein, 211 aa, Sorghum bicolor
  Clone ID: SORBI-28MAY03-C56996_1.pep
HEAHVDNANTAQALQGMQPMGVMGTMGMNQMRPNGTIPYGAQQRFAHAQMRPQASQQPALSPQKVPGQGLSRTASITALNSQLSGSSQNGQMVAMSVPQQQQQQWLKQMQSSMGSPVSPQQQYQHQQRLLLMQQLQQKTGLSQQQLLQVQQQHPHLSAQQLIQQQHFLQQLQQQQPLQSPRVSASGSQKSANLTGSQPGTPLSVGTMTGGS

SEQ ID NO: 34935 - protein, 125 aa, Sorghum bicolor
  Clone ID: SORBI-28MAY03-C5698_1.pep
IQVSRSRSLILSVQVKSFAVAVTIGVLLHLALLAFNAAMLEILSRLEQKGESVFAKKEYARAVILVASQKTLPVLVAVVEQLGGAFGESGFLVIPCVAAHINQIIIDSIIVNWWRQKDQQFTSAK

SEQ ID NO: 34936 - protein, 53 aa, Sorghum bicolor
  Clone ID: SORBI-28MAY03-C56788_1.pep
GHGDIRARKESFFLKKLVINYFYAFLRKNCRRGIATLSVPHTRLMQVAMQYMV

SEQ ID NO: 34937 - protein, 170 aa, Sorghum bicolor
  Clone ID: SORBI-28MAY03-C56799_1.pep
MASPDPSAAGAGAGGESTSQAAAVEPIRMPTVEEIKGQDIWNNCAVRSVVSGVMGGGLGVLMGLFFGALDNPIMAEEMTARQQIVYTAKQMGRRSISNAETFAVMGLIFSAAECTIEKVRAKHDPPNTAVAGCVTGGALAVKGGPKATCIGCAGFAAFSVAIEKFFDRHT

SEQ ID NO: 34938 - protein, 151 aa, Sorghum bicolor
  Clone ID: SORBI-28MAY03-C56805_1.pep
ARGGEANISHQTAFIIFFVFDSVSLFISLAVVVVQTSVVVIERKAKKQMMAVINKLMWVACVLISVSFLALSFVVVGRAERWLAVSVTIMGTTILATTIGTMLYWVIAHRMEAKRIRTNKRNRLSRSRSLSISGMSEGEWVEEEYKRMYAI

SEQ ID NO: 34939 - protein, 143 aa, Sorghum bicolor
  Clone ID: SORBI-28MAY03-C56831_1.pep
IQPTQAIRDLAVKLKLAPVRGVITGKSVVVVDDSLVRGTTSSKIVRLLRDAGAREVHMRIASPPVVGSCLYGIDTPSEGELISNRMDLDGVRREIGSDSLAFLSLDKLHSIYGEESGDYCDACFSRKYPVLPTLADPAVEPDE

SEQ ID NO: 34940 - protein, 115 aa, Sorghum bicolor
  Clone ID: SORBI-28MAY03-C56837_1.pep
FLYMSEVDVGIKFVDFVAAVLRDKVPDAAARRDLVMRGDRVAAAEAVRRGLVDAAVDGGPEDVVAAAVAEAERLAARGWDGEAVAEIRKAAWPQLWGQVKDHGAGPAPAGVRPRL

SEQ ID NO: 34941 - protein, 203 aa, Sorghum bicolor
  Clone ID: SORBI-28MAY03-C56852_1.pep
PSRASLPWRHALPGAPRRTLLGCPALGWNLRAVSLGPRLAGGASAPRPGQGPIMCGNTPWIRRALVRVARVMPSSCLSAYRFLRGRVLGSLVPAVPWFPALLVACRAAPSVGCAVSQVVLPPLGRRAALRWCATPARRAQRPCLLPALCADSSLLSSLPPSPLARPCSAAAGRLLWVSLEFRISFFRHFADLRHLRVVQTLRF

SEQ ID NO: 34942 - protein, 173 aa, Sorghum bicolor
  Clone ID: SORBI-28MAY03-C5714_1.pep
IAAIAPFSHRLAFDDLPADLQRLRCKVNFQALVFRSHIISLGETLVKRLRSSVGGRSNKSIHQVVGDTNQAQKYAVLHLRFDKDMAAHSACDFGGGRAEQLALAKYRQVIWQGRVLNSQLTDRELRNTGRCPLTPEEIGLLLVALGFDSKTRLYLASHKVYGGEARISSLRKL

SEQ ID NO: 34943 - protein, 137 aa, Sorghum bicolor
  Clone ID: SORBI-28MAY03-C57144_1.pep
RKERILRQGGSILRSAAGAVPALRKPWRASAATATMMQEAPSFLFSTGTISLLTEQEPQEDESKNDSTSPSSHPEPAENGILPDDDATSFSQLHATDPKNLSFCISPLALMLLETLDLGDIYGFKISHPNGQRRDLS

SEQ ID NO: 34944 - protein, 227 aa, Sorghum bicolor
  Clone ID: SORBI-28MAY03-C57159_1.pep
KSVELLPELWKSGGFSLETSSSYRRSLLNNWNLDGETIARIQKKFAVFLLYSGCEARPPNLHSQLDGSFVPRNNMEEAILLLMILLRKFNLKRIERDPSVMHHLTFALSMSGQLIPLAGQFEELLPSVLDKKEWLYSVALCYLAEEDDLSALNLLKRILKSGEDSDHLKELLLASKACIEMSAHSEGASYARRAIANMQGGCKPMAGLADLLLGVALSNQARSAISD

SEQ ID NO: 34945 - protein, 265 aa, Sorghum bicolor
  Clone ID: SORBI-28MAY03-C5716_1.pep
HEALWNLIQLVGEKARRNTVLLMDRDNAEVFYSRVSDIDDLFYCLSHELQYIISREEHPSVQMQRALELANACIALVQAASHYRKDHKEWYPSPEGLITWNIQPVVRSGIWSLASLIMELLGDSGAADMSMKSSLWSQLEGLTDILLEAYIGLLTAQFERGQEHGVLVQEYCERRDELLRSLYNLAKQIVEVKYQESKDGTDNLDLKESIFRKVISPILATAKRHEGYQTLWQICYDLDDSDLLRSLMHDSVGPHVRISFFVFKE

SEQ ID NO: 34946 - protein, 113 aa, Sorghum bicolor
  Clone ID: SORBI-28MAY03-C57166_1.pep
ALLTFGMGMYTMFYGSQSIQQQARHVDTSHLGAFNQKLKEGARIRSVTQAKTRISHAILLLLQVGVLEKFKSVPLLTGLDMACFGGAVLASSASVFLLSKLYMGQQGLKQTVT

SEQ ID NO: 34947 - protein, 160 aa, Sorghum bicolor
  Clone ID: SORBI-28MAY03-C57185_1.pep
HEAAIFLKASPSCVSNLERRIGMQLDKASLEDLLIPNVSDSVETLYDVDCAQRILDHFLAMDQETGGASPGIGEDGQMLASPSLMPIMMVAKLIDGYLAEVAPDMNLKLPKFRSLAAAIPDYARPIDDGLYRAIDIYLKAHPHLSESEKEELCRVMDCQK

SEQ ID NO: 34948 - protein, 157 aa, Sorghum bicolor
  Clone ID: SORBI-28MAY03-C56928_1.pep
CDHHCVTEKLEDQVASGEMADEEPVKSNEVAKKSKSRKKDKKKANVASPSLPREPKPEMDDSDDPDFWVPPVGSRWDDDDGKDRWESSPGKPNSAKNKGGSDDDGAGDNDGGGDDDTADKDDAESRELASSRTKRMSIEAVGPSSFASRKKKPKKEQ

SEQ ID NO: 34949 - protein, 130 aa, Sorghum bicolor
  unsure (1)..(130): unsure at all Xaa locations
  Clone ID: SORBI-28MAY03-C56946_1.pep
XXPHPLFLLRPTPASGASPRGRAACGAPASRGPQHRRHRVPRRHPPTGRCAAAWRGAWARSCRSSPEPRPPPGPPPRVAGADRCAPAASSPWRSLLGSRLWLSGSVQEAGFGLVIRWRTKAPGRRTALLV

SEQ ID NO: 34950 - protein, 307 aa, Sorghum bicolor
  Clone ID: SORBI-28MAY03-C56951_1.pep
HEAGTETNINLNHQIYYHVLGSDQSEDVLCWKDPEHPKYTFGASVTEDGKYIILGIYEGCDPVNKLYYCEISSLPRGIEGFRETQELLPFVKLIDNFDAQYEVVANDGDEFTFLTNKSAPKNKLVRVNIKNPELWTDVLPEHEKDVLESADAVNNNQLLVCYMSDVKHILQIRDLRTGNFIHQLPLEIGAVSEISCRREDKEVFIGFTSFLSPGIIFRCNLAPTIPEMKMFREISVPGFDRTSFEVKQVFVPSKDGTIIPMFIMSKKDINLNGSHPTLLYGYGGFNISITPSFSVSRVVLCKNMGFV

SEQ ID NO: 34951 - protein, 218 aa, Sorghum bicolor
  Clone ID: SORBI-28MAY03-C56953_1.pep
ARGRDLDRGVDVVVATPGRLNDILEMRSARLKQVSYLVLDEADRMLDMGFEPQIRKIVKEMPHRRQTLMYTATWPKEVRRIADDLLVHPVQVTIGSVDELVANSAITQHVEVITPSEKQRRLEQILRSQDSGSKILIFCTTKRMCDQLARTLTRQFGASAIHGDKSQSEREKVLNHFRSGRSPILVATDVAARGLDIKDIRVVINYDFPTGVEDYVHR

SEQ ID NO: 34952 - protein, 143 aa, Sorghum bicolor
  Clone ID: SORBI-28MAY03-C5720_1.pep
KHFTLHAYPTKKSLFGKTHRVQKDFCFIASTLDEAILWVTCFAEQSIYVNLLPRPAASSINPDSDNPLSESLFDQPPIKCKSPQRVLVILNPRSGHGRSSKVFHEKAEPIFKLAGFQMEVVKTTHAGHAKSLVSTFDFSVCPD

SEQ ID NO: 34953 - protein, 251 aa, Sorghum bicolor
  unsure (1)..(251): unsure at all Xaa locations
  Clone ID: SORBI-28MAY03-C57217_1.pep
RGARRAASATRWRAPSRRPVAPSWPRRGRAVPCATSTATRGSCCWSSTCXSDESARAAVADALREHGRVDVLVNNAGIHLVAPLAEVPMESFHQVFDTNVYGAMRLIQAVIPHMMERRKGTIVNVGSITALAPGPWAGVYSASKAALHALSDSLXGGTKSNLGSSSAAKYDQMHEWKYYKKYEEGLRARTDISQGPGATPAEELAKKVVASVLKKNPPAWFAYGQFSAILSMLYYAPLWFRDYFYKLVMKC

SEQ ID NO: 34954 - protein, 74 aa, Sorghum bicolor
  Clone ID: SORBI-28MAY03-C57228_1.pep
ERTIDYNPKRTRFRKQHRGRMKGKSCRGNHICFGRYALQVLEPAWITARQIEAGRRAMTRYARRGGKIWVRIFP

SEQ ID NO: 34955 - protein, 203 aa, Sorghum bicolor
  Clone ID: SORBI-28MAY03-C57236_1.pep
HEDSFPPLKAGLFFLKHAEAVGKEIPARELHEILLLSLQWLSGTMTKSPPVYPLHLLREIETRVWLLAVESESQSKADGEFATYAVAHNIAVGNSSSIIEQTADVITKIDSNMSSPHMKVTERNGTRDSLSSQHAQLFESNSEASSTTINNTRAKRRVKTNSPLRRGGNDNTESRTNELDNSSHSSKIGEQARNLLSEEEFAK

SEQ ID NO: 34956 - protein, 253 aa, Sorghum bicolor
  Clone ID: SORBI-28MAY03-C57234_1.pep
HEEQSFKRNKDSPGKRGDTELHLAARAGSVAHVQRILAECDPELVVELAARQNQDGETALYVSAEKGHVEVVCEILHAADVQSAGLKASNSFDAFHIAAKQGHLDVLKELLQAFPSLAMTTNSVNATALDTAATQGHIDIVNLLLETDASLARIARNNGKTVLHSAARMGHVEVVTALLNKDPGIGFRTDKKGQTALHMASKGQNAEILLELLKPDVSVIHVEDGKGNRPLHVATRKGNTIMVQTLISVEGIE

SEQ ID NO: 34957 - protein, 160 aa, Sorghum bicolor
  Clone ID: SORBI-28MAY03-C57238_1.pep
MAALVQEADDVDHYEVLCLPSGEEGAALTVEQIEKAYRTQSRLRHPDKRPDDPNATADFQRLSSSYKLLRDESLRRQFDARLRGRREAAARAAAAGVKRRKAVSDLEERERAAAAGIPADPEELAKREAKRMAADIERELAAFRAAKQASASGAASTSAH

SEQ ID NO: 34958 - protein, 120 aa, Sorghum bicolor
  Clone ID: SORBI-28MAY03-C57040_1.pep
MNMILQSFHHSLRTSFQAEQKSECCTSGEHDSQIVPFPLHDEKIDELDGPLLSNADELDRGSKVCVPHGHDAQITPCSTDEDIHELDHPPLSSSALVDLESEDHVSDDRDSKVAPCLVKD

SEQ ID NO: 34959 - protein, 73 aa, Sorghum bicolor
  unsure (1)..(73): unsure at all Xaa locations
  Clone ID: SORBI-28MAY03-C571_1.pep
VXRLVPTTSMKETSASFLVLPRELLKPSHGTPPAVTSGEEGIAGGNGGSATCTGSSFFIFAAGDASGSVSMGL

SEQ ID NO: 34960 - protein, 53 aa, Sorghum bicolor
  unsure (1)..(53): unsure at all Xaa locations
  Clone ID: SORBI-28MAY03-C57109_1.pep
TDDTMNCRKRFVRSYPFTLQQSSSRMVTYFLYILVYGIWKPILXIFTICFIDF

SEQ ID NO: 34961 - protein, 190 aa, Sorghum bicolor
  Clone ID: SORBI-28MAY03-C57130_1.pep
HEDEVELTREILQSIGCADDAPCDDGLSSLDSLQEELEKLVASKRFLLVLDDVWIDEGKTEKENRSMWKKVLAPLRSAAIGSKVLVTTRMKLVAEVLNAAHVVSLDRLRSSDCWLLLKEVALGGQPMDFPPELQEILGAIVANVKGLPLATKAIGQMISSTRSTRKWRALMNTEISDNIIISSPQLSYQQ

SEQ ID NO: 34962 - protein, 170 aa, Sorghum bicolor
  Clone ID: SORBI-28MAY03-C57292_1.pep
MEEHVPRGGGGGGRPPIPAAARKPALARHSSFVRSPANNKKPENERTFESMDTEFIPVVRSAGWADIGSRHTMEDVFICSDNFMQDFGFESSDEGPSAFYGVFDGHGGKHAADFVCSNLPRFIVEDEGFPREIVKAVSSAFLQVDAAFADACSLNCSLASGTTALAALVV

SEQ ID NO: 34963 - protein, 161 aa, Sorghum bicolor
  Clone ID: SORBI-28MAY03-C57317_1.pep
TRVKSSTAPSTNITGAQRRGLKNLGCTSISDVLPSGCSSSDSVRDRRVEVTKKRTSDAESSSRSRGISEQSNLSQPRASYPGSTGPRARAVEQLASQQIARTNSRSIQDPTDSIRTRRPFTLRARERMIPGEREDSVFALHETVASVHPECGHFHTDGAPP

SEQ ID NO: 34964 - protein, 246 aa, Sorghum bicolor
  Clone ID: SORBI-28MAY03-C57305_1.pep
TRLLQLPPEVPAPGAPALRGVLDRLFAHWLSLPDTAALLASLVHKAKASGGGGAAAAMLPSMMLQGRAAVPPLSPRSPRLSRRPSSLGAGQPNRSASPLRPPAARPAKEVIPQFYFQDGRPPPYEVKKQCISTVDQLFAGHSNGLRAPEFRMVTRELCKLPTFFTTVIFDKIDKESTGFVTRDAFIDFWVNSNLMSMDSATQVFTILKQQNRNYLTKEDFKPILKDLLDNHPGLEFLKSTPEFQER

SEQ ID NO: 34965 - protein, 72 aa, Sorghum bicolor
  Clone ID: SORBI-28MAY03-C57321_1.pep
ERTQTEWQTLYTNQRKTLLQLCFVLYSIAVYVESYNIKYFSAYADISIQYSEQRTCSVSKSRAQGIGIQHSE

SEQ ID NO: 34966 - protein, 171 aa, Sorghum bicolor
  Clone ID: SORBI-28MAY03-C57339_1.pep
TRATHDMAWKAHYREVFDHGIREALCCLARAKYLTVLEEDEVYSVARLLGDLVAYRASGTGHLELLAGLALLQKHGNLPESQTDLMEASHELMQEAAFLHPFAEACYTGPLLDVGRNPILFPCAWVYRQGVLTPWARRRRPALDGDNWWRGHAAAFLRVVNIPPKALLRGR

SEQ ID NO: 34967 - protein, 214 aa, Sorghum bicolor
  Clone ID: SORBI-28MAY03-C57354_1.pep
TRTGKRPRQHREYEREERHDQHKRPFPHAQESSNNDGLVLYRILCPDSLIGSVIGKNGNVINAIRQQTSAKVKVVDPYPGADKRVILVYCYVKHRDLDAEVDDNEPVCAAQDALLRVHNAIVDTLHRNRRDSDKKNTEEANILVPASQASNVIGKSGAVIKHLRSTSRAFIKVSPKDPSDATHSCAMSFDNFVQITGGAEAVKKALFGVSTIIY

SEQ ID NO: 34968 - protein, 107 aa, Sorghum bicolor
  Clone ID: SORBI-28MAY03-C59709_1.pep
ARGFPVPGMVPHPMYRPTMVPPPPPPPPPQPSTKLAELQLELDTHPSKESIDAAIGDVLVRPSRPRPRGRAPPSPGRPGSARPWPGAPSLPPAAPATASATGRSHRT

SEQ ID NO: 34969 - protein, 131 aa, Sorghum bicolor
  Clone ID: SORBI-28MAY03-C59736_1.pep
AANMEGKGINRQSAVDLMAGAIGCLLPKLGEFLKQEHNLETSIKQDIESLDTQLRTIMDTALPWVQQDDKHCAYQLRGLSYDIEDIMDNLLLLVGKASASKPITNQDSFKETLEDIKIQVKNLAASHAGNF

SEQ ID NO: 34970 - protein, 162 aa, Sorghum bicolor
  Clone ID: SORBI-28MAY03-C59830_1.pep
HEGEDHESHRSGKVETKEVNEQESSRGHATLSKKSQNPQPDNSLLNQVEEDAISDDENHEDSRRGRSKLERWTSHKEIEYSNIDDDSTQTFPTIKADAEADEVGKSEVSAAVGNSDINSNVDTGQTSDKMTEERDRHLDTVERLKRRSERFKLPMPGEKDAP

SEQ ID NO: 34971 - protein, 184 aa, Sorghum bicolor
  Clone ID: SORBI-28MAY03-C59831_1.pep
ARGSHDQLIAKVRSILENQSCENNSIDHQAKPTAPTAADANDLDMHDIHNGDNIQSEHVTEAPNHSKGYGTNQHINHERHVPLQQNSPTEAAAPQPMDAATNAGSEQELDHEHSPVHTDVTIGDVVPPILGQAMDQEGTGQASHIGSMCFLKFVPSNITIIPIYLSCSCQCQYSWRNLIPGFSS

SEQ ID NO: 34972 - protein, 175 aa, Sorghum bicolor
  Clone ID: SORBI-28MAY03-C57409_1.pep
HEGTIPQNFSGLPNLQILSLEGTWLNGSVPSTIWNGIRLTGSRSLILDFQNNSLKTIPAAFDPPPNVTVMLYGNPVCEDTNGALITNLCQPMSVNMQTSKNEQGYSCQPCPTDKNFEYNPSSPIPCFCAVPLGFGLRLKSPGITDFRPYEDAFEINLTSLLQLFLYQLNIESYIW

SEQ ID NO: 34973 - protein, 272 aa, Sorghum bicolor
  Clone ID: SORBI-28MAY03-C57436_1.pep
MAEAEADATAALSARSKVQAFLEAARAGDLQSLKSLVAVLDEDGTGAASVASAVRDADWRTALHFAAREGRADVCEFLIGELGLPVDPKDDDGETPLIHATRQGHLDTAKYLLDHGADPSVATNLGATALHHAAGIGNTELMKLLLSKGVDVESESDAGTPLVWAAGHGNPDAVKLLLQHNAKPNTENDDGVTALLSAVAAGSLPCLEVLIKAGANPNVKAGGATPLHIAADSGNIEVIKCLLKAGADPNICDDDELKPVQVAAWRNNREAV

SEQ ID NO: 34974 - protein, 163 aa, Sorghum bicolor
  Clone ID: SORBI-28MAY03-C57438_1.pep
ARGSTDEYEIHHQAAAAGGGFEQADPVSYSEEYGLSFGVSHSTSTEDGQPLYVSRNSSFNTVDERMMGKDGKLHRLMGYSSASELLRRHSPDLFESFDRRTPTIERTHVVDRKGKGVCVAENDAGERDGGAVVKRSKARSGGLPLHGILKKGIHGLESLKLRS

SEQ ID NO: 34975 - protein, 102 aa, Sorghum bicolor
  Clone ID: SORBI-28MAY03-C57468_1.pep
HEATFRKLYGRIETDIMENDQLTVVIQNNYNTYSFGGSKALVLSTTSWIGGKNNFIGVAYLSVGGFCLFLALLFLVLYMIKPRYNVLFQSDADAFPIILDLS

SEQ ID NO: 34976 - protein, 152 aa, Sorghum bicolor
  Clone ID: SORBI-28MAY03-C57476_1.pep
TRQGSNHAGNNLTLKGWPLTGLDHFRSGILQQKPFMQSPQQFQQLQFLTPQQQQQLLLHAQQNLSSSMSNDVDTRRLRMLLNNRNVVLGQDGQTNSGGDIIPNIGSPGQSGGSRNDIDILIKKKLALLQQQQSQQQSHSQQQQLQQPALSGQ

SEQ ID NO: 34977 - protein, 134 aa, Sorghum bicolor
  Clone ID: SORBI-28MAY03-C57242_1.pep
HEAAPGFGLLKVGPEGGLATPLATEAEGVRLNFTNDLDLDDEGNVYFTDSSIHYQRRNFMQLVFSGDPSGRLLKYNPQTKETTVLHRNLQFPNGVSMSKDGSFFVFCEGSRGRLSRYWLKGEKAGTVDLFAILP

SEQ ID NO: 34978 - protein, 239 aa, Sorghum bicolor
  Clone ID: SORBI-28MAY03-C57243_1.pep
HEGDHCRSPFQKGQGSVSDPIYMNPRWTRPVQQHFDQASMISDYPSHHASSCSDYCRPGEHYVGGQDVRLENGVYVKEQNGGHPPMFYNESHPHDRVWHAHTNQSHQRYEDPRLQPPANGRVIEPYIVDGNSVNSAFAPNKVYEMHSASLGRSSHESPHHFHGTSELINDTYHNQQVGGSGSYVQPAGFEESSGQHYNHSSAYGADSFYQMQQNLPPIQSLRRRANSPVHTASPYDSPH

SEQ ID NO: 34979 - protein, 164 aa, Sorghum bicolor
  unsure (1)..(164): unsure at all Xaa locations
  Clone ID: SORBI-28MAY03-C57246_1.pep
MEVFNCQPTDMWDRSPSKRHYEPRQTRQYSIRSIATPASMDSMRRSSVGLLIGLLLIRLNRCSAVGDEGAGEVGAAFPVVVSTWPFREAVRAAWKVVSTGEGGGSAVDAVIAGCSACEELRCDGTVGPGGSPDENGETTLDALVMNGETVXATMEIGAVAAMRY

SEQ ID NO: 34980 - protein, 196 aa, Sorghum bicolor
  Clone ID: SORBI-28MAY03-C57263_1.pep
HEEMLQQLLLSKFTGVTGPVQFDSDHNLVRPAYDILNIAGSAPRLIGYWSNYSGLSVAAPEILYQMPRNTSTSAQQLHDVVWPGDSTTKPQGWIFPNTGQPLRVGVPIKASFKELVSGRGDNMSGYCVEIFNAAIKLLPYPVPYQFITIGDGTKNPSYIDIIRMVAANSLDAAVGDFAIVRNGPQLAEYTQPYIES

SEQ ID NO: 34981 - protein, 177 aa, Sorghum bicolor
  Clone ID: SORBI-28MAY03-C5728_1.pep
AAGGGGATFERGKMVFLEDVSCSNGGTRRFELEELLRASAEMLGKGGCGTAYRAVLDDGTVVTVKRLRDATAPAAASKKDFEHHMAMLGRLRHPNIVPLNAYYYARDEKLLVYEYMPNGSLFSVLHGNRGPGRTPLEWAARLRIAAGAARGLAYIHHSGRRGSGTPKLAHGNIKSTN

SEQ ID NO: 34982 - protein, 188 aa, Sorghum bicolor
  Clone ID: SORBI-28MAY03-C57578_1.pep
HEAHPYMSSGATTLHGLLQDGHQQDMSSTTEQSAMTASSLMNPSSNNLALALQGHHHQEQDHQQQMLSSFGSELLLSPTSPYGFQSSLLRSLMEPTATAAAKPQALPGYQQYDQYQQMGMGQARFPPAGATREALQFTNDAPFWNPSAAGFGVAPAPAPDQASSVRSVKPSPTAARTTATLALKTALE

SEQ ID NO: 34983 - protein, 262 aa, Sorghum bicolor
  Clone ID: SORBI-28MAY03-C57650_1.pep
ARGLKPRTKRWLFARNLEESGSSLKFAKLETEEAVSRIMKYSEDIEKGSFTPSREKDELSLGLGNPEHPGRVRGLGKHKTWARGFREDVEMYKKHGRNREVSLATLVKTLVAKELQEQGLSTERRSQIEPPRDLVLVGSPPNVQSSQGSNAASASVDHIRVPTRCILLIPIGRGQEMAEVATGLAHPPIPGDIWHHKPVPADYSKVEVHTVNPEYAKHKIEHPTSEGIRELGLLMKQFILWYKKDIVLNVSSPTPSDVHLER

SEQ ID NO: 34984 - protein, 205 aa, Sorghum bicolor
  Clone ID: SORBI-28MAY03-C57651_1.pep
ARGVAVTAVAIASGACLSTKVDFLWPRIEQLPDTLIFEGVEVTGYQIFEDPKVQKAIEFASTAHLGQFRRTGDPYVTHCIHTGKILAALVPSTGERAVNTVVAGILHDVVCDTSESLKSIEEQFGDDVASLVSGVSKLSYINQLLRRHRQKNTGGSTLTSEEANNLRVMLLGMVDDPRVVLIKLADRLHNMRTIYALPVPKAEAV

SEQ ID NO: 34985 - protein, 110 aa, Sorghum bicolor
  Clone ID: SORBI-28MAY03-C57664_1.pep
MAPVYTGAVHGTNGGSGLTLNPAVVAQRALSLGGASTPLSSSTPPAYGNIVTVLSIDGGGVRGIIPGTILGFLEEKLQEFDERPEARLADYFDVIAGTSTGGLVTAMLTA

SEQ ID NO: 34986 - protein, 135 aa, Sorghum bicolor
  unsure (1)..(135): unsure at all Xaa locations
  Clone ID: SORBI-28MAY03-C57670_1.pep
ARGAIKEVFLYINDEPDHTNSSVITLGTMRIKCLEKLNTLLSCLKLPLISSKRTIRDFCIESASIIFWTVSTSTKVITNKKLELLVVDEAAQLKECETLIPLRLWTLXHAVLIGDECQLPATVKSKVCTDALFGR

SEQ ID NO: 34987 - protein, 198 aa, Sorghum bicolor
  Clone ID: SORBI-28MAY03-C57692_1.pep
KSIVLQIDSKSQQVSASALRHSLQDRLSKGASSGSGRSRSDEIYLKLRTSTAPPLKLIDLPGIDQRVMDDSTISEYAGHNDALLIVVIPAMQAADVASSRALRLAEDIDPDGTRTIGVLSKIDQAAADAKTVSCVQAILSNKGAPRAAADIEWVALIGQSVSIASAQSGSVGSDNSLETAWRAEAETLKSILTGAPQS

SEQ ID NO: 34988 - protein, 288 aa, Sorghum bicolor
  Clone ID: SORBI-28MAY03-C57708_1.pep
ARGLRYLNAPWTRDLQFPECITKLSHLIFLNLHGSDIEKIPESIGEMKDLRHLDLSCCRIKRLPDSFMSLQKLVHLDFSNCHLMLGESESLWSLSRLEHLSLSKCRIEGDLAKALCGLRELQYLELSHLFCWGNLGRGLQHVAKLMYLDIRGFLDRNIVGGAETETVIEAISSLSNLVYLNLGWNQNLYYIPESIGNLSKLRTLDLSHCINLERLPAAISGINNMKFVHVAGCDRLDKSTLPLYKNVAKLLPYFAVHAGDSESSSNLRWLEYENPTKLELSGLENVKS

SEQ ID NO: 34989 - protein, 147 aa, Sorghum bicolor
  Clone ID: SORBI-28MAY03-C57359_1.pep
TRGRREAPLPLFNQERLYSVAARRFGRKWRPDSSDDDDEGTSAPKRNLRFGKFGASSEEDSEIDESGDTGAIRRRWSSAALRNCDMKKERRVLKYYEEESNDLAGRIRELREEIRNREVLGTERRRYESRGESLLPVKDLMSVVSPL

SEQ ID NO: 34990 - protein, 167 aa, Sorghum bicolor
  unsure (1)..(167): unsure at all Xaa locations
  Clone ID: SORBI-28MAY03-C5736_1.pep
MPAPTLPTPPPSPLLPPAGEPFRVFVGYDPREHEAYEVCRRSLLRRSSIPLDVRPIRQADLRAAGLYTRARGPTESTEFSFTRFLTPYLAGYRGWALFVDCDFLYLADIPELLAAAVPPADAADRIAVACVKHEYQPAEATKMDGAIPDGYPRKNWSXMVLYNCAHP

SEQ ID NO: 34991 - protein, 259 aa, Sorghum bicolor
  Clone ID: SORBI-28MAY03-C57368_1.pep
MDATGQQEQHAGDGGGDRYGVLLYYKYAEVPDAAALAAFYEAHCRGLALVGRVRVGPDGVNATLGGRMTTLEKHIKEMSSNALFEGTDFKLASCDDPVDERVARECGFTSLSVRVVKELVTLCSNPTSAPPEVSSAGKHLSAAEFHSVLQNVAGTSLDAVASAEKKEVVVLDARNVYETRIGKFNVPNAKTLDPEIRQYSDLPSWIDEHAEQLHGKSILMYCTGGIRCEMASAYIRSRGEGFENVFQLYGGIQRYLEQF

SEQ ID NO: 34992 - protein, 208 aa, Sorghum bicolor
  Clone ID: SORBI-28MAY03-C57378_1.pep
HEATVEPPMLVISTVLSVMAYDYPQEKLNIYLSDDAGSIITLYALYEASEFAKHWLPFCKSSRVEPRSPAAYFGKEATPPDACDRKEWFSLKEMYKDLADRVNSVVNSGKIPDVSKCKLRGFSKWSENTSFRDHPSIVQILIDGNKRKATDVDGNVLPTLVYMAREKRPQEHHHFKAGSLNALIRVSSVISNSPVIMNVDCDMYSNNS

SEQ ID NO: 34993 - protein, 226 aa, Sorghum bicolor
  Clone ID: SORBI-28MAY03-C57719_1.pep
MVGGFLRAFAAASAVPAAAAAAYALSSSSAPCSSKLRFPLPASFLSAASSSSSSGRAPSAVPPTATAAAAAADLSAPDKQQDSALPGLTTEFMVDMKCEGCVTAVKNKLQTLEGIKNIEVDLSNQVVRVLGSLPVKTMLDALHQTGRDARLIGQGNPNDFLVSAAVAEFKGPVIFGVVRLAQVNMELARVEATFSGLSPGKHGWSINQFGDLTRGAESTGNVYNPP

SEQ ID NO: 34994 - protein, 94 aa, Sorghum bicolor
  Clone ID: SORBI-28MAY03-C57733_1.pep
LSYIVSTRFKLLVLFLISYQSSKQYASSPANGSASVHPFVKSCRFHTWKKWFYKSGSTSKDTIIIQTQPSCYLNLLKLHKWRPRRRLGISVVLD

SEQ ID NO: 34995 - protein, 60 aa, Sorghum bicolor
  Clone ID: SORBI-28MAY03-C57748_1.pep
KIVQIFLRTKQSLKNTIFLFAIYLFIFIHHLFMSNLQIVESRFQTYIFFVSVPRSPLRTD

SEQ ID NO: 34996 - protein, 126 aa, Sorghum bicolor
  Clone ID: SORBI-28MAY03-C57749_1.pep
HEASCRFAESRIRAETIAAEDILHDMGAISIISSDSQAMGRIGEVITRTWQTANKMKVQRGSLPGSADSNAAQNNDNLRIRRYIAKYTINPAIVNGFSDFVGSVEVGKLADLVLWKPSFFGAKPEL

SEQ ID NO: 34997 - protein, 284 aa, Sorghum bicolor
  Clone ID: SORBI-28MAY03-C57753_1.pep
MASRLLHLHLRRGRVRVRGGSPAGSPVPAPARPLSSSPPPTASSASAGGGGGIEKVLVANRGEIACRVMRTARRLGVATVSVYSDADRGALHVRAADEAVRIGPPPARPRGLNAGAIIDAALRTGAQAIHPGYGFLSESADFAQLCETEGLKFIGPPASAIRDMGDKSASKRIMGAAGVPLVPGYHGADQDIELLKLEADKIGYPVLIKPTHGGGGKGMRIVERPDEFVDAVLSAQREAAASFGVNTLLIEKYITQPRHVEVQVFGDQHGNAIYLYERDCSLQR

SEQ ID NO: 34998 - protein, 162 aa, Sorghum bicolor
  Clone ID: SORBI-28MAY03-C57768_1.pep
TRETLKDNDVLVQYKIMRETLIYLSHLDHEDTEQQMLRKLSKQLNGEDWSWNNLNTLCWAIGSISGSMVEEQENRFLVLVIRDLLNLCEIMKGKDNKAVIASNIMYVVGQYPRFLRAHWKFLKTVVNKLFEFMHETHPGVQDMACDTFLKIVQKCKRKFVTL

SEQ ID NO: 34999 - protein, 165 aa, Sorghum bicolor
  unsure (1)..(165): unsure at all Xaa locations
  Clone ID: SORBI-28MAY03-C5748_1.pep
DRLATPCHEGHAHSDGKRECNSDEENSEGERKPKKGSLKKRAATAGYKFRHSLRRKSKTKDDNHVASIEDIRDVQELETVERFRQCLLDEGLLPEHHDDYHTMLRFLKARKFNIDKAKHMWSEMLRWMKEFGADNIDEFDYTELDEVVKYYPQXYHGWQRGKAVT

SEQ ID NO: 35000 - protein, 188 aa, Sorghum bicolor
  Clone ID: SORBI-28MAY03-C57486_1.pep
TRPCLNHDQSVLVESLDVPDWATCFPGYFEDCGPVATYNHVDDIGSPVHEYLPRKGVPIGPEHQADIPEWRPRISMIVPGTSEFCADLDCSSASTSESVTRGDDYVSESDKWIRCCVVPMMSCSSLVDWAGDNKIDCNCSDEGSTRCSRQHIIEARDSLKMSLGQDTFRELGLCEMGEDVAQRWTDDE

SEQ ID NO: 35001 - protein, 157 aa, Sorghum bicolor
  unsure (1)..(157): unsure at all Xaa locations
  Clone ID: SORBI-28MAY03-C5753_1.pep
RMLTXWFEFGSIYVRNESSSNQRMKEINXKCLIRGCLKDLPTYQWLTVLSQLISRICHQNADVVKMVKCIITSILREYPQQALWMMAAVSNSTVLARRDAAAEILQSAKKGCRRASNALFSQFTNLIGHLIRLCSHPGQPRAKTINIXTEVSALKRM

SEQ ID NO: 35002 - protein, 202 aa, Sorghum bicolor
  Clone ID: SORBI-28MAY03-C57619_1.pep
TRGVGGGILWVASALSVPPRRSRRSRARASSRRRRPPPSIPSSSTALELRGSPLAVAFVGLPLAPPPLTGPWGLGDGGFGTVYRGKLRDGRVVAVKRLYKNNYERVEQFINEVDILSRLHHQNLVILYGCTSRSSRDLMLVYEFIPNGTVADHLHGSRASERGLTWTLRMNIAIETAEALAYLHAVRIIHRDVKTNNILLDN

SEQ ID NO: 35003 - protein, 93 aa, Sorghum bicolor
  unsure (1)..(93): unsure at all Xaa locations
  Clone ID: SORBI-28MAY03-C5751_1.pep
MWNSIYRFLCGLCAPSSSEHGLHGAHPXVAVLGRDILSFQSTSQVPDELSRHVVSFKKAQANWYKKLLVAWKKARPPPKTPEEAAAFVVQTLK

SEQ ID NO: 35004 - protein, 205 aa, Sorghum bicolor
  unsure (1)..(205): unsure at all Xaa locations
  Clone ID: SORBI-28MAY03-C57837_1.pep
ARGYDKESGLWGXGEKPDRVVSTNLNFNGKLQPDASNGNAQVFINGREITKIELRILKIAKVQCPRDTHFWVYHDGGYEEEGQNNIKGKIWESPLTRFACALVSLPVPPTHFDATKDDVPYSSRTVPDYLDHKRIQKLLILGSPGAGTSTIFKQAKLLYGNRFTEEELENIKLMIQSNMFKYLXILLEGRERFEEEALAVSDHPG

SEQ ID NO: 35005 - protein, 168 aa, Sorghum bicolor
  Clone ID: SORBI-28MAY03-C57842_1.pep
MRREPTTSLACGTGALAIFLRKAFEVDITTSDYDDKEIEENIAYNCRANTLDVLPHIRHTWGHPFPVSRPDWDIVIASDILLYVKQYDNLIKTVSFLLNEYKQNGHKSDSITITNKSGTPVPAKSPVFLMSWRRRIGKDQSLFFDGCEKAGLEVQHLGDLVYLISKKR

SEQ ID NO: 35006 - protein, 130 aa, Sorghum bicolor
  Clone ID: SORBI-28MAY03-C57846_1.pep
SASSSLFVLPDLPYSSLDISFVSFATDPSTSATPLPSLHSSASSGSSGSSNSSSGSSGSSNSSSGSSGSVSSDSSFNSSFSPSSSSGSSSSPGFSTGNGSTNSASIPSAVSTSPGASSSFSSSSSSSSLV

SEQ ID NO: 35007 - protein, 198 aa, Sorghum bicolor
  Clone ID: SORBI-28MAY03-C57847_1.pep
TRNWIQLEPAIERTTPSDINGCWTGSATILKSDQPAIIYTGADTEKRQVQNIAFPKNLSDPYLREWIKPDNNPLIQPVGQGLIPNQFRDPTTGWIGPDGLWRIAVGAELDGYSAALLYKSEDFLHWTRVDHPLYSSNASTMWECPDFFAVLPGKNIGLDLSAAIPNGAKHVLKMSLDNCDKYMIGIYDLKSDVFVPDS

SEQ ID NO: 35008 - protein, 208 aa, Sorghum bicolor
  Clone ID: SORBI-28MAY03-C57854_1.pep
STRVSAAREGNTSDVKELIPEFYYLPEFLENSFNLDLGEKQSGEKVGDVVLPPWAKGSAREFIRKHREALESDYVSENLHHWIDLIFGYKQRGKAAEDAVNVFYHYTYEGNVDIDAVSDPTMKASILAQINHFGQTPKQLFQKPHPQRRTDRKVPPHPLRYSAYLTQQEIRKTASSVSQVVSYNDKILIASVNCLLKPLTYNEYISWG

SEQ ID NO: 35009 - protein, 182 aa, Sorghum bicolor
  Clone ID: SORBI-28MAY03-C57713_1.pep
TRLVRRVEPTAPASSVLRKGDVIVSFDGTSVGCEATVPFRSTERIAFRYLTSQKCAGDIAQLGIIRDGNSMKVQTILQPRKHLVPFHVEGGQPSYLIVAGLVFTPLTEPFIEEECEDTLGLKLLAKARYSLATFEGEQIVIVSQVLAHEVNIGYEHMGNQQVMRLNGTTIKNIHHLAHLVDT

SEQ ID NO: 35010 - protein, 167 aa, Sorghum bicolor
  Clone ID: SORBI-28MAY03-C57716_1.pep
MPVKAAAVATAAVVSSSMVIAAAKSNGDIKLDVPVAAAATAAAVVATTGAVNKQYEYLDPGCQLLCLPSSSNKLIQKGRHDLLDDDQLETNHGQDNSLEHEKDSVQAPQEAERISDRSTGTESARSEIALDEIAEFEIQWEELTLGERVGLGSFGEVYRGEWHETEV

SEQ ID NO: 35011 - protein, 78 aa, Sorghum bicolor
  Clone ID: SORBI-28MAY03-C5773_1.pep
ARGFDSSSFPLLSSCRAQIRAFHFHIHGILLLYYLVNLLQICEIKKLVQKGRLLIVYWFSLLMCRHLWFHVSGAAEVN

SEQ ID NO: 35012 - protein, 174 aa, Sorghum bicolor
  Clone ID: SORBI-28MAY03-C57392_1.pep
MGDVPQAPHAAEGGGGGLEEGAVPDPNPAPGLSLGGCSDPVSLELSMGGDYYRACCGDPDPDIPEGPKLPCVGEKEPLSSLAAEFQSGSPILQEKIKLLGEQYGALRRTRGDGNCFYRSFMFSYLEHILETQDKAEADRIMVKIEDCKKTLLSLGYIEFTFEDFFAIFIDMLES

SEQ ID NO: 35013 - protein, 157 aa, Sorghum bicolor
  Clone ID: SORBI-28MAY03-C57902_1.pep
ARGQHQPRIVREKRFTEVIHNTVSQGGRVLIPAFALGRAQELLLILDEYWSKHPELHKIPIYYASPLAKRCMAVYQTYINSMNERIRNQFAQSNPFHFKHIESLNSIDNFHDVGPSVVMASPGGLQSGLSRQLFDKWCTDKKNACVIPGYVVEATLA

SEQ ID NO: 35014 - protein, 191 aa, Sorghum bicolor
  Clone ID: SORBI-28MAY03-C57924_1.pep
TRHRFYQRSPSSVSHLVSNFRKRLCDNDPGVMGATLCPLYDLILEEPNSYKDLVVSFVNILKQVAERRLPTSYDYHQMPAPFIQIKLLKILAVLGSGDKQASGHMYTVLGDIFRKGDTASNIGNAILCECICCISSIFPNPKMLEAAAETTSKFLKSDSHNLKYMGIDALGRLIKINPDIAEEHQLAVIDC

SEQ ID NO: 35015 - protein, 85 aa, Sorghum bicolor
  Clone ID: SORBI-28MAY03-C57932_1.pep
TRVEQPSPRLLKHIIRCYLRLTDDRRACNALRSSLPTALRDGTFNDLIEVDLTARLWLHQLLHNIMMMSNGGGGPHPVLGRAMGM

SEQ ID NO: 35016 - protein, 74 aa, Sorghum bicolor
  Clone ID: SORBI-28MAY03-C5794_1.pep
YQIVFLKVFLEPSINCQHSFYTTTFADIKKIVGCRCAYFVQYECYFCIAELFILDLMNLFINYPAWYFQLLLVT

SEQ ID NO: 35017 - protein, 174 aa, Sorghum bicolor
  Clone ID: SORBI-28MAY03-C57956_1.pep
ARGSCLAAVEGFKSSADMLVTYMKEYPMCPQILLISARLDRKHGTCPGLKSFDELILNWPKEAQGIQYMWNQYVEHVLATDTELAEKVLTCWFDEHGKDCDIQTNSAICIELSSEEPGTSSLVSPQEVGSGPSTSEDLIFRLLNLSLYKILENNLQEAQIAVDKALKLAHGEWY

SEQ ID NO: 35018 - protein, 103 aa, Sorghum bicolor
  Clone ID: SORBI-28MAY03-C57774_1.pep
LSATGRTQPTATGNRWYPGHANAAACDVALSAMVYGLLACDGALCYGLWATPTAGIIARVGPRRTLELKPARDASKWGWFNLGLNRNRSIDSFVVKWSTDQTV

SEQ ID NO: 35019 - protein, 133 aa, Sorghum bicolor
  Clone ID: SORBI-28MAY03-C5779_1.pep
EPGSGRVARGALADLPPPFAPPCSALTAGWALPTPHWQCHVDPRLRRHRVTAPCTRAQLTPHDKQDNAALFGTLLSVPTVGAARRSPSLRAPAQLWAGSADSLLTCFTRFSPVSGLPMKLHALGQSATAAGLH

SEQ ID NO: 35020 - protein, 190 aa, Sorghum bicolor
  Clone ID: SORBI-28MAY03-C57798_1.pep
TRSESAAMLARKPPQKMTTARRSRAAEVHNLSERRRPRGINEKMRALQELIPHCNKTDKASMLDEAIEYLKSLQLQVQMMWMGSGIAAPPAVMFPGVHQYLSRMGVGMGPAAAMPSMPRLPFMAAPQPVVPPNAQVNPVPGYRGHHHMPAAVGMAEPYGHYLGVNHLQPPPSQHYAQGVGYYPPPLGAKA

SEQ ID NO: 35021 - protein, 120 aa, Sorghum bicolor
  Clone ID: SORBI-28MAY03-C57816_1.pep
MAGGDELKLLGFWGSPFVLRARLALSFKGLSYEYVEEDLKNKSQLLLQSNPVHKKVPVLIHNGKPVCETKIIMQYLDEVYGPSLLPADPYDRAMARFWAAYIDDKLLGSLMMMSMGKTDE

SEQ ID NO: 35022 - protein, 192 aa, Sorghum bicolor
  Clone ID: SORBI-28MAY03-C57817_1.pep
MAVTVVRDVETGLDASTSDRDGDGAGDKPSWFTPKRLPRGFCIINMLNYVDRGAIASNGVNGTRKSCSGGTCTSGSGIQGDFDLNNLEDGSLSSAFMVGLLLSSLIFASLVKRYNPFRLIGVGLLVWTIATAGCGVSFDFWSITICRMFVGVGEASFISLAAPFIDDNAPIAQKTAWLGMLYMCIPTGIALR

SEQ ID NO: 35023 - protein, 136 aa, Sorghum bicolor
  Clone ID: SORBI-28MAY03-C58080_1.pep
MGKGPSSRAGSRHHQFRARAMTRVDDLQEVFSGLQSARKDSRPADAAVLEAQLQQMLREWRSELSAPSPASSLQGNARELSDPPSDTLRLLQLAAAEEEDDATSKMVEQQQQQQQPPPPPPPPPPPSADQNQGHAQ

SEQ ID NO: 35024 - protein, 127 aa, Sorghum bicolor
  Clone ID: SORBI-28MAY03-C58131_1.pep
MGRGKIVIRRIDNSTSRQVTFSKRRNGLLKKAKELSILCDAEVGLIIFSSTGRLYEFSSTNMKAVIDRYGKAKEEQIGTNNATSELMLWQREAASLRQQLHNLQESHKHRLRVVLKKKGSLINRKFQ

SEQ ID NO: 35025 - protein, 132 aa, Sorghum bicolor
  Clone ID: SORBI-28MAY03-C58133_1.pep
TRAPAPPALPALRHRPFPPLPPLGGPGAPPSSRPGPAPGPAAGWHGRGGGEPCRRRPPQSPPRPLLPSPPARALSAASAAASAGRPVPWGGGRALVQVSAPVPVAVPAPVPAPPPPPRPVRHGRRPPRASVP

SEQ ID NO: 35026 - protein, 158 aa, Sorghum bicolor
  Clone ID: SORBI-28MAY03-C58152_1.pep
GRTDLLVRVKLTPNEKLQGNRSKHTRSRGGVAAAVAAAPGCSRVWGRPRVGATPPHHHARVWPCLGATPPRKAPGHGRSSRAGRGTRGAGARSRVEGGMEGVVGLRPRRRVLPVSSPCSLLQRSGFLRGRKERGEVKRREKRAAFTEVAIAMAAAASC

SEQ ID NO: 35027 - protein, 221 aa, Sorghum bicolor
  Clone ID: SORBI-28MAY03-C58153_1.pep
TRAARKSSWLSEEEFRVGHIDLKPATARSVLGNQSADPSMPKDQNARAKSIENRHERSEGAMKPDVQQKKSSVAANGSDIQISSSSIQGKSSVVVRAVDEPPKPVSDEGVKVSTKPTSESETRATQKRAHNAGKVMKNDVAKEDAKAGKSTSWNVNQQVSTVDREAMPHGADAAQETNTTISNGNLHPVQRKVSSSSQRNAVLVTHNGAANPSGESIDLID

SEQ ID NO: 35028 - protein, 153 aa, Sorghum bicolor
  Clone ID: SORBI-28MAY03-C58172_1.pep
MATGVAPAPLPHVRVRDGGVGFTRSVDFAKVLSTPSAGTMRTSSSRGRALVAKSSSTGSETVELEPSSEGSPLLVPRQKYCESIHQTRRRKTRTVMVGNVPLGSDHPIRIQTMTTSDTKDVAKTVEEVMRIADKGADIVRITVQGRKEADACF

SEQ ID NO: 35029 - protein, 120 aa, Sorghum bicolor
  unsure (1)..(120): unsure at all Xaa locations
  Clone ID: SORBI-28MAY03-C5787_1.pep
MHDFCXTIPYGFAVLAGGVMGYLRRGSTASLAGGAGAGAILLLAGFVSLKAFEKRRNSYVALALQTLCALALTYVMGQRYLETSKIMPAGVVAGLSAVMSVFYLFKIATXGGNHIPPKKE

SEQ ID NO: 35030 - protein, 90 aa, Sorghum bicolor
  Clone ID: SORBI-28MAY03-C57874_1.pep
MFAELKVLTLKIHKIRIASFFDSLRGFFSGICARGSHLPCGFPLVPGRLFHPALASRTLRTVLGPLEAVSLAPSYCDKSIVIVGIEFLGP

SEQ ID NO: 35031 - protein, 208 aa, Sorghum bicolor
  Clone ID: SORBI-28MAY03-C57875_1.pep
HEACAKEDMRYKPSGARGFISTCLNMFVEPVLNYWPLNKLRERALNHILEHIHYEDETTQYIGLCPVTKALNMICCWVENPNSDALKRHIPRIYDYLWIAEDGMKTKIYNGTHNWELALIIQALLSADAANEYGRTIERAMGYIKRAQVTTNPPGNPSDWFRHRSKGSWPLSTVDNGWASSDTSAEATKAMLLLSRVYPKLVENSDGD

SEQ ID NO: 35032 - protein, 66 aa, Sorghum bicolor
  Clone ID: SORBI-28MAY03-C57884_1.pep
MAGLEELKKKLQPLLFDDPDRGGASTRVPLPEDTCDSYAISDGGTVNLLSRSLGEYNINELGFHKR

SEQ ID NO: 35033 - protein, 78 aa, Sorghum bicolor
  Clone ID: SORBI-28MAY03-C57893_1.pep
PCSCCKCRTDLAAPFYSSRKRVSSLESMQGTCQICCGMKKRASVIGSKSKLRQEKMQRTEVSRVSEGKRKKENKKYLR

SEQ ID NO: 35034 - protein, 186 aa, Sorghum bicolor
  Clone ID: SORBI-28MAY03-C58242_1.pep
PAGVKFDPTDQELIEHLEAKVKDEGSRSHPLIDEFIPTIDGEDRVGYTHPEKLPGVTRDGLSKHFFHRPSKAYTTGTRKRRKIQTECDVHKGETRWHKTGKTRPVMVNGRQKGCKKILVLYTNFGKHRKPEKTNWVMHQYHLGDLEEEKEGELVVCKIFYQTQPRQCSWSSDRGTAATAAMAATTM

SEQ ID NO: 35035 - protein, 169 aa, Sorghum bicolor
  Clone ID: SORBI-28MAY03-C58273_1.pep
ARGPRAIALAIAQVLMAIGHFNFAMAWPGTMYIGTLLVGVGYGAHWAIVPAAASELFGVKNFGALYNFLTVANPAGSLVFSGVIASGIYDAEAAKQAQQRHNSMLLAMSGRVVNIVSEAAPSLKCEGAICFFLSSLIMSGFCIIAFGLSLILVYRTKIVYTSLYGRPRT

SEQ ID NO: 35036 - protein, 200 aa, Sorghum bicolor
  unsure (1)..(200): unsure at all Xaa locations
  Clone ID: SORBI-28MAY03-C58298_1.pep
HEDGLGIITIADIPEFPELRKRLLRLAPRIANLPEEVKKQLEDPDSRYNFGWARGKEKXXESGKLDTFKGSFYANPVLDVPTTDDVLVSRYPSYCRPNIWPNENLPELEIAFKALGKLMMEVGLMLAHHCDRYVMGQGVGSYDGDSLEQTIARSRCHKGRLLYYFPRQFSKQIDVESVSSWCGWHTDHGSLTGLTCGLFT

SEQ ID NO: 35037 - protein, 159 aa, Sorghum bicolor
  unsure (1)..(159): unsure at all Xaa locations
  Clone ID: SORBI-28MAY03-C5830_1.pep
SKSDDYQDSDGEQENEALDRSNRRRKRSQRYTQDFVEAVSDIDPNFDSDDDIMGEAVYDEEYLRSRKQNKASSASEEDEEFRLEEDAEDDDEEEYSLSSSEDLEEPQPQRHKKLETRGRRGTKLRSXDEIETGLDAAAFFRPRINSYKYDFSDSDDELS

SEQ ID NO: 35038 - protein, 187 aa, Sorghum bicolor
  Clone ID: SORBI-28MAY03-C58310_1.pep
HEAVLQFECCKRIMECLSEDTVCSVLQAGSSISSCKPLEEVCKRNFAMHFDYCTTACTDFVLLDEAPFKDILEHGDMTVTSEERVLDVILTWCMGACETFHWTSVDELLRSSTPEQLFGERLSGINTLLPLVRFPLMQLSILKRMERSTLANDIQAFRQLVAEAIEFSHAGQLMLTSYECERFQHRR

SEQ ID NO: 35039 - protein, 189 aa, Sorghum bicolor
  Clone ID: SORBI-28MAY03-C58309_1.pep
MVTSPLVTVRAAAFALTLTPSSRLSRASFRACLAQRRRRRWPPRCSGKQAAVVEEETPSPQEAKNGEGEQGRGPQGWFALDTIGLDILSIALPAALALAADPIAALVDTAFVGHIGSAELAAVGVSISVFNLVSKLFNVPLLNVTTSFVAEQQAVDDDSAGSREGYDFPRSPEELTQKRKFLPAVSTSL

SEQ ID NO: 35040 - protein, 181 aa, Sorghum bicolor
  Clone ID: SORBI-28MAY03-C57979_1.pep
MGEESTACPAAKVYYEGCPGCAMDRKKETQSGVPYKELLFVATTTFASALPITSLFPFLYFMIKDLHVAPREEDIGFYAGFLGAAYMIGRGVASVFWGVAADRVGRKPVLAFSVFSVIVFNTLFGLSVKYWMAISTRFLLGALNGFLAPVKAYSIEVCRPEQQALGISVVSTAWGMGVIIG

SEQ ID NO: 35041 - protein, 296 aa, Sorghum bicolor
  unsure (1)..(296): unsure at all Xaa locations
  Clone ID: SORBI-28MAY03-C57989_1.pep
TRLWWVGMITSXVIVGEIANFVAYAFAPAVLVTPLGALSIIVSAVLAHFILNERLHALGVLGCVMCIAGSVVIVIHAPQEQEITSVREIWNMAIQPAFLLYVASVIVIVFVLVFYFSPLYGQSNVLIYTAICSLMGSLSVMSVKALGTSLKLTFEGTNQLIYPETWFFMLVVATCVLTQMNYLNKALDTFNTAIVSPIYYVMFTTLTILASVIMFKDWSGQSPGSIISEICGLVVVLSGTILLHVTKDYERIPQSRSVYAPLSPSLTTRLNGELLKHVEDERTSDEEKALRRQEMY

SEQ ID NO: 35042 - protein, 106 aa, Sorghum bicolor
  Clone ID: SORBI-28MAY03-C5803_1.pep
HHHPSPSSLPSPSRAQSQRSVAPILFSLLVGSQLLPPSVRYTRLPSASNDYWRAHWQWRPRLARRRQRWSWRQWMKGAGSGSARSGRLSQRRRCSRSSGGRGASTR

SEQ ID NO: 35043 - protein, 133 aa, Sorghum bicolor
  Clone ID: SORBI-28MAY03-C58065_1.pep
CLSIGPGAGEGVRMNWSVRHAREVGAGRIPGRKGPGADNKKNRHTGGTPTTDGARARTHASHQTHSGRERPRERRPAGRESEPAGREGGTARPKKMEASQGRVSKHLRGETQQDRRDQEGCIREQHKELTPHG

SEQ ID NO: 35044 - protein, 271 aa, Sorghum bicolor
  unsure (1)..(271): unsure at all Xaa locations
  Clone ID: SORBI-28MAY03-C58072_1.pep
TRGKLRMVDDKLMQQKAQLLLDEAASWSLLWHLYGKGHEELSGELLVPPITSHQEACRFVAADLTAQLCLRIILWLEGLASAALDLEKKVRGPHVGSYLPSSGVWHRTQRYLKRNNNDSTIVKHVDFDAPTREGAQLLPDDKKQDELLLEDIWTLLRAGRLEEASELCRSAGQAWRAATLCPFGGIDMFPSLDALHKNGKYRTLQAIELESGVGRQWRLWKWASYCASEKIAEQDGGRYEMAVYALQCSNLKRILPICTDXESACWAMARS

SEQ ID NO: 35045 - protein, 206 aa, Sorghum bicolor
  Clone ID: SORBI-28MAY03-C58421_1.pep
ARGSGIEYDYLFKLLLIGDSSVGKSCLLLRFADDSFVDTYISTIGVDFKIRTVDLDGKTVKLQIWDTAGQERFRTITSSYYRGAHGIIIVYDVTDMESFNNIKQWLSEIDRYASDNVCKLLVGNKCDLVDSKVVETEKAKAFADSLGIPFIETSAKESINVEEAFLTMSSEIKKRMATQPTVERRPTVHVHMRGQPIQQKSSCCSS

SEQ ID NO: 35046 - protein, 175 aa, Sorghum bicolor
  Clone ID: SORBI-28MAY03-C58434_1.pep
MSGEAAAAAVGGGGGGGGEGETNGVQPNVTIYINNLNEKIKLEELKKSLTAVFSQFGKILDVLAFKTLKHKGQAWVVFEDVASATEALKRMQGFPFYDKTMRIQYAKTKSDIVAKADGTFVPRERRKRVDEKPEKKQKREHHHDASQIGMGVNAYPGVYGAPQLTQIPIAGGQRV

SEQ ID NO: 35047 - protein, 183 aa, Sorghum bicolor
  Clone ID: SORBI-28MAY03-C58466_1.pep
TRARRSRAQSSSKRPHTPDHCQQYKAVIQGRTGNRTVSNIPHEIEAHSAVRQIETEMATKWNHQFMKASQGADYGYIEHNQRDAGGEIYSLREELMVAQDRIHQLEAECRSTKKQLDHLVKNIAGEKASFKSREHDEFHHILDAVKEELNRERKQRQQAEMMNSKLHNDLSEMKFVAKRHLPD

SEQ ID NO: 35048 - protein, 65 aa, Sorghum bicolor
  Clone ID: SORBI-28MAY03-C58487_1.pep
FHIFTKINVESVTNFLLFLVLSLFPTLDSRCHLLVVPQHARRMALRSCGSLRSSEDGGLMQYPAL

SEQ ID NO: 35049 - protein, 280 aa, Sorghum bicolor
  Clone ID: SORBI-28MAY03-C58499_1.pep
AREPLCDRTACSLSGPVVRSLLLRRRRLADEALLALLDEGGGPLVDVGRHPRHLRHPRPETAPLRHPGAGAALLLLLPSRDRRRLPLPEQRLLPLHLRRRRAGGAAVLCMRTVILDRHRPPHLRLLHSRHCCWTVGSGGRRSSSSVLLLIRNVPRRRRRGALFQHGRLDAAAVLASIAMAAQLEVELGPLDGYSELVFFHATGVVSSLRRRRRVATAGASAAPWALGDALHPAHRQVLGQEREEPVAHAAGRARRWLDVATTATATTAFRHRRVLVLYLV

SEQ ID NO: 35050 - protein, 159 aa, Sorghum bicolor
  Clone ID: SORBI-28MAY03-C58514_1.pep
ARGRCVLAFRSPVFRAELFGPMKEKAENRIRIDDMEPAIFEALLQFIYTDRLPDSCSDGRNPAITHLLVAADRYGVERLRLLCESKLSEAIDVETVATTLALAEQHNCSQLRRACIGFMASPNMLGPIMETDGFNHLIASCPLVMKEILDKVSCIWSGK

SEQ ID NO: 35051 - protein, 154 aa, Sorghum bicolor
  unsure (1)..(154): unsure at all Xaa locations
  Clone ID: SORBI-28MAY03-C61595_1.pep
XKDDKGLETETWYDLALLYLDMAQWRDAEVCVLKIRSISPYSALAWHATGKIYEAKGLTKEALGAFFRALDLDPKHVPSLISTATVLRQLGDRPLPSIRCFLTDALQLDRTNHVAWFNLGLLYKEEGGRSAAEAAECFQAAAFLKETAPVEPFR

SEQ ID NO: 35052 - protein, 106 aa, Sorghum bicolor
  Clone ID: SORBI-28MAY03-C61602_1.pep
FPCIPLSWISSGTNALQPQVPVSEPSVPPGIRPSTPLAVYSSHVHVRIYTVTDSQLHTFFSSNPSSAMTVASGRLLRATSKAFQTDRNLPSPSTSGNTTPYCIPSL

SEQ ID NO: 35053 - protein, 111 aa, Sorghum bicolor
  Clone ID: SORBI-28MAY03-C61609_1.pep
RLRMLPVHQGASHPGGIPRGLAPDRRASTSSEGLRSAPPCRPQTVSGVRLLLATARASCGLGVLRGLSLLPRPETLFSFFLSGWFSRCLSPVVCYGLTVLAPRAFFSSRVV

SEQ ID NO: 35054 - protein, 100 aa, Sorghum bicolor
  Clone ID: SORBI-28MAY03-C5864_1.pep
LETVLSEISKKTLIRGQNYNSRNAVSYALLDKDKQSAFLSSFDKSGYRSSDKLLIAYKPRRGRFAVYDGEVTLEEAERFVGSVLNGDVQLSPTKQKPVLR

SEQ ID NO: 35055 - protein, 234 aa, Sorghum bicolor
  Clone ID: SORBI-28MAY03-C58658_1.pep
ARGDKEVGIQLATNEIKAIILDMFAAGTDTTTTAMEWAMAELVTHPRAMRRAQDEVRAAAAGSTGVNEDHVAQLDYLKAVVKETLRLHAPLPLLVPREPAADAEILGYHVPARTRVLINAWAIGRDPAIWERAEEFVPERFLGGTAAASVDFRGQHFELLPFGAGRRMCPGLRFAEASAEMALASLLYHFDWEAAGGQGSREGTPTPSLDMTEVNGLAVHIKSGLPLLAKPWVP

SEQ ID NO: 35056 - protein, 195 aa, Sorghum bicolor
  Clone ID: SORBI-28MAY03-C58677_1.pep
MGVLLLVHVLLVAVAASAPAADAWGKEGHYMVCKIAESFLTEEASTAVKELLPGWAGGDLAEACSWADTVRFRYKWSSPLHFADTPGDCEFNYARDCHNTKGEKDMCVVGAINNYTAALKDSSSPYDPSESLMFLAHFVGDIHQPLHCGHTDDLGGNTIKVHWYRRQSNLHKVWDVNVIETAMKDFYDNDQSTMI

SEQ ID NO: 35057 - protein, 153 aa, Sorghum bicolor
  unsure (1)..(153): unsure at all Xaa locations
  Clone ID: SORBI-28MAY03-C5868_1.pep
MQQHMQGFVTDIVNMMKHEGLYYPQGGPIITSQIENEYQMVEHAFGSSGQRYVSWAAAMAVDXTTGVPWTMCKQNDAPDPVINTCNGLICGETFVGPNSANKXALWTXNWTSRYLIYGNDTKLRSPEDIAFAVVYFIARKNGSYVSYYMVLTS

SEQ ID NO: 35058 - protein, 220 aa, Sorghum bicolor
  Clone ID: SORBI-28MAY03-C58706_1.pep
ARGEKERDDNKKEKAKSRRNENTIFGALQKVQQDKKQLEESIEKHKQAVKELIENYPGLSSEVPPGSALEEQFLSYFRAAKDMEESSSPFRDGAATQTPVVETAPVDASTSAAGRPVDTPPRPAKAKMTEDRAVTKPSTEVRRPGGRRPLIRPTLRTEEPHADTDASAVDASTVVQDKGGPSVEREATGILPVLQPSSRKRPISSAQTVDSASQGEANDA

SEQ ID NO: 35059 - protein, 205 aa, Sorghum bicolor
  Clone ID: SORBI-28MAY03-C58333_1.pep
MLQSDKNTAKLDPKFLELPVFWTQSRQYRLLNAFPNVLNLCNNSLTGIIPQGIGQLKVLNVLNFSSNSLSGEIPQQICNLTNLQTLDLSNNQLTGELPTALSNLHFLSWFNVSNNDLEGPVPSGGQFNTFTNSSYIGNSKLCGPMLSVHCDPVEGPTTPMKKRHKKTIFALALGVFFGGLAMLFLLGRLILFIRSTKSADRNKSS

SEQ ID NO: 35060 - protein, 202 aa, Sorghum bicolor
  Clone ID: SORBI-28MAY03-C58339_1.pep
ARGMYFGEHNIEGMLAVLEPLHAMLERGPETIKENAFIQAYGHELLEAHECCSKYRATGEDAELTKAWDLYYHVFRRIDKQLPSLTTLDLHSVSPELLKCRKLELAVPGTYAADSPLVTIEYFVPQLIVITSKQRPRKLTIHGSDGNDYAFLLKGHEDLRQDERVMQLFGLVNTLLENSRKTSEKDLSIQRYAVIPLSPNSG

SEQ ID NO: 35061 - protein, 223 aa, Sorghum bicolor
  Clone ID: SORBI-28MAY03-C58346_1.pep
ARGAAPGHGDHVGPGRHERRAMSPPELALARAAPTVPPPPHPGALPLPPPAGVGMGSTYATAECPSSVAAADASAAPAGGSDGAGALPTPPAAAEVPGPRHQAGPRAQVVMSPHAETAPATPHRGPADTAAPSVPVREAGPPVRAVVVAEAHVPPVTEPHMLSHPGPAEVYISSTNDKADYSSSVDASEVNGGPVNVSNGTGTMLSDEMKAKEDETHHQTDTH

SEQ ID NO: 35062 - protein, 222 aa, Sorghum bicolor
  Clone ID: SORBI-28MAY03-C58396_1.pep
GYIGLEYFGRTVGIKIMPMGIHMGQLQSVLRLPEKEDKVAELRQRFQGKAVLLGVDDTDIFKGINLKLLAFENMLRMHPKWQGRAVLVQIANPPRGKGKEMEAIQAEIRESCDRINREFGQTGYSPVVFIDRNVSSAERLAYYTIAECVVVTAVRDGMNLTPYEYVVCRQGIPGSESAPEVSGPKKSMLVVSEFIGCSPSLSGAIRVNPWNVETTAEALNEA

SEQ ID NO: 35063 - protein, 128 aa, Sorghum bicolor
  Clone ID: SORBI-28MAY03-C58784_1.pep
NIQATTEPQEKHLAGYSEPAENTLPYLTPNTMASRAGSHTTSCAASSTTKLNATTLRNSSVPSCPLCSKCASAYPSHVDKTLLRCRLQWCRHYELPMMFPIKRADVPTQSPLYSPIIYPNSLSEGFRT

SEQ ID NO: 35064 - protein, 247 aa, Sorghum bicolor
  unsure (1)..(247): unsure at all Xaa locations
  Clone ID: SORBI-28MAY03-C58807_1.pep
RHEADEDDPHRTVQNKNFITKVMFLSAQTRPRYDHEGNCYFDGKIGLWPFVREDQAKRRSQNRERGDPVTKTMIVDRQTMXSYLIGKVLPEIKRCWPRESRGETIWIQQDNARTHVPADDPDWLLAVAQTGLDIRLMHQPPNSPDMNILDLGFFASLQSKADDLNSSSLNDLIANVLAEYQNYNPYLLNRVFLTLQGSLIEVMKQRGGNHYKIPHMNKDRLERLGILPDRLSCDCELYEEVKQALST

SEQ ID NO: 35065 - protein, 197 aa, Sorghum bicolor
  unsure (1)..(197): unsure at all Xaa locations
  Clone ID: SORBI-28MAY03-C58866_1.pep
HEDKIQLGPSEFLTGVSGTIGPFKSLINVITSLTFVTNTRSYGPFGKGRATQFHIQMQNNGRVIGFFGRSNQYLNAIGVYTRPKXRVARSSDHKPDVYAKFGPWGGDGGNPQDIKMLPYRLDTVKISSGVIIDSIEFTYTDHDGQYHTIGPWGGHGGDNNSFQLGPXEFLIGVSGTIGTFNSQVKVITSLTFVTNNA

SEQ ID NO: 35066 - protein, 235 aa, Sorghum bicolor
  unsure (1)..(235): unsure at all Xaa locations
  Clone ID: SORBI-28MAY03-C5889_1.pep
MDNLKSMGFPVDDLKFDPELVIRGLIIDKEKGNLVKADRFGYVKRAMHGTQMLSTRAVSEIYGRELVDLRKESRWEFLNTLFSVSEAVMFMQMVDKLDQGLVPAELGPLDYKGLYNAVSKALFRAHVEGQLKLVEMXREIMAEPERFVEPDPELPLALLDQKEAGKKLLLITNSDFHYTNKMMNHAFNRFLPNDVGWRDLFEMVIVSARKPEFFQLSHPLYEVVTDDGLMRPCFK

SEQ ID NO: 35067 - protein, 151 aa, Sorghum bicolor
  Clone ID: SORBI-28MAY03-C58894_1.pep
TRVRLVADDAHQVFAVFASRRPPWTSPPPLCSGLGSCRRWGAVAPQLGSAPAAPGRWGGAPQQLLLCLTGVPLLAVYSLARVSAPSLFPPAPGSPTLLFDLMLLSPPTGSVRSCLLLPQLQLLGVLSQCFGLSPRVHSHGAWRRALERPPC

SEQ ID NO: 35068 - protein, 279 aa, Sorghum bicolor
  unsure (1)..(279): unsure at all Xaa locations
  Clone ID: SORBI-28MAY03-C58909_1.pep
ARGVDSHETQRQIMFEVNSFTCPAYGKFCNDAQRHATLKLEVELRNWRSCFISYFNAQKAYIEALDCWLSKFILTDTIRYSRGISSIAPDRAGAPTLVVICHDWYTTMSKFPNKRVSLTMRNFLRSVRVLWLKQGEEQQQKRKVDSLAKELDKKVTAYKRAENRIIGTKLLEHKPEIDAKQRMEHLSEKKEMLNVLRKRIETEKAKHHACMRDTHDVTLNGFKIGLASIFESLAEFSKDSVKLYEDLLARAHDKDXDKATTDKRPCVGGPYPHIAVDAT

SEQ ID NO: 35069 - protein, 200 aa, Sorghum bicolor
  Clone ID: SORBI-28MAY03-C58910_1.pep
MADTVQYRLERVADELDDLERRGLFTRAELSDVVRKRRDFEYRLRRHSPLRQDFLDYIAYELRLDSLRNLRKRAIIRAAADEDDEPRDGARSSDDEEGGGRKRKKKDKSKKKWKKSVSDVAGVLRVLDIYRMATVRFKGDLDLWFRYLEFCRDKKHGRMKQVLAQAIRFHPKVPGLWIYAAAWEFDQNLNVAAARALMQS

SEQ ID NO: 35070 - protein, 122 aa, Sorghum bicolor
  Clone ID: SORBI-28MAY03-C58525_1.pep
MESRPGGTNLVEPRGQGAAALPSGGPAVQPWWTSSGAVLGAVSPAVVAPGSGVGIGLSSSPAGGSGGGGTAKGAASDESSEDSRRSGEPRDGSSGQEKNHATSQIPALVPEYLAPYSQLELN

SEQ ID NO: 35071 - protein, 111 aa, Sorghum bicolor
  Clone ID: SORBI-28MAY03-C58529_1.pep
IPKNYNTSQINTGSIRVPHRVKEVVICVAMNFVNVCHITVKTCLFYSSGCPSAAWLFLVFLMATMHVGLVCIRVFCYSCCFSIGVCLASCGCHARDLCHDMSAMALLTTGK

SEQ ID NO: 35072 - protein, 141 aa, Sorghum bicolor
  Clone ID: SORBI-28MAY03-C58595_1.pep
MSNLFAVALVLSSLYYGITMATASSDESFFQKCLASSCSEGGPEIRFPFRLVTSPLSCGAPGMELVCSKADTILVHPNLGLCKVIAIEYSVGTIIIVPLAESKCPFQKIISTNLSTDVYRPYGERATLVSCSAEFIPSDKA

SEQ ID NO: 35073 - protein, 263 aa, Sorghum bicolor
  Clone ID: SORBI-28MAY03-C58606_1.pep
MATTAAAAAAALAGATTAAPKARRRAHLLAARRALAAPIRCSAAPPATLTVTAPPATPLRPWGPTDPRKGADILGAALERCGVRDVFAYPGGASMEIHQALTRSPVIANHLFRHEQGEAFAASGFARSSGRVGVCVATSGPGATNLVSALADALLDSVPMVAITGQVPRRMIGTDAFQETPIVEVTRSITKHNYLVLDVDDIPRVVQEAFFLASSGRPGPVLVDIPKDIQQQMAVPVWDTPMSLPGYIARLPKPPATELLEQV

SEQ ID NO: 35074 - protein, 375 aa, Sorghum bicolor
  Clone ID: SORBI-28MAY03-C58596_1.pep
HEETVEGGGLIILLLRSLSSLTSLYTMVMDVHERFRTESHTQAAARFNERFLLSIASCKACVVMDDELNILPISSHMKFIQPVTNNEDSEGLSKRERELKDLKDQFREDFPVGPLIGKCCTMDQGKAVINFLDSILDKSLRSTVALLAARGRGKSAALGLAIAGAVAAGYSNIFAPAPSPENLKTLFDFVCKGINALEYKEHLHYDVVKSADPELKKATVQINVYKQHRQTIQYLRPHDHGKLSQVELLVIDEAAAIPLPIVKSMLGPYLVFLSSTVNGYEGTGRSLSLKLLQQLESQSQPSAQSNGSNSSRLFKKIELTESIRYASGDPIETWLNDLLCLDLANSIPNISRLPHPKECDLYYVNRDTLFSYHKE

SEQ ID NO: 35075 - protein, 118 aa, Sorghum bicolor
  Clone ID: SORBI-28MAY03-C5863_1.pep
KAQDLAQPLVDAQIPFKIHVVKDHDMKERLCLEAERLGLSAMIMGSRGFGASRKGGKGRLGSVSDYCVHHCVCPVVVVRYPDDAAGAGGDAAGATDELHTVPEDEPVYHDAPEVQKEN

SEQ ID NO: 35076 - protein, 160 aa, Sorghum bicolor
  Clone ID: SORBI-28MAY03-C58981_1.pep
HEGVVEGSDDANFAIESDTTEIVSTDNIIFLWGFREKSVKELKPYLIGLHQAFSEDFEVKLLDKTCSALIFRDSNTATQLLKEINSEGPSLNRFLSEGLKAAGFEVYRKVCRLGLWDSDLAEVLEDVSTELGVPTLPACSTSRTYWNSALMLDLKEYLEY

SEQ ID NO: 35077 - protein, 183 aa, Sorghum bicolor
  Clone ID: SORBI-28MAY03-C58991_1.pep
HEDDDDENSGRSRAAKRAGGGQKRTGLRLLYWARNVVTKSDSARETERSQSQAAASPLEIENLAEIIEDFKMVLVVRNDLKMGKGKIAAQCSHATLGLFKKLQQRAPKSLRRWERCGQVKVVVKVESEEDMLVLQGRAKSLNLPTHITIDAGRTQIAPNSRTVMAILGPADMVDDVTGGLKLL

SEQ ID NO: 35078 - protein, 128 aa, Sorghum bicolor
  Clone ID: SORBI-28MAY03-C59032_1.pep
WPSSWKLQPPHPKPASAAAPGAHASASQALLWLPFRPTPLHPWPEGRCRWRSGEQPWWRASLACARHCRRALLAACSPGIMMVWGREGVGEMGCGLREMESRRLGEGELRLARWGVSGVRQPLRWGLV

SEQ ID NO: 35079 - protein, 188 aa, Sorghum bicolor
  Clone ID: SORBI-28MAY03-C59035_1.pep
LNNMHKDRKYMEFQDVYREDTVKTYKECSRVQGQLDDISAYDNHRNQIDLLNSSQDSNPTPPLNLPSHAQREKTQGNNSQKRKARGTLKGLAASHKRSKQGSQKLKVEFSRIGGVAGENTRTFIDEIVLFTRKKAPLIGVRTWRDIHEDVKKSIASNIMVSSDLFSVAYTFTKLFKKWPSIYIFCSRE

SEQ ID NO: 35080 - protein, 237 aa, Sorghum bicolor
  unsure (1)..(237): unsure at all Xaa locations
  Clone ID: SORBI-28MAY03-C59061_1.pep
MATAAATAPHPTPPTPLQQQQHQQDKDQKQQKALSMNAIRLKAIGDRLKAHLRGMNVPPIAEFAHLVYAFARRVAFALAPGVGPRSAAHVPVILCSGFVRRXSLLSXSARMVLGLSCKNACSNNWFQPADSRDIFRMANELSGNFCTSTGQAASDSTVLEIISQIMPRYYPRLKFERLITSIEAKVGYDILMADFFIERNLSRDEKIRLIVVQKENLDASSCVSSPPHVSFLVNGRG

SEQ ID NO: 35081 - protein, 197 aa, Sorghum bicolor
  Clone ID: SORBI-28MAY03-C59043_1.pep
MFNRLKIDFLSNHNQASRVLQMERNSLEHLLLHFCGVTAKKEYQNARAREDTHYLLYIYDLMRQRLQRESTFENDLLLEVHKRSNEICLQFYEKELLTDTSYLHIYGLREHELDAKQLAVVAALHEWRDSIARQEDESTGYILPNKALIEIAKQMPTDVGHLKRIVKSKYPYVESNLELIAYTVWNALKYSYAYEGI

SEQ ID NO: 35082 - protein, 182 aa, Sorghum bicolor
  Clone ID: SORBI-28MAY03-C58725_1.pep
HHGDEVFAFPKEVMQSTMLEVVVKDKDVVRDDYVGRVSIDLNEVPLRVPPDSPLAPEWYRLMGKDGMRDRGELMLAVWYGTQADECFPSAIHAGSTPVESHLHNYIRGKVYPAPRMWYVRVNVIEAHDIYPMENHIPDVLVKVRLGHQLLKTRQVRSPTRNFMWNEELMFVAAEPFEDDLII

SEQ ID NO: 35083 - protein, 204 aa, Sorghum bicolor
  Clone ID: 14188380.pep
QVGWSAAQHYNSNAVEHNNKSYVAPVHKYNNGTIVTSDVTTASTSTERLDGSNMEAASDYDMIGTPSVNTSCMYGIGSVVIKGPCGDVEKCPMHSRYDSQLSVNADGFGLQVNENKENYGKPDHKQLYPDPRKSSERSMGAPKQHLGSVSPSQVGSNRVGIVLEDVSECEILWEDLVIGERIGFGSYGEVYHADWNGTVSSFAF

SEQ ID NO: 35084 - protein, 151 aa, Sorghum bicolor
  unsure (1)..(151): unsure at all Xaa locations
  Clone ID: LIB3476-011-P1-K1-G4.pep
PTRPDPRVRPRVRPRVRRYDSQLSVNADGFGLQVNENKENYGKPDHKQLYPDPRKSSERSMGAPKQHLGSVSPSQVGSNRVGIVLEDVSECEILWEDLVIGERIGFGSYGEVYHADWNGTEVAVKKFLDQEFYGDALDEXRCEVRIMRRLR

SEQ ID NO: 35085 - protein, 185 aa, Sorghum bicolor
  Clone ID: SORBI-28MAY03-C58738_1.pep
MSSQVSTSRGLHPPGKLGTFESPHAWPLPAPTAQPEAGRGDDQEVRLLSVAWNQDCGCFAAGTSNGFRIFNCEPFKETFRRDLKSGGFGIVEMLFRCNILALVGGGSNVQYPPNKVMIWDDHQSRCIGEFAFRSDVRAVKLAKDYIVIVLERKIFVYNFTDLKLLYQIDTLSNPKGLCCLSHHSN

SEQ ID NO: 35086 - protein, 223 aa, Sorghum bicolor
  unsure (1)..(223): unsure at all Xaa locations
  Clone ID: SORBI-28MAY03-C58752_1.pep
HEDQGHAQVRQDMKPEPREEAIDVAVEQPQPQLLSQGVLPNGPAAASAVFHDQMYYVNQELTVEDFLYDDDYKIDLSGSNLDVLNNLEGIVQLEYPQFNFPQELAPNACLDMSNCGXQSAGGVFLHMTDLLTTMTSAPSAFLKPKCALWDCPRPAIGSERWHDYCSMYHADLAVQEEGPPGTMPVIRPRGIDLKDGPLFAALSAKIQGKNVGIPICEGAATAK

SEQ ID NO: 35087 - protein, 222 aa, Sorghum bicolor
  unsure (1)..(222): unsure at all Xaa locations
  Clone ID: SORBI-28MAY03-C5924_1.pep
MPGLPLPQPINQNIGREYAYPGSTGQAFHQQLRTALSPDEKLAAERDLALYCKPVELYNIIQRRALKNPLFIQRCLLYNIHARRKKRIQITISLSRSTNTELQAHYIFPLYVLLARPTSNLSLEGHSPIYRFSRVHLLTSFSELGNKDNSEATFIIPDVKSLSTSHPCNLDIIXISCGQVGQSNGEDNCSGNHVEGSSLQMFEGKCSLGKIPTNLLASSLES

SEQ ID NO: 35088 - protein, 225 aa, Sorghum bicolor
  Clone ID: SORBI-28MAY03-C59247_1.pep
TREAGKTDGKETEGGPKSEGVSSNPPGSGANAAPELSTAEKQELQNKMAKLMAMLDEVDRKYKHYYHQMQSVVSSFDMVAGPGAAKPYTAVALQTISRHFRCLKDAINDQINVIRKKLGEEESSSGKEGKLTRLRYIDQQLRQQRAFQQYGMIPQNAWRPQRGLPENSVTILRAWLFEHFLHPYPKDSEKLMLARQTGLTRSQISNWFINARVRLWKPMIEDMYK

SEQ ID NO: 35089 - protein, 163 aa, Sorghum bicolor
  Clone ID: SORBI-28MAY03-C5925_1.pep
MASAAGGNEGPDPREIELYLEEILALTQLGEDYTEFMVNKIRGLRDVKPELGPRAMKAFRNGNFNKMEQDLTGFYVIFEEFFMVENVRKAIRIDEPIPDGLTTSMVDDVFFVLQSCCRRAASTASINSVLAVLGGATSLLSNEYHEALQWMMREPNLGAKLFL

SEQ ID NO: 35090 - protein, 185 aa, Sorghum bicolor
  Clone ID: SORBI-28MAY03-C59251_1.pep
MALLKNSLVLQGRLRHAAAAALFTARRGAATATEEYARRNYADNTSEYNTVIGSLVAQRRPYLLRDAYDDMMLDGVKPERDTFHTLIVGTMKGSRLQDALYFRDQMKEMGLQPDVNLYNFLISTCGKCKNSDAAIMLLEEMKAHGVKLKGETYICLLNALASTGQTDQVYAIVSDMSAAGLGLTS

SEQ ID NO: 35091 - protein, 142 aa, Sorghum bicolor
  Clone ID: SORBI-28MAY03-C59286_1.pep
IKIKLSPRQHREGATKEKSKLDSLTLYRTAIRLPKKMDRRRHPWHESLKRKHTHTHKKTLWKKLNFLKENAQIPRGGRTRVTENRTQRWILSSDLAASEVVQAHERERERERRHNGTRNSEREERKKKRGKKRRKRGRRQRR

SEQ ID NO: 35092 - protein, 189 aa, Sorghum bicolor
  Clone ID: SORBI-28MAY03-C59316_1.pep
TRGERPIGFVPLKISSFSESKSDDKRFYIITPTKTLQLRTGCAKDRATWIEALVSARSEYSFNGDLSGDQNDASFSTEKLRNRLHAEGIGEAVIKDCEQIIHSEFSQYQTQMKQRCEEYLSFIGSLPREVEVVNSVDSTVPEKPQLELFKHDCSSSGKCSEYSNTESSDDVGKQEISELSDGDEFHFYD

SEQ ID NO: 35093 - protein, 221 aa, Sorghum bicolor
  Clone ID: SORBI-28MAY03-C58923_1.pep
VFLTRRAPTASTSDPRSTVSSFLDEIPLLLPLRPPPHSGHPRGSIHGLILEVRVTGCRKLRDTEFFTRQDPYVVLEYATTKLRTRTCTDGGRNPTFDEKFHIPLIEGLRELNVTVWNSNTLTHDDFIGNGRVYLHKVLTNGYDDSSWSLQTRHMRSAGEVKLIMHVDVSAMKNKMGKSVAASSAHPVPALSMRVPTPAPAPAPAPAPAPAPAPAPAPASPI

SEQ ID NO: 35094 - protein, 227 aa, Sorghum bicolor
  Clone ID: SORBI-28MAY03-C58929_1.pep
AGPRAAAAGSPGAPPAAAAPRAAAPPPPACSSPPPELVAGGGCPVVVVAGAAPLVGASAALPFARSGARLPHPRIPCLLRSPLGPVLVAAAGVSACAYFLGSCVARPPGRVRVSGTVDFASRCAAVLGAHGARASAGPGSGAPAAAASLLSGALSLAPCSIRSVSRPGPRLPRPPPLCLLGPPVGPEQYVAVMNSIFSAQRSMVPIDSCIVGTQDSAFLQQASYITG

SEQ ID NO: 35095 - protein, 160 aa, Sorghum bicolor
  Clone ID: SORBI-28MAY03-C58944_1.pep
HEADNGIVAIPVRPEAYGKGLPYAPENWPHSGDIWHWKVGSRSSGAGHWADRYLMPPSRFPDATPKKLRFASRVQVEEFVKREFPDVDPSTFFSMFIWRIPAEGYRIQKGTQQVWHNEPEPVVADPGGLCKARNSLCNLEREGFVESSPARACNICCKEP

SEQ ID NO: 35096 - protein, 230 aa, Sorghum bicolor
  Clone ID: SORBI-28MAY03-C58976_1.pep
MADDQPAWKIPPIVQELTAGVQEPPSRYVVGEQDRPAMAAAAAMPEPIPIVDLSRRSANDGADDDETAKLLSALQNWGLFLAVGHGMDPGFLTEMMEVTRGFFNLPLDEKQKYSNLANGKEFRFEGYGNDMVLSEDQVLDWCDRLYLTVEPESRIVRSLWPAQPPAFSDVLREYTTRCREIAGVVLASLARLLGLHEGRFVGMMSDGVAMTHARFNYYPRCPEPDRVLGL

SEQ ID NO: 35097 - protein, 285 aa, Sorghum bicolor
  Clone ID: SORBI-28MAY03-C59402_1.pep
HEALEILGNIQQTDGAVLIEHDSSQDPGSEQALIDQNELPPLPDGPPPLPSDSPPPPPPLPPSPPPATPPPPPPPLSPASPPPPPPPPLPSGPPPQPAPPPPRPAPPPLPTQAPPLPSIPPPVPSSPSSLGYQPPAPEYFMTPNGNQLTQMTGNTSIQAIGNTTTFIPGGPVNGQAAVNFVTSMPANNNVFMAPQTSNGNYQFRPTGVPFQQGNFSAFPSAQTPLVHPHSRMAHMNPMGQQAVPPPRNPYAVQSFPNSQSHYPPEEHNWLAGGRALSCSEGPFMD

SEQ ID NO: 35098 - protein, 152 aa, Sorghum bicolor
  Clone ID: SORBI-28MAY03-C59433_1.pep
GPDAAQQPPCGPQRSVTHPDGAGTRSHPAAGPQRPAARGRPRGGPDQRGPGRPAPRAARSPGPAARRCPGARPETRRPDRTAPRTAPSRAPSHREARAAPKTPGPGARGVGGDPGTGFGGSRDQVPDSRRALGGGAWRRLGARGRAVGGGLV

SEQ ID NO: 35099 - protein, 197 aa, Sorghum bicolor
  Clone ID: SORBI-28MAY03-C59436_1.pep
PWLEGVFPFAWQCWAVLESKGGNIRRARELFDAATVADAKHIAAWHGWAILEIKQGNIKKARNLLGKALKYCGGNEYIYQTLALLEAKAERFEQARTLFEQATQSNPKSCASWLAWAQVEMRAGNNTMARNLFEKAVQASPKNRFSWHVWALFEANEGNIDSARKLLKIGHAVNPKDPVILQSLALLEYNFSSANVA

SEQ ID NO: 35100 - protein, 86 aa, Sorghum bicolor
  Clone ID: SORBI-28MAY03-C59447_1.pep
HEDYEAGVRGHSHDRLPCCGIGFGWFLFIFGFFLGAIPWYIGALLLWCSRVDYREKPGYVACTVAAILATIAVIIGAAAGTHVFLF

SEQ ID NO: 35101 - protein, 303 aa, Sorghum bicolor
  Clone ID: SORBI-28MAY03-C59462_1.pep
MNGEKGLLRNQNAGFTALASPVRREIGNRSLTRSFCVDDNDLEDGKASKERESSAQSLKLPKIQNQAFLSGLAYCISSCSMILVNKFVLSGYGFNAPVFLMLYQNIVSVTIVSTLSLSGAVPTEPLTWNLIKVWLPVNIIFGARLITSMFSLKYINVAMLTILKNVANVLTASGETYFFKKQHGTQVWIALLLMIISAVAGGITDLSFHAVGYIWQTLNCFLTASYSLTLRHVMDSAKQATKSGNLNELSMVLLNNVLSLPLGIILVLGLNEVEYLLETPLLQMPEFWLVITASGVLGLGINF

SEQ ID NO: 35102 - protein, 129 aa, Sorghum bicolor
  Clone ID: SORBI-28MAY03-C59486_1.pep
KLMYLCFHICLRLNSSIQRSTNSISSITSDACTAFHASAVVIRWWKIIIGSAAVHSSAALHAGITNAFQIATRRCLCHQQKRYTTLSSRTASPGSATFRDGLSLLPLCPDGALVPEEKSRREAANPGEI

SEQ ID NO: 35103 - protein, 181 aa, Sorghum bicolor
  unsure (1)..(181): unsure at all Xaa locations
  Clone ID: SORBI-28MAY03-C5909_1.pep
MAALLTRAGARLKRSGSGFHLRSVLAGHGLFSSEAATTAAPAASVDDRAVAVAATGEEDGDDLRSRIFRLGLAKRSATAALDKWSGXGRAAPAAELRRIARDLSRVRRYKHALEVADWMKTHHESDLSESDYGMRIDLITKVFGASAAEDFFEKLPPGAKSLEAYTALLHSYGRSKMTDKA

SEQ ID NO: 35104 - protein, 310 aa, Sorghum bicolor
  Clone ID: SORBI-28MAY03-C59108_1.pep
ARGWNVPNGEPPKPGSSPSKRDLNFGGIVARAGAYFRRQNPGFGPNPSPPSFEEMYFLGNTTDGIVSDNKAGEPTPFYLSILKSANETVGPNALEKRQNSGESSGNISISLPAPDLEADGTGAPAQLFPRAVQQPVRLYDRGLQTEHYGFYTYFKRTIYLKSVTTLNGTDDESDVPLDKDGGARRSEAKFLVTWSQTRFLVQIWTRSENNTQLLRSNNGEEPGTMPYPITIKTDTHGGRSGEKFVWHWPVDDRQGIDTANPKLLPNDIGFGGRLVNPRKDRDTSFGGFDGGTGGCRCEWVNFVVRRDSGN

SEQ ID NO: 35105 - protein, 80 aa, Sorghum bicolor
  Clone ID: SORBI-28MAY03-C59129_1.pep
SPPMKLGARNLQFLRTKRSESCRVDQDNAEEIQPLLCTRAESRYETFSISLGGSSNSDSQYSQRINSLEHDFEPSLGVPR

SEQ ID NO: 35106 - protein, 199 aa, Sorghum bicolor
  Clone ID: SORBI-28MAY03-C59152_1.pep
ARGHGGDAKQHNQNAEGFPSYRSKRAALEVPMQKSLGFGLKSENGKRDYVANDMVQSLHKQDSKIVAKKTIKLLDGPPYSKRPKLEPVQTGRDAEAKGHEFISQKNVPDLTPCAASEKSRLLKQKRISDAKRIDKKNIRSGVRSKYDCFSSKAGLANFDSGFSGDSVLGAHGLKSDVRDITNHIENLSLSELLDGTYKY

SEQ ID NO: 35107 - protein, 297 aa, Sorghum bicolor
  Clone ID: SORBI-28MAY03-C59557_1.pep
HEGLTNIKDWCISRQLWWGHRIPVWYIVGKKCEEDYIVARTEEEALAKAQEKYGKSVEIYQDPDVLDTWFSSALWPFSTLGWPDLSKEDYKHFYPSTVLETGHDILFFWVARMVMMGIEFTGPVPFSYVYLHGLIRDAEGRKMSKTLGNVIDPLDTIKDYGTDALRFTLSLGTAGQDLNLSIERLTSNKAFTNKLWNAGKFLLQNLPDKSDVSAWDVLLANKFDSEASLQKLPLPECWVVTGLHELIDKVSRSYDKFFFGDAAREIYDFFWGDFADWYIEASKTRLYHSSDKFAAAT

SEQ ID NO: 35108 - protein, 337 aa, Sorghum bicolor
  Clone ID: SORBI-28MAY03-C59602_1.pep
HEARTTISSVYRTSQIAASVYKSSYHQKAFPEALFHQLLLAMLHPDNKTRIGSHRVLSTIVAPSLLCPWSAMSFPIPMKGDDSQNLHLLVLSAFSSEAIINEARTKNKIQASLQENNKSEAIVDAENGYAQTEPDKRKYPGSPYLNEHDRTTFNDEDLEFMKLNNHQIVLLLSSIWSQASLDDNSPANFEAMALAYSIALLCSKSKSSSHVALVHCFQLAFSLRRKSLSHESDLQPSRRRCLYTMASAMLIFSAKFADLHQIIPLVKAAAPEKMVDPHLCLTDDCQLINTSAESSNSEMVYGSEEDESDALAFLSAVNKHDTELIETVMCHFKEKFE

SEQ ID NO: 35109 - protein, 155 aa, Sorghum bicolor
  Clone ID: SORBI-28MAY03-C59622_1.pep
TRRTLEDEENYESTLMSVDLTKVPLDTVATDNAGMKPVGCSKNTVGASSASPENTQVSEHSSSDEDANMTEQHDDDGTADGGSTQGLECTSPERSEERLRPGFHGNPVSTAPEREVTDTEQVPETESQAGNVGCDDQRCDNMGGETMPLEDEVQL

SEQ ID NO: 35110 - protein, 101 aa, Sorghum bicolor
  Clone ID: SORBI-28MAY03-C5965_1.pep
MVVQEFTVDLNKPLVFQVGHLEERYQEWVHQPIVSKEGPRFFGNDVLEFLTCTKWWAVPTIWLPVVCFMFVKSILMGNTIQDVVLMALFGIFIWTLIEYTL

SEQ ID NO: 35111 - protein, 249 aa, Sorghum bicolor
  unsure (1)..(249): unsure at all Xaa locations
  Clone ID: SORBI-28MAY03-C59641_1.pep
TRQKTRPHPSNLDILSVARSVCCKTSLLAALEVKYGSLPENIFVKAAKLCSDNGTRIDWHQEEFICPKGCKSRSNSNALLPMQLTAVDFPEAPSVDPLNDDEMWEMEEYHYVLDSKHFGWKPKNERVVLCEDISFGREKVPIVCVIHADAKDSLGMKPEELLPHGSSVPWKGFHYITKRLMDSCLSDSXNSMPGCACSYTECSPENCGHVSLFDGXVYSGLLDINGTPMHGRFAYDKDSKIILQEGYPI

SEQ ID NO: 35112 - protein, 185 aa, Sorghum bicolor
  Clone ID: SORBI-28MAY03-C59677_1.pep
HEAASKLGRERHSVSASARPGAQCWRRRKGLAVSCQTGAAPAVLRMEETTAAAAAGSNAQAEFTVVMKFGGSSLASAERMREVADLILSFPDETPVVVLSAMGKTTNNLLLAGEKAVSCGAPKASEIPELAVIKDLHLRTVDELGLDRSIVSGLLDELEQLLRGVAMMRELTLRTRDYLVSFGEC

SEQ ID NO: 35113 - protein, 79 aa, Sorghum bicolor
  Clone ID: SORBI-28MAY03-C59334_1.pep
SRNLSFSPSSTTFRLKQHLHMNKHANCVRAQVHDLTQVNPHNTSHEYVMKQCQITMLPQAYISSTCISPYAIIQITLQC

SEQ ID NO: 35114 - protein, 229 aa, Sorghum bicolor
  unsure (1)..(229): unsure at all Xaa locations
  Clone ID: SORBI-28MAY03-C59336_1.pep
MGEGXAXDGLIKLFGKTIPVPETPAAGDAAKDIQQSGSSGTTDLKGQENTLQDSTGSPPQQEVADTEDSSAAKNSSADKQQGEAANQKEKLKKPDKILPCPRCNSMDTKFCYYNNYNINQPRHFCKNCQRYWTAGGAMRNVPVGAGRRKSKSASAASHFLQRVRAALPMDPLCTAAKMNGTVLSFGSDMSSLDLTEQMKHLKEKLIPIAGIKNGDERSVGSCTEGPAKA

SEQ ID NO: 35115 - protein, 234 aa, Sorghum bicolor
  Clone ID: SORBI-28MAY03-C59349_1.pep
MLRQSSSRNQRSKGLKLKKALQISLLLLVSVWLLYQVKHSYEKKAYSEDEANDLHKDDKDQREAVRLGRKDLPPKMEADSSTLDERVEDEENDEMEQEMKHDENDEDPIDEQDLEKDEDLPEPGEHSSEKDGDVGVFEDEERKERSQEDQEKSFHGDNVSSAVTHDPPSSEQDELFHHAQEKVLFVDDASTAVPNENHDEAGSKEEEVRRARERSFRGDDVSSSVDHDAKVAKP

SEQ ID NO: 35116 - protein, 145 aa, Sorghum bicolor
  unsure (1)..(145): unsure at all Xaa locations
  Clone ID: SORBI-28MAY03-C5939_1.pep
ARGAFVANSVQVADGRREVDIRDRDTDGDDSERQKFTEEEEDEVVRMRNTPDFFNKIVDSICPTVFGHQEIKRAVLLMLLGGVHKITHEGINLRGDINVCIVGDPSCAKSQFLKYTAGIVPRSVYTSGKSSCAAGLXATVAKEPE

SEQ ID NO: 35117 - protein, 138 aa, Sorghum bicolor
  Clone ID: SORBI-28MAY03-C59392_1.pep
MMRQTQAAILQKTQQRAAQQQPQSRHHHHQPPSGSRAPATGSRAVVTGSRAVATGSRPASAPNAERFENRLRKPTTFLCKHKFRNELPDPSAQLKWLPLNKDKDRYTKYRITSLEKNYIPKMIVPDDLGIPLDLLDMS

SEQ ID NO: 35118 - protein, 207 aa, Sorghum bicolor
  unsure (1)..(207): unsure at all Xaa locations
  Clone ID: SORBI-28MAY03-C59854_1.pep
HEAAGPMVSVDSLRAYLQIVDVASILRLDRDIADHAFELFKDCSSATCLRNRSVEALATAALVQAIREAQQPRTLQEISTASNLPQKEIGKYIKILGESLKLSQPLNSNSIAVHMPRFCSLLQLNKSAQELAAHIXGEVVVNKCFCTRRNPISISAAAIYLACQLEDKRKTQAEICKVTGLTEVTLRKVYKELLENWDDLLPPDYTP

SEQ ID NO: 35119 - protein, 189 aa, Sorghum bicolor
  Clone ID: SORBI-28MAY03-C59868_1.pep
HEGIELNEYLKPYGLCSPRVPGPGATIGGMCATRCSGSLAVRYGTMRDNVINLRAVLPNGDVVKTGSRARKSAAGYDLARLIIGSEGTLGVITEVTLRLQKLPSHSVVAMCNFKTIKDAADVAIATMLSGIQVSRVELLDEVQIKAINMANGKNLPEVPTLMFEFIGTEAYALEQTLLVQKIANKHHGS

SEQ ID NO: 35120 - protein, 264 aa, Sorghum bicolor
  Clone ID: SORBI-28MAY03-C59886_1.pep
HEAAFKDGKAPMDPSTLVKAEDMDAYAPKDLLVVTTGSQGEPRAALNLASYGGSHALKLSKEDVLLYSAKARPGNETRVMKMMNRLTDLGPKIIMGKDSGLHTSGHAYREELEEVLRIVKPQHFLPVHGELLFLKEHELLGRSTGIRHTTVIKNGEMLGVSHLRSRRVLSNGFVSLGKEDLQLMYSDGDKAFGTSTDLCIDERLRIASDGIIFVSMEIFRPQKEHGLAQSGLTGKFKITTRCLWLDNGRLLDALYKAAHAALSS

SEQ ID NO: 35121 - protein, 195 aa, Sorghum bicolor
  Clone ID: SORBI-28MAY03-C59895_1.pep
ARGRTNFGAGSNDSVRYPDDPFDRIWESDSVRRANYLVDVAPGTERISTTKPIFVGTNEEPPEKVMQTAVVGQDGSLNYRLDLEGFPANAWGVSYFAEIEDLAPNETRKFKLEVPGMPALSKPTVDVEENAQGKYRLYEPGYTNLTLPFVFSFGFRKTNDSSKGPILNALEIYKYVQITIGSQDANIMATMVSRY

SEQ ID NO: 35122 - protein, 192 aa, Sorghum bicolor
  Clone ID: SORBI-28MAY03-C59891_1.pep
MPGAPPAAASAGTNNRRIRVKANMMTASCYVCRSVVRAPPLKSRTAVRCQSAAPPGATSTSKLVLEVKERLAREHPGLPTGRNGRDDDDMVLWFLKDRKFSVDEAVPKLTKAIEFGVSELSEESVKGLYQTGKAYVHDSLDVYGRPVLVVVAAKHFPSTQDPVENQKLCAYLVEKAVSRLPSGAENILGIFD

SEQ ID NO: 35123 - protein, 173 aa, Sorghum bicolor
  Clone ID: SORBI-28MAY03-C5995_1.pep
NAWKGKPDRYGAPVSSSGSKKRKAPSKKTKCKSAAESCLPEKPLAKVAWFRVILDEAQSIKNYRTQVARACWGLRAKRRWCLSGTPIQNAVEDLYSYFRFLRYDPYAVYKQFCTMIKIPISRNPTNGYKKLQVVLKTVMLRRTKATMLDGKPIISLPPKTVSLKTVDFTGEER

SEQ ID NO: 35124 - protein, 174 aa, Sorghum bicolor
  unsure (1)..(174): unsure at all Xaa locations
  Clone ID: SORBI-28MAY03-C59488_1.pep
MAESFVLNTGARIPSVGLGVWQIQPDAAVNAIYAAVKAGYRHIDCAPAYSNEKEVGLALKKLFEDGVVKRDDLFITSWLWSANHAPEDVKEGFDTTLQDLQLDYLDLYLIHGPIRIXKGTSITSPENFIPTDIPTTWAAMEKLYESGKARAIGVSNFSCKKLDDLFAVARVPPA

SEQ ID NO: 35125 - protein, 162 aa, Sorghum bicolor
  Clone ID: SORBI-28MAY03-C5950_1.pep
MDSTGKTTEPPQLSPQAASAAQISAVLGNDDILREILLRLDFPTCLVRAAAVSKRWLRHASDPAFLRRFRRLHPPRLLGFYLDTSNSWLRFIPLPQPPELAAVIRRGNFDFGRGAGHVSDCHNGRLIVYIDDRPGKTTVCRPLHPVRGATVLPLPQIPSVGH

SEQ ID NO: 35126 - protein, 131 aa, Sorghum bicolor
  Clone ID: SORBI-28MAY03-C59504_1.pep
MAAAPARFIFSFSSVEPLLIAASPAAARNSRQGRHRGRFIRPLAASSTLLRNDFDLQEGLTDVQKILHQRQKSGREMMVTIDNLKRLCVDHYFEEEIESAMSVCMNLVHSNDLFDATLAFRLLREAGYDVS

SEQ ID NO: 35127 - protein, 319 aa, Sorghum bicolor
  Clone ID: SORBI-28MAY03-C5955_1.pep
GVRRHGRGNWDAMLRDPKLKFLNNRTSEELASRWILEEQKIIDEPMSTATRRSNSTAFPGISDAMMSRALNESNFSKMRMEQPKLQSHLTDIQLGSSDILSRFPHIEAANYINSGEGGTPQIPWQDFKHRSSYGGDFHGGAFDKLEKPDVGPIPPFMPNPFMTDSIGSLPINRKNNSSIPHSEIRSSSRENIHLSGVSDGQINLLHEMQRRVRSGKQPMEMNLNHIDHSNSQLDNTSDLGGLKSNKLPHWLQEAVRAPSSKPPERELPATVSAIAQSVCLLLGEQEPSIPPFLIPEAPLSRPKDPRINSKKRKLRKAQQ

SEQ ID NO: 35128 - protein, 165 aa, Sorghum bicolor
  Clone ID: SORBI-28MAY03-C61610_1.pep
TDADSEDWLARTLGYINANEKEGVSGIVDPTLVVDEDHLEEVWAVAIVAKTCLNPKPSRRPLARYILKALENPLRVVREQEELQSNASHLRSTPSQGSWRFAFHGNKYHGWEVMPASGQALAGKNTAKSQGTEASDEDEENSFSFKRASRENFPDPIEFEESVVV

SEQ ID NO: 35129 - protein, 133 aa, Sorghum bicolor
  Clone ID: SORBI-28MAY03-C6001_1.pep
MPFKFSFLSANYVLFFKLYKMAPNLNSCLMDLYVEQMRFAAIKCMSKSYRPTVPVRYAARVLGFVGVDKVCEALEECEEWLKAHGAILSVDNNGELQIDTKVSSTSLYLPEPENAVSHGDASLAVDDFLTRAS

SEQ ID NO: 35130 - protein, 206 aa, Sorghum bicolor
  unsure (1)..(206): unsure at all Xaa locations
  Clone ID: SORBI-28MAY03-C60015_1.pep
MAVSGEKRPPPPAPASGGTARKKLILALFICFSALLYKQILQPPLPKIAGSPGGPPVTATRTRLSDGRYLAYLEHGVPKEKAKYKIIFVHGFDSCRYDALPISTELAQELGVYLLSFDRPGYAESDPHPGRTEKSIALDIAELADNLQLGLKFYLVGFSMGGEIMWSCLKHIPHRLSGVAILGPVGNYWWSGLPANVXRDAWYQQL

SEQ ID NO: 35131 - protein, 143 aa, Sorghum bicolor
  Clone ID: SORBI-28MAY03-C6004_1.pep
RSSVSMQFRCVYIKIEHEAMIILMQAKGFGQLWIKWMRKIFESDTSAVLLNGVPGKTFNCKRGVRQGDPLSPLLFVLAADFLQSLVNKGKDLGLLRLPFPLNSNLDFPIVQYADDTLIIMETDSRQLMFLKSLLNTFANCTGL

SEQ ID NO: 35132 - protein, 274 aa, Sorghum bicolor
  Clone ID: SORBI-28MAY03-C60081_1.pep
ARGFVGYCAETHEEVLHQKGKYIFAEKRERLLCFEYLHNGSLHKHITAGPCGLPWRVCYQIIKGICLGLHYLHEKHIIHLDLKPDNILLDDGMIPKIADFGLSRLLGEKSRTITQLRLGTPVHARGGYMAPEYIDDGVITIKSDIYSLGVIIRHMMMGRNSGDTTDQDILESWMIRLEKDSSQMRQQTQLLEIGYKEQIKACIEMLHRCTRPKPKDRPTIEDILLTLEETEARVKLVAGPTSNTVQLELAKFGPWGGDGGKPRDIKMVPYLLDT

SEQ ID NO: 35133 - protein, 146 aa, Sorghum bicolor
  Clone ID: SORBI-28MAY03-C60119_1.pep
TRIYCEVECTCGCQLCFNCSLQAHSPCSCMMWELWIQKCRDESETVNWITVNTKPCPKCHKPVEKNGGCNLVACICGQAFCWLCGGATGRDHTWSSISGHSCGRFTDDQTKKTEQARRDLYRYMHYHNRYKAHTDSLKQEAKLKNE

SEQ ID NO: 35134 - protein, 92 aa, Sorghum bicolor
  unsure (1)..(92): unsure at all Xaa locations
  Clone ID: SORBI-28MAY03-C6002_1.pep
TLHSRRFAWLQADLMNHRTLRHRPRLHNTAGRRTSTARSRYRSEELVAAAAESVSALTLQEPDVTSSEDLIEXVSSEELITVSPQTLAAHNT

SEQ ID NO: 35135 - protein, 92 aa, Sorghum bicolor
  Clone ID: SORBI-28MAY03-C63755_1.pep
WVHKMQLISIHKRILHKIPKHCNNCWLNPAYTASLFLWGCTRLLLKFSTETSTCTPRSLFMDRHNTPVMPNMDTACKTYPQIPHNHLAWSVP

SEQ ID NO: 35136 - protein, 105 aa, Sorghum bicolor
  Clone ID: SORBI-28MAY03-C63826_1.pep
SSPACAKGLQHIVLATVHFFSYIQFYILPLQTKALAAPAPLNSTQIPIFTSQIKTRHRLTIVLQTLREISLLDAVVKTSYIVKCPFHILWQISSLHPGKCISITD

SEQ ID NO: 35137 - protein, 165 aa, Sorghum bicolor
  Clone ID: SORBI-28MAY03-C63858_1.pep
CCTFSNGEYVKAGLSLLEKWITDVTEEFAGTSWHELNYIREAVGFLVIHQKRKKTLQEIRQDLCPSLSVRQIYRICSMYWDDKYNTQGISTEVVAAMREVVNKDTQNLLSNSFLLDDDLSIPFSTEDLSMAIPAIDYADVDLPECLQHYTSVQFLIRQQDLQPAQ

SEQ ID NO: 35138 - protein, 119 aa, Sorghum bicolor
  Clone ID: SORBI-28MAY03-C63861_1.pep
IIDPALDSVKKLLNLDQPSGPTRQDDVKSTARSSAARESSETSAAVGSDTPGLTSNDAGNNGREATRTPTNDFDLDRFIKKRLALDPAELDAVLEGSDPRGVVSQRRKQRLPRKPLPVP

SEQ ID NO: 35139 - protein, 157 aa, Sorghum bicolor
  unsure (1)..(157): unsure at all Xaa locations
  Clone ID: SORBI-28MAY03-C60241_1.pep
MPARVVYLGEAELVPDRDDRVLELEIVRKLAAGCAEAGRSISLALEAFPCDLQEQLNQFMDGRIDGSSLRLYTSHWAPERWQEYEPILNYCRDNGIKLVACGTPLEVVRTVQAEGIRSLSKAQRKLYAPPAGSGFISGFTSISGRSLIDKISSXRGS

SEQ ID NO: 35140 - protein, 276 aa, Sorghum bicolor
  unsure (1)..(276): unsure at all Xaa locations
  Clone ID: SORBI-28MAY03-C60307_1.pep
QQGHPLAFISKPLGPRTQGLSTYEKEYMAILLAVEQWRAYLQHAEFLIYTDQKSLVHLNEQRLHTVWQQKVFTKLLGVQDKIVYKKGQDNRVADALSRRPHSSETCMAISTVVPQWCSTVVAGYSSDPQASTYITQLSVDPGAVPHFTLQNGLLRYKNRIWLGNNKVMQQRVIQALHTSAVGGHSGVPVTCRRVRQLFAWPGLKNDIYEFVTSCPTCQQSKPDRARYPGLLQPLPVPSSAWQSISMDFVEGLPVSHGYXCIMVIVDRFSKYSHFLT

SEQ ID NO: 35141 - protein, 219 aa, Sorghum bicolor
  Clone ID: SORBI-28MAY03-C60351_1.pep
LVALWQKSLIYCICLRIPTNFYHGVNFTVTPLVQRRRPDHCTQRTAPTVAAGPLGAGAPPTARRWPSGLRRAAVSAAVVAAPLHQGEKQGRARRRPPVGGPGSWAAEAANRAGPREAAVSNPKPQGQRDGKTERGEGTQAQTAAQWPGEARIADRKGTQAQHGARAPGGAGPAARPPPDRARAGGGRAGRSGAGAQPRSRPRARGVRPPGPPRRDPPGR

SEQ ID NO: 35142 - protein, 219 aa, Sorghum bicolor
  Clone ID: SORBI-28MAY03-C60316_1.pep
GMKMQGYNGSQLWDTAFAVQAIVATNLIEEFGPTLKLAHNYIKSSRVLDDCPGDLDDWYRHTSKGAWPFSTADHGWPISDCTAEGLKASLLLSKISPKIVGEPVEANRFYDAVSCLMSYMNDNGGFATYELTRSYPWLELINPAETFGDIVIDYPYVECTSAAIQALTSFKKLYPGHRRKEVDSCVSKASNFIESIQKSDGSWYGSWAVCFTYGTWFGV

SEQ ID NO: 35143 - protein, 104 aa, Sorghum bicolor
  Clone ID: SORBI-28MAY03-C60368_1.pep
MRKPDQRRTTARSRGFDDLEDDYNASPYEGFRKRGASMRKPDQRRTTAKSSGFDDLEDGLLTAKSRRAKEDEDDEVLPYEGVRKHVVSRRATPSQRRFTAARNQ

SEQ ID NO: 35144 - protein, 162 aa, Sorghum bicolor
  Clone ID: SORBI-28MAY03-C60376_1.pep
MAASARGSVWEIQPRDVEAAGLAAADAAAFVAALRSAAAAAGSGATRDAVWAAVAAAGVLRPEHPHALHQLVYYSTYAGWDRDARGPPPYWFPSPIDCKQTNLGRLMEANGPKLLGSSYKDPISSLSHFYRFSVENQEVYWSMVLKQLAVNFKQEPRAILST

SEQ ID NO: 35145 - protein, 245 aa, Sorghum bicolor
  Clone ID: SORBI-28MAY03-C59950_1.pep
TREECMERLLPPEESKSLDYDKLYKGLEVLADFEKLANSRVVDSGVLRGMNVEDIRKAGERLILQGGCKNFFQKIVKTRENLNLDIHILSYCWCAELIRSAFSSAGCLDGLNIHSNEFAFEESVSTGEIDRKMQSPLDKVEKFKSIRSDVDSTVPSLSVYIGDSVGDLLCLLEADIGIVIGSSTILRRVGKQFGVSFVPLFPGLVDKQRQLTEEDASVLKARSGVLYTVSSWSEIHAFILGSDFS

SEQ ID NO: 35146 - protein, 241 aa, Sorghum bicolor
  Clone ID: SORBI-28MAY03-C59961_1.pep
MPLVRFEVRNEVGLGDPGLYGGGAAAAGEPKALLEGVAVAGLVGILRQLGDLAEFAADVFRARHEQVIATSARGRKVLTRVQNIEAALPSLEKAVKNQKSHIHFAYVPGSDWHTQLQNEQNHLLASDLPRFMMDSYEECRDPPRLYLLDKFDTAGAGACVKRYSDPSYFKKAWDMTRADKTANLQREKRSQKIKRKGSRLREPYHGQATSRHRGTEFQRSLTAGQLVNRQFASPSNDGQSI

SEQ ID NO: 35147 - protein, 324 aa, Sorghum bicolor
  unsure (1)..(324): unsure at all Xaa locations
  Clone ID: SORBI-28MAY03-C59975_1.pep
ARGEEGMGNVHVALRYLHEALKCNKRLLGADHIQTAASYHAIAIALSMMDAYSLSVQHEQTTLQILQEKLGQDDLRTQDAAAWLEYFESKALEQQEAARRGMPKPDSSIASKGHLSVSDLLDFISPDQERKERDMQRKCRRAKNNIRAHQGESVEEKENFQHDSGSPLEASKDGFQEEKLDVHPPAVLEENYAAHDEQKQCDVLSPEEYSDEGWQAASMRGRSANVRKKSSRRKPALMKLMVDRFEDGHTGSVYRTSLQPQTKGDKEDSVSAPSQLSFGSFLKTDKVNGDPSIAEDKSCNGSTKAEQRXKPTGINRPTNIAFKF

SEQ ID NO: 35148 - protein, 239 aa, Sorghum bicolor
  Clone ID: SORBI-28MAY03-C59980_1.pep
MCFLSKREEKGNIDPVLCFLSKREEKGNIDPVHSSFGVMLKYIVAPLMDQRILLIIPLIVYIGLQHAFVWAVFTKNIVKPVLGISGVGGAMAIYGAADAICALVTGCLTSGLYSATFIVSIGTVVQGVVLFWLLLFYSPTVGVLGTAAPLLIGALWGVGDGMLNTVLNTVLGLLFEDAKEAAFAQCKVWECAAVAIIFFLSPNITLQAMLIIMTTALFISCGAFLFLTIVIDKPSTVRS

SEQ ID NO: 35149 - protein, 75 aa, Sorghum bicolor
  Clone ID: SORBI-28MAY03-C60008_1.pep
LLMLYTPPQISLVIGAMVPKLLISLCLLLLHLCSNTLNDWHAYSGQSTTPIDNTLDPQMYHMFAHVSVNFHGHRI

SEQ ID NO: 35150 - protein, 219 aa, Sorghum bicolor
  Clone ID: SORBI-28MAY03-C60428_1.pep
YLTLKEVFESLDLTGYDLNVDLLDVHADKSTFRPCDKFNLKYNPCGQSRLREIFLKQDNLIQGRFLAELTKEVFSDLEASKYQMAEYRISIYGRKKSEWDQMASWIVNNELYSENVVWLIQIPRIYNVYREMGTINSFQNLLDNIFLPLYEVTVDPASHPQLHVFLEQVVGLDLVDDESKPERRPTKHMPTPEQWTNVFNPAYAYYVYYCYANLYTLNK

SEQ ID NO: 35151 - protein, 172 aa, Sorghum bicolor
  unsure (1)..(172): unsure at all Xaa locations
  Clone ID: SORBI-28MAY03-C60437_1.pep
ARGFCWNCTEEAHRPVDCATVSKWILKNSAESENMNWILANSKPCPRCKRPIEKNQGCMHITCTPPCKFEFCWLCLGPWSEHGERTGGFYACNRYESPRQEGAYDESERRREMAKNSLERYTHYYERWAANQSSRQKALGDLQSLQNDKLEKLSDIQSQPESQLKFIIEAWX

SEQ ID NO: 35152 - protein, 151 aa, Sorghum bicolor
  Clone ID: SORBI-28MAY03-C60442_1.pep
METPPPFQESAHCDVCRCTFGTFRRRHHCRSCGRTLCHEHSSYHMALPQYGIYTDVRVCYDCFNKSSSQGRVGNSVSAGSISGAADSFSGLSLGKEDASAPMKNSTVQSATPLIECKCGMPLCICEAPKPEPAPTPVKNISTVPSTTQSNP

SEQ ID NO: 35153 - protein, 343 aa, Sorghum bicolor
  unsure (1)..(343): unsure at all Xaa locations
  Clone ID: SORBI-28MAY03-C60473_1.pep
HEAIVAAPLLIAFELLLCIYLESIRXNHPSVDLKIVFLPLLAFEAIILIDNFRMCRALMPGDEESMSDEAIWETLPHFWVAISMVFLIAATTFTLLKLSGDVGALGWWDLFINYGIAECFAFLVCTRWFNPMIHKSPTHGEASSSSAAIRYRDWESGLVLPSLEDHEQERLCGLPDIGGHVMKIPLVAFQVLLCMRLEGTPASARYIPIFALFSPLFILQGAGVLFSLARLVEKVVLLLRNGPVSPNYLTASSKVRDCFAFLHRGSRLLGWWSIDEGSKEEQARLFYTESTGYNTFCGYPPEVVRKMPKKDLAEEVWRLQAVVGKKVKQKQIVNKNIALFECS

SEQ ID NO: 35154 - protein, 59 aa, Sorghum bicolor
  Clone ID: SORBI-28MAY03-C60488_1.pep
LLLFGGLNSHHVASFSTSSTCTSISCILLYQQRSMKNRKNAYKYRKGHEVCTVPLMPNV

SEQ ID NO: 35155 - protein, 181 aa, Sorghum bicolor
  Clone ID: SORBI-28MAY03-C60126_1.pep
ARGKEVWRELLNPSPAVRRMLYAGCGIQLFQQITGIDATVYYSPTIFKDAGIKSDQELLAATVAVGFTKTVFILVAIFLIDRVGRKPLLYVSTIGMTICLFLLGVALTLQKHAVGLMSPRIGIDLAIFAGCGNVAFFSIGMGPICWVLSSEVFPLRLRAQGSVLGQVGGRVSSGLVSMSFL

SEQ ID NO: 35156 - protein, 47 aa, Sorghum bicolor
  Clone ID: SORBI-28MAY03-C60224_1.pep
TWSKLSFTGRHRCHNCILLWTEEGLHPTRCYFIPHVSVLWLALFLNN

SEQ ID NO: 35157 - protein, 195 aa, Sorghum bicolor
  unsure (1)..(195): unsure at all Xaa locations
  Clone ID: SORBI-28MAY03-C60230_1.pep
LTRVEELIDPNTGNWDEQLVRDTLWEEEAEVILTIPIGEGLLDWPAWHFNSKGQFSVKSAYKLAAQYRDNEADWEAGTSAEGGPAAASFPWQKIWQLKVPNKVQMFFXCFVHNSLPLRRNLKRRRIKIETLCPMCWLDEDCGHLFFKCKGARECWRALHMEELRCTLASCGSGREVAMKIWEQQSETQLKIVASC

SEQ ID NO: 35158 - protein, 59 aa, Sorghum bicolor
  Clone ID: SORBI-28MAY03-C60225_1.pep
GGNDQVALPNQRYCNCRDILNFRLVKSHNKSISSISIQNITRSLAHIDTWFHSSLHTGS

SEQ ID NO: 35159 - protein, 203 aa, Sorghum bicolor
  Clone ID: SORBI-28MAY03-C60603_1.pep
TRLRVFDPMTHRVSSVDQLPRRGGRAPDHRGRRLCLPPGGDDPDAFRVMSLQHGNAKKLARLEVYNSCTRAWRVLTGAGTAKIPARKHMAKIYRGQYAPAMHAGDRIFWKYDAANLLLSLDTQTMTFSNVCLPPGVTRLSAYAVGETEDGTCCLVHVLESGNRQMQVWRFKVGDDHEGNGDQMWELERQVPLILASPSACLSG

SEQ ID NO: 35160 - protein, 148 aa, Sorghum bicolor
  Clone ID: SORBI-28MAY03-C60610_1.pep
MDLMLPFKVGDIAESRSFSLGYRGAWFRSKINLMCIRQGHLECLLEYLDFPDEKKTWTRLYKIPPGSHRRKSHLSRMIMVRPTFPQCYWENEKPNQLPKTHAVAIVTGPWKVGDLIDWWYTDCYWTGKIIELLGDDKVKIALHEEPIG

SEQ ID NO: 35161 - protein, 244 aa, Sorghum bicolor
  Clone ID: SORBI-28MAY03-C60680_1.pep
TRGNNSLNGLNPPLPSVETNNGKSSGRNKSSVPAIVGGAVGGFAALLIAFIGVCIICRRKEVAKEPGEPDDGQWTPLTDYSKSRSNTSGKTTTTGSRTSTLPSNLCRHFSFGEIQAATNNFDQTSLLGKGGFGNVYLGEIDSGTMVAIKRGNPTSEQGVHEFQTEIEMLSKLRHRHLVSLIGYCDDMNEMILVYDYMANGTLREHLYNTKKPALSWKKRLEICIGAARGLHYLHTGAKHTIIHR

SEQ ID NO: 35162 - protein, 93 aa, Sorghum bicolor
  Clone ID: SORBI-28MAY03-C60683_1.pep
FFFFFFMQRRMDFTEFGQKCQQFICFGPRGPTKLSPPLSSPRARPKLASNQPNSPARALPFPLSPTRGLVSTRRRNRQPAPFPPTGRPHSLCR

SEQ ID NO: 35163 - protein, 197 aa, Sorghum bicolor
  Clone ID: SORBI-28MAY03-C60685_1.pep
HEAYGRPSANIVIQNVVIRSMVSAGVSIGSEMSGGVSDVLVENVHVWDSRRGVRIKTAPGRGAYVTNIVYRNITLENVRVGIVIKTDYNEHPDEGFDPKAVPTIGNISYTSIHGHRVRVPVRIQGSAEIPVKNVTFHDMSIGIVDKKHHVFQCSFVQGQVIGYVFPVPCKNLDLYDERRELVKQSTLQNISDIDYSF

SEQ ID NO: 35164 - protein, 213 aa, Sorghum bicolor
  Clone ID: SORBI-28MAY03-C60704_1.pep
MGGGRKRRRRGGSDAPSMHPRNRYAAAAPDAPALAELYPSFRPFVSVSDRGRASVDFTDFSATRELTRVLLLHDHGVNWWIPDGQLCPTVPNRSNYIHWIEDLLSSDLIPPISSSSERVKGFDIGTGANCIYPLLGASLLGWTFVGSDVTNVALEWAQKNVESNPRLAELIEIRNANAPSSESESVVREAAREKILEPAEDVAMPKPHILVGV

SEQ ID NO: 35165 - protein, 60 aa, Sorghum bicolor
  Clone ID: SORBI-28MAY03-C60384_1.pep
HLEFPYMFLQGSGEVPRDITYRLYSSMHHSSIAICSVFIASYLEPWMDSKFVISSSVKLF

SEQ ID NO: 35166 - protein, 198 aa, Sorghum bicolor
  Clone ID: SORBI-28MAY03-C60391_1.pep
ARGLKDLNFQAQRGMRVAVCGTVGSGKSSLLSCILGHVPKLSGEVKICGMTAYVSQSAWIQSGKIQENILFGKEMDKDKYERVLESCSLKKDLEILPFGDQTVIGERGINLSGGQKQRIQIARALYQEADIYLFDDPFSAVDAHTGSHLFKECLLGALSSKTVVYVTHQIEFLPAADLILVMKDGKIAQAGKYNEILG

SEQ ID NO: 35167 - protein, 170 aa, Sorghum bicolor
  Clone ID: SORBI-28MAY03-C60400_1.pep
MLLPALQTWQKDSNSSGWGLLFPHNRGIYHSLFSRKLSHIPEQNSSCPIVIGNSKLLSDKIEAERLQTEKTLSKDLLKQKYKKNFRPQLVSKCLILPENLRGKSMEFLHHQYHLVNRITPQYLSAYELMIQRERIVDEEEWNFLWNHILSNTTFIVEDWDSNICNIETLH

SEQ ID NO: 35168 - protein, 238 aa, Sorghum bicolor
  Clone ID: SORBI-28MAY03-C60405_1.pep
TRAALKRRDFLQLGFKFDNLLMEESAQILEIETFIPMLLQRQEDGHARLKRCMLVGDHHQLPPVVKNMAFQKYSHMDQSLFTRFVRLGVPYIELNAQGRARPSIAELYNWRYRELGDLPYVREQAIFHKANAGFSFEYQLVDVPDYKGKGESAPSPWFYQNEGEAEYIVSVYIYMRLIGYPATKISILTTYNGQKLLIRDVINKRCKPWNIEPPNKVTTVDKFQGQQNDFILLSLVRT

SEQ ID NO: 35169 - protein, 176 aa, Sorghum bicolor
  Clone ID: SORBI-28MAY03-C60417_1.pep
ARGTPLGQEPPQTVSAHGIMMEVRDRRQMDLARVSPGARGSREEVLGEPLTPSEVRALVKPHISHNRQLNIGRDGLTHNMLEMIHCHWRRQEICKVRCRGVPTVDMKNLCYHLEEKSGGKVIHRVGGVVFVYRGRHYDPKTRPHYPLMLWKPATPVYPKLIKEVPEGLTKEEADEM

SEQ ID NO: 35170 - protein, 225 aa, Sorghum bicolor
  unsure (1)..(225): unsure at all Xaa locations
  Clone ID: SORBI-28MAY03-C60799_1.pep
QCRRKTTXEKIKEEARRRKEAIMAKYRQQQSQKQDMESKPSSNDEEVRAMDGNETIYQKDARGSGSTGNDEAENKHNSSEVFDDKTDFTVGKSPAHNDASTSAGAFTDERTIGVSGLGEGSPKSERSADMFCDDIFGESPAGIRKSGKDDGLHIERNALHDNWDDADGYYTYRFGELLDGRYEIIAAHGKGVFSTVVRAKDLKASKDDPEEVAIKIIRNNETMYK

SEQ ID NO: 35171 - protein, 184 aa, Sorghum bicolor
  Clone ID: SORBI-28MAY03-C60816_1.pep
ARGTTVDASETQVIEAMRTRASHIGNTSKFSKASKLALQLIEAGSVKPGTISHFFAILEAAMSSPGACNEPSVRADYHKLFDAAQGVTELFNQQQKNQFDIWVLHAVVANDLFTDDSFVFSKAVGKIKDAISALPVATVDDDNDEAAALAAASKTDSVTDNKTDHSAPAAASNSVADDSTHAAA

SEQ ID NO: 35172 - protein, 276 aa, Sorghum bicolor
  unsure (1)..(276): unsure at all Xaa locations
  Clone ID: SORBI-28MAY03-C60840_1.pep
CSFIQLTDFGLSKVGLINSTDDLSGPAVSGASLYGDDEPHMNELEQMDHRARRQNRSAVGTPDYLAPEILLGTGHGCSADWWSVGVILFGPRVGIPPFNAEHPQTIFDNILNRKIPWPHVPEEMSFDAQDLIDKLLTEDPHQRLGANGASEVKQHPFFKDISWDTLARQKAAFVPSSDSASDTSYFTSRYSWNPSDENIYEAYEFEDSSDNGSLSGSSSCVSNRQDDMGEDSGGLNEFESSANVNYSFSNFSFKNLSQLASINYDLLTXGLKDDQP

SEQ ID NO: 35173 - protein, 50 aa, Sorghum bicolor
  Clone ID: SORBI-28MAY03-C60868_1.pep
KHETTIIYLRTEVSHLLQDFFSKNFCKRITSNLTIYLTNSVESCKKGAFM

SEQ ID NO: 35174 - protein, 205 aa, Sorghum bicolor
  Clone ID: SORBI-28MAY03-C60901_1.pep
HEEERELQLVSEDCNTKRKHGEDKDIMGEVTKTHEAIQSLDKSISTLQMELAAKRSTLERLRSSGSPVTSETSQPRKKAFVVIGVNTAFSSRKRRDSVRETWMPQGEKLKQLEEQKGIVIRFTIGHSATSNSILDKAIDSEDAQHHDFLRLDHVEGYHELSAKTKIFFSTAVGIWDADFYVKVDDDVHVNLGMLATTLARHKTKP

SEQ ID NO: 35175 - protein, 248 aa, Sorghum bicolor
  Clone ID: SORBI-28MAY03-C60919_1.pep
TRIDYIRSLSRCKRWNAQGGKSNVYFAKTMDERFIIKQVTRTELESFVEFAPQYFKYLMESLTSGSPTCLAKIVGLYQVSVKSLKAGKEVRMDLMVMENIFFERKISRVYDLKGSLRSRYTAGDSKVLLDSNLIEALHTKPIFLGSKAKRRLERAVWNDTSFLALADVMDYSLLVGIDEEKKELVIGIIDYLRQYTWDKQLETWVKASGILGGPKNESPTVISPMQYKKRFRKAMSKYFLTVPDQWSS

SEQ ID NO: 35176 - protein, 222 aa, Sorghum bicolor
  Clone ID: SORBI-28MAY03-C60519_1.pep
ARGQKVRYGKAGSPDKEITARNIIIATGSVPFVPTGIEIDGKTVFTSDHALKLESVPDWIAIVGSGYIGLEFSDVYTALGSEVTFVEALDQLMPGFDPEIAKLAQRVLINPRKIDYHTGVFASKITPAKDGKPVLIELIDAKTKEHKETLEVDAALIATGRAPFTQGLGLENINVVTQRGFVPVDERMRVMDADGNVVPNLYCIGDANGKLMLAHAASAQGI

SEQ ID NO: 35177 - protein, 270 aa, Sorghum bicolor
  Clone ID: SORBI-28MAY03-C60525_1.pep
MAAPCHLHLHLHLPGCPQTLALPLPSPRGFSARPGLRSRSRLRLRPVAALGPADAGDLLGRVEAFLYTVADAAVSAADPVVTAADGGTKEAPGDWLSGITNSMETVLKVLKDGLSALHVPYSYGFAIILLTVLVKAATFPLTKKQVESALAMRSLQPQVKAIQERYAGDQERIQLETARLYKLSGVDPLAGCLPTLVTIPVWIGLYRALSNVANEGLLTEGFFWIPSLAGPTTIAARQNGQGISWLFPFTDGHPPLGWSDTLAYLVLPVL

SEQ ID NO: 35178 - protein, 72 aa, Sorghum bicolor
  Clone ID: SORBI-28MAY03-C60531_1.pep
CVVVCLPSNVWLFDHLLSFRLEMGKWFSYHQPSKLFATYMHYNFELVLLFCEPDVYCFLHSCLMSGLLVLAL

SEQ ID NO: 35179 - protein, 91 aa, Sorghum bicolor
  unsure (1)..(91): unsure at all Xaa locations
  Clone ID: SORBI-28MAY03-C60561_1.pep
CSACSLNSLFLLWQCSSVSVGVKRRGGPGGLNKVCGVSSELQAIVGEPVMARIEIVKXFWAYIRRNNLQDFNNKRKIICNDELRLVFETDS

SEQ ID NO: 35180 - protein, 109 aa, Sorghum bicolor
  Clone ID: SORBI-28MAY03-C60589_1.pep
KEDNSACFLHSHDIYKFALPIQRVFQEATEELLGRSAWASTVASKFSPTVIELQKFCQTWWLLKVQLLLALIVMTWALVLLALQWSFSLNCCFPGILPTWWQLTFHLFL

SEQ ID NO: 35181 - protein, 160 aa, Sorghum bicolor
  Clone ID: SORBI-28MAY03-C61150_1.pep
DGARDDEFEMGAGPRRFSYTQLSQATRGFSDDEKLGEGGFGSVYRGYLQDQGLHVAIKRVSKTSRQGRREYVSEVTIISRLRHRNLVQLVGWCHDADELLLVYELMSNGSLDKHLYSTDNILTWPFVTSKFQHEECDEIRSFSVYDTVRREICKLRMEQG

SEQ ID NO: 35182 - protein, 164 aa, Sorghum bicolor
  Clone ID: SORBI-28MAY03-C61172_1.pep
TRRMMNMYKKAAEFWAELRLELLSASELFADGSSNQIWRLYWASHQRFFRHMCMSAKVPAVVRLAKEALAENKCVVIGLQSTGEARTEEAVTKYGVEMEDFVSGPRELLLKLVEENYPLPPKPDSFQQGDEKVTEIQRKRHSALDVSFKGRVRKVAKVVDVSDD

SEQ ID NO: 35183 - protein, 214 aa, Sorghum bicolor
  Clone ID: SORBI-28MAY03-C6118_1.pep
EADSLRATYIRRLTSVLIQHVPAFWRLALSVFSGKFAKAASGNVVSDSDMNAKPAANKNDDKSGEVKYTNHTLDEVASMVRATISAFDTKVQSTFRDFEECNILCPYMSDTIKEIAKACQTLEGKDSSPTAVKMLRTLHFEMTKLYILRLCSWMRATTKKISKDETWVTLSTLERNKSPYAISCMPLEFRDITISAMDRIDTMILNLMSETAKS

SEQ ID NO: 35184 - protein, 197 aa, Sorghum bicolor
  Clone ID: SORBI-28MAY03-C61236_1.pep
MLLLPPSAEPILATTQLTRSVPPLRHFPPPGPGLLMGGLLESGRAILARLLAESSPVDLSAQLLSPAAVPFHLIPFVGQSLPLPRHFLSAAASMLSFGLRALDRPPLVCLLRALIVTVVGPSAFRLVSCPPGRPVPQQSVHLCWFPRSPVPWLMCLRPISAELQKALGSHLSWKDRYPPFFDDIAARLLPVIPLIIY

SEQ ID NO: 35185 - protein, 251 aa, Sorghum bicolor
  Clone ID: SORBI-28MAY03-C61249_1.pep
HDCFVQGCDASVLIDSTDGNTAEKDAQANKSLRGFEVIDRIKEVLESQCPGVVSCADVLALAARDAVLLARGPYYGVPLGRRDGTRSVDSDTFTALPPPFFNTTSLIKLFGSHGFTVQDLVALSGGHTLGIAHCGNFKARLAETDTLDAALGSSLGATCAANGDDGAAPFDRTSTRFDTVYYRELQMRRGLLSSDQTLFESPETKGIVNMFAMNQAYFFYAFQQGMLKMGQLDLKEGDEGEIRHTCGVINS

SEQ ID NO: 35186 - protein, 72 aa, Sorghum bicolor
  Clone ID: SORBI-28MAY03-C61584_1.pep
DNLIQRTLRQQFKETTVITIAHRISSVLDSDMVLLLDNGVAVEHDRPNKLLEDKSSLFSKLVAEYTMRAAHT

SEQ ID NO: 35187 - protein, 197 aa, Sorghum bicolor
  Clone ID: SORBI-28MAY03-C60708_1.pep
ARGQEAITEAVSVARGINTKYGSSSYKPVVLIDHRIPFYEKIAFYAASDCCIVNAVRDGMNLVPYEYTVCRQGNEEIDKLRGLDKDTHHTSTLIVSEFVGCSPSLSGAFRVNPWSVDDVADALCRATDLTESEKRLRHEKHYRYVSTHDVAYWARSFAQDLERACKDHYSRRCWAIGFGLNFRVIALSPGFRKLSLE

SEQ ID NO: 35188 - protein, 199 aa, Sorghum bicolor
  unsure (1)..(199): unsure at all Xaa locations
  Clone ID: SORBI-28MAY03-C60732_1.pep
FLRGSCTLKFWQQVLTNGLIWRVGNGDRXIWNDPWFRREWTXPSTPRGANLMNXVIEMIDPCTGNWXQDTKDVNXILLIPVHMEMDDVAAWCYXGLFLTKSAYIVQEEFEKKAIMXAHSSSPGALIDKDXEFWKKIWSMGCPGPGEDQRFSYAHFILLLRMVLKKRWMDLNTKCVVCQWXDEEGHLVYKRKELKEGNAS

SEQ ID NO: 35189 - protein, 237 aa, Sorghum bicolor
  Clone ID: SORBI-28MAY03-C60741_1.pep
TRGNFLIGCSFLIFILTTRFIGRRYKKLFWLSAISPLLSVILSTAAVYATRADKHGVKIIQKVHAGSSPSSAKQIHLNGPHATECAKIAVICAVIALTEAIAVGRSFASGRGYKLDGNKEMLAMGFSNVAGSLSSCYVATGSFSRTAVNFSAGARSTVSNIVMSITVFVALELFMKLLYYTPMAVLASIILSALPGLIDIKEACNIWKIDKMDFLICLGAFVGVLFGSVEIGLAVAL

SEQ ID NO: 35190 - protein, 263 aa, Sorghum bicolor
  Clone ID: SORBI-28MAY03-C60786_1.pep
MATGTGDLGFECAVITGGAGGIGKAMARHFISKGKKVLIAGRTESKLQNTMQEIGAAGYYVLDTGEVQSIPDFVKRITTDHPELDCLVNNAGVQRPLEVLKDDDFLSKADQEININIRGPMHLALGLLPHLQTKKSALIINVSSVLGFIPFSIINPVYNGTKAWLHFWTMNLRTQLKNGGSNVRVVEIAPPTVSTDLHRERSDPDDNKKEKNPNALSVDEFMDQVASKLEKGDETIGPGMAGEVIDRWYGAFGEQYAKATGSQ

SEQ ID NO: 35191 - protein, 151 aa, Sorghum bicolor
  unsure (1)..(151): unsure at all Xaa locations
  Clone ID: SORBI-28MAY03-C6147_1.pep
MLYIVGLGLGDERDITVRGLDAVRSCSKIYMEAYTSLLSLGLDPAALANLEKLYGKEITVADREMVEERVDQVLSEAADTDVAFLVVGDPFGATTHTDLVVRAKKMXVEVKVIHNASVMNAIGVCGLQLYRYGETIXIPFFTDEWRPDSFY

SEQ ID NO: 35192 - protein, 146 aa, Sorghum bicolor
  Clone ID: SORBI-28MAY03-C61480_1.pep
KIALGGRYSRDFFNRYGDLRHIRRLRFWPLNKVLMEKYEFTEVNAIGMADFLVPILDFVPEKRPTAAQLLQHPWLDVGPLRQQPKTLPDSAQSSVDGVSEKQKKENEERDAMALELGNIAIDGASSRMANDPQASTNKTTAIPSKK

SEQ ID NO: 35193 - protein, 62 aa, Sorghum bicolor
  Clone ID: SORBI-28MAY03-C61566_1.pep
KSNRLYMFVRIQKWSAANQGSANKPTGNSLKFLRMCTTRFLIHQIGFILTPNHRDGLSSNKF

SEQ ID NO: 35194 - protein, 190 aa, Sorghum bicolor
  unsure (1)..(190): unsure at all Xaa locations
  Clone ID: SORBI-28MAY03-C6151_1.pep
MATLARWHPPLPPAPLAAGAAARPPTARPLARRRIPRRAATVVSPRAFGGDFDGFVRRAWRSANAGAERLAFEARQAAKRLDGRFSISRRLAEASRAARARAVEIDAELGIGRRWRSFSVDFSRNWPRYRREINDFMETPIGRALATIFFLWLALSGWXFRIFIFGTFVLPFAVPLLLGALANKVAIEGT

SEQ ID NO: 35195 - protein, 112 aa, Sorghum bicolor
  Clone ID: SORBI-28MAY03-C61580_1.pep
TPLGEWIFKSKSKQNSCGLQGACKGFMFGLQVTELVEIWPEQVTHGRRWVPVEEAYGLCRYDWMREALDKLKEQLLFESNEFRPLPSPELVDSSSLFMVMPPAAAEGAVALC

SEQ ID NO: 35196 - protein, 201 aa, Sorghum bicolor
  Clone ID: SORBI-28MAY03-C60957_1.pep
MAASATPRPSLILPRAASHSHSQPSAVGLTSDRVAASRRRRGDFVFVVNPSGANGRTGKQWKQLLPLLRTRLADQCNICECITSGPSHAIDVTREAIKDGADAVIAVGGDGTLHEVVNGFFCKGSPVRALDRGPDHSTALGLIPLGTGSDFSRTFGWTNDPCDAIDRIVRGVKSKLDIGVMEGPNREPHFFVNVADIHLSA

SEQ ID NO: 35197 - protein, 159 aa, Sorghum bicolor
  Clone ID: SORBI-28MAY03-C60976_1.pep
MVALVPIAHIVAAVFSIIELGLTSYVASGYNGYNGWSGWWSRSPDIVNFLIFNSVWSLLVLAYVGLTPLYMTRLFHKLVSVGLLVITTIFWFAGAIAFAVFVGTPRCGANTFCGSSQAAVAFAFFIWAIFMFLAALDTLEAMRSRGHHSTKAHHTYPGA

SEQ ID NO: 35198 - protein, 234 aa, Sorghum bicolor
  Clone ID: SORBI-28MAY03-C60958_1.pep
MNSHKLLLVVLLLLLLNYASYAATSWEDDEFLKTCSSRRCHKHGPEIRFPFRLPSHPPSCGAPGMQLSCSGHDTILDHPVLGSCKVTAIYYRHRVMNIILPADSSSHCPLQKLVTRNQSTHVYAPVTRTFSSDSVLVGCSREATNQDGIVGPSSCLSLSNNANQLWYLVLPYTDMSTLPMGCEVVAKSIPIPYAYDKIGPKVETFFGRSLFNKKANRAINFGETSFSWNLNHIT

SEQ ID NO: 35199 - protein, 88 aa, Sorghum bicolor
  Clone ID: SORBI-28MAY03-C6101_1.pep
MDTAIGSVPASSDGAAPAASGSAPRDATLGRHLARRLAEVGARDVFTVPGDFNLTLLDELEAEEGVRLVGCCNELNAAYAADGYARAR

SEQ ID NO: 35200 - protein, 249 aa, Sorghum bicolor
  Clone ID: SORBI-28MAY03-C61034_1.pep
MASSSSSDSGRNAETLASRTSSALAAASLIPGLPDDVATVILCLLTFPDQSRLRATSRAWCLLLSAATLLPLRRSLRLPRRHLLCLFPTGPSLASPILLDPAAPTAWWPLPPLPCSPQLYGLANFAAIAVGRHLYVLGGSCFDARSYPLGQPSASAAVYRLDLANSRHCWERLPDMQLPRGSFACAHTPSAGGLLVAGGGSRHPMFPSNGSRTDSTEWYDATAQSWHVGASMPRDRAGCVGFLARGAGD

SEQ ID NO: 35201 - protein, 124 aa, Sorghum bicolor
  Clone ID: SORBI-28MAY03-C61621_1.pep
ITAKHPCKLSFALPTLKLTTASENDSKDCLFSQPTQMLREYGKPTSRRQGRKSFSLTVIASGQFVQQITMTRTTRQRLVFTLSVQPNIRSDPTKSSRRFTQLSEYRFTRLLVWATWVWWPGRIF

SEQ ID NO: 35202 - protein, 127 aa, Sorghum bicolor
  Clone ID: SORBI-28MAY03-C61672_1.pep
AVKTDKAKILKVSWDGSADSYNAAKLEELFQKFGKVEDVVIKTRKSRSKGSAIVVMGSKEAALLAIQNHFSLFPLNVAPVQESGGLPARSAQTYESTASNIDGTGFSDLEASVFRKLQEAQKRKQCG

SEQ ID NO: 35203 - protein, 143 aa, Sorghum bicolor
  Clone ID: SORBI-28MAY03-C6168_1.pep
HEEEVDSQDIAITHENKVSADDGLQVQEPIRISNNRNDNKVRELELRIELLEAELREAAAAEVGLYSIIAEHGSSVNKVHTPARRLSRHFVHALKNCLRDKMGSAARNATSGLVLVAKACGYDIARLSFWLSNCVVLRAIVTE

SEQ ID NO: 35204 - protein, 142 aa, Sorghum bicolor
  Clone ID: SORBI-28MAY03-C61680_1.pep
NRHNHDTISMAVIDKMGHIAVGTSTNGATFKIPGRVGDGPIPGASSYGDNEVGACGATGDGDIMMRFLPCYQVVESMRQGMDPRDAAKDAISRIARKYPDFIGAVFAVNKEGVHAGACHGWTFQYSVRNSSMQDVEVITVYP

SEQ ID NO: 35205 - protein, 126 aa, Sorghum bicolor
  Clone ID: SORBI-28MAY03-C61688_1.pep
GVGVPDILGLSLPCLMDFSCIRPTGRLEHGLVSGSKGKTQAAHHCDLEFLIRYLPWIDQYKRMECSMKGSKCGFTVHDQEQICMSKEQSTHILRSQIWDRCSDYRVKDSTQKQSYSTEEFFCYSPH

SEQ ID NO: 35206 - protein, 243 aa, Sorghum bicolor
  unsure (1)..(243): unsure at all Xaa locations
  Clone ID: SORBI-28MAY03-C6171_1.pep
HEGPLTPHEEAQSVGQLREVSNKAHNAELKLFLEVELGPELCPIRPPEKSKEDILLFFKLYNAEKEELRFVGRLFVKALGKPSEILTKLNEMAGFSPNEEIELYEEIKFEPNVMCEHIDKKLTFRSSQLEDGDIICFQKAPVPDGDTQVRYPDVPSFLEYVHNRQVVHFRSLDKPKEDDFSLELSKLHTYDDVVERVAHQLXLDDPSKIRLTSHNCYSQQPKPQPIRYRGVEHLLDMLVHYNQ

SEQ ID NO: 35207 - protein, 92 aa, Sorghum bicolor
  unsure (1)..(92): unsure at all Xaa locations
  Clone ID: SORBI-28MAY03-C61257_1.pep
MDGLTDEQRLAFQEAFSLFDKNGDGCITMEELAAVTRSLGLDPSDQELNDMMSEVDTDGNGIIDFQEFLSLIARKMKDGDGDXELREAFEVL

SEQ ID NO: 35208 - protein, 101 aa, Sorghum bicolor
  Clone ID: SORBI-28MAY03-C61302_1.pep
VLRIISDIALAEIADGCPKLKEIALSHCPDVTNVGLDHLVRGCLQLESCQMVYCRRITSSGVATIVSGCTRLKKLLVEEWKVSERTRRRAGPVLSFLCTGL

SEQ ID NO: 35209 - protein, 201 aa, Sorghum bicolor
  Clone ID: SORBI-28MAY03-C61311_1.pep
NSHPKIADFGLAKLCRTKESKLSMTGARGTPGFIAPEVHSRTFGVVSTKSDVYSYGMMLLEMVGGRKNVKSVAQESSEKYFPHWIYDHFGQDDGLPACEVTSENEGIAKKMSVIGLWCIQILPMHRPTIGKVLEMFDRGLDELDMPPRQNFSEIFLDPACGSYAVRTCLIGRTKTKASSEVLKMKEISIVNSKILQRLPTL

SEQ ID NO: 35210 - protein, 124 aa, Sorghum bicolor
  Clone ID: SORBI-28MAY03-C61402_1.pep
NPQRYEIFFCFNSISFMASIVVVMYLLNKSARKKDVPLEVLHLIMILDLLALMTAFAAGSCRKFRTSVYVYALVLGVVVYLVIVVLLSSGIAKCLRPMERNKVSSQRSPSHASTTSTLILEDQV

SEQ ID NO: 35211 - protein, 128 aa, Sorghum bicolor
  unsure (1)..(128): unsure at all Xaa locations
  Clone ID: SORBI-28MAY03-C61422_1.pep
MSGVAGDSARAAVMKNEWKDQDLGLXQVAFDESTMPAPACSCTGELHQCYKWGNGGWQSSCCTTNMSMYPLPVMPNRRHARMGGRKMSGGAFTKLLSRLAAEGHDLSIPVDLKDHWAKHGTNRYITIR

SEQ ID NO: 35212 - protein, 84 aa, Sorghum bicolor
  Clone ID: SORBI-28MAY03-C61857_1.pep
KRRIRETFKDFPQSALQLIETLLAIDPADRLTATSALRSDFFTTEPIACEPWSLPKYPPSKEIDAKRRDEEASRFVPLPLISFS

SEQ ID NO: 35213 - protein, 159 aa, Sorghum bicolor
  Clone ID: SORBI-28MAY03-C61878_1.pep
GISKRQDISYHPNVQICVGCKPTFIRISDYGMWYMLNQLEFSNISRLNLRNVCCGQELSQETSVKLGVEYPLACNYMCVRLCVVWRLTVSFQYISIQLKQRQFDLVLEDFAYGIQPGFGHCTYTAAYRFSFVDNCTRYCAHLEHALNRFLSDKCKKGSR

SEQ ID NO: 35214 - protein, 135 aa, Sorghum bicolor
  Clone ID: SORBI-28MAY03-C61881_1.pep
ISRVIAKQRRDLNRVNVKKDIDISSSENCRVWVEMQSSSDLNEQGTSSTSVSHYAGSPSSDIVLLSELQRQSSKKEDVEDITVIPTIPNKEDDKDIIAMPVIPDKEDAVDGIPILAIPRAMLCNLVTRCVHFFRP

SEQ ID NO: 35215 - protein, 65 aa, Sorghum bicolor
  Clone ID: SORBI-28MAY03-C619_1.pep
LLQGVICTVFRVGGCKISDSATIQGSQMDFTQNNITENCGLRTRTSLLTQTSMEHDKSLWESCSN

SEQ ID NO: 35216 - protein, 140 aa, Sorghum bicolor
  Clone ID: SORBI-28MAY03-C61904_1.pep
VDQCLVWRCLECLGCTFCDQCYKQNGQSLHSHELRQIHTSETLQKHTLQDYIDGLLHASRCYDPRNCTHPVCLTLKKLFFHGVRCDIRARNWSGCNKCVFMWKLLLCHSKDCNDVNCSVPRCRDIKAYIAEKLKVVGPVL

SEQ ID NO: 35217 - protein, 83 aa, Sorghum bicolor
  Clone ID: SORBI-28MAY03-C61919_1.pep
VDTCKDKFLTFEFEDDFLVVLHREEAAAASSDILKEHAIPSIRSSDLSEPYVETKNDIQKTSEDFGESPVTNFEMGIDCLLWA

SEQ ID NO: 35218 - protein, 157 aa, Sorghum bicolor
  Clone ID: SORBI-28MAY03-C6640_1.pep
APCTRSEIWMIEKGSLEDDIFHEPIFSCLSEELNELHNRTYEAIVRPAVQSMELQGQFDMPETIPESNIAGFRAATINDPLHIPDGIQSDALLSGANDACGATPTFGLQIPPDNQVNGASNDFVIGTLFQGVTEPFIDNEKEVAPADREHAQVDTLY

SEQ ID NO: 35219 - protein, 196 aa, Sorghum bicolor
  unsure (1)..(196): unsure at all Xaa locations
  Clone ID: SORBI-28MAY03-C66393_1.pep
MGSVAGDTAARLAYPPARRDDSVVDDYHGVRIADPYRWXDPDSEETKEFVARQAELAETVLAGCPDRENLRREVTRLFDHPRHAAPFRRGNKYFHFHNTGLQAQSVLYMQDDLDGKEEVLLDPNTLSKDGTIALSTYSISKDGNYIAYGLSESGSDWVSIHVKSITNKQPMPDKLSWVKFSSISWTHDGKGFFYGR

SEQ ID NO: 35220 - protein, 96 aa, Sorghum bicolor
  Clone ID: SORBI-28MAY03-C66421_1.pep
SSDLSCSVTMQAEGHHDSIVNLQQSTTISTLVLKENAPPLYLDTKVLKDKACTENAINILTDNPFGAKRLSPIVAVAPPHDSSSIKQSTDDAQFFL

SEQ ID NO: 35221 - protein, 185 aa, Sorghum bicolor
  Clone ID: SORBI-28MAY03-C66424_1.pep
MMRSVSGTGSAGSRRSDPGGSGELSRFSVATTTASSASDSSASSGARGISFLDAFRSCFVPPEARSPENSMSDDSHPSHQLSQSLSSQGSNSGSVFGSRRSIKGMYSPMHKSSLDREIPGSTKFSLSQIQKATKNFSPNFKIGQGGSGTVYKGQLADGTLVAVKRAKKNVYDKHMGREFWNEIET

SEQ ID NO: 35222 - protein, 200 aa, Sorghum bicolor
  Clone ID: SORBI-28MAY03-C66438_1.pep
MAWPRSSLVLPFGLIALVFACVAQASIVEHTFNVGNLSISQLCQPPRIITAVNGQLPGPAIHASDGDTVVVHLVNQSPYNVTIHWHGIFQRGTPWADGPTMVTQCPVKPGGNYTYRFNVTEHEGTLWWHAHISYLRATVYGALVLRPRGGTEAYPFPTKPDREETVILGEWWNDNVYDLEQLAFLTGFTARNAHAYTING

SEQ ID NO: 35223 - protein, 150 aa, Sorghum bicolor
  unsure (1)..(150): unsure at all Xaa locations
  Clone ID: SORBI-28MAY03-C62000_1.pep
CIHTTTGNPKLVLYEYMAXGDLHRWVHELPVGSMDTEDICMDTMEAIEDRKPAGDWPTRNRIILGVARGLAFLHQGWTGAAAGSGRRRRPIVHGRLVPTNILLGDDMEPRISDFLHRPGGGGGGDETATPASDVYRFWTVVFEVVTGQAR

SEQ ID NO: 35224 - protein, 76 aa, Sorghum bicolor
  unsure (1)..(76): unsure at all Xaa locations
  Clone ID: SORBI-28MAY03-C62052_1.pep
EECTIHGPLFNQETLILRAKLEVTWKLAFGDAHSITAGAVTDAPCLLYLLHCVSSVSVVYSFXCYISLSPCCYCSG

SEQ ID NO: 35225 - protein, 145 aa, Sorghum bicolor
  unsure (1)..(145): unsure at all Xaa locations
  Clone ID: SORBI-28MAY03-C6210_1.pep
MGRAPCCDSTKGLKKGPWTPEEDKLLVDYIQANGHGSWRMLPKLAGLNRCGKSCRLRWTNYLRPDIKRGPFTPEEHNSILQLHAIVGNKWSMIAAQLPGPTDNEIKNYWNTHMKKQLRQEGAXAQLRNGAAAASSXCPAARHMAQ

SEQ ID NO: 35226 - protein, 108 aa, Sorghum bicolor
  Clone ID: SORBI-28MAY03-C6213_1.pep
MADGEDIQPLVCDNGTGMVKAGFAGDDAPRAVFPSIDGRPRHTGVMVGMGQKDAYDGDEVQTKRGILTLKYPIEHGIVNNWDDMEKIWHHTFYNELRVAPEEHPVLLT

SEQ ID NO: 35227 - protein, 111 aa, Sorghum bicolor
  Clone ID: SORBI-28MAY03-C62110_1.pep
IIFRRILVHMKIRPTTSKEPNSRLHGQHPDRMHSKATNRGKVPTPPRRPRTSGGEGTSPPEEGSSGQQVEQKRQSQKVGRSSNTSCRYRSAGGRTGKWRLRDPREGKSLDI

SEQ ID NO: 35228 - protein, 40 aa, Sorghum bicolor
  Clone ID: SORBI-28MAY03-C62141_1.pep
LTDWDRFARREYVRLAMEEDGEDASNASGDVWDESLESPF

SEQ ID NO: 35229 - protein, 62 aa, Sorghum bicolor
  Clone ID: SORBI-28MAY03-C62174_1.pep
GGARFGGRDFRRDRGSGGGYGGGSFGGGGGGGGYGGSSGYGGGYGGGGGSGYGGGQSMSSWD

SEQ ID NO: 35230 - protein, 122 aa, Sorghum bicolor
  Clone ID: SORBI-28MAY03-C61735_1.pep
MFFRFVTSGEIQRRSDFFEPFISGLTNSTVVQFCKASVEPMGEESDHVHIIALSDALGVPIRVMYLDRSSCDTGNLSVNHHDFIPSSNASEGDAAMTSTPDAENPYITLLYRPGHYDILYPK

SEQ ID NO: 35231 - protein, 103 aa, Sorghum bicolor
  Clone ID: SORBI-28MAY03-C61792_1.pep
REIGNAFSELTDPIDQRSRFENQIKQHNVKRAAMAKEVKSTEGDGEDDYSYEVSLDEDFLTSLEYGMPPASGMGLGIDRLVMLLTNSSSIRDVIAFPVLKIQQ

SEQ ID NO: 35232 - protein, 32 aa, Sorghum bicolor
  Clone ID: SORBI-28MAY03-C61852_1.pep
EARRGEADRVIPTLKPKHLFSGKRTLGKTSRR

SEQ ID NO: 35233 - protein, 70 aa, Sorghum bicolor
  Clone ID: SORBI-28MAY03-C61805_1.pep
ILEALVPQVIYGLLDHLHGRVPCSCACAKSIVVSSSAHDSCWMGIHCCCSISNMVCIHVAYDLAQRAESA

SEQ ID NO: 35234 - protein, 109 aa, Sorghum bicolor
  Clone ID: SORBI-28MAY03-C61853_1.pep
PTEQAKLTYCRNLSGGLHSAKDTNVSQKAILERIKSKSESESYQLGLKLSLKWSTGAGPRIGCVKDYPTELRIQALEMVDLLAGASTVPHTPLLAQAQECHDPASRLEA

SEQ ID NO: 35235 - protein, 67 aa, Sorghum bicolor
  Clone ID: SORBI-28MAY03-C62284_1.pep
SGSIPTKDPANCVQKSAIHRPTLKASHQQATGFLVSVITTLGYCVSRTVDNTNSFVAVKLIRGFDKV

SEQ ID NO: 35236 - protein, 128 aa, Sorghum bicolor
  Clone ID: SORBI-28MAY03-C62311_1.pep
LASDNMEEHTSVHFRVYKSQEKYMVLMCSDLRKSSLRPELYTPAYGGFFEFDLEKEKTISLRTLIDRSAVESFGGGGRVCIMARVYPVALIDDGGTRMYAFNNGTTTVKVPRLKAWSMRRAQVNVKKG

SEQ ID NO: 35237 - protein, 169 aa, Sorghum bicolor
  Clone ID: SORBI-28MAY03-C62337_1.pep
AYVKSVVDPTERLKQIAEMLAIHYYLLFNGSDGIWHHMKTFYMEQSTFSFSGKVYVGQNDIFDSLSNIRKKLKGDRPREKIVHVVEKLHCRANGEDGVAIRVSGSFIVGNQFLVCGDGIKAEGMPSLDELSIDIPSKRVGQFREQFIMLPGNLMSCYYISKQDLYIIQS

SEQ ID NO: 35238 - protein, 45 aa, Sorghum bicolor
  Clone ID: SORBI-28MAY03-C62447_1.pep
MVRDFDLNSNATIIFQLAKIKWNKGLNGTKPNHHKMYGNDTCKSL

SEQ ID NO: 35239 - protein, 194 aa, Sorghum bicolor
  Clone ID: SORBI-28MAY03-C6246_1.pep
ERRKKLKREQQDDGSRLHSQQIRNDYAPQPKRHSRFKEAPQGWLDCPAFGEPIDKIIPSKVPLDETFNESVPPGKRYSSKQLVNKQRKAGREIGLVIDLTNTTRYYSPAEWTRQGTKYAKIACKGRDAVPDNESVNKFVYEAMMFLDRQKQSKNPKYILVHCTHGHNRTGFMIIHYLMRTHVSCVAEAINIFAQ

SEQ ID NO: 35240 - protein, 120 aa, Sorghum bicolor
  unsure (1)..(120): unsure at all Xaa locations
  Clone ID: SORBI-28MAY03-C62388_1.pep
SGQHIVEVKPQAVSKGFVAEKILSTLMXKGRQADFVLCIGDDRSDEDMFEQIADSMRRSMVDPETSLYACTVGQKPSKAIYYLDDANEVLNMLEALADASEEAGSGSPEATDGPSTLEEA

SEQ ID NO: 35241 - protein, 106 aa, Sorghum bicolor
  Clone ID: SORBI-28MAY03-C61928_1.pep
REQFCHQMTQHARSLVPLKKIAKITPILRLPKGIISQRIKTPSLFKYVKEVCFTNGIKAENKQLIELYVNPINKQYQIEACSQNLPFPLLLREKITSETIGSILYP

SEQ ID NO: 35242 - protein, 76 aa, Sorghum bicolor
  Clone ID: SORBI-28MAY03-C61943_1.pep
LISYLQPWKYKAVKASGFFSRKTNHEDCPICLSTFRSRETMITLPCRHHYHAACVTKWLKVNKTCPVCKYELFGHS

SEQ ID NO: 35243 - protein, 72 aa, Sorghum bicolor
  Clone ID: SORBI-28MAY03-C61939_1.pep
FRYLEPEAKGLSSLASAVLPHAHCQSFLNGRAFFFTSFFERSGLCHLYDCTQCTLPKRGGFVSSVHSKCRIT

SEQ ID NO: 35244 - protein, 43 aa, Sorghum bicolor
  Clone ID: SORBI-28MAY03-C61972_1.pep
SAQDIKDLYAEEAAAQREKERQRMLSIPGLIAPNELQDEMVDS

SEQ ID NO: 35245 - protein, 111 aa, Sorghum bicolor
  Clone ID: SORBI-28MAY03-C62670_1.pep
PPNAHYFFLILTAVCRRRRPQRRARRGRGYLGFWGKCASYTCGLSVIRRLLFFLFLFFWAPVYSMSGNYLWAEWTCSATCNQLHFPMSPSTRNNSCAVCNREPLDGFLLFQ

SEQ ID NO: 35246 - protein, 169 aa, Sorghum bicolor
  unsure (1)..(169): unsure at all Xaa locations
  Clone ID: SORBI-28MAY03-C6269_1.pep
MMSSRERKKQAAALQEKLKILRSITHSHALSNTSIIMDASAYIKELKQKVVRLNQEIACAQDALRHKSSSYPTVTVETLGVQGSFLVNVFSDKSCPGLLVSVLEAFDELGLSVLQATASCADSFRLEAVGGENVADNVXEHVVKQAVLQAVRNAPRAAASRTRSKQGAG

SEQ ID NO: 35247 - protein, 168 aa, Sorghum bicolor
  Clone ID: SORBI-28MAY03-C62729_1.pep
PLFEKIKGLVSGANVSDHQIFGDPGKLQNAKLCELHPASWFCVAWYPVYRVPRGNFRAAFLTYHSLGKLVHQKCSLDTNDEHTRVVSPVVGLQSYNDKGEQWFQLRCPDLKQLPREDSSKTDPAEVHKERLRTLKMGALAMARAVVPKGIGESVNHHPDYEFFLSRCT

SEQ ID NO: 35248 - protein, 109 aa, Sorghum bicolor
  Clone ID: SORBI-28MAY03-C6276_1.pep
PTRFHVSYVWLQRLKEINTQYQEKLLALGARQANYRDEFLHKESLARQQQYQHASMSHYANNSAAGEQHGYHPTALPGEQHGYNATPAAAAGGATERLIEVMLLASMNL

SEQ ID NO: 35249 - protein, 134 aa, Sorghum bicolor
  Clone ID: SORBI-28MAY03-C62775_1.pep
ILPYNTHVTTELVGTLGYIPPEYGQAWVATLRGDIYSFGVVLLELLTGKRPVQVLTKSKELVQWVKEMRSQGKDIEVLDPALRGRGHDDQMLNVLEVACKCINHNPGLRPTIQEVVYCLETVVEPLQVQVQVQL

SEQ ID NO: 35250 - protein, 267 aa, Sorghum bicolor
  unsure (1)..(267): unsure at all Xaa locations
  Clone ID: SORBI-28MAY03-C628_1.pep
ASGVALAPAPAGPGRFKQGEAGTARGRVIRVADPVREGRMPVPPPPPLLAAPATPSESPPATGRRGDEDDEERQRYYLNMGYAIRTLREELPDVLYKEPSFDIYRDDIVFQDPLNTFXGGLENYKRLFWALRFTGRIFFKALWVDIVSIWQPAENMIMIRWIAHGIPRVPWDGHGRFDGASVYKLDKNGKIYEHKVHNVAMNPPTKFKVLPVHELIRSLGCPSTAKPTYFEASSQYLCAGPSYLRLAWIRCYISLCRMLSLANLGEG

SEQ ID NO: 35251 - protein, 141 aa, Sorghum bicolor
  Clone ID: SORBI-28MAY03-C62205_1.pep
LQYQQQTEGFEESYIYLENAISQMGSFDGILGFSQGAAMAALFCRQQQKICGSPKFRFGMFCSGYPAPVGDFGNEPIKLSSLHCFGNGDGHDRQIANRASAELAGLFEQDCCSVVEHDMGHIIPTRSPYIDRIKDFLSNFQ

SEQ ID NO: 35252 - protein, 112 aa, Sorghum bicolor
  Clone ID: SORBI-28MAY03-C62226_1.pep
LGSLMMMSMGKTDEEKAEGRKQSSDAVETLERALKECSKGKPFFGGDSVGYVDVVLGGFVAWVHLIDRLTGLNVFDSSKTPLLAAWLESFGSLDAAMAVMPDVQRLVELSAR

SEQ ID NO: 35253 - protein, 140 aa, Sorghum bicolor
  Clone ID: SORBI-28MAY03-C62237_1.pep
EDKLKTIVSMVPTKKNHAKYNLLRDQSLAKFPHRSQNRAAKENAPCYFISFSFCAVYFFSFILVKLIKHQPSHVICPFWLVTLVLCLARSLGAALRARRRRRRPACWHRGLARDEALEPAVARPSPPAAAGSSPRPARSA

SEQ ID NO: 35254 - protein, 226 aa, Sorghum bicolor
  Clone ID: SORBI-28MAY03-C6226_1.pep
TREEMKKIVLKVVKQCVSTEGVEADYIRNDILPDFFKHFWVRRMALDRRNYKQLVETTPRVRNKVGVADIVGRIVEDLKDESEPYRRMVMETIEKVVANLGASDIDARLEELLIDGILYAFQEQTSDDANVMLNGFGAVVNALGQRVKPYLPQICGTIKWRLNNKSAKVRQQAADLISRIAIVMKQCQEEQLMGHIWCVLYEHLGLLSFSPCIFLGHQSTYHLLSI

SEQ ID NO: 35255 - protein, 213 aa, Sorghum bicolor
  unsure (1)..(213): unsure at all Xaa locations
  Clone ID: SORBI-28MAY03-C6288_1.pep
PTGFIGELMKQSERCIDEGTHPRFLVDGFDVAKRACLDFLEKFKTSVVIGEEPDRDTLKMIARTTLRTKLYHAYADQLTDIVVNAVLCISKPDEPIDLFMVEIMHMRHKFDVDTRLVEGLVLDHGSRHPDMKRRAENCYILTCNVSLEYEKSEINAGFFYSNAEQRRXMVAAERRQVDERVKRIIELKNKVCAGGDKNFVVINQKGIDPPSSD

SEQ ID NO: 35256 - protein, 63 aa, Sorghum bicolor
  Clone ID: SORBI-28MAY03-C6290_1.pep
MLQEIGLHKMLCPSAVPFFFFYLTFISFVNLEDVKLIMSCKCKGKDSGEHKHLSACLDHLVET

SEQ ID NO: 35257 - protein, 211 aa, Sorghum bicolor
  unsure (1)..(211): unsure at all Xaa locations
  Clone ID: SORBI-28MAY03-C6298_1.pep
FNGSVPDWLDSFSNLTVLRLQSNQLKGSIPASVGKAAMLTELALAGNSISGDIPNLGSLNKLEMLDLRDNELDGELPEMPTSVVTILLSKNSLKGEIPEQFGQLNRLQHLDVSFNFLVGSPPAELFALPNISYLNLAANMLSGSLXSSLTCSSTLGLVDXSTNRLTGDLPSCLNGNLNNKVVKFDGNCFSGDPAHQHEAKYCQQSHKVKGS

SEQ ID NO: 35258 - protein, 71 aa, Sorghum bicolor
  Clone ID: SORBI-28MAY03-C62970_1.pep
KKVVKARKPYLHESRHQHAMRRARGNGGRFLNTKKSDNGTPNGRAEPKKGDGNSEHLHVPPDLLQLRQNGA

SEQ ID NO: 35259 - protein, 195 aa, Sorghum bicolor
  Clone ID: SORBI-28MAY03-C6304_1.pep
MVPDDEHALSPSETTTGPPSPSVEDYMAKFLSDSFSSKIGFDFTENDFTTRSISSDSKVDGNILAPSKISSVVNEGYRSTVGCGQAKKDADIQQENMPSCSSEHAMVTPKFGKDSVNLGTTDALELPTEGMTPKFGAIRGSEDSIGRRLRSGKVLPIGGPMKKQKKIQQQMVNQGATPAADLTSHENVGRILHLE

SEQ ID NO: 35260 - protein, 82 aa, Sorghum bicolor
  Clone ID: SORBI-28MAY03-C63040_1.pep
HGAKKPPKAVQTKHSNTFSYSITGIPHGRRIAASNQGTLMLPKDSINLATVTAASNPIAILLPFSTELAWINLEFANLAQQR

SEQ ID NO: 35261 - protein, 123 aa, Sorghum bicolor
  Clone ID: SORBI-28MAY03-C62583_1.pep
AAIGFANHGKFLMRTLGDMEKLLTGSVLCILALSFLCWIGGIPCSIAVPESSLCYLNCMFLSLLVSNMHIQWTFVSATCGLSELNCSETCIYMECSQWEVVWSSGCSFMARNCNHMVFLYAKR

SEQ ID NO: 35262 - protein, 98 aa, Sorghum bicolor
  Clone ID: SORBI-28MAY03-C62585_1.pep
EQLYNAGFENLFWVQGGLEAAEEEDFEREGSQPFKLAAIGGVSEFFGWTDQQRRQAAKEGLGYRLVFTGRLVGALVLLDALFLGAQRIGPLLQEMQPH

SEQ ID NO: 35263 - protein, 105 aa, Sorghum bicolor
  Clone ID: SORBI-28MAY03-C62589_1.pep
RQAIYSGTGQSHQFSSPNSKNKGQMLTKILLAVKDDTQNHCMITSATTEFCCHLVRSQSAMSTQKLIGHVYIQELSVVPAIQPARVRFTSVAGTNITEYLTLFCK

SEQ ID NO: 35264 - protein, 160 aa, Sorghum bicolor
  unsure (1)..(160): unsure at all Xaa locations
  Clone ID: SORBI-28MAY03-C6267_1.pep
LARDWKVSVKEAKDTLKLWYSDRKEVLAWQMKQKQLAHEKSEVYTLLGRSRRFPNMAHATSGQRGHIERAAINAPVQGSAADVAMCAMLEIDRNTRLKELGWTLLLQVHDEVILEXPSESAELAKSIVVEXMSKPFYGTNILKVDPAVDAKCAQNWYAAK

SEQ ID NO: 35265 - protein, 68 aa, Sorghum bicolor
  Clone ID: SORBI-28MAY03-C63127_1.pep
CAEKYAAESAKLACTAYEGVEQESPLEDDYFFAALPVVQKRIAQGGVRLAAILNKIFGGKSRLQIQSS

SEQ ID NO: 35266 - protein, 134 aa, Sorghum bicolor
  Clone ID: SORBI-28MAY03-C63138_1.pep
LTKILCSLGTSNSQPCCRQLPVPAQRSLCDELPWYIHIPYEDLKTAGSVDICHSLSNTNNRLLPAVVYSGVLTIQTLLMDIYFFLDRKFILLILRESALVGHPHEWSLFVSFSMVIFFLWLIWTLVIVPVPSGR

SEQ ID NO: 35267 - protein, 60 aa, Sorghum bicolor
  Clone ID: SORBI-28MAY03-C63181_1.pep
AKNKKIIFFCVQKSHESPNCHCSRNSRSPRSCKQELELQPVSGTMSNRNEESLPVTDKDK

SEQ ID NO: 35268 - protein, 166 aa, Sorghum bicolor
  Clone ID: SORBI-28MAY03-C63241_1.pep
RLHEEGVHPDYRIYLQCLFSALEPSSLAKAVYPVLVSYSSPDKQAFPRHTLSRAALIMSESPIFLLDTFTNLIVYYLSTADPSIPFPPPRDCLLRTTINRLKQDRCITPKLTFIHGGKDDSTLFESYLIEEQDVDGSGFTTGSGFVAFRESVRNVAGEIIQEEIGS

SEQ ID NO: 35269 - protein, 104 aa, Sorghum bicolor
  Clone ID: SORBI-28MAY03-C63289_1.pep
SLKLDDVTENQKEKLFSEHDNLLKQREHVRRLHQEAQRQHHQKFHKVWGQLMKTGYQNSRFAHQVERFACLYSSQVTNFGLYSPNKYYRPSEDYMPHEFDVLGL

SEQ ID NO: 35270 - protein, 165 aa, Sorghum bicolor
  Clone ID: SORBI-28MAY03-C6283_1.pep
PPPIPRLSGSLALTRRLFPRASAPLATPTRASLTRVDEKAPTDGVRRCPPGGSPARSPPPPPHPPRRAPPPPGRTPPPSSPGPRRTARWRPRPRRAAAARHQQRLPHRRPRGGRASRHRHHPRFTGGKTLPQFEGKHTRFIYNSDDEIEREGVADAAEATAELGA

SEQ ID NO: 35271 - protein, 55 aa, Sorghum bicolor
  Clone ID: SORBI-28MAY03-C62835_1.pep
RFSEMHWLDPAEGHTSWPHVVQCLLTLLTARLSSQEITCDLFVLNCKGGNVKDVA

SEQ ID NO: 35272 - protein, 154 aa, Sorghum bicolor
  Clone ID: SORBI-28MAY03-C6285_1.pep
LTASFLRFLLLLLLPLTALYFFYTLHLLLTSASSAASNCAPDAASVSRVSANLTAATASASTAAAEKQLPPSPLAVPSATTLQHVVFGIAASSRFWDKRKEYIKVWWRPRGAMRGYVWLDREVRESNMSRRARCSRHQISSDTVPSPYTQPSHR

SEQ ID NO: 35273 - protein, 137 aa, Sorghum bicolor
  Clone ID: SORBI-28MAY03-C62852_1.pep
SVPDGMEQVVMYYKERYNNTPIYITENGYAQGSNSSMSAKDFTNDTPRINYIRDYLTFLASAIRNGADVRGYFIWSLLDCFEWTSGYTLRLGLCHVDFNTLKRTPKLSANWFRKFLKGSLVGTRLRDKSSQLQHYTA

SEQ ID NO: 35274 - protein, 160 aa, Sorghum bicolor
  Clone ID: SORBI-28MAY03-C62857_1.pep
KTHKQDERQAATIVTHASKYPGRQLTPRCSSGCVAARCGWLPMQVSRFVSPAVGDVLPAPIAFIAVSAELTEGVPGRCRSACGGVLVPRVAPVLRVPQFFQSVRSRSLFVVRSRVRAGSRCSSLGWVSVEPLGPGMGFFFQSTILSFLLNLQELDIYART

SEQ ID NO: 35275 - protein, 68 aa, Sorghum bicolor
  Clone ID: SORBI-28MAY03-C63492_1.pep
LIRHMAPPCQRGRGVSLGSPPICRNPDAPLMPCYFVGISVRYIAERRLSTIPLIHSLNKRELLTPPVS

SEQ ID NO: 35276 - protein, 111 aa, Sorghum bicolor
  Clone ID: SORBI-28MAY03-C63547_1.pep
GYIKGDQETVNNGSMNLVDVRDVADALLLAYENPQASGRYLCCSPAIRVSDIVNTLKTSYPTHTYPQKFVEVEGSNTYITEKLRKLGWTSRPMEETLRDSVDCYRALGILN

SEQ ID NO: 35277 - protein, 155 aa, Sorghum bicolor
  Clone ID: SORBI-28MAY03-C6360_1.pep
PRRGGFCFACVALGGSRCGAACSRLTREGGSATLLLSCCCSGDRGIEGGRGRGGEARAWGLDGGGGKLPYSYAAHQDGGKLVKSFSRVEPRKFGLGLVAGFLLVTCAYFSTAKFDAIHIAMISPISSNAAGIGSLVGAAADTSNSNSKQQFDSGK

SEQ ID NO: 35278 - protein, 191 aa, Sorghum bicolor
  Clone ID: SORBI-28MAY03-C63666_1.pep
ARGMPHRPAVRARLGPLSLRDLDPPRSCQAPGGWLLRRLGRPLPSARRRRPVSPGSCSATYPAAPPVMPGARNLALPPPLAAPPGCPRAWLRLTPGPYQGALVLDSVCSLCLCSVLSAFFRSLLLPVGPYLPLSLVLCPRPVAPFLPLFRWFCPRRTSLSPPLLRCHCHHLPGVTSRGLGSRFPSVPVDNT

SEQ ID NO: 35279 - protein, 39 aa, Sorghum bicolor
  Clone ID: SORBI-28MAY03-C63679_1.pep
AMYVPETKGLSFEQVEQMWKERAWGNSGNCQRLLGAAAP

SEQ ID NO: 35280 - protein, 145 aa, Sorghum bicolor
  unsure (1)..(145): unsure at all Xaa locations
  Clone ID: SORBI-28MAY03-C63739_1.pep
HGSHQSSGATXLWEKNEPPVNPTRYNLSAFAITLNELTPELKEKLPPTDSRLRPDQRHLENGEYEKANAEKLRLETRQRMARKMQESGWKPRWFQRDREDGTYRYVGGYWEAREQRTWVGCNDIFGNLSSSQKLPPSALYTSSSI

SEQ ID NO: 35281 - protein, 127 aa, Sorghum bicolor
  Clone ID: SORBI-28MAY03-C63045_1.pep
IAPELYSRNFGTVSYKSDVYSFGMVVLEMMSGKRRSIYPETENQNDIYIPEWIYEKIVTGQELELVREMTQGEKDIMRKLAIVALWCIQWNPANRPSMTKVVNMLTDSLQSLKMPPKPFVSSFGQQA

SEQ ID NO: 35282 - protein, 225 aa, Sorghum bicolor
  unsure (1)..(225): unsure at all Xaa locations
  Clone ID: SORBI-28MAY03-C6307_1.pep
APEKSWESWWEKEQEPLRYSGKRGTIVEILLALRFFIYQYGLVYHLNITKKITKDNQSVLVYCFSWVVIFVILLVMKTVSVGRRRFSAELQLVFRLIKGLIFITFTAIVVILIAIPGMTVLDIFVCILAFMPTGWGLLLIAQAIRPVIQKIGLWGSIKALARGYEILMGLLLFTPIAFLAWFPFVSEFQTRMLFNQAFSRGLQISRIXGGHKKDRGTRNKESTGC

SEQ ID NO: 35283 - protein, 193 aa, Sorghum bicolor
  unsure (1)..(193): unsure at all Xaa locations
  Clone ID: SORBI-28MAY03-C6308_1.pep
PERAVEYLYSGIPVTAEVAVPIGGQGANTTDRAPTGEAGLSGIPNTAPLNLFPQGGSNAGGGAGGGPLDFLRNNQQFQAVREMVHTNPQILQPMLXELSKQNPQILRLIXENHDEFLQLLNEPFEGGEGDFLDQLEEDEMPHAISVTPEEQDAIGRLESMGFDRARVIEAFIACDRNEELAANYLLEHAGEED

SEQ ID NO: 35284 - protein, 90 aa, Sorghum bicolor
  Clone ID: SORBI-28MAY03-C63095_1.pep
ADFADGELKEEMFAIRFGSVENCKKFKELIEEIAESLTKNEGKEGEDGSSTAELLEKLTVSEDKSEGSGKSESTDSGKVNETKSDAAPAE

SEQ ID NO: 35285 - protein, 96 aa, Sorghum bicolor
  Clone ID: SORBI-28MAY03-C63102_1.pep
CFLAFLPTGWGILLIAQACKPLARHVGLWGSVRALARAYEIIMGVLLFTPITILAWFPFVSEFQTRMLFNQAFSRGLQISRILGGQKKERSARSKD

SEQ ID NO: 35286 - protein, 200 aa, Sorghum bicolor
  Clone ID: SORBI-28MAY03-C6388_1.pep
MGLLGMMGDSFGCSATGERLVSAARDGDIQEARALLELNPRLARYSTFGIRNSPLHYSAAKGHHEIVSLLIESGVNINLRNCRGQTALMQACLYGHWKVVQILVLFKANIHRRDCFSGATAIHFAALKGHTRCIRLLVADYVPSLSEFWTIMRAKSKDQMKKDAFDAVALQRLVNGKSDGGVTPLHLAALHGHAESVQLL

SEQ ID NO: 35287 - protein, 134 aa, Sorghum bicolor
  unsure (1)..(134): unsure at all Xaa locations
  Clone ID: SORBI-28MAY03-C63915_1.pep
FVAVATLVGPSAGEADARVPALGVHRGPSFPHGGPVVDAWPLVGRSAGGAGAVHPSRWVRFCPSFAPCSPVVTACLGVVLVLALATCVGVLRMLRSGSPLLIGLLLFPTGSLPVLVLCIVRCVDVFXLQIGGAR

SEQ ID NO: 35288 - protein, 133 aa, Sorghum bicolor
  Clone ID: SORBI-28MAY03-C63917_1.pep
CHPVWQQDKLRKLCQSKGVHLSAFSPLGSPGSPGINGSSVLENSIVVSVAEKLQKTPAQVALRWGIQMGHSVLPKSANESRIKENIDIFDWSIPEDLMAKFSEIKQVRLLRAEFAVHPQGGYNTLEDFWDGEI

SEQ ID NO: 35289 - protein, 108 aa, Sorghum bicolor
  Clone ID: SORBI-28MAY03-C63936_1.pep
PKLEFHEKTSCSTAADKPSSICESSYISSKIRAAVEILNSIIKTPALTVGDTTESIPSMALPVKAIVFSQWTGMLDLLQLSLNRNDIQFRRLDGRVRIWRGWFQRHCY

SEQ ID NO: 35290 - protein, 80 aa, Sorghum bicolor
  Clone ID: SORBI-28MAY03-C63940_1.pep
KHLSGTNQSVQILSFFPPQKGPNALNLFSHCSILQFDTVRFRQTAAVHKCLVPRLYTVFDFFWVFFLLLYWCSLGFLQIL

SEQ ID NO: 35291 - protein, 160 aa, Sorghum bicolor
  Clone ID: SORBI-28MAY03-C63950_1.pep
GMELRDKVTEYVKERILALRAANPGQYDNISVVRTNSMKYIPNYFRKAQLTKMFFLFPDPHFKEKNHRRRVISMQLLDEYAYVMEVGGIIYTITDVEELGEWMRSCLEKHPLFETVPEEEIKADPVFKLLSTATEESQKVARNGGQTFHAIFRRISLKEE

SEQ ID NO: 35292 - protein, 130 aa, Sorghum bicolor
  unsure (1)..(130): unsure at all Xaa locations
  Clone ID: SORBI-28MAY03-C6329_1.pep
MKLTVKTLKGTHFEIRVQPNDTIMAVKKNIEEIQGKDSYPWGQQLLIFNGKVLKDESTLDENKXNEDGFLVVMLSKGKTSGSSGTSSSQPSNTPAARQAPPLDAPQQAPQPPVAPTTTSQPEGLPAQAPL

SEQ ID NO: 35293 - protein, 199 aa, Sorghum bicolor
  Clone ID: SORBI-28MAY03-C6331_1.pep
ARGSPSAAAMSSADELFHNGQIRPVRLAAALLQPHPDPAVLLDFPHDAAADTDAVREEVEVEADERGRVRTRSVRRKARSMSPFRTHASAASHVPAAPTVPVPEHESADEARQTATPAASRSSSSSSTASSASSASSSSSRGSRRWGGFLKDLLHRSKSDGGKTTHHAQHSHHAAAPASPTRSPRRALVRLRHPRGEGD

SEQ ID NO: 35294 - protein, 162 aa, Sorghum bicolor
  Clone ID: SORBI-28MAY03-C63331_1.pep
GCRTLAEAKIHIEQKRKKEYELNAQKAKESSLIANNKSVQKMNRSMKIESDGNLDPKKGGAGLDSPKTTGLTSVKQWDDWDIVGLPGAELLSASEKLLCCQNRLLPSHYLRMQEVLMQEIFKGSVLKKEDAHVLFKVDPTKVDSVYDMVTKKLGNHEEAPTV

SEQ ID NO: 35295 - protein, 121 aa, Sorghum bicolor
  Clone ID: SORBI-28MAY03-C63361_1.pep
RMAGCGQVAHGGGVEITARGKDYPVREESVTAAVSALSFEKETVIGANLQSDFRVGRGSKISVSANLNSRNLGKLSVRTSTSDHAEIALIAVVSLIQFILRRRSAAADKGEQEIDDTYLDD

SEQ ID NO: 35296 - protein, 124 aa, Sorghum bicolor
  Clone ID: SORBI-28MAY03-C63409_1.pep
IDDAVGGLQVQKPNDDDGVWYDVPIVPNALLVNVGDVTEIMSNGLFRSPVHRAVTNAESDRVSLAMFYTLDSEKEIEPLPELVDDKRPRRYRKTTTKDYLALLFERFTRGERALDAVKIDLNDD

SEQ ID NO: 35297 - protein, 61 aa, Sorghum bicolor
  Clone ID: SORBI-28MAY03-C6410_1.pep
PVEKCLLALVLLQKVLVIVKVMIRQVALVMGLFVHQNFRSLTRDVAPIARKQYGHTTSATQ

SEQ ID NO: 35298 - protein, 116 aa, Sorghum bicolor
  Clone ID: SORBI-28MAY03-C64119_1.pep
MPMFGVPGQAIHPSASSIQPFPSLAGLPVRPNLAPQASAVMATMVQEQQQGATQQQQSLNNEAQQGANTGDPQLQTTVQAENQHFSVPYSAQTESNQFLDGGGNRTDTTGRNEAET

SEQ ID NO: 35299 - protein, 109 aa, Sorghum bicolor
  unsure (1)..(109): unsure at all Xaa locations
  Clone ID: SORBI-28MAY03-C64159_1.pep
RAKLDDGLLDQIFSKRKETIRINWAAYPHYQAPEEFAPIVLDGKQLYYVNTFESAASAIETGAVAAENVARLIIXRRSLPQRGVEPDAPHIKPFAEQEEEGSQRRHVDL

SEQ ID NO: 35300 - protein, 56 aa, Sorghum bicolor
  Clone ID: SORBI-28MAY03-C64160_1.pep
VPLEIGIRTGSDEGQPIVVSSPNSASAQAYVNIAEKVTQRLNELAEERRMGPEILL

SEQ ID NO: 35301 - protein, 82 aa, Sorghum bicolor
  Clone ID: SORBI-28MAY03-C64226_1.pep
MYMTNIVLSIQISEHISVLKSIALDFYNLLLPKTASHAKHSTTTACKHLPPAQDCYKTRCFQTTCTSNKRTLQQGHSSFFKM

SEQ ID NO: 35302 - protein, 80 aa, Sorghum bicolor
  Clone ID: SORBI-28MAY03-C64231_1.pep
LVPGTLPQSSFRPCSNVFDLFDFLCTKFLHPLGTECQHACCCPRYIARHTVSHNLKPQSSIICNLIYVVTLQQHSGFLTC

SEQ ID NO: 35303 - protein, 154 aa, Sorghum bicolor
  Clone ID: SORBI-28MAY03-C67613_1.pep
MAKEFPVPPVVFTPSTPTHRRHPAPGVGASPPPAFAPPRPSTSSAANPLPFMSFDVSAAAASSSSAPPLFTGPIGVGGSGASFEDEPPLLEELGINTRQIWRKTISILHPLRSADPSLHADADLSGPFLFLLSFGLFQLLAGKFHFGIVLGWVT

SEQ ID NO: 35304 - protein, 124 aa, Sorghum bicolor
  Clone ID: SORBI-28MAY03-C67646_1.pep
ACLLACTVSQSPRVTRRREEVWGSLPGLGGHTEMVEMRSIRATACFLLFSLLVSQRLGSCASINEQGRPFLRFGENLADEPTGSLSNQGVNCSHDGKAVALLPKGYKLSGELPSDLHKHTEMIS

SEQ ID NO: 35305 - protein, 170 aa, Sorghum bicolor
  Clone ID: SORBI-28MAY03-C67652_1.pep
MVSAGVHGGGGDGQEAVDFRGNPVDKSRTGGWLGAGLILGTELAERVCVMGISMNLVTYLVGELHLSNSKSANVVTNFMGTLNLLALVGGFLADAKLGRYLTIAISATVAATGVSLLTVDTTVPSMRPPACANARGPRAHQDCVPATGGQLALLYAALYTVAAGAGGLKA

SEQ ID NO: 35306 - protein, 95 aa, Sorghum bicolor
  Clone ID: SORBI-28MAY03-C67694_1.pep
ILLKKELTPATNMLRSSSSTSYAIKFSATTFSHRSKKQPCRQRLQKPTFHPCPVTLPSSKSPSSHPAPGKAKPPYGSHVQWDGSRSSSPSGKTPA

SEQ ID NO: 35307 - protein, 102 aa, Sorghum bicolor
  Clone ID: SORBI-28MAY03-C64406_1.pep
IALVDSMVAASWGCTYKMAASRPRSFLLGEAVRGKKIYRSQPRVVEPYPTWLVICYAAAKGQASTTMPNSCTSCVPHQHNLNEAATSLGCDVAAIFFPGDMI

SEQ ID NO: 35308 - protein, 64 aa, Sorghum bicolor
  Clone ID: SORBI-28MAY03-C64437_1.pep
YELFDKEGNRPIVIEELASELGLGPSVPLHVVLKDWIRHSDGNLSFLGFIKLLHGVSSRTIPKV

SEQ ID NO: 35309 - protein, 113 aa, Sorghum bicolor
  Clone ID: SORBI-28MAY03-C64485_1.pep
PNTALAHAATSVMGPWETLGNPCVGGNEVFRSTTFFSQSTFVLPVPGLPGSFIFMADRWNPSDLIDSRYVWLPLTIGGIPDEAADYSFMFPLWSRVSIYWHKRWRLPEEWRDS

SEQ ID NO: 35310 - protein, 153 aa, Sorghum bicolor
  Clone ID: SORBI-28MAY03-C64529_1.pep
QPNPEIRPTAVYVMHHPLFWSPELRLSFLRDTSDRIEKTSETDLINALESIGPVAFGGKWGEKLDAALVTDMGRYRKYNFESIRDLLRYIRNKSGHYRELSEDLKGILGSLPEGFDRYFASRFPKLLIEVYKVLWVHCKDEEAFSKYFNGSSL

SEQ ID NO: 35311 - protein, 114 aa, Sorghum bicolor
  Clone ID: SORBI-28MAY03-C64604_1.pep
QFLQSAMTEMVKIKSQLTSYHGEMGKLDSKFVEKTASSSRVGALLDEKDIAAAELEQELGRIRQESQKIAKEKEKIDAEVASLKTAVSRYEDLCNGAESKFKDVLAGLRLKRLT

SEQ ID NO: 35312 - protein, 214 aa, Sorghum bicolor
  Clone ID: SORBI-28MAY03-C64612_1.pep
GARGRARGASSSAPRTNKGSSRPPVPPRSKGKAWPAPVPRKGDKGASTSCPPPPVDGGETVAPPEFPFGLKNAAATYASSVSTSISAYADLPGHHLRSTLDLISTPPVLSYPEDPTSSDDEWVGADFSGCGDPGTFMRFLEASNYCLSYSDSDDGSYDPSRECFNLEVGGTPHNTQGGAGPSRQENATPPPNRTPGTNPGARGVASAPVGGHRP

SEQ ID NO: 35313 - protein, 146 aa, Sorghum bicolor
  unsure (1)..(146): unsure at all Xaa locations
  Clone ID: SORBI-28MAY03-C63973_1.pep
EMIKDPKASWTESKPKLEKDPQGRARNPDLGQGDAEKLFRDHVKDLYERRVRDFRALLSEVITPEVAARTTDEGKTAINSWSEAXGLLRSDLRYNKLASKDRESIWRRYADDLTRKLRQSDTKEKEKDKPDTDGKQLRSSDPPRRR

SEQ ID NO: 35314 - protein, 58 aa, Sorghum bicolor
  Clone ID: SORBI-28MAY03-C63979_1.pep
SKMQSEYDALVARLNSPSFVEKAPEDIVRGVREKASEADEKISLTKNRLAFLQSTIST

SEQ ID NO: 35315 - protein, 69 aa, Sorghum bicolor
  Clone ID: SORBI-28MAY03-C63988_1.pep
KRMRKQTLQVQACMQLLTSLDATANATRDDLPEEAMRNDQSLHAFHGLTIFRSSRPGCGFYPFLIFFLD

SEQ ID NO: 35316 - protein, 116 aa, Sorghum bicolor
  Clone ID: SORBI-28MAY03-C64050_1.pep
KNAESVSSKGGCSYLFDIASQIDMERVRTVGAIEYLIDATRSGNVSRYINHSCSPNLSTRLVLVESKDCQLAHIGLFANRDIAVGEELAYDYRQKLVAGDGCPCHCGATNCRGRVY

SEQ ID NO: 35317 - protein, 104 aa, Sorghum bicolor
  Clone ID: SORBI-28MAY03-C64790_1.pep
PDVARAIMETLVEIADQSPPKRPRYDKEDEELLEKANSQEVTEMTFRDCLTQHVEQVDYEMALDYAMQSGVSEEPREAIYLNSLEGSYKFVDLQSPVFVFRFVP

SEQ ID NO: 35318 - protein, 48 aa, Sorghum bicolor
  Clone ID: SORBI-28MAY03-C64793_1.pep
MKALIRVEQFDKVPVIYEEMITSGCAPDRKARAMLRSALRYMKHMRVA

SEQ ID NO: 35319 - protein, 126 aa, Sorghum bicolor
  Clone ID: SORBI-28MAY03-C64916_1.pep
RRIYVDLPDAQNRMKILKILLAKEKLESDFKFDELANATEGYSGSDLKNLCVAAAYRPVHELLEDEKKGCVSNGTSYLRPLKLDDFIQAKAKVSSSVSYDATSMNELRKWNEQYGEGGSRTKSPFG

SEQ ID NO: 35320 - protein, 79 aa, Sorghum bicolor
  Clone ID: SORBI-28MAY03-C64825_1.pep
MIGASDEQVDVFNEVWYTVLINAGETSKAIEILAKQIRKREGAPFLWRLLEKAYSLDGRSADASVASKKANALQAAYFH

SEQ ID NO: 35321 - protein, 135 aa, Sorghum bicolor
  Clone ID: SORBI-28MAY03-C64919_1.pep
DDKLFPAWYGMVKAQAEEERAEKVKETLAAIEKMEVAFAKCSGNGNAAFFGGDSMGYVDIVLGSFLFWFEAVRRVDGLEIIDASKSPLLAAWAERFGGSVEAKEVVPVPEADLAVQYINKFRAPAIDAAKLASSE

SEQ ID NO: 35322 - protein, 163 aa, Sorghum bicolor
  Clone ID: SORBI-28MAY03-C6496_1.pep
VGSRGVSPVPWYYHPSTTPPPPPPPAAHYAHGAHQQYHGVLPFYPAATTYGYSPNYVADLSYNAKLGQAAAGGTAGSYLQPQGHFAYPAAAQGGMHVAAPNGMMPVYPFYHYQYHHASQGLGVPAAHFFPPVSAAAVTTVPAIVSKPTVMAAPPKVEQVTGCS

SEQ ID NO: 35323 - protein, 43 aa, Sorghum bicolor
  Clone ID: SORBI-28MAY03-C64252_1.pep
VTLNTQGNQIIANGSFIGAGIFLALLVRSMQRVKKLDKFETMI

SEQ ID NO: 35324 - protein, 76 aa, Sorghum bicolor
  Clone ID: SORBI-28MAY03-C64278_1.pep
FTLWFTLTRVACKLHYEQIMRIPFLPIYCGVSELSTLVCAGKDLFLLCFLSLPLPGPGLCVDLARRHRWRNPHRSI

SEQ ID NO: 35325 - protein, 130 aa, Sorghum bicolor
  Clone ID: SORBI-28MAY03-C6433_1.pep
GYDIPKGANVVVNVWAVARDPAVWDDPLEFRPERFLRENIDIKGADFRVLPFGAGRRVCPGAQLGINLVASMIGHMVHHFRWTLPEGTRPEDVRMVESPGLVTFMDTPLQAVATPRLDKEELYRRVPSEI

SEQ ID NO: 35326 - protein, 146 aa, Sorghum bicolor
  Clone ID: SORBI-28MAY03-C64364_1.pep
VEPCDRELEEKVREAQELKAERLRKKQQVEELESIVRLKQAEAEMFQLKANEARQEAERLQSIALTKSKTAEQDYASMFLKRRLEEAEAEKQFLFEKIKLQENQRPAVGVGSSSGAGGDSAQTMMLSKIQDLLKNVRSKPAKSEGH

SEQ ID NO: 35327 - protein, 65 aa, Sorghum bicolor
  Clone ID: SORBI-28MAY03-C64398_1.pep
IAECGWTPHSFTPLMQKQMLYSNCSSHLQMHESMQQLLISPFPLIHVEKQPIPSWSSSLLSPITQ

SEQ ID NO: 35328 - protein, 63 aa, Sorghum bicolor
  Clone ID: SORBI-28MAY03-C65053_1.pep
SAEYINDDESETSIAGNEEGQLEQSPDLSGDEHFELDMLERLESSVPLGSLPIDGMIEQLNSE

SEQ ID NO: 35329 - protein, 140 aa, Sorghum bicolor
  Clone ID: SORBI-28MAY03-C65100_1.pep
WVLKLEMLERLVITSCDGLLKVVEEDSGDEAETKTEGQGGKWIGDGQSACNSGDNAHAEFLNLRSIELTDVKMLRSICKPRNFPSLETIRVEDCPNLRSIPLSSIYNFGKLKQVCCSVEWWEKLEWEDKEGKESKFFIPI

SEQ ID NO: 35330 - protein, 127 aa, Sorghum bicolor
  Clone ID: SORBI-28MAY03-C65134_1.pep
HYHALHVAEQIDLYQRRSGLFDSDLAIQEATGTPQDVWWEKHGSGTKELQSFAARILGQTCFGATRYNLDKSLTERLHTEKRSLADQERFRNMEYIHYNLRLVNAVPRLNGPKHGKVTAQLSDWVSA

SEQ ID NO: 35331 - protein, 113 aa, Sorghum bicolor
  Clone ID: SORBI-28MAY03-C65163_1.pep
PTVQPQILGKKKALVLERGFWFKTILPPVASSCDSWVSCSCSVVTAIPFRPWSVDSEQCVDEAATPQSLICSEHVKAVERLASLTSTLYTASFPFSWSVNLRASGETGLLTEE

SEQ ID NO: 35332 - protein, 185 aa, Sorghum bicolor
  Clone ID: SORBI-28MAY03-C6521_1.pep
EAKDFLLKCLQKEPELRSTAPDLLRHPFVTGKLDDLQPLNHAADKDSCNEIPADDMPNGLGLNHSSNWSTMNSNKSSKIKPLWEGSCDDDVMCEFADKDDYAAVGSSYNPMSEPFDDWENKFDISPEQNSHQPMEFGELAKHAESSITENDFTFPVEGSCEDDDVLTESKIKAFLEEKALDLKKL

SEQ ID NO: 35333 - protein, 132 aa, Sorghum bicolor
  Clone ID: SORBI-28MAY03-C65253_1.pep
RKEYEEKKEEVANEIIRRLEKKLFPGLQDSIVLKEVGSPKTHRRFLARNDGTYGPMPRGKPKGLLAMPFNTTSIDGLYCVGDSCFPGQGVIAVAFSGIMCAHRVAADIGLEQKSPVLDAGLLGLLRWFRTLA

SEQ ID NO: 35334 - protein, 145 aa, Sorghum bicolor
  unsure (1)..(145): unsure at all Xaa locations
  Clone ID: SORBI-28MAY03-C6467_1.pep
MASRTASKDIITLRGSAAIVSEFFGYAANSILYNRAVYPEESFTKVKKYGLTMLLTQDEGVKDFIANLTSQLSKWLEAGKLQRIVLVIMSKGTSEVLERWNFNIVTDAEVVEXGAIKEKSDXEIMREIQGIMRQITSCIXYLPCL

SEQ ID NO: 35335 - protein, 159 aa, Sorghum bicolor
  Clone ID: SORBI-28MAY03-C64690_1.pep
FGPFQIEAKVGEVAYKLSLPSSSQVHPVFHVSQLKHALPVKHQVADLQNTLDGLQFPEQVLQRRVSSKDSAVVLQGLIKWSGLPQSLATWEDLEPLKQRFPRAPAWGQAVSKGRGGVTTSPSKEAQGTGPVTMASPATEKRQSTRIRTPSTRTTGPQWA

SEQ ID NO: 35336 - protein, 145 aa, Sorghum bicolor
  Clone ID: SORBI-28MAY03-C64699_1.pep
TYGTWFGVKGLIAAGRTFENSPAIRKACDFLLSKELPSGGWGESYLSSQDQVYTNLKGNRPHAVNTSWAMLALIDAGQAERDPTPLHRAAKVLINLQSEDGEFPQQEIIGVFNKNCMISYSQYRNTFPIWALGEYRCRVLASGKQ

SEQ ID NO: 35337 - protein, 171 aa, Sorghum bicolor
  Clone ID: SORBI-28MAY03-C64748_1.pep
ERAVGKKLREKELEAEAMNRKSKELNEQIRQVAMEVQSWQSAAMYNQSVANSLKTRLMQVVAQSTNLTREGTGDSEEADNAAYSQNPNARAGAAHEGFFQSDLLGGGGGGRATTSTATIGLGACRWCGGKEASVLVMPCRHLCLCIDCERVSDVCPVCRFPKSGSVEINMS

SEQ ID NO: 35338 - protein, 80 aa, Sorghum bicolor
  Clone ID: SORBI-28MAY03-C65388_1.pep
LPIARQLVDSDGSKLSSVSLKNLRERYNIPLTGSAHRAMQDVTTLCYVLQKLTFELKLTVPQLLEKSFQASDLPATRAEK

SEQ ID NO: 35339 - protein, 106 aa, Sorghum bicolor
  Clone ID: SORBI-28MAY03-C65414_1.pep
EESEKPELTSPEDLGVQAASMLLEEVAQGGVVDSTHQGLLFILCALCPPDVSKVRVGQLTPYGIETLRNIRDFLDVKFIIKPDPNSNTVTLKCVGAGAKNLARKIS

SEQ ID NO: 35340 - protein, 123 aa, Sorghum bicolor
  Clone ID: SORBI-28MAY03-C65420_1.pep
AHPSGHSMPPVLLGTVTARCIRAAAQGAAFAAAVLAELPAGRFRHQLRSLLGCSGGVGLGGVRRGPADPTLAGLLGSAQLGAGAGLPRGGSSGGVVSGLFLQPVMLGLRGSPYPLCSPRKSYY

SEQ ID NO: 35341 - protein, 90 aa, Sorghum bicolor
  Clone ID: SORBI-28MAY03-C65532_1.pep
LAATRCLQVRVETCVEKGDPRDVICGAAEKAGADLLVMGSHGYGFLQRALLGSVSDHCVQNCKCPVVVVKRPDSKQQQPARGGDASLGSP

SEQ ID NO: 35342 - protein, 179 aa, Sorghum bicolor
  Clone ID: SORBI-28MAY03-C65560_1.pep
FATGGRGNRYSGGTSSYYEGRRGRRSYQSRVSNDFVDAASTAVGADDNTSSSSSGDGWGGSKSSGGYGGWDEILDNNTAAAQEAKRSSNSFSAGNNGYGTKSRPPTTGEEDADYTAAAGGGGRVDQGVGPPPERMRMRRRRIPRTMGLGSSRYKQAPLLMRLLVAVFPFMGSWFRLYHW

SEQ ID NO: 35343 - protein, 100 aa, Sorghum bicolor
  Clone ID: SORBI-28MAY03-C65580_1.pep
RLQSLQRILQGSVAVQVNSGVLSVCTAFLSGEPATRLRSQELQQLIAALLEFMAVCKRAIRVHFRLIGEEDQEFHTQLVNGFQSLTAELSHYIPAILSEL

SEQ ID NO: 35344 - protein, 88 aa, Sorghum bicolor
  Clone ID: SORBI-28MAY03-C65830_1.pep
VRITPCLHMENATVHLNSAIRLTDLKMVLLPIFIMASNCLQSWPQFFCIVADVEIPYSYIPLIFREKKKSEEDCLTRFPFQFPLEQPG

SEQ ID NO: 35345 - protein, 242 aa, Sorghum bicolor
  Clone ID: SORBI-28MAY03-C6499_1.pep
TRVSGYQIRRRLLLTGTPIQNSLQELWSLLNFILPNIFNSSQNFEEWFNAPFACDVSLNDEEQLLIIHRLHQVLRPFLLRRKKDEVEKYLPVKTQVILKCDMSAWQKAYYEQVTSREKVALGSGLRSKALQNLSMQLRKCCNHPYLFVEHYNMYQREEIVRASGKFELLDRLLPKLQRAGHRVLLFSQMTKLLDVLEVYLQMYNFKYMRLDGSTKTEETRGLLADFNKKDSEYFMFLLSTRA

SEQ ID NO: 35346 - protein, 52 aa, Sorghum bicolor
  Clone ID: SORBI-28MAY03-C65002_1.pep
ASSGNSYSIPSTFVPMNQSQNVTVVVENPMPVDAKGKLVSNVVVGVTSGGKK

SEQ ID NO: 35347 - protein, 92 aa, Sorghum bicolor
  Clone ID: SORBI-28MAY03-C64998_1.pep
KANQVGTVTEAIEVVKQAKDAHWGVVVSHRSGDTEDSFIADLAVGAAAGQIKAGAPCRGECLTKYNQLLRIEEELGSEGVYAGENWRTVSTS

SEQ ID NO: 35348 - protein, 105 aa, Sorghum bicolor
  Clone ID: SORBI-28MAY03-C65027_1.pep
VGQRQLVCLGRVILKRSKILVLDEATASVDTATDNLIQKTLRQQFSEATVITIAHRITSVLDSDMVLLLDNGVAVERDTPAKLLEDKSSLFSKLVAEYTMRSTHT

SEQ ID NO: 35349 - protein, 219 aa, Sorghum bicolor
  Clone ID: SORBI-28MAY03-C6504_1.pep
VIREQNFMAANEIIELFCELIVTRLPIIAKQKECPADLKEGICSLIFAAPRCSELPELGRMRDIFEKKYGKDFVSAAVDLRPDAAVNNLLIEKLSVKKPSGQIKLKVLKDIAKEHQIDWDTTESEQELLKPPEELIKGPSTFVEASNMPVKTILTPHVLQPNPVNFSYRYSDDEYDDRGTMQFKDAASAARAAAVSAERAASAAKAAADFAIRTTIHLM

SEQ ID NO: 35350 - protein, 73 aa, Sorghum bicolor
  Clone ID: SORBI-28MAY03-C65617_1.pep
IHEVERKLCVVGLWCIQMKSHDRPTMSEVIGMLEAGVDGLQMPPEPFFCGDEQNSVTGTFRLSSELSAISENE

SEQ ID NO: 35351 - protein, 87 aa, Sorghum bicolor
  Clone ID: SORBI-28MAY03-C6563_1.pep
ATIHGAVLALTASVLSVPYDMPSWLPSHVTLLARFIREPSPIRSTVTKAVAEFKRTHADTWSIQKDAFTEDELEVLRDTSSSSSYFA

SEQ ID NO: 35352 - protein, 107 aa, Sorghum bicolor
  Clone ID: SORBI-28MAY03-C65730_1.pep
EGEVIHGLLEKLGLGEACAVANALMGANDAVHDEALCGHSSKLAVTFGVLHLPEGRPIRVTKNSKVCSHCHEAAKFISKMCNREIILRDSSRFHHFEGGRCSCRGHF

SEQ ID NO: 35353 - protein, 112 aa, Sorghum bicolor
  Clone ID: SORBI-28MAY03-C65716_1.pep
DIHLLHRLFSVRLNCGSLMKFFKQLQSIFLRKFLLKSMMYMQDTLTHAHRKALGSCSFDDSLIAISVWLGWSSNFVRAELAIYFFFSRIQLAIDLSYSFFKLCQSCQEVSRT

SEQ ID NO: 35354 - protein, 317 aa, Sorghum bicolor
  Clone ID: SORBI-28MAY03-C6576_1.pep
HEGNLEACTVLVQVGKKDDLMVKDKTGLTPAQLAADKNHRQVAFFLDNARRVHDRGCGANTRFGKLSKLGLAPLLWCTIIGMLIIYMHSVISGQYATTMTAPFGMFAWSGVFLATAGLVMFYKCSRKDPGYININTRGSQNQRDDEPLLKMELENPALLSGNWSQLCITCKIVRPVRSKHCSTCDRCVEQFDHHCPWVSNCIGKKNKWEFFMFLTLEVFAMIITGSAAIIRIVRDPDSPSSFGAWIHYSAFQHPGVVSFLALDCFLFFGVAVLTVVQASQIARNITTHEMANSMRYAYLRSPGGRFRNPYDHGIRKN

SEQ ID NO: 35355 - protein, 102 aa, Sorghum bicolor
  Clone ID: SORBI-28MAY03-C65807_1.pep
RYPFCNNWMGTAACCFMDFELKAHQRFKEVLNGLADARWSVIESDGVDDAKHQHMEFISQYLTSNIWVGSLILLMESAPKKTDGNWNESIEKTLAKKAIRFG

SEQ ID NO: 35356 - protein, 221 aa, Sorghum bicolor
  Clone ID: SORBI-28MAY03-C6535_1.pep
TRPAVFPLYRPSPATEAATPASPWTLSLPATPLPTTTPTRHRLLLLLPVPPPPPSPPVAAQADYSPRSRSPSPRRPRSSPPSRRPNPPPRRSSPLCRRPNPPLHPPPPLPSLPSRRPSLPEETLSASSSTARSRSGSPQATAPTTTRTKPRSAAPATTRRACRLCLLARGPCPRSSRRRSTRSGSAPVLVPEPGGRQSIRLRRRSQISAPPYLQARLPTQE

SEQ ID NO: 35357 - protein, 215 aa, Sorghum bicolor
  Clone ID: SORBI-28MAY03-C6533_1.pep
APASNSASHLWPEDMACLACLDAQAPRSVVYVAFGSFTVFDTARLQELADGLALTGRPFLWVVRPNFANGVDEGWLDQFRRRVGDKGLVVGWAPQQRVLSHPSVACFISHCGWNSTMEGVRHGVPFLCWPYFADQFMNQNYICDAWGTGLRIDADERGIFTKEEIRDKVDQLLGDDGIRTRALSLKRAACESITDGGSSHQDLLKLVNLLREQYL

SEQ ID NO: 35358 - protein, 156 aa, Sorghum bicolor
  Clone ID: SORBI-28MAY03-C65353_1.pep
VPNDVYCRDAVALGLWSGKWRMIGDMWEEGERRRLGPIASVSADDGRITEVFMLDDNNVFRYDFTSNRWLKEATTRRKIPNTEPCGFIPMNGELYVLRSAKVRVEASGPWRQLKKKLAMEFQVYNPVTKKWRVLTTYPPVGAPIDFRTAALCTVEL

SEQ ID NO: 35359 - protein, 114 aa, Sorghum bicolor
  Clone ID: SORBI-28MAY03-C65355_1.pep
LIKSSGAVGLIAANSINGLRRRTYAASGLSGAFVGPCPCWRSGPAGWRTSPIAGPTAVFSERVFLNRKRFKQTVPIHIAVGIMCLSIASFEIYRGEKQFLRQIIRTLKHRDKAQ

SEQ ID NO: 35360 - protein, 44 aa, Sorghum bicolor
  Clone ID: SORBI-28MAY03-C65994_1.pep
QKPGQQGSLQQAAQKQTCFGGNPLPPPCPEGKSNPKHQTPWVVT

SEQ ID NO: 35361 - protein, 115 aa, Sorghum bicolor
  Clone ID: SORBI-28MAY03-C66037_1.pep
EAKRFLKSQREALLKCLEIAARRYRIPWTQTAIDIFAKHAYDNVTRFTRQQRDAIVKLWNSIKEQQIRRKQGKSVSGKLDVNAFEYLQEKYSHEKISIRHSVGGGGERRATAWLG

SEQ ID NO: 35362 - protein, 173 aa, Sorghum bicolor
  Clone ID: SORBI-28MAY03-C66153_1.pep
RATARLLELDDDDGIIGQFGDRGSINARFNYYPACPRPDLVLGVSPHNDACVLTLLLADEHVGGLQFHRDGTWYCVPPVHGRPLLVNVGGSLEIMSNGAFKSPVHRVVTNSQKERVSLAMFYATDLEKQVQPIAELVDEKHPARYKKIKYRDLMAAHYEYFSRRGRVIESLKV

SEQ ID NO: 35363 - protein, 157 aa, Sorghum bicolor
  Clone ID: SORBI-28MAY03-C6622_1.pep
MHSMSSSSMAPCTMIMASVAAVLVVLSSAAAAGLDMDFYSSTCPRVEAIVKEEMTEILKVSPTLAGPLLRLHFHDCFVRGCDGSVLLDSTPSSTSEKDATPNLTLRGFGSVQRVKDKLEQACPGTVSCADVLALMARDAVVLANGPSWPVALGRRDG

SEQ ID NO: 35364 - protein, 198 aa, Sorghum bicolor
  unsure (1)..(198): unsure at all Xaa locations
  Clone ID: SORBI-28MAY03-C6634_1.pep
QNHDGSTEWKETWWEKSDWTGYKELGAEKSGKNAEGDSWWEKWKEVLYQDEWSNLARIERSAEKQAKSGVENAGWYEKWWEKYDAKGWTEKGAHKYGRLNEQSWWERWGEHYDGRGFVLKWTDKWAETDLGTKWGDKWEEKFFAGIGSRQGETWHVSPXGERWSRTXXEEHFGNGKXHKYGKRRLARVRFGVDEGHTM

SEQ ID NO: 35365 - protein, 218 aa, Sorghum bicolor
  unsure (1)..(218): unsure at all Xaa locations
  Clone ID: SORBI-28MAY03-C66381_1.pep
SSAMNAACSSSVPESSPSRKGSGSTSTWWPAPLWAIPVELSPSTFTSALGDASGVESSXXSSSSSSPSSSSSSSPXASWLVASSPFVSTFAPLTIPSSSSAAATGGARSPPALGSAXSGEPAPPSPSSLSGSASGVVSPPCAAAPSDMATASFSGVCHASSPLASSASGRSCGSSPSRSGPAARPRGSLIAGGVGRERTGGCYFRGRFAPRSFFFFFF

SEQ ID NO: 35366 - protein, 183 aa, Sorghum bicolor
  Clone ID: SORBI-28MAY03-C65582_1.pep
LLIMNTLIMNKNIYGSLHFTEPGHQFQQRVDNPRSQTKQSPTGTTATKCQSSVHQQKMSFNGILLRLTKVKQPWWPGTINELSQLHNKIILTTEGMRDSPSNTLPAKMLNPIYRYCHPRFSSLQNGLPMRQCLSLLPRFLAPEILSHCCNLFLALDYSFTWDSSSHTLPSLGRIHGKSLQSLD

SEQ ID NO: 35367 - protein, 78 aa, Sorghum bicolor
  Clone ID: SORBI-28MAY03-C65596_1.pep
MYFNTKIELKTQSRKIHTKMNDFRCICTTRQNSSSAGAPETFNFCMNFYKISLHLTFCVEVRLKIHYEYASFQFFENS

SEQ ID NO: 35368 - protein, 46 aa, Sorghum bicolor
  Clone ID: SORBI-28MAY03-C65608_1.pep
QFTFSQDVVSGETVRKLPKCSHTFHQPCVDRWFIDHGSCPVCRQDV

SEQ ID NO: 35369 - protein, 166 aa, Sorghum bicolor
  Clone ID: SORBI-28MAY03-C65611_1.pep
LLYSFRYYIHNTEMALKLPLKNGSHLLKSQEPSPSPQPSLLLIPFYGLIIYAINSPFHFMDMESPEILNPNDRHTPCTPRMQHDEPPTRLGSLHHVPTWLQNLGSYKNEYQTFRFDATRSFVRSLCIPKKSYQISHANRSPVTYQKWSRNTVNLFLPLQHQPLVHL

SEQ ID NO: 35370 - protein, 89 aa, Sorghum bicolor
  Clone ID: SORBI-28MAY03-C66453_1.pep
LEKLLKVKAVRKVVKMPRNGDVPYTHANVSLAQRELGYRPSTDLQTGLKKFVRWYLEYYHPELAEKQKLRTSSNGKGSRGRNGSSSSAR

SEQ ID NO: 35371 - protein, 215 aa, Sorghum bicolor
  unsure (1)..(215): unsure at all Xaa locations
  Clone ID: SORBI-28MAY03-C66556_1.pep
PHSKKRQQQKRPRPQPPPPTPSPPIPPRREPPPAQPPPRAPSPPRRPRSPPRPPPRPPPPAPPPSPPSSSPPPPPPRPPPPTPPPPPPSPPPPPPPPAAPPPASSPSAPPPPPRPPRAPPPSPRAPPPPXPPPPPPPRPPPPXRRARPPPPXPPAPPRPPRPPPPRPAPPPRPPRRRASPPRGRRARPRQLQRLLRHGPQARPRRAPRPLRGLRR

SEQ ID NO: 35372 - protein, 167 aa, Sorghum bicolor
  Clone ID: SORBI-28MAY03-C66557_1.pep
VPLPSLSLSSRRTRRWRRSMVKRRLGRHYRACSLDLVSRGSPLFSRLLHVVPLGPCASMAIRRHGRERTTASTLPAGRRSPSSPPAARLPDRQLLVRSPPRAGGWGPALHSGSPIRWVVGRLTPSPTGRSLPAEQLHVQVRTWMIGSALPCPAAVLAELHINCLYIS

SEQ ID NO: 35373 - protein, 128 aa, Sorghum bicolor
  Clone ID: SORBI-28MAY03-C66559_1.pep
MKTRIVYSRDFLLSFGELEHCKKLPTGFDTALLSGLQELSAGVLERNKGYYNTSQGRPDGSGGGYTITYSSRGGNTGGRWDTRSSGSSDRDGEVPDRESQTQGRGGNQYRRNWQNTEHDGLLGSGGFP

SEQ ID NO: 35374 - protein, 190 aa, Sorghum bicolor
  Clone ID: SORBI-28MAY03-C66562_1.pep
MEDPQAQCGAHENPPPRRRGRLPWLPPEPRATAACLHVQPASDGTGATSEERHPEELGHPRAPPVDGPKAWPGDRPAATLPQKGREKPPQGEVQPGGPAEGRRAGAKPVPTRGDRGAAPSGATRKPGSPRDAGGGARVGPSERAGRGAGGGGAGWAGGGGGRERAGTEREFGGGGGGGRGGDRSVRARPV

SEQ ID NO: 35375 - protein, 132 aa, Sorghum bicolor
  Clone ID: SORBI-28MAY03-C65857_1.pep
VGDKEGTIFGGLVEAPLQPSSSKKYQGTNNSCVFTNLHNRPVIYRPTGANNYFTVCSTDYMALGGGGHFALYLDSDLLTGSSSNSETFNNGCLSHSSDFSVKDVELWGFVYPSKYEEMLTICRTEKPGICRW

SEQ ID NO: 35376 - protein, 63 aa, Sorghum bicolor
  Clone ID: SORBI-28MAY03-C65864_1.pep
ENAAAALLQLCTNSNRFCSIVLQEGAVPPLVALSQSGTPRAREKAQALLSYFRSQRHGNSARR

SEQ ID NO: 35377 - protein, 54 aa, Sorghum bicolor
  Clone ID: LIB3476-022-P1-K1-C1.pep
LNVRLLKALLQSLLTEKWPLSIVCHSVYCNISMLVHVFLWCLLCQQSIPEHYTI

SEQ ID NO: 35378 - protein, 92 aa, Sorghum bicolor
  Clone ID: LIB3476-022-P1-K1-B1.pep
DHTSSAYSTTHCTRLRSIDPAITLVESTRLELSARPLSINGGQSGVPACVTSPRARSARSDLNERTVARCDPKCAYRKMASVHCVSLSLLQY

SEQ ID NO: 35379 - protein, 140 aa, Sorghum bicolor
  Clone ID: SORBI-28MAY03-C65967_1.pep
CSVRQYPVACQTPTVLPIRMDTSFLCFINATFIKERIIEWVREEVENPNGKARERIQAVVLDMSSVVNIDTSGLTALEEIHKELVSLGIQMAIASPGWKAVQKMKVSRVVDRVGEDWIFMTVGEAVEACLAAHKGTALEC

SEQ ID NO: 35380 - protein, 66 aa, Sorghum bicolor
  Clone ID: SORBI-28MAY03-C66632_1.pep
CTPMSDYILLNNFMLDHTERDLLLSRAIINRSRHELFSRTGTYTCRDVLLYHHITCHRRVILGLIP

SEQ ID NO: 35381 - protein, 173 aa, Sorghum bicolor
  Clone ID: SORBI-28MAY03-C66638_1.pep
ADPLAAERPLFEIVSAAQAIIPESEDVITMHLTRGGYGGNISTRQVPVLIGDNIERCLTDAFAPLGGVIGAEWNDLFWDVHPGSSAILDQVDAVLKLKPEKLAASRRVLSEYGNMFGVTVIFVLDELRRRMEKGEEEGAPEWGVMVAFGPGLTVETMVLHRSGPPAEKKLAEA

SEQ ID NO: 35382 - protein, 86 aa, Sorghum bicolor
  Clone ID: LIB3476-023-P1-K1-B10.pep
LNRCSELVVVKENCKRQGHSEVLLATTMERCQQRKIQRLSIHVDLMRMTMVALYRMAGFQIDSTIEGYYAPHKDACRMYFDQGSTP

SEQ ID NO: 35383 - protein, 69 aa, Sorghum bicolor
  Clone ID: LIB3480-006-P1-K1-H11.pep
GRRATPALPSPSLLGHSEVLLATTMERCQQRKIQRLSIHVDLMRMTMVALYRMAGFQIDSTIEGYYAPH

SEQ ID NO: 35384 - protein, 98 aa, Sorghum bicolor
  unsure (1)..(98): unsure at all Xaa locations
  Clone ID: SORBI-28MAY03-C6664_1.pep
CHPNQKAAAVAAVEPVAVEDLFTSLHRHIEANAFEQAXQVLKTAPGDEDVVRCKAVXCINADGIGKFLVKIRAKERRPIDLGYYVQGHSFLMVKKLQG

SEQ ID NO: 35385 - protein, 143 aa, Sorghum bicolor
  Clone ID: SORBI-28MAY03-C66640_1.pep
TGLGPKGLLPCAPAGVSHGEFYDECAPPRYHVVVRDYGHLDMLDDDGVPYVISNCMCKRNTNTTKDLARRAIGGAMVAFLRAKLEDDDEDLRAVLQNSPGLSPAVLDPVEYDDDEAMDGPGCAGNNGVAGAAGEPPSPSPLPA

SEQ ID NO: 35386 - protein, 97 aa, Sorghum bicolor
  Clone ID: SORBI-28MAY03-C66647_1.pep
RGALRAEKPELLTVILPQSLKKQPPESQELLSKVQNLIEKPQYDHLPLIEASRLCNMDIISKVQQVICFAFHDSKLLMETCQEAKNLRKIVTLFYLD

SEQ ID NO: 35387 - protein, 140 aa, Sorghum bicolor
  Clone ID: SORBI-28MAY03-C68986_1.pep
PPSAISTCGIGYGAQAGGEIADFIIVLRNTDAIRTFSGKAHLSVGAGVSASAGHVGRAAEADFRAGDGGYAACYTSSCSKGAFVGCALNGSIVSTRDTENARFYGGPVKASDILLGSMARPPAASPLYKALSELFGKIGR

SEQ ID NO: 35388 - protein, 75 aa, Sorghum bicolor
  Clone ID: SORBI-28MAY03-C68989_1.pep
RIMENSKFLRMRLFTEKGRTRNKYLRYGLRLFMMGCVFLIAYLTKSFHLFLGINRVLRYHYTRVWIAYLAVYGSV

SEQ ID NO: 35389 - protein, 107 aa, Sorghum bicolor
  Clone ID: SORBI-28MAY03-C69033_1.pep
SSGYEGNSNRGYPGKSLEGSAVKDPDPLDMSEEAKAERWFRRAAQIKDICELANIPDEDFPEIIPMRKGVNRFVVSKRKPPLERRLTSPQYRRNLPIVSSEMDKDAS

SEQ ID NO: 35390 - protein, 137 aa, Sorghum bicolor
  Clone ID: SORBI-28MAY03-C68995_1.pep
LLNVTSGPASIVQAAVPKILSVEHPEFHRNVVDLLESAADALYRRVNQIEALKCYSKPEGSMFIMVEINTSTLHGVADDMDFARELIKEECVLVLPGSIIGLKNWVRIFFGAPVNLILEACDRIELFCRRRMLKQNN

SEQ ID NO: 35391 - protein, 156 aa, Sorghum bicolor
  unsure (1)..(156): unsure at all Xaa locations
  Clone ID: SORBI-28MAY03-C66737_1.pep
MGRYGPFPAAAGDGGGCLPLPIVAAEGALAVLDVAIATAAFVQLARIHRHNQLQGWTRQKIFHLMIGLSDVVFLVYFVSTIIATCQRWICWVHGCGFVLMASPQILLLASFLLLLSFWVDLCHQTNDEDXQHGRNQSHHEALLDRTKVKPGIRPVN

SEQ ID NO: 35392 - protein, 134 aa, Sorghum bicolor
  Clone ID: SORBI-28MAY03-C66740_1.pep
LKLGFILSCTKRKRREGTDIPGRYCGCSSRPTKTSAARRRAHLGHYKKVELGAAIALMRLCLEQQIWTPGREDGRRRDGEERQEAATGGEDAGGGGGGMWGRSREGRRPDAEACGGGASRDGGAVCDETERGRL

SEQ ID NO: 35393 - protein, 207 aa, Sorghum bicolor
  unsure (1)..(207): unsure at all Xaa locations
  Clone ID: SORBI-28MAY03-C66742_1.pep
HHSIGDGCCGAGSNSKYQQVPATMGSSAAPANVREICRAQRADGPAAVLAIGTANPANCVPQDEFPDFYFRATKSDHLTGLKEKFKRVCKHAWDLTNQLIRFYYLPSRAGTYLDXHICTYYIRFTVDACMHDVANEHDVMIVISVSACTPVPGPGQKLGVQKRYLHHTEELLSAHPEFLDHSSPSLDARLDIVKTAVPELAAQASRK

SEQ ID NO: 35394 - protein, 154 aa, Sorghum bicolor
  Clone ID: SORBI-28MAY03-C66744_1.pep
MASAPPVAISTTAVFKRGRHPVDTKHVDHSQVPGVPKPLMVVTPTDAGVYPVAVCFLHGCSMYNSCYQTLLSHVASHGFIAVAPQLGGILPPLDMEDLKDIDATRKVTAWLADNLAHVLTNILHLHAVTPDLSRLALAGHSRGGDTAFAVALGL

SEQ ID NO: 35395 - protein, 135 aa, Sorghum bicolor
  Clone ID: SORBI-28MAY03-C66752_1.pep
MTMAGSCAAPPVAGLPSLRTPPPTHLRLGGFLPCSSAARSRGGAVLGCALGAKKQTPGVLNRLLCGYMRRDGHEGDVSSQGRDDTVMFGPDDDGVKIPTQVETLVKGTAMVAEPEYKAIPDLDYLQELLAIQQQG

SEQ ID NO: 35396 - protein, 203 aa, Sorghum bicolor
  Clone ID: SORBI-28MAY03-C6677_1.pep
WHRLPAHTHAEAEAPEAPAMLRNRSRSRAVGAGAGANQGGPGGGLMAELPAATAAQSPRHPSSASSAAAAPVFPSPRPFVAMALPPQAGLLLDGSFEGPSSAVSPTSILETKQFCCSALPPFLSERSLRRAHTDAAVAPEPAGVGLADVLRDHGDAKVAGGKVVFGSLLRIQVPSGRAVELVSSPIEFGAKNRDAQLAVLSPA

SEQ ID NO: 35397 - protein, 242 aa, Sorghum bicolor
  Clone ID: SORBI-28MAY03-C66580_1.pep
YMLYKDTCNRKSNQQNLGTIKSSNLCTEIIEFTSPNETAVCNLASSAWPRFVREKGVPLESHPSKLVGSSDSKNRYFDFEKLAEVTSTVTYNLNKIIDINYYPVETAKRSNMRHRPIGIGVQGLADTFILLGMPFDSPEAQQLNKDIFETIYYHSLKASAELAAKEGPYETYEGSPVSKGILQPDMWDVVPSNRWNWPSLRETISKVGIRNSLLVAPMPTASTSQILGNNECFEPYTSNIYS

SEQ ID NO: 35398 - protein, 211 aa, Sorghum bicolor
  unsure (1)..(211): unsure at all Xaa locations
  Clone ID: SORBI-28MAY03-C66582_1.pep
FLPLFGYRVWLACLNGKCQKCDLGERKTSPASLDLGGEWLEAALQNARGDEGVAKGLGARLASRAGGRPARCSGEGRRGRPGRRGAPQESERSSPAETPRSSGIAQGRRGKGARGPPGKWGPPQGREVTGCRAQAFPRPTRTGAGRRTTDAGRRASSRQQQQPGPPGLPGAAGASGSSRRGRRERAPRPXRRGRAPRPRAAGPAGAAGRRR

SEQ ID NO: 35399 - protein, 175 aa, Sorghum bicolor
  Clone ID: SORBI-28MAY03-C66583_1.pep
MSAAQQKQKAAASASAAGAEQEGEGEHGPFPIEQLQASGIAALDVKKLKDSGLHTVEAVAYTPRKDLVQIKGISEAKVDKIIEAASKIVPLGFTSASQLHAQRLEIIQVTTGSRELDKILEGGIETGSITEIYGEFRSGKTQLCHTLCVTCQLPLDQGGGEGKAMYIDAEGTFRP

SEQ ID NO: 35400 - protein, 170 aa, Sorghum bicolor
  Clone ID: SORBI-28MAY03-C66597_1.pep
MENPAPPTDPAAATGATPTPSSSPSRRLPDFQQSARLKYVKLGYHYLISHGMYLLLTPLMVLVAVHLSTLSPRDVADLWAHLRLNLISVVACSTLLVFLGTVYFLTRPRPVYLVDFACYKPGPERRCTRDTFMRCSRLTGCFTDGSLEFQRKILERSGLGEETYLPPAVT

SEQ ID NO: 35401 - protein, 116 aa, Sorghum bicolor
  Clone ID: SORBI-28MAY03-C66633_1.pep
EKWKVASLAAVSLICFSSSAILALVTNVPVLLYWYSTDVDIINNAVILFIYYFIGSSVPSGFVLWIMREMPHRQVVERPTESRVVTLFRERPSTTQDPQWRTAVTSSNKALKSSPI

SEQ ID NO: 35402 - protein, 187 aa, Sorghum bicolor
  Clone ID: SORBI-28MAY03-C66901_1.pep
MATATYLSSFPAAPSSRTRLRRQTTRATASATDRPREVVSPKRRLPLRKVPGDYGLPVLGAIRDRFEYFYGPGGRDGFFTSRVRAHGSTVVRLNMPPGPFVARDPRVVALLDAASFPVLFDTSLVDETDLFTGTFMPSTDLTGGYRVLSYLDPSEPNHGPLKTLLFYLLSHRRQHVIPKFREVYGDL

SEQ ID NO: 35403 - protein, 117 aa, Sorghum bicolor
  Clone ID: SORBI-28MAY03-C66903_1.pep
MSSKMPCTITYKKPGTSPPVFLAGSFTDPQWQLREMEYTTDQNGDHAFQSEVMLEPDRDYQFKLRIGHDNWALAENYPTATDDSGNQNNVIRAPEKPAEEQIAPAGVDTPAISLNPA

SEQ ID NO: 35404 - protein, 179 aa, Sorghum bicolor
  unsure (1)..(179): unsure at all Xaa locations
  Clone ID: SORBI-28MAY03-C66925_1.pep
ARGSWRPPPPAGRSPPXPPPPPPPPPPPPRPPPPXPPPRPPAPRPSPCVPRGASPPPAPPPPRSCGAGPCRRPPPPPPPPRPAPPRRPPPPXPPRAPPSPPAPPPPAAPRGEGPAPPRARGGARRHVPRRAARAAPAPGQPRRLPAQRCRRGRPRLGAAGGGGRGPPRSPGNEQGHEAR

SEQ ID NO: 35405 - protein, 107 aa, Sorghum bicolor
  Clone ID: SORBI-28MAY03-C66935_1.pep
MAPSQAAAAGPTFEDLERDLQAVLMDQNHTAPADELSMFRSGSAPPTVEGSRTAIGALFSGPPLPANNLGGSGGGGTGAGIDMLTEEEIRSHPAYLSYYYSNEHLNP

SEQ ID NO: 35406 - protein, 66 aa, Sorghum bicolor
  Clone ID: SORBI-28MAY03-C66940_1.pep
GPSASGGGRKIDGFLYKYRKGEEVRIVCVCHGSFLTPAEFVKHAGGGEVTNPLRHIVVNPQQSVFL

SEQ ID NO: 35407 - protein, 170 aa, Sorghum bicolor
  Clone ID: SORBI-28MAY03-C66964_1.pep
TLNHAKTCDMGRKCYVFRTVGCEITFNPIGEVLGARIEDQTFALQELQPHQLFHVKQLAAQAYQMWGQLEEVANEMPLAANKSFVPTMNSGREPSESQGSMISSGSQNAKYLDCTGTATSSAAAMSTNSSSTSDSTAAVPANDAMFWSPSIAPECDFSWQDSAGCWDQVD

SEQ ID NO: 35408 - protein, 177 aa, Sorghum bicolor
  Clone ID: SORBI-28MAY03-C6665_1.pep
LINVPFWYYAFSALFYPFLTQRTKSKFVVARPSKVTETLLKYIPIEAIPVKYGGLKRDGDTEFSADDGESVTEVTVKGSSTQTIEIEAIEGDATLTWDLTVLGWEVNYKEEFVPADEGSYTIIIRKGKKMGTGEEAVRNSFRAGEPGKVVLTVENTSHRKKKVLFRHKAKSACAKKC

SEQ ID NO: 35409 - protein, 159 aa, Sorghum bicolor
  Clone ID: SORBI-28MAY03-C66681_1.pep
TNEAEVARAAEAAGFEAVVAELGGGGGGDEAEQARVVNAFDVVLGMHGAGLTNAVFLPPGGVLIQVVPYGKMEHIARAEFGEPAADMGLEYLDYSVSAEESSLMETLGPEHPAVKDPDSVHRSGWGQVFELYLAKQNVRVNVTRFAPTLAQALHHLRQQ

SEQ ID NO: 35410 - protein, 159 aa, Sorghum bicolor
  Clone ID: SORBI-28MAY03-C66689_1.pep
MDNGDRSGAAAGAVGSAGSLGLRVGQAVFSSASLLFMSVGVEFFSYTAFCFLVTIMGLVIPWSCTLAMIDVYSVLVGCPLRVPGVMVIVVVGDCALSIVSFAAACSSAAVIDLLLQFHGSHCSPRFCGRYQLSAMMAFLSWFLMAASAIFNLWFIASRW

SEQ ID NO: 35411 - protein, 192 aa, Sorghum bicolor
  unsure (1)..(192): unsure at all Xaa locations
  Clone ID: SORBI-28MAY03-C66709_1.pep
MRGSEVKSGKSQKSSAQRHISAGFVVAGLLMLLIYLVAQHFAVGASHVVITEAQVIMDNVKAPDETVVITEAQRIMDDIKAPSETENGKVVCNMEGRSDTCEVDGDVRTNGTALSVTLVPASRSEXSEWMIRPYSRRFASLRKVTVTQLQDRAAAAPCTATHDMPAVLFAIGGYAGNYWHDYADILVPLFVA

SEQ ID NO: 35412 - protein, 177 aa, Sorghum bicolor
  Clone ID: SORBI-28MAY03-C67017_1.pep
MASSGTMPLAYQTTATSPDWLNKGDNAWQLTAATLVGLQSFPGLVVLYGGVVKKKWAVNSAFMALYAFAAVWICWVTWAYNMSFGDKLLPLWGKARPALNQGYLIGQADLPATVHYFANGSTIETAAAEPLYPMATVVYFQCVFAAITLILVAGSLLGRMSFAAWMLFVPLWLTFSY

SEQ ID NO: 35413 - protein, 143 aa, Sorghum bicolor
  Clone ID: SORBI-28MAY03-C67028_1.pep
MEPVKLVEGYNFDDHTTSDVRVCFKLIDEQPEWFSCHSSVLSQNSKYFADRLGQNDIRSSSCIEIECPRAEYDHYVKMLKLMYLPGESVVDSFDSVRSALGVLRASNSLGCELVTKGCIAYIEAASWDENEEEEILEVARNLG

SEQ ID NO: 35414 - protein, 137 aa, Sorghum bicolor
  Clone ID: SORBI-28MAY03-C67032_1.pep
MASRDFLGGFGRDGGQAPAGGAAARTCGESDGIELSLGLSLGGCFGADPSQDGKELRLQRSSSIASICSLPPTSCGAQDAAAAAATAPPPDQLLRTSSLPAEYMEDRLRRRAMQSQRRLEAKRKRLERRNSMNSGRP

SEQ ID NO: 35415 - protein, 192 aa, Sorghum bicolor
  Clone ID: SORBI-28MAY03-C67058_1.pep
MAARRPRDDEEEEDDEDGGGADDHPHRRGPRRIRPAPLAFTAVVRRVVAQETIQQIVHNLEPLIRRVVREEIQNMFSHHQDHVPLRSLSLRIQEADVLPPLKLVFAKQLKLPIFTNNKLVDIMDNPIEIQLMDTRTNSMIALPDTHLGSSSVKLEVLVLDGDFQCEDRDGWTADQFNAAIVKAREGKRPLLV

SEQ ID NO: 35416 - protein, 115 aa, Sorghum bicolor
  Clone ID: SORBI-28MAY03-C6707_1.pep
MATKPGVSAAVLPLVLLLALSATAVAHNGRHPDDENNNNNNNPGGDPGAFFAGMPWFGGARTGGGPGGGFFGGWGEGGGLGYRRGAEVPPSTVCPQDGPSRGKRLTCPQRCFRTS

SEQ ID NO: 35417 - protein, 125 aa, Sorghum bicolor
  Clone ID: SORBI-28MAY03-C66794_1.pep
GESASQVESYEAQNTRHDKASSATTTADTPAAAISQAIDSPSTDTPSLGKSVRNQSPRTPESEAVQSSKEPQPTADPIISKDITKTAASGDPSKAPPRGSVVPLIITTGALAVAIGIGWWQAAYH

SEQ ID NO: 35418 - protein, 207 aa, Sorghum bicolor
  Clone ID: SORBI-28MAY03-C66820_1.pep
INFHRATESNKNHVAIDYCPARIGVGQRRRHHPFILLGMLRCEVGGGQGQWLQPAWPVCARHWRLIHRSQTWQSSACRVSPWLDPSPPWHLGLPRRRCSHGRGERERERTRGGGREQRRRWRAASGRPHERLLPPHREGRGDRERKRMEEKEDEEDKADEVEVEEEEGGRNAPVALGAVAVAVSPGIGSRKEGSKERGGEESKKEET

SEQ ID NO: 35419 - protein, 176 aa, Sorghum bicolor
  Clone ID: SORBI-28MAY03-C6685_1.pep
MAATTAAAAMRAVAVSAAALLVVASSLAGVASAATLALYNRCGETVWPGIQPSAGKEILARGGLQLSPGHSTSIRLPAGWSGRVWGRQGCAFDASGHGRCATGDCGGAFFCNGAGGAPPATLAEITLGATASAQDFYDVSLVDGYNIPIAMTPVHGSGAHCVPAGCVSDLNRVCPA

SEQ ID NO: 35420 - protein, 121 aa, Sorghum bicolor
  Clone ID: SORBI-28MAY03-C66882_1.pep
MTFLFPVKNQQGTIEGRPPAAPGRVSMARGLLVRVTPAERLVGDGKERDKDEKAPATGGAGAEADVGSVALDKMVISFMEESSAAVERPPRGRCGNCFNGNQDGISDDEDFDFLPSASHPA

SEQ ID NO: 35421 - protein, 181 aa, Sorghum bicolor
  Clone ID: SORBI-28MAY03-C66896_1.pep
MAAPAQAQVLPLLRWSRSASFLCASPRRLFSALRRPAAAARCEAGSKAMLKGMDYSELENWVQAQGFRPGQAMMLWKCLYGNNVWAHCYDELTGLNKDFRKMITEHADLKALTVKDIHTASDGTRKILLSLEDGSVIETVIIPCARGRTTVCVSSQVGCAMNCQFCFTGRMGLRKHLSTAE

SEQ ID NO: 35422 - protein, 264 aa, Sorghum bicolor
  unsure (1)..(264): unsure at all Xaa locations
  Clone ID: SORBI-28MAY03-C6716_1.pep
SMKSPDFEYIDNQDSSMLASLQRRTNEHLRITEDRDVEENKWKKNAIAPMEIDRICDVDNEYEDPQLCATLASDIYMHLREAETKKRPSTDFMETIQKDINPSMRAILIDWLVEVSEEYRLVPDTLYLTVNYIDRYLSGNEINRQRLQLLGVACMLIAAKYEEICAPQVEEFCYITDNTYFRDEVLDMETSVLKYLKFEMTAPTAKCFXLRRFARAAQACDEDPALHLEFLANYIAELSLLEYNLLSYPPSLIAASAIFLAGLY

SEQ ID NO: 35423 - protein, 139 aa, Sorghum bicolor
  Clone ID: SORBI-28MAY03-C67174_1.pep
MGCGQSKIDQEEAVSRCRERKRLMADAVVSRNGFAAAHTGYTVRLKSTGGALSDFAQGEAPDPSLVSSHTHHAPAVAAASISTPPGPSAASVTSPSPPPPPPFADFSHASLQRSSSTPNIPMPEPRAAAKNRPPADAPI

SEQ ID NO: 35424 - protein, 95 aa, Sorghum bicolor
  Clone ID: SORBI-28MAY03-C6718_1.pep
MEVKLWNDKRERELLESYADLYAIIKSTEKLERAYVRDLVSAADYEAECLKLISQFNSLSSSLAGAVTVPRFVQAYRLDCPAALNRLLQSGVPAT

SEQ ID NO: 35425 - protein, 196 aa, Sorghum bicolor
  Clone ID: SORBI-28MAY03-C6720_1.pep
MVVYTQEHVYRHPWDRVTAAACRKFTDPASRTVLSHVADVHTLHRRLDSDTGRLHAARSITVRSPPLPFVLRRLLPSAASSPNGAALCHCVETSLVDAQRRAMDVVVRNVSLRGLIEVEERASYRPHPDRPDDWTQFRQETTIRCRPLAVLAAVAEKVETRCAERFLQNSAKGREVVERICRYLEAESAGAAPSVI

SEQ ID NO: 35426 - protein, 121 aa, Sorghum bicolor
  Clone ID: SORBI-28MAY03-C67208_1.pep
MDFSSGDVKAAIMRPAAAAAAAAAESGTSTLLRGWQEFRRSGAPARFLCFEDGKWVDVTGEAVPRLRRAFQERRAMADASCGGEAYLFDFLRMVRIDEATGDETGLAWIDHHGGCFFPAPA

SEQ ID NO: 35427 - protein, 200 aa, Sorghum bicolor
  Clone ID: SORBI-28MAY03-C67203_1.pep
PNILPLPVKKIPSVSPPRHLLPTRRRTGDGAARGTGFPSLRPSPPALRRAGRARAKPRPPHHAVAGCRRPPRVLDGTLGTRSSPPAVAAKLTGRYVAIHFPYFLGSTHGGDGVGRLRRCLALVRGSSLPCPSPALLPHPFLLATNSGQAPRRRPTARNARVPNSAHGAVRASPGVGYQRGCSLLWRFPAAPCLLLCSMKP

SEQ ID NO: 35428 - protein, 127 aa, Sorghum bicolor
  Clone ID: SORBI-28MAY03-C66977_1.pep
LGESALDQLVEIIKILGTPTQSQILQMNPNSEEFRLPQIKAQAWSKVLKNADPLVIDLISKVLVYNPRDRLKPMEALAHPYFNDLRNQNFQIQECKIPELFNFSAEELGGVKQEILDVIIPSWKKSK

SEQ ID NO: 35429 - protein, 109 aa, Sorghum bicolor
  Clone ID: SORBI-28MAY03-C66986_1.pep
AKVIAKEGSFTVRTMQLFVTTRRCLLLQAQAQADDDDDELPRWLAMETASTVRAVVEPMLRTHFGWDAIAMDGLFCRYSLLLEAYYRSITSRSKGDLTSVFLVLEKKQH

SEQ ID NO: 35430 - protein, 102 aa, Sorghum bicolor
  Clone ID: SORBI-28MAY03-C66994_1.pep
RAPRGCVNSVRGGLHSSLVAWSPLFVCSAYPCSWFACAVELDAAVIAAEAASWAGCISERIQRLLVFPSLEEQWRPQAEANDEAERLLSSDSSETFPAGTVM

SEQ ID NO: 35431 - protein, 134 aa, Sorghum bicolor
  Clone ID: SORBI-28MAY03-C66987_1.pep
FARFCSKGKGEKLETHGNKFKQTSGAQQALLMENSSPGHHLARKGSARHWSREQSSTQAGRAKSAGHCALVYLSEMYTRSSSSTGPSLFHMIKQPKTSTDEYCPLRQFKQEHFRTPLQHISSTSPSRCCSGNPA

SEQ ID NO: 35432 - protein, 107 aa, Sorghum bicolor
  Clone ID: SORBI-28MAY03-C67001_1.pep
TLCALFLPVTNSRGAFYGRAAGGAQLGKQLAGALFIIGWNVVVTSIICVAINAVVPLRMTEDKLEVGDDAVHGEEAYALWGDGEVYDVTEHGPRGGAAVAPVSTTPN

SEQ ID NO: 35433 - protein, 44 aa, Sorghum bicolor
  Clone ID: SORBI-28MAY03-C67293_1.pep
LAGTRVEQPLGFLYPRLELGNQANFAMDHLGNGGDPVIITIKNR

SEQ ID NO: 35434 - protein, 153 aa, Sorghum bicolor
  unsure (1)..(153): unsure at all Xaa locations
  Clone ID: SORBI-28MAY03-C67308_1.pep
MAAPALLPPGFRFHPTDDELILHYLRNRAASAPCPVPIIADVDIYKFDPWDLPARAXYGDGECYFFSPRDRKYPNGIRPNRAAGSGYWKATGTDKPIHXSAATGEAVGVKKALVFYRGRPPRGSKTNWIMHEYRLAAANGSTSPLAAAYRPPS

SEQ ID NO: 35435 - protein, 187 aa, Sorghum bicolor
  Clone ID: SORBI-28MAY03-C6732_1.pep
ASPEYLSVNVGREDITGIDFVVFEHPEVTILSGHVEGDGIDTLQPHLSVEIRSAADPSRVESVLPVPLSYYFEVRDLPKGKHLVQLRSGLPSHTHRFESELVEVDLEKEPQIHVGPLKYKTEERHQKQELTPAPVFPLIVGVSVVALVISMPRLNDLYQSAVGMTSLGSGMAPIKKEPRKNIIRKRV

SEQ ID NO: 35436 - protein, 79 aa, Sorghum bicolor
  Clone ID: SORBI-28MAY03-C6734_1.pep
MATNENLPPNVIRQLAKELKNLDESPPEGINVIINDDDFTTIFADIEGPAGTPYENGVFRMKLLLSRDFPHSPPKGFFL

SEQ ID NO: 35437 - protein, 109 aa, Sorghum bicolor
  unsure (1)..(109): unsure at all Xaa locations
  Clone ID: SORBI-28MAY03-C67340_1.pep
PASSTTSSRWPARPCQKPHRRRQAHQGEGERMRVAMERLLYEARVDVVLAGHVHAYERFTRIYDNKADSXGPMYITIGDGGNREGLALKFIKDHKSAHLSEFREASFGH

SEQ ID NO: 35438 - protein, 156 aa, Sorghum bicolor
  Clone ID: SORBI-28MAY03-C67350_1.pep
MHSVKVLSAIAAIGVSAVSAASTCTSDIKVTEPTPSIDCDVVNGDITIDKDVAGTVVINGPKQIKGDFIAKGAGDLISISSTSINAIGGKFELSNLESLSNLEFSSLTSLGELSFIKLPRLGELNFGTEGVTKIKTIQITDTFISDLSGLSVATVE

SEQ ID NO: 35439 - protein, 213 aa, Sorghum bicolor
  Clone ID: SORBI-28MAY03-C67071_1.pep
MDYKTGKSQGNGYNTKPTKNVVSNTIGNNAPMHSEAGTRLNTYENSSTTKKTAHGGVANEKKQTYIFKEPAGETVTGDKKTYNAQKIVGNGTFGVVFKAQIAETGETVAIKKVFQDKRYKNRELQILKELGHPHVTNLRHAFYTQGDSNDEVYLNIVMDYIPGNLYDIIKYYRQSKHKVPNVLIRLYSYQIFRSLAYIHGIGICHRDIKPQNL

SEQ ID NO: 35440 - protein, 199 aa, Sorghum bicolor
  Clone ID: SORBI-28MAY03-C6708_1.pep
RRGGGHHLALVHSPSCYSYVWAFTLQMYLQAQSKNIIITYLAMLNLGLHLLLSWLMTVKFQLGVAGVMGSMVIAMWIPVFGQLAFVFFGGCPHTWTGFSSAAFADLGAIVKLSLSSGVMLCLELWYNTILVLLTGYMKNAEVALDALSICLNINGWEMMISFGFLAATGVRVANELGAGSARRAKFAIYNVVITSFSIG

SEQ ID NO: 35441 - protein, 189 aa, Sorghum bicolor
  Clone ID: SORBI-28MAY03-C67080_1.pep
MEMQDEAIVVVARPEEAAAAAVVAVRRMNSSGVGKMSYADNSDFQRVIASVTKKARQELAAALYRARGRPDSMAIADLGCATGPNALLNVSDAVEAVLAENQHHPPPQLHVFLNDLPADDFNAVFRLLPSSPLAATGCCLVSAWPGSFYERVFPEASLDYVVSSSSLHFLSKAPTMRMEHPVNLGRVYV

SEQ ID NO: 35442 - protein, 63 aa, Sorghum bicolor
  Clone ID: SORBI-28MAY03-C67094_1.pep
NGKYLKLDPKPGDFTIIRIIKVRTEYCSINIRRIMVGVVKDNTDQDSWFSAKPITVGNLSIIS

SEQ ID NO: 35443 - protein, 141 aa, Sorghum bicolor
  Clone ID: SORBI-28MAY03-C67130_1.pep
DPVRVAGHVMLCPFFGGAERTASEAEFPPGPFLTLPWYDQAWRLALPPGATRDHPFANPFGPESPGLGGVALPPTLVVAAERDLLRDRQADYVARLKAMGQPVEHVEFEGQHHGFFAVEPAGDAGSEVVRLVRRFVYGNSY

SEQ ID NO: 35444 - protein, 93 aa, Sorghum bicolor
  Clone ID: SORBI-28MAY03-C67545_1.pep
DGRAKRIIYWESVSNLVEPGGIVVITSCNHTKDELLQEVEDFTKRKFGKENVDEGAGDVSEIFRYIDHVRTYPTIMFGGIEGSQVCTVAFQRV

SEQ ID NO: 35445 - protein, 95 aa, Sorghum bicolor
  Clone ID: SORBI-28MAY03-C67549_1.pep
MLLPPATMVPLRARAPARQRRRRGAACARAGTARWSPTRAPTARRTPASGPSSSRTTSSPPTATRTPTSSPPAPAPAPTTPPPTSRRSRHNDRFG

SEQ ID NO: 35446 - protein, 168 aa, Sorghum bicolor
  Clone ID: SORBI-28MAY03-C6755_1.pep
MASPSSTSNNSALSPVAASGATTPGAGAPCAACKFLRRKCLPGCVFAPYFPPEEPQKFANVHKVFGASNVTKLLNELLPHQREDAVSSLAYEAEARVKDPVYGCVGAISVLQRQVHRLQKELDAAHAELLRYALRHVAAGIPTALPVSVSVSAAPRLSTAMTTSPPQF

SEQ ID NO: 35447 - protein, 92 aa, Sorghum bicolor
  Clone ID: SORBI-28MAY03-C67560_1.pep
ASSYLDGKRPLRGMVDPTVRSPVPEEDLEALRDVVRLSLCVRSDAGDEQRPDMGEVVRALRGVTGLSPEQVTPRDNPLWWAELEIASAVESD

SEQ ID NO: 35448 - protein, 145 aa, Sorghum bicolor
  Clone ID: SORBI-28MAY03-C67569_1.pep
EIINKCFSKRTVEEIISALELEATNLADEWVATTIQSLKKASPTSLKISLRSIREGRTQTVGECLQREYRMVCHVMRGDFSRDFFEGCRAILIDKDRNPKWMPPRLEQVHDEAVEQYFSRIDDPQWEDLNLPPRRSHGRNIESKL

SEQ ID NO: 35449 - protein, 203 aa, Sorghum bicolor
  Clone ID: SORBI-28MAY03-C67604_1.pep
MATPAAAPAPPNPNPVPDDPPLQQQHEEEEEESPEPEPETAPTSLTTSIDPTPSGGEESESDDSSSVSSAPSSAPAPAPAAAAAATPSPAAKDLLHISFNQDYGCFAAGTKSGFRIYNCDPFREIFRRDLAAVGDGATGAGVGGGAGGGGIGVVEMLFRCNILALVGGGDNPHYPPNKVMIWDDHQSRCIGELSFRSPVRGVR

SEQ ID NO: 35450 - protein, 207 aa, Sorghum bicolor
  unsure (1)..(207): unsure at all Xaa locations
  Clone ID: SORBI-28MAY03-C67228_1.pep
MSSSSLPHVVEDMPHVLQLLSDGTVVRFADYDTLPPPSVPPALPVQWKDAVYDATHDLKLRVYRPPPASCGNNKLPVLVYFHGGGYVLGTFALPNFHACCLRLAAELPAVVLSADYRLAPEHRLPAAIDDAASVIDWVRAQAVDAAGGDPWLAESADLGQVFVTVDSAGXNIVHHVAVRLASASASGELSPGLDPVRVAGHVMLCPF

SEQ ID NO: 35451 - protein, 196 aa, Sorghum bicolor
  Clone ID: SORBI-28MAY03-C67247_1.pep
PALTNTPPKKPEQPKKEAKKEAAPAAEAAPAAEEAPAAPKAKHPLEALGRPSFPLDEWKRQYSNIKDHNEAMKYFWENLNFEEYSIWKVDYKYIVGRAPAFGANNLSGGLGARLVRAREHVPACAAAPGGDSDSVVQRAPAIPGHRHVPAVAGAPEWPSSIFGKLDPPAPGHRLFVSDAWGWEKPITVNGKEYKLA

SEQ ID NO: 35452 - protein, 81 aa, Sorghum bicolor
  Clone ID: SORBI-28MAY03-C67256_1.pep
FKLNNIFHVGESILWAKKVSFFRGPGRPAPRSATRRPKAPRPPLAPPCAPAPAASPPPRRSLRPAQGTARRLPFHLVGNLY

SEQ ID NO: 35453 - protein, 144 aa, Sorghum bicolor
  Clone ID: SORBI-28MAY03-C67265_1.pep
NVSFPELEEIGGGFTIQNNTKLLAIDDFPKLEKVTGGVALRGSSEKVKLPKLEQVSGSVVVSSTTDIEEFCKFFDDMKDDKKIDGEEKCSFNNKNANKGEDGGQKSDGSGSSQSNEDDDSAAGSVSINMAVLALAGVAAVAQLF

SEQ ID NO: 35454 - protein, 173 aa, Sorghum bicolor
  Clone ID: SORBI-28MAY03-C67700_1.pep
PPPLAAAAAAAPADPVTERLQEAAAARRKTEGAATAHARRDDYWSPQLDLPSSASPPSIHQRGRDTPAPQGHGRRRGAAGEAAAGAGRKGISIDLTAPLLLGIVAAGFVGYNGEKVAGGGSGIQEHVGGAVALGVVNSFEMKVMLAGVTWFIIGAAIAGVIQVLGRREENIWK

SEQ ID NO: 35455 - protein, 105 aa, Sorghum bicolor
  Clone ID: SORBI-28MAY03-C67704_1.pep
EDKRLQADVVITPVVKQLLPANFTLVSGQEDAVDLARLLRARYVVPMSNGDVDAGGLLATVLTKQGTTQSFQALLSEALPQAQALDPTPGVPLQVQLQLDIIMDR

SEQ ID NO: 35456 - protein, 190 aa, Sorghum bicolor
  Clone ID: SORBI-28MAY03-C6772_1.pep
MAAAPAAGGQGGVGMDTALVDDIIRRLLEVRTARPGKQVQLSESEIRQLCNVSREIFLSQPNLLELEAPIKICGDIHGQYSDLLRLFEYGGFPPEANYLFLGDYVDRGKQSLETICLLLAYKIKYPENFFLLRGNHECASINRIYGFYDECKRRFNVRLWKVFTECFNTLPVAALIDDKILCMHGGLSPV

SEQ ID NO: 35457 - protein, 227 aa, Sorghum bicolor
  unsure (1)..(227): unsure at all Xaa locations
  Clone ID: SORBI-28MAY03-C6773_1.pep
MKALILVGGFGTRLRPLTLSVPKPLVDFGNKPMILHQIEALKEVGVTEVVLAINYQPEVMLNFLKDFESKLGIKITCSQETEPLGTAGPLALARDKLMDGSGDPFFVLNSDVISEYPFAELIEFHRAHGGEATIMVTKVDEPSKYGVVVMEEGTGKVERFVEKPKVFVGNKINAGIYLLNPSVLDRIELKPTSIEKEXFPRIAADQGLFAMVLPGFWMDIGQPRDYI

SEQ ID NO: 35458 - protein, 148 aa, Sorghum bicolor
  Clone ID: SORBI-28MAY03-C67741_1.pep
PSLTATSPPPSPLFPPATLPLSLPLPLRTRAVLRSATTPTTSAALVLTPTCLTALLPTLSALATLPSTVRVLSSPPLPALSLPLPPSPLLLLPLPPLPATTPLPAPSPLVLLLLLPPLTSSLLVPPRLSLLVSLPSLVPLPCSKWLMV

SEQ ID NO: 35459 - protein, 167 aa, Sorghum bicolor
  Clone ID: SORBI-28MAY03-C67744_1.pep
MGERKVLNKYYPPDFDPSKIPRRRQPKNQQIKVRMMLPMSIQCATCGTYIYKGTKFNSRKEDVIGETYLGIQIFRFYFKCTKCSAEITFKTDPQNSDYTVESGASRNFEPWRDQDEAADKEKRKRDAEEMGDAMKALENRAMDSKQDMDILAALEEMRSMKSRHAGV

SEQ ID NO: 35460 - protein, 205 aa, Sorghum bicolor
  Clone ID: SORBI-28MAY03-C67752_1.pep
MLLRLKIVGGVHSVVLPVPGGGYDIHGGGACYAAAAPCCWRRSRRSVVARRPRRGSATVVVMALKEEPDGSRSGFAGGGGPSWDPGLEIQVPFEQRPVNEYSALKDSALYSWAELSPGSFFLRLGGLCLITFTVLAAPIAAASFNPGKDPLKFVLAAGIGTLLLVSLVVLRIYLGWSYVGDRLLSAVVPYEETGWYDGQMWVKPP

SEQ ID NO: 35461 - protein, 162 aa, Sorghum bicolor
  Clone ID: SORBI-28MAY03-C67440_1.pep
FQGPWCFENFVQSRSLRRAQDVRKQLLTIMDRYKLDVVSAGKNFTKIRKAITAGFFFHAARKDPQEGYRPLVENQPVYIHPSSALFQRQPDWVIYHELVMTTKEYMREVTVIDPKWLVELAPRFYKGADPTKMSKRKRQERIEPLYDRYHEPNSWRLSKRRA

SEQ ID NO: 35462 - protein, 192 aa, Sorghum bicolor
  Clone ID: SORBI-28MAY03-C67457_1.pep
MASRATLLPLFLLLLAAPALATSGTIVFTTLGRSRYAFDIFALPLSPLSSAAASAELRLTDGVSVNYNGNFAPSSSSSEPPSLLFVSERNGSLNLYRTPVPLSASAARRREALEEEDDSPTLTPLLPWDPIALKDRPSLTPDGAHLVYVSTAEPAGSPRRSWAAVYSTSLASGATRRLTPRGVADFSPAVSP

SEQ ID NO: 35463 - protein, 230 aa, Sorghum bicolor
  Clone ID: SORBI-28MAY03-C67462_1.pep
IMLDAAPERTIHTDVLFGLLKQLIKRRSDMRLIVTSATLDAEKFSGYFFNCNIFTIPGRTFPVEILYTKQPESDYLDAALITVLQIHLTEPEGDILLFLTGQEEIDHACQCLYERMKGLGKDVPELIILPVYSALPSEMQSKIFDPAPPGKRKVVVATNIAEASLTIDGIYYVVDPGFAKINVYNSKQGLDSLVITPISQASAKQRAGRAGRTGPGKCYRLYTESAYRNE

SEQ ID NO: 35464 - protein, 105 aa, Sorghum bicolor
  unsure (1)..(105): unsure at all Xaa locations
  Clone ID: SORBI-28MAY03-C67513_1.pep
MASSARGIMFRRLKTLTLSPALASGATSQHHQLQQRAPVSGTAKGKAKLKAGQPLKRSTIGAKKGAPSTGGGGXGGRGRREAIERITNISESCLNASTPLRHLSP

SEQ ID NO: 35465 - protein, 182 aa, Sorghum bicolor
  Clone ID: SORBI-28MAY03-C67778_1.pep
MSNLSDPSKEDTSPEGSGTTQRTGAWSNTLNTLLQQASVCGVAAGYCLSASLLSIINKWAIMKFPYPGALTALQYFTSVAGVLLCGQLKLIEHDGLNLRTMWKFLPAAVMFYISIFTNSELLLHANVDTFIVFRSAVPIFVAIGETLYLHQPWPSLKTWLSLSTILGGSVIYVFTDNQFTVT

SEQ ID NO: 35466 - protein, 78 aa, Sorghum bicolor
  Clone ID: SORBI-28MAY03-C67788_1.pep
IEILIILHKRSAENFFYKFVAANKGLLSSYSSKCFFGIMSKTVLVVVFVLLPQKTFKIFSKILGMLRLLTRLESINSN

SEQ ID NO: 35467 - protein, 193 aa, Sorghum bicolor
  Clone ID: SORBI-28MAY03-C67800_1.pep
MPALLVNTVSVSPAAPRPGSSWPPTPTARRASTRHRCRAEASGSGTNGGDSGYRPGGVRGSWVSDYDLYELLGVERSSPQSEIKAAYRSLQKRCHPDVAGAAGGHDMAVVLNEVYALLSDPDARLAYDQEQARRSEFAGYTGRPLYSSWLGPESERRAVFVDEVRCVGCLKCALHASRTFAGESVYGRARAVA

SEQ ID NO: 35468 - protein, 214 aa, Sorghum bicolor
  unsure (1)..(214): unsure at all Xaa locations
  Clone ID: SORBI-28MAY03-C67790_1.pep
CPRKEFSGTVVDKGDLSPHWQGSDWKTSRVKWDEATNFNGPERVSSWEIEPFDASAPAINIPVQPSMKNKRPRETAESLDIHALEPAQEFWLSGRPEQHKTSISSNEPNCISVHQVAWTSERPGYSAMSSSICQNSAVIGSWFKDFNSSSKGASPSLPEISQKLFQVTSNDARVPPWPXLSAYQAEELSSKLSCNTALCSYQTEEVAPKFSIAV

SEQ ID NO: 35469 - protein, 71 aa, Sorghum bicolor
  Clone ID: SORBI-28MAY03-C6781_1.pep
MVVADDARLMVGIHWYGYGNWEKIRLDPKLGLAAKIAPATLGERETFLPRAPNLDNRASALLQKVSLLNQR

SEQ ID NO: 35470 - protein, 179 aa, Sorghum bicolor
  unsure (1)..(179): unsure at all Xaa locations
  Clone ID: SORBI-28MAY03-C67816_1.pep
CFKLDRSAMVERSVKSEHGVDLFLPPGFRFHPTDEEVITSYLLQKFLNPSFAPHAIGEVDLNKCEPWDLPSKAKMGEKEWYFFCHKDMKYPTGTRTNRATKEGYWKATGKDREIFKQPGRELVGMKKTLVFYMGRAPTGTKTDWVMHEFRLDGKSRHTNDSXSXLRFNPKDEWVVCKVH

SEQ ID NO: 35471 - protein, 88 aa, Sorghum bicolor
  Clone ID: SORBI-28MAY03-C70881_1.pep
MALLNPVYAFVVPFLFVVTVPLAVFAGITTTIAFSVLILRVLAVYLDVALSFVPHYLGGRKTRPYHPNTYHPHHHQILDPGPAALYTN

SEQ ID NO: 35472 - protein, 194 aa, Sorghum bicolor
  Clone ID: SORBI-28MAY03-C70888_1.pep
MFKSGISSFARAARPAVVPRRALRPSSLRLPISSRWASTASVGTGKIHQVIGAVVDVKFDTQKLPAILNSLETENNGQKLVLEVSQHLGENVVRCIAMDGTEGLVRGASAQDTGAPITIPVGPATLGRIMNVTGDPIDERGPIKTDKRLPIHTEAPEFVEQSTSAEVLVTGIKVVDLLAPYARGGKIGLFGGAG

SEQ ID NO: 35473 - protein, 199 aa, Sorghum bicolor
  Clone ID: SORBI-28MAY03-C70892_1.pep
MKWVVPFLVAFVPLVAAQNATKELLTNLPACAAPCYEDAIKKSDCNSTDVKCVCSTQVIIQTAEACAAQACHVRDSLTTLNMTYTYCEVPVRNKTPIFINVTIVLGVISGVATALRLWSKFFYTKTELGLDDLFIVLTLFIGMPSTAMNIHGTAGHGEGRDIWTLEFDDITKFGFYFWLLEIFYFAQVSLLKTSLLFFY

SEQ ID NO: 35474 - protein, 84 aa, Sorghum bicolor
  Clone ID: SORBI-28MAY03-C7091_1.pep
LVSRQLTASCRSHASPSTVEPLRGLGPISVQQSLLLILYLLYHLYNILCIYTRSLGGLSPLNPKTFKILLKKKKKKKKKKKKKK

SEQ ID NO: 35475 - protein, 138 aa, Sorghum bicolor
  Clone ID: SORBI-28MAY03-C67963_1.pep
FPITLDEATSVTVKRPVAVQRSKAEKASKVEVLVIDGIEVDRDVAAKFDVFVNTEDHAAVGSGGRELAGSFVNVPHGQGHRHGHGKKGRGIKTKLRLALNEQLEDLKAEGDESVVVTLVPRQGKGKVKVGGVKIELMH

SEQ ID NO: 35476 - protein, 193 aa, Sorghum bicolor
  Clone ID: SORBI-28MAY03-C67949_1.pep
MTEPRQGLQATAIGIDLGTTYSCVGVWMNDRVEIIANDQGNRTTPSYVGFTESERLIGDAAKNQVARNPVNTVFDAKRLIGRKFDDPIVQKDIKLWPFKVEAGPDGKPLIAVKYKGETKKFHAEQISSMVLTKMKETAEAYLNKSIKDVVVTVPAYFNDSQGQATKDAGVIAGLNVLRIINEPTAAAIAYGLD

SEQ ID NO: 35477 - protein, 66 aa, Sorghum bicolor
  Clone ID: SORBI-28MAY03-C67979_1.pep
LTDRVVDIIFHVFDTNQDGNLSSEEFLRALQRRENDIRQPTIPGPLGFLSCWFSGRKCSSLQQVVL

SEQ ID NO: 35478 - protein, 159 aa, Sorghum bicolor
  Clone ID: SORBI-28MAY03-C68012_1.pep
GPRRVTPASRGASKRNAEHDAPKHDRRDVLLGLGALSASATATLVTARRAGADPVATPDISSCGPADLPPSANVLTCCPPPSNALPVDFALPDATSLPLRTRPAAHSVTADYVAKFNAGIAAMKALPADDPRSFAAQATVHCAYCDGSYSPEGFPDVEL

SEQ ID NO: 35479 - protein, 174 aa, Sorghum bicolor
  Clone ID: SORBI-28MAY03-C68023_1.pep
MAVEAVLDAAAAVMPSPAPPRGRGDDVVVVVVVAAAAADDQVATTSGGGGTAAEEEEDVNAVVQQEEHGHQGLAKRKKRSRRRRDREQQQPPTPTQTQEEYLAQCLVMLATGRRDRDVPAPAPPQDHACSVCGKVFPTYQALGGHKVSHRTKPSPAPTTPGVGDGDHHHDEEEK

SEQ ID NO: 35480 - protein, 227 aa, Sorghum bicolor
  unsure (1)..(227): unsure at all Xaa locations
  Clone ID: SORBI-28MAY03-C67759_1.pep
SRQDHSRSQSNFFVLNKHLHSLKLIPAPKPSKARASSLPPSPASSSALPPPLPTXAPPSNETVKYTTEVVTHLTTYCPEATTLTYGEKTYTITEATTLTIEDCSCTITKPVATGTGYAPPPKPTHAKDCAEMCSDKYDDCRVAPNANMATCAAEYAACLNYNPWESGKFVKPTSCHAGGKPTAVYTTEVVTAVTTYCPEATTLTYGNKTIPVTAPGTVTXPDCHFTT

SEQ ID NO: 35481 - protein, 133 aa, Sorghum bicolor
  Clone ID: SORBI-28MAY03-C67763_1.pep
MALSGMRGLSVFISDIRNCHNKEQERLRVDKELGNIRTRFKNEKGLSPYEKKKYVWKMLYIYMLGYDVDFGHMETVSLISAPKYPEKQVGYIGTSCLLNENNDFLRMVINTVRNDIIGRNETFQCLALTMVGN

SEQ ID NO: 35482 - protein, 165 aa, Sorghum bicolor
  unsure (1)..(165): unsure at all Xaa locations
  Clone ID: SORBI-28MAY03-C67773_1.pep
MGEEQAAPKPAEAAAAALELTGFVMSAEDAERRAAAAGVATVQDLLPLLIPSARKRAQVPISDFQVGAGGLGASGRVYVGVNLEFRGVPLCHSVHAEQFLVANAAAAGESALRAVAVSHMPCGHCRQFLQEIRGAAGIQILVTSDAXQGRAPEWRTVASLLLRPF

SEQ ID NO: 35483 - protein, 209 aa, Sorghum bicolor
  Clone ID: SORBI-28MAY03-C67776_1.pep
MAAPDPPPRPGKPPLPWRARLLVGAASALHAASLRRDGTVNRFLLSLFDRTAALTPTAPVGGVASTDHAVSDHLHTRIFVPEIPGGGGKELPVVVYFHGGGFVFHSAASAQFDELCRRLASAIPAVIASVDYRLAPEHRFPAQYDDGEAALRWVLAGAGGALPSPPAAAVFVAGDSAGGNVAHHVAARLPDAVAGLVPVQPFFSGEAPT

SEQ ID NO: 35484 - protein, 72 aa, Sorghum bicolor
  Clone ID: SORBI-28MAY03-C6806_1.pep
FKFIFSNSYAIFSLFCLVRYVGYLTSGYFCTLFFSLRRVSLHLLFYSLCFEFGTYLFGMTSFRLIFLWYVIF

SEQ ID NO: 35485 - protein, 183 aa, Sorghum bicolor
  Clone ID: SORBI-28MAY03-C68080_1.pep
HKEPTVPKEVKPKSGKSSLKGKITSFFSKRKKAEKEKANPSPLGTLNSRASSASTVAVGKSDVPQHVCTSLQDDVASENLEEQFNHGPIGVPVDEPEAPSVSKSPASHEKALSFEIRTSHFDQPSPTSVLDLQFEDISEKSPISSESAITAKQGPPSWPLPCGSFPATLPWHVASRAPPLSPS

SEQ ID NO: 35486 - protein, 88 aa, Sorghum bicolor
  Clone ID: SORBI-28MAY03-C68120_1.pep
LLKKTFSLFPHVLPRLCITNIRGACANLCHKASALALTSPANRRVLFVSTQYATQSHESRPTYSRLSLRWCKPSSDCDHHLKALRLTA

SEQ ID NO: 35487 - protein, 105 aa, Sorghum bicolor
  Clone ID: SORBI-28MAY03-C68146_1.pep
MRLPSLSAALLGALAWTARADDLDDNIRSISLRTHSLTQPYLDSDMQSRWYDFGGDTIIRTDSYIRLTSDRPSQSGWMYSRVPLTATNWQVEVEFEISGKNQLYG

SEQ ID NO: 35488 - protein, 89 aa, Sorghum bicolor
  Clone ID: SORBI-28MAY03-C68181_1.pep
RFEYRAFVTVGRNPDIKKVLRDILIALNEESYTYSKLMGLDENQLVRKLNEFVKEKRYELASTITDSMLSYSRFYVIYMHNLFFTSLFY

SEQ ID NO: 35489 - protein, 134 aa, Sorghum bicolor
  Clone ID: SORBI-28MAY03-C68148_1.pep
MDEKVDLVEVLTRRVEDLQRERDALRKDIEQLCMQQAGPGYVSVATRMLTQRTAALEQDIENPQKKLGGCLRENQNLQEELAEAYRIKSQLAELHGAALSKNKDLEKQVRFFQSSVAQAFAERDSSLMECEKAK

SEQ ID NO: 35490 - protein, 173 aa, Sorghum bicolor
  Clone ID: SORBI-28MAY03-C67818_1.pep
MERARRHASRALLRRLLAAATTTTTTASPATSSSRGISTLSPAAPAAGRQQQQRRRPPPHQHAQGRPVSVSALQPSDTFPRRHNSATPAEQAAMATTCGFDGGLDALIDATVPAAIRAPPMRFSGRFDAGLTESQMLDHMQRLASMNKAYKSFIGMGYYGTHVPGVVLRNLME

SEQ ID NO: 35491 - protein, 177 aa, Sorghum bicolor
  Clone ID: SORBI-28MAY03-C67861_1.pep
IDANGILNVSAADKSTGKSNEITITNDKGRLSKEEIEKIVSEAEKYKQQDEIVKKKVEAKNGLENYCYSVRGSLKDDKIKDKFSEEERTNLEKLCADALAWIESNPEAHAEEYEKHRKDIEAVFNPVISRIYQETGGAGAGGMPGGMPGGFPGGAGGFPGGAGGQTGGAGPKVDEVD

SEQ ID NO: 35492 - protein, 140 aa, Sorghum bicolor
  Clone ID: SORBI-28MAY03-C67890_1.pep
QVCTAPITSTELPFLSISRQSSLRSCASLTSPSTLSSSILSSNTESTISAVCSPVFSVPTTPCCFSALCTPVFPKTPTTKSCSSAPPVFSEPAASCCFSASCTSIFSKTPTPSCSPASFPPDFSERTAPCSSVSSGPMAL

SEQ ID NO: 35493 - protein, 132 aa, Sorghum bicolor
  unsure (1)..(132): unsure at all Xaa locations
  Clone ID: SORBI-28MAY03-C6793_1.pep
MKMHRFALPGLGFLVLWMLLHCGSELAAAVPPDGWYDYSAYTDCRGQPEPALYNGGISSSATATTRTGTAXTETGVFSPAFVVYNLNKTTMYTFSCWVKLEGAYSALITARLAPDNTGARCIXTVLPERLWP

SEQ ID NO: 35494 - protein, 207 aa, Sorghum bicolor
  Clone ID: SORBI-28MAY03-C67914_1.pep
MAAAPMVVPRMKLGSQGLEVSAQGLGCMGMSAYYGPPKPEPDMIALVHHAVAAGVTLLDTSDVYGPHTNELLLGKALQAAGGVREKAQVASKFGILTDADGNWGVRGDPAYVRASCEGSLQRLGVDCIDLYYQHRIDSKVPIEVTVGELKKLVAEGKIKYIGLSEASASTIRRAHAVHPITAVQLEWSLWSRDVETDIIPTCRELGI

SEQ ID NO: 35495 - protein, 176 aa, Sorghum bicolor
  unsure (1)..(176): unsure at all Xaa locations
  Clone ID: SORBI-28MAY03-C68313_1.pep
MGTLGGHVAPGAGFLLIGLWQLFGHSRPFLLRPGSYAAPVWFPAPGVRHLELILIIIGAAISVPMELVIXPAKHQPFDDDGTIPSVHLHNFEHASISLARLVFAAATIHLDRVRAPLRDAVSQLAAAAAFAQQLLIFHLHSADHAGVQGRFHRLLQMVVAVTLAASLLLIPYQRSI

SEQ ID NO: 35496 - protein, 159 aa, Sorghum bicolor
  Clone ID: SORBI-28MAY03-C68395_1.pep
AIAGAGLIVYQIFIYRPVHKYLGSVNSCRAASALPVPLIAAFPFMTHLSGLKLGLALYFATTFKAALGTTTLTSTSLLQNYAVPQHQRGAANGIATTAMSFFKAIGPAGAGALFSWTQKRQDAAFFPGDHMLFLILNVLQCIGLVLTFKPFLAVPKHLK

SEQ ID NO: 35497 - protein, 203 aa, Sorghum bicolor
  Clone ID: SORBI-28MAY03-C68433_1.pep
MEGGAHEFDGSTFKECFSLSWRNPYVLRLAFSAGIGGLLFGYDTGVISGALLYIRDDFGSVDRNTWLQEMIVSMAVAGAIIGAAVGGWTTDRFGRRASILVADFLFFAGAAIMASATGPAQLVVGRVFVGLRVGMASMTAPLYISEASPARIRGALVSTNGFLITGGQFLAYLINLAFTKAPGTWRWMLGVAALPAVVQFALM

SEQ ID NO: 35498 - protein, 189 aa, Sorghum bicolor
  Clone ID: SORBI-28MAY03-C6844_1.pep
YWSFPRSTAPRNHPLSASWLLGNSNSTSEAWCVDASYSSSLPTFPQPLLSPANPISPRSCATLPPPSPLLPPPLPPRTAPPPPTSLPPPCTAQAPPTSRPPLPPPSADTPTRRPPPPVAAAPGTPRSQPTRRPRRRTLTPNLPRRKSPPPTPGRSRTPRRRHRRWSRPASSSRASGSRGRRSSRRAGPG

SEQ ID NO: 35499 - protein, 124 aa, Sorghum bicolor
  Clone ID: SORBI-28MAY03-C68451_1.pep
RHEAVGLFLTHSGWNSTLESLGAGVPMLCWPFFAEQQTNCRYKCPEWGVAMEVGADVRREAVEARIREAMGGDKGKEMARRAAEWKQAAAGSAARSLANLDSLINDVLLSGTIGRLTQIKVCRV

SEQ ID NO: 35500 - protein, 83 aa, Sorghum bicolor
  Clone ID: SORBI-28MAY03-C68849_1.pep
ELIEEIAMKKKKEADPKKKKPKRKPLFVKNGAIVVCRIQVNSLICVEKFSDFPQLGRFTLRTEGKTVAVGKVVDVPPAGSPTF

SEQ ID NO: 35501 - protein, 169 aa, Sorghum bicolor
  Clone ID: SORBI-28MAY03-C68029_1.pep
PHSSPILTLSGCGRGCEAIHTRLRHPAPNSSRCHPQPPTTSIASDASRLRRSCPHPLTPFTTLVATNGSTRHRHLRIKMAPGRKGGNQKSTTHEPVETPMTDYELQRAYNILEKNRMFQRLGLGKLRELVGTKPVVVAREESDPLYESRESIMSSKHKTWLTGKQLSPH

SEQ ID NO: 35502 - protein, 160 aa, Sorghum bicolor
  Clone ID: SORBI-28MAY03-C68031_1.pep
MAPLPSAARLLRSTLGRLRSPPPARAFSSAAATETGAGAGNGREAAIAAAAVAMAGSGLGLWLKPPSLADSGEAPGGQISVAGATEAREEEKGWFLFADSFRRRVFFNYEKRVRLLSPPEKIFEYFASVRNPEGEVYMLPDDLMRAVVPVFPPSESTIVR

SEQ ID NO: 35503 - protein, 211 aa, Sorghum bicolor
  Clone ID: SORBI-28MAY03-C6804_1.pep
SSGYHILKVSGYSRTKGTPTGELIKSHPFTEGGHPRVRQYYPNGDSSECADYISLYLCLDESVTDAAVKAQFKFHFIDDVEEEDQTQALTTVSVRSFESNQSWGHRRFIKREDLEKSKHLKDDSFVVRCDIAIANELRTEEVAMAEAPTTTFVSVPSSDLHQHLGDLLQTEKGADVVFEVSGETFKAHRCVLAARSPVFNAELLGQMKESD

SEQ ID NO: 35504 - protein, 82 aa, Sorghum bicolor
  Clone ID: SORBI-28MAY03-C68050_1.pep
GFCYGGWLIGWPAKRRSFGPNFGRTIRKHAVCLGFSQEWGKNGQSYQKEWVEIRLTAMVCSTVGVHWSMRIFASYMVIGGTF

SEQ ID NO: 35505 - protein, 128 aa, Sorghum bicolor
  Clone ID: SORBI-28MAY03-C68073_1.pep
FQDKQLKLELQYKVEDEWQTCFDLEDPPAIPNIAYVGFTAETGELSDNHDIISVAAKNLYTQPGTSNTGKSSGTKNKGRKGTGKTTNGNKQGGSWTWFFTKIILFIIIAGGAYVGYTAYRSKAKSHRF

SEQ ID NO: 35506 - protein, 191 aa, Sorghum bicolor
  Clone ID: SORBI-28MAY03-C68536_1.pep
ECELFTKCMESWDSMEAHDLPECMKFGLEKIFDSYGTIENMLHQEEKYRMPYLRQSIKDLVRSYNMEVKMLQAGYIPKSTEEHLKLSMITVGYPILSCASFVGMHDIATKDCFDWVSSVPKMVEALSVILRLVDDLVSYEREQLIPHVASTIDSYMMEHNVSIEVARGQIHVLKEDPHLRSPFSTMCCYKK

SEQ ID NO: 35507 - protein, 90 aa, Sorghum bicolor
  Clone ID: SORBI-28MAY03-C68553_1.pep
LNQQQQHLHQQQHLQQQQQLNQQQLQQQQQQMTMSGNQNAQLAQQFKQVPSMSAYGMRMPPVKVEAFHELVSGDSSLKHDNDPNKLTSPK

SEQ ID NO: 35508 - protein, 184 aa, Sorghum bicolor
  Clone ID: SORBI-28MAY03-C6858_1.pep
HSSVVLLSCIVLVGLFALQHRGTQKVAFMFAPIVIIWLLSIGGIGLYNIFHWNSNIYQALSPYYMVKFFRKTGKDGWIALGGILLSMTGSEAMFADLGHFTSASVRVAFITVIYPCLILQYMGHAAFLSKNTFHMPTSFYDTIPEPVFWPVFVVATLAAVVGSQAVISATFSIVKQCHALGCFP

SEQ ID NO: 35509 - protein, 205 aa, Sorghum bicolor
  Clone ID: SORBI-28MAY03-C68598_1.pep
KIGGIGTVPVGRVETGVLTPGQQVTIAPAQVTTEVKSIEMHHEQMPQATPGDNIGFNVKGLSVKDIRRGYVVGDKTNDPPAGCADFTAQVIVLNHPGQIHAGYAPVLDCHTSHIACKFAEILSKVDKRTGKATEENPKFVKKGDAAMIKLEPSKPMCVESFSDYAPLGRFAVRDMRQTVAVGVIKAVTKKAAGAADAKGAAKKAK

SEQ ID NO: 35510 - protein, 242 aa, Sorghum bicolor
  Clone ID: SORBI-28MAY03-C68635_1.pep
LEFYEEKELLRNDPLPLALEKDKDSRLLTSPLKFPGKLAVDVQNNRLFISDSNHNRIVVTNLEGQFICQVGSSEEGLLDGPFDAALFNRPQGLAYNSKRNILYVADTENHALREINFVDETVRTLAGNGTKGSDYKGGGQGTNQVLNSPWDVCYDPTEETVYIAMAGQHQIWKHIVRDGVTKVISGDGYERNLNGSSATSTSFAQPSGISLASEMQELFVVDSESSSIRVVNLKTGGSRLLA

SEQ ID NO: 35511 - protein, 109 aa, Sorghum bicolor
  Clone ID: SORBI-28MAY03-C68228_1.pep
MERYHPSEVYELFVRHMNTPRVVVDNGVCATATLVQVHSARKHGVLLEARAALSDHGVCVRKGYISSDDGRWFMDVFHVTDASGRKVADADALLARLESSLTADALPPR

SEQ ID NO: 35512 - protein, 102 aa, Sorghum bicolor
  Clone ID: SORBI-28MAY03-C68235_1.pep
MLTVLTPSRASRLLRVFSHLEARVLPAAAIRLSSSASSSSSSSPAASAAPPPMDAPSEWTARRVREQYISFFVSKEHTRWPSSPVVPVDDPTLLFAYAGMNQ

SEQ ID NO: 35513 - protein, 298 aa, Sorghum bicolor
  Clone ID: SORBI-28MAY03-C6824_1.pep
ARGDDPDKKEIKFASKIQIRMSLDFGYHVLDESTYYSSDLQPSSKPARKPSIGMLELGVLGARNLIPMKPKDGRTTDAYCVAKYGPKWVRTRTILDTLNPQWNEQYTWEVFDPCTVITVVVFDNGQIGKNGGGPDQRIGKVRIRLSTLETDRVYTHFYPLLVIHPSGLKKTGELHLAVRFTCTAWVNMMALYGRPLLPKMHYTQPIAVMQLDYLRHQAMQIVAARLSRAEPPLRREIVEYMLDVDSHMFSLRRSKANFHRITSLFFGFLAMLKWYDGIRSWRNPITTMLVHMLVLILI

SEQ ID NO: 35514 - protein, 155 aa, Sorghum bicolor
  Clone ID: SORBI-28MAY03-C68295_1.pep
GIPYPRSIVVSLVRSASLVLQGVWFAVMGVMLWTPALVPKGCFLNLEDGLHVVRCRTDEALDRAKSLVNLQFSWYLTGTVAFVVLFYLQMAKLYPEQPQYAPLVKGGGGGGGRGAVREGRVGVGDLEPADGGVGEAAIRGCGHVVSGTKPVEIER

SEQ ID NO: 35515 - protein, 137 aa, Sorghum bicolor
  Clone ID: SORBI-28MAY03-C68302_1.pep
MAPLLFRDMKGLSCSSQASTAICPSLERQPMVRSHKAIASPSPSPSPLAHAPAEPRTHRHDGKKGQQQQHKAVVVPNITGGLVSPAGSSRYLLSSGRFAATVTEEIQEVVESAPAPAPAVDAKREEASEAAEAKSGA

SEQ ID NO: 35516 - protein, 154 aa, Sorghum bicolor
  Clone ID: SORBI-28MAY03-C68759_1.pep
ILAVRAVIVQLAFFLHIQTFVFRRPAVFSRPLIFATGFMTFFSVVIALFKDIPDIEGDRIFGIRSFSVRLGQKKVFWICVGLLEMAYSVALLMGATSSSLWSKTVTIAGHSILAGILWSCARSVDLTSKAAITSFYMFIWKLFYAEYLLIPLVR

SEQ ID NO: 35517 - protein, 160 aa, Sorghum bicolor
  Clone ID: SORBI-28MAY03-C68760_1.pep
KEARTHDTPLAIPYLKHFALTGIVPIGEAMMRDHGAPRHAPPMGPHSTWKRRTARSHLVAWGRGTGGHGRARVGPPAALAHSRTHTHLYVHVQHARARITCDDTGSRIIAFASLVAAAAAGRRRRRGQRPEAGEGGGDGDAGHVEPLAAAPVRDGHPPPL

SEQ ID NO: 35518 - protein, 183 aa, Sorghum bicolor
  Clone ID: SORBI-28MAY03-C68781_1.pep
MDALRLRPSLLSAARPGAARPRDHFLPPCCSIQRNGEGRICFSSQRTQGPTLYHHQKFFDWKSSYCRISHQSLNTSVNASGQQLQSEPEAHDSTTIWRAISSSLDAFYRFSRPHTVIGTALSIVSVSLLAVQSLSDISPLFLTGLLQAVVAALFMNIYIVGLNQLFDIEIDKVNKPTLPLASG

SEQ ID NO: 35519 - protein, 209 aa, Sorghum bicolor
  Clone ID: SORBI-28MAY03-C68782_1.pep
MADHPVAGEHHHPSPASSAATALGPLLLLPSELLHEILLRLAVPELLRLRSVARPLSSLISSPDFRRLYHLSSSPSGPGPAAAWLLLFKKLPPRDAAIRGFHGPSGRWFRIPVSSILAPAVPPGEDLYFLAASASSFLFAANGRRELVVVDLTARAARRLPPSPLGPRGTSSWRRFGLKLVADPPGSNRFRFLFAELVNNTPFLFEYRS

SEQ ID NO: 35520 - protein, 185 aa, Sorghum bicolor
  Clone ID: SORBI-28MAY03-C68827_1.pep
IRPFDGPHTHFSFEDHSSSLHCRVQNPTTRATMPRLAAAAAVSRRAGEALRRGALGRLRLLSSLQPSNAASSDEVLVEGKATARAAVLNRPGYLNALTTTMGARLNKFYESWEDNPDIGFVMMKGSGRAFCAGGDVVRLRELISEGKLEECKDFFKTLYMFIYFLGTYLKPHIAILDGVTMGGGW

SEQ ID NO: 35521 - protein, 177 aa, Sorghum bicolor
  Clone ID: SORBI-28MAY03-C68497_1.pep
MPPPHLILLLFLGLGGVLLPAAWAADEQFVFDGFKGANLSFDGMATVTPDGLLMLTNGTNQLKGHAFYPAPLRLHRAPNGSTATAAMQSFSTAFVIGIIGAYEDLSSHGMAFVVAKSSDFTSALPGQFMGLVSSATNGNATNRLFAVEFDTILNSEFNDMSGNHVGVDVNGLNSVDA

SEQ ID NO: 35522 - protein, 198 aa, Sorghum bicolor
  Clone ID: SORBI-28MAY03-C68518_1.pep
MEMVECSLVATLAPRPLPGRVPKALPRPAVLGGRARLRVLSAGLGREQPPPPQQAGVRASGPDHGGRTLGQAAVGLAAAAVVSLTGFSGDVSPLPAPPARAESLTVAFPVSKAREVNRVQKTLVETWGLIRETFVDPTFNHQDWDQKLQQTMVEIFPLKSADAAYSKISGMLSTLGDPFTRIISPTEYQSFRIGSDGN

SEQ ID NO: 35523 - protein, 91 aa, Sorghum bicolor
  Clone ID: SORBI-28MAY03-C6852_1.pep
MGAAANSNHEEESSPLIPAAAAAADEKPPQAPAPAPEAAKCYADGVPVVMGEPVSAHAFGGLPRESWNSGILSCLGRNDEFCSNDVQVCLL

SEQ ID NO: 35524 - protein, 123 aa, Sorghum bicolor
  Clone ID: SORBI-28MAY03-C68532_1.pep
IEAPSPLPTFKVRKEKLGDRITALQQLVSPFGKTDTASVLHEAIQYIKFLHDQVASLSSPYLKNGIPMKQFQHKGSEDSKDNGDTKQDLRSRGLCLVPVASTYTVAAETPEFWHPTFGGTFRW

SEQ ID NO: 35525 - protein, 113 aa, Sorghum bicolor
  Clone ID: SORBI-28MAY03-C68527_1.pep
QIMGGKKYDMDEFFIGCVDVRDVAQSLIVLYENTSAEGRHLCLESSERMVDFTNRLAHLYPEFSVYRIQEDKQDWVVRPKDPSKKLINLGVRFTPLDKTIADTMDCFRSKGLI

SEQ ID NO: 35526 - protein, 157 aa, Sorghum bicolor
  Clone ID: SORBI-28MAY03-C68906_1.pep
RLRTFPNTFYFSYATKKTRKLFGITVPSSVLGVHPMLFLRVLQMCMWRHPQSAPLPYKGYRDEDWEDNDGALNTISMTHPRIPIEHPHRLGVHDSDRHPSLPGCWYYKIIEAAPILFIVNRERAGVQFDLLYDGIFQRCRKHAFRKSPPTVPNETSQ

SEQ ID NO: 35527 - protein, 198 aa, Sorghum bicolor
  unsure (1)..(198): unsure at all Xaa locations
  Clone ID: SORBI-28MAY03-C68927_1.pep
RRPWAAQQEAPRRRGGLRDVGGDGRAEDVEAEEHVHGGADPELHQAQDEPRHRLVSWQRRPTSARASAAAAAACRWSLPPLARGSCYFFYIPLIXRRAKKRNGTGGGGGQRTNERRKEGRTGPDRSRPPDWAAARRVCLFSGREAGRVSPSLWLRCGLVRSRSGSVPRCAAVSVLGSRSRSLVVGADRRGGEGLSLSS

SEQ ID NO: 35528 - protein, 213 aa, Sorghum bicolor
  unsure (1)..(213): unsure at all Xaa locations
  Clone ID: SORBI-28MAY03-C68950_1.pep
RLLQSNAPPRRTCTQRQAHLLASPPHRGAAAASPFRVPPPLAVRVSPSADPRDAASTSTPTRRGRRFQDQPAIYPCLDWSTMQAYYGQGVLPPAFFNPGIAPGHVPPPYVWCPQNMPPAAFGKPYAAIYPHAGGFLHPFMPLXMVNPLSAEPAKSANSKDNSLNKKLKEIDGTAVSSGNSEKTSGDYSLEGSSDGNNPXVSGTPKKKSFDDRT

SEQ ID NO: 35529 - protein, 204 aa, Sorghum bicolor
  Clone ID: SORBI-28MAY03-C68957_1.pep
MSISEKETKPEIASSKADIYPADEKKGLPQHDKNMHDIEIMSSDKVKQPLETAEDIVTHVIQVDDDPTMNPWTIRMFAIGIGLSAFGAVLQEIMYFKPQVVYVSVMFLTVLAETLGTGLAHIIPRWGRIGRLLNPGPWNRKEHTAAVLMASAASVSALSTEALTVQKLWYGGYPSVAAGIFVTLSSQLIGYGVAGMMRSVLLYP

SEQ ID NO: 35530 - protein, 114 aa, Sorghum bicolor
  Clone ID: SORBI-28MAY03-C68961_1.pep
MRDSESSDDAQLDEPLGRVAILSYGSGHMLNDITSSCWFTYLLVFLTDLGLSPGDAPSGLLSRLLAVGCTSFFAGLVLVPFGRVIRGLAARSFAVPCPFSPYCKRILPLLCIMK

SEQ ID NO: 35531 - protein, 188 aa, Sorghum bicolor
  unsure (1)..(188): unsure at all Xaa locations
  Clone ID: SORBI-28MAY03-C6897_1.pep
HEESAATETISTPSVAPGSLASTLNLRSLILSGDFFLAAVVACTLTKLVLRLEEVQPSKVESNKACTGALLIMTSILQLGQSSYLPHPIDXDSYDRIVLCLRLLCNTGDDVRKIWLQSCRQSFAKMLAEKQFRETEEMKAKAQISHAQPDDLIDFYHLKSRKGMSQLELEDEVHDDLKAATGGFTKDA

SEQ ID NO: 35532 - protein, 178 aa, Sorghum bicolor
  Clone ID: SORBI-28MAY03-C68639_1.pep
MADQWWESTSHRSHGASACSAAAPPPLTVTGGRVACGWTSPTAAAAESTSSVTFQDPYRSSTHQQPLSDAASSLGDPHMDWTQAFLSGRSDTSFQAVLQEQPPAMNDPLIRDGDMSAGSFLVDQQAQLSPSPSPYGTDPSQAQALFDGTAAVHNISMYGDSESSVTYDATAASMQFSS

SEQ ID NO: 35533 - protein, 123 aa, Sorghum bicolor
  unsure (1)..(123): unsure at all Xaa locations
  Clone ID: SORBI-28MAY03-C6864_1.pep
MKDPESLNMSKKSPRSASKLASTLRSLSFKRKDELPEDCEQLQQQSEDDPYQTLETAYVAHVSLSWEALHCTYVHLSLIVAAQPDNXTTYSSAVKLXQHRPVLDRGFVENEPFEHGTPVEIYA

SEQ ID NO: 35534 - protein, 174 aa, Sorghum bicolor
  unsure (1)..(174): unsure at all Xaa locations
  Clone ID: SORBI-28MAY03-C68644_1.pep
VGLQVNFLSVYIASSFCLKPQDQCSSIMRTCNYISAAVASPPPLRQWPGGISWQRSSRLQCSATPTRHGDLDKKGDNRLRQTTGIFQPSIWGDVFLDYSNPAAASSQQQVCSFTDVLYYFRFLFSLSLSIHTHTHTHTHTHTHTHTHTLFSADSDAGTSGQTEGRSGKHDXKFN

SEQ ID NO: 35535 - protein, 104 aa, Sorghum bicolor
  Clone ID: SORBI-28MAY03-C68707_1.pep
IVHYSYRFVFITKGLVINYFEDRSCYIIYLSPVYSWRLETHRNSSPKKKGLEELPSEKTEGSLYIVQYEVATVQCLIGPQTMLTGEMEVILPVMVSLSYSLSRR

SEQ ID NO: 35536 - protein, 123 aa, Sorghum bicolor
  Clone ID: SORBI-28MAY03-C6872_1.pep
MALSVSSLAAALSHLSLPSTSTSKPHPAPLLRLRSTSRRAVSLALRASAAEAAEPSEADLPVEEVVAVEEEAEEDALSGIALRKYVKQRLPGGFAAQRITATGRRKTAIARVVLQEGTGRSSS

SEQ ID NO: 35537 - protein, 191 aa, Sorghum bicolor
  Clone ID: SORBI-28MAY03-C69063_1.pep
MQADQEKDVSPVAVDIQVKEETSDIEPTLVPHPIRKQANSSNLQASLTLFKSFIGTGLLALPYAYRTAGVTLSIIMTVIISSMLGYCFLLLLETANDKVGKGRTSFPKLARDILGVKGKYIVQTFLLIEQLCCCIGIIIFTKDFLNHILCSFEIDSLCGNTAFNLFFSLALTVPLSLINNMHYFYIPSMAA

SEQ ID NO: 35538 - protein, 201 aa, Sorghum bicolor
  Clone ID: SORBI-28MAY03-C69066_1.pep
MTTVSRALGSAFAGFTRAPAAAQTATTLPSPCGSSALLQHWRWSRASRARRFSSGRSARISMSLRAGIVGLPNVGKSTLFNAIVENGKAQAANFPFCTINPNVGVVAIPDPRLQVLSKLSKSQQTGPTSIELVDIAGLVKGASKGEGLGNQFLSNIREVDSILQVVRCFEDDDIVHVNGKVDPRSDIDVINLELIFSDLEQ

SEQ ID NO: 35539 - protein, 203 aa, Sorghum bicolor
  Clone ID: SORBI-28MAY03-C69073_1.pep
MGHSYLQLLFFLLVFITFNSSFHQSMAQTDAGELATLLTIKKDWGNPSALSSWSSQNASSYCSWAGVVRCVNGQVSALSFQKLNIINPVPASICNLKNLSHLDLSYNNLTGQFPTALYGCSALQFLDLSNNHFSGALPADIDKKLSSPATAMEHPNLSSNGFTGSVPLAIAGFPKLKSLLLDTNSFNGSYPGAAIGDLTQLET

SEQ ID NO: 35540 - protein, 171 aa, Sorghum bicolor
  Clone ID: SORBI-28MAY03-C69076_1.pep
MGDSSEKNGHGTLTRVLFCGPYWPASTNYTKEYLQDYPFIQVDEVGLEQVPDVIDNYHICVVKNRRIDSDIIAKATQMKIIMQYGVGLEGVDVNAATEHKIKVARIPGSTTGNAVSCAEMAIYLALGVLRKQKEMDTAVNRKDLGIPVGDTLFGKTVLILGFGAIGVELAK

SEQ ID NO: 35541 - protein, 171 aa, Sorghum bicolor
  Clone ID: SORBI-28MAY03-C69089_1.pep
DPRRLPLMAPTAHQVGTNACNANHICHSTMHAWLSRRGEVYCLLVHQQAAREELLEENKSHRRKDNTVVVVVGNNKQSAAALVRCHPALADHPDRKASIRGVVGELLSMAGSAASGGRSLISLGVGDASCHACFRRGGEFAAEAVADVARSGAFDCYAPSHGFPAARRAVG

SEQ ID NO: 35542 - protein, 137 aa, Sorghum bicolor
  Clone ID: SORBI-28MAY03-C6910_1.pep
MSTTTEAAAKSGTAAPVRCQRIGCDAVFTDDDNPEGSCQYHPSAPMFHDGMKEWSCCKQRSHDFSLFLQIPGCTTGKHTTEKPITKAVSTNNPIKATPIQASKQGVGVEACARCRQGFFCSDHGSQPKPQKPSATDD

SEQ ID NO: 35543 - protein, 183 aa, Sorghum bicolor
  Clone ID: SORBI-28MAY03-C68862_1.pep
YVMMISIVDNQAAILMSAEGTNVWSGAQVQQFNTLAIAWSIAPKMFSIGARYEWVTIAYLIGFAAPLPFYIAHKFFPHIRIFSYLNIPIILWYLGYLFVGLNASVTSYFILGAFGQFYLRRYRPEWFVKWNYLISAALDGGTQVMVFIATFAVFGGSGKAVAFPEWAGNKVNNYDYCAFNANS

SEQ ID NO: 35544 - protein, 91 aa, Sorghum bicolor
  Clone ID: SORBI-28MAY03-C68867_1.pep
LVGEDLNGCAFVYGSLSFVDKVSCGVALYVLESYQGSTKIRSNLGTVFGYSVTRLGLGLVPAVCSLLSAIVAYTMDLPDTRRRPLVEPLLA

SEQ ID NO: 35545 - protein, 140 aa, Sorghum bicolor
  Clone ID: SORBI-28MAY03-C68872_1.pep
GRDEDIDLVIPPVFKGCTKVLNADDQKVPRDLYWEAVCSGDEASDWLKVEELLQQSIAKNPFVGEPHLVLAQVYLNMERYGDAQMQAEEGLKLLLEWGSSWDKRMTWEGWVSWGRAMLTKASEKDWPHTAFGIINLGLVK

SEQ ID NO: 35546 - protein, 138 aa, Sorghum bicolor
  Clone ID: SORBI-28MAY03-C68884_1.pep
VLPVDYITADKFDKDANTGYATDKDGIPDGWQGLDCGEESVKLYKEAIAEAQTILWNGPAGVFEFEKFASGTKATLDAVVDAVQKDGKIVIIGGGDTATVAKKYGVEDKLSHVSTGGGASLELLEGKELPGVTALSSK

SEQ ID NO: 35547 - protein, 151 aa, Sorghum bicolor
  Clone ID: SORBI-28MAY03-C69322_1.pep
DESDKLHEELITIEEDLYASLGLHFKTLDMATGDLGAPAYRKFDIEAWMPGLERYGEISSASNCTDYQSRRLGIRYRPSPSEPPSTNTKKGKGAGSGPTRFVHTLNATAVAVPRLIVCILENFQQDDGSIVVPEPLRPYMGGLEVISPKFE

SEQ ID NO: 35548 - protein, 267 aa, Sorghum bicolor
  unsure (1)..(267): unsure at all Xaa locations
  Clone ID: SORBI-28MAY03-C69304_1.pep
PAVQSNVAKLIMRNKPLSHGIPRFTIPLHCDGLVLIPSITGHIFVCNPATKEFVELPXGTRNVLLEQRVAFGFDPSSGTYKVARHFLRSYSEGXIRTEFDVGHEVLMLGDGRDTLEWKATIDPPYPIQARTPICLPGFFYWSAVQSVADPDQGKLDIDVILRFSMCAVPFTVRPCPPGSCCLSTDVGVWEAGGKLCYVHSLSPFEVSIWLAQNGQNIIKWSLRCRVNLPIPRGARVLACASADEDTIFLSVDARDLFKCNLHDVLKQ

SEQ ID NO: 35549 - protein, 141 aa, Sorghum bicolor
  Clone ID: SORBI-28MAY03-C6935_1.pep
WFGSKAAQKVQMPLTAVTSVIDGLKRLYVEKLKPLEVAYRYNDFASPLLTNSDFDAKPMVMLLGQYSTGKTTFIKHLLKTSYPGAHVGPEPTTDRFVVVMSGSDGRTIPGNTIAVQADMPFTGLTTFGGAILSKFECSQMP

SEQ ID NO: 35550 - protein, 124 aa, Sorghum bicolor
  Clone ID: SORBI-28MAY03-C69351_1.pep
MSSRYRADRGRAASDMTRKLRELLQKSDNRICADCSAPDPKWASANIGVFICLKCSGVHRSLGTHVSKVLSVTLDQWADDEINSMIEVGGNSYANAIYEAFLPEGYHKPHPDSSQEERADFIRS

SEQ ID NO: 35551 - protein, 219 aa, Sorghum bicolor
  Clone ID: SORBI-28MAY03-C69354_1.pep
WKLIVSCRVADAVSSGRALPSSTSSQQTPPPAARDPAIPPPLSSGSRGAFYRSSPCPPPPPHPPPTTPTTAPASAPAPRRCSSSSSSPSSPSPSSSAAARASPRPRAGPALPPSPPPPPPPPPSPAPTTAWRTARSCWTRPSPRGCRGRARCRFRSPRATRCLHATGTASRRSPMATSRSCSTCTTGPATFASSSTASPASRASARRCSSSATTATSRR

SEQ ID NO: 35552 - protein, 198 aa, Sorghum bicolor
  Clone ID: SORBI-28MAY03-C69375_1.pep
TPTKPKPKPTAPPRNPASSFDAIPAAIASASTTTRSPVPACVRAISPLAAGMAGGGAGARGSDRAGAGAARSPTTTAAIQTTIQSIKEVVGGHSDADILDTLRESNMDPNETAQKLLNQDPFHEVKRKRDKKKESAGQKSFADSTAQVEQSSQWMKPHTQRMENDQRRTPNQGQNSGPSREFRVVRDNRFQHGCGGEQ

SEQ ID NO: 35553 - protein, 189 aa, Sorghum bicolor
  unsure (1)..(189): unsure at all Xaa locations
  Clone ID: SORBI-28MAY03-C69365_1.pep
GSISTGCGKGARAAPGSPSEGCTSRPGAGGGGAGNTAPPAGAAGAGTGTTSPAAAGAGGAGAATAGGGGAGAGRRVERPAAACPAGGAVGALAAGDGEPDAAGDDRAAAAGGGGAAASGGGGRAAEGRRAGGAAGATPAGXGGGRPGRRGRGARRGRARPGRRGRRARGGGGGRPLSGGGGRPAGSREG

SEQ ID NO: 35554 - protein, 218 aa, Sorghum bicolor
  unsure (1)..(218): unsure at all Xaa locations
  Clone ID: SORBI-28MAY03-C72774_1.pep
MNFLYRTTQPAAPELPRRSHLHQHRDALQKPTTTLEGLIADDSYQPSSARSEDGVANNGSRDTSGDPSSLDSKSLVPLGTHSDVTEDEGWITIPCKALPESWNGISEMVQLQTLDRSFLFPGEQVHILACLSXSKQDVQGISPFRIAAVMSKNGNSLQNSTNKSSPVSANGHDNGAAGESGYQDVELNGEASPTEHDILETQSLLQMEDRKQQIEHVL

SEQ ID NO: 35555 - protein, 158 aa, Sorghum bicolor
  Clone ID: SORBI-28MAY03-C7282_1.pep
HEGPLVSSLKPEKKEQLVELLDAKAGDLILFALGEQSSANRILGRLRLFIAHKLEVIDTSAHSVLWVTDFPMFEWNSDEQRYEALHHPFTAPNPEDMNDLPSARALAYDMIYNGVEIGGGSLRIYKSDVQQRIFEIIGISPEQAEEKFGYLLECFDMG

SEQ ID NO: 35556 - protein, 126 aa, Sorghum bicolor
  Clone ID: SORBI-28MAY03-C72826_1.pep
MEGSRAGAGDYIASLLSSSPRLDFGVLGAADGGGEEEDCLDKFCGDPGFAARAARLSSFSAQRFPGAASLFGLPPPVPAASGGGEFAGSREASSVSDPASAMMKDANAKKRKAPPAAKGKGKESSV

SEQ ID NO: 35557 - protein, 160 aa, Sorghum bicolor
  Clone ID: SORBI-28MAY03-C72843_1.pep
METKKQKKQHARSRSFTGGGLASFLKSTVASFSSTFPSSSGGGGGRRASFNHRNAFSGPIVSIVPPEARGGGRRNKRSSGYVTPEPSSPKVSCIGQIKRSNSRRQKKVNPCGKNGGACPLPPRPSVSADGKPCRPPRGSLVKRLSFFRRSRSRSRTSRAS

SEQ ID NO: 35558 - protein, 54 aa, Sorghum bicolor
  Clone ID: SORBI-28MAY03-C69613_1.pep
SCTLFFFLGKDPVKEHSDKFIHGFDPRILYETFDPRICQYIRSYQSTVSLFTDG

SEQ ID NO: 35559 - protein, 82 aa, Sorghum bicolor
  Clone ID: SORBI-28MAY03-C69722_1.pep
HRYMCTNRSNELTLKKKNSVDHKRIRQDNRTRRYIEALKFSKLRNKPIIINSPFMYLPDMYSLSSSVLTTKISINKVCKRSN

SEQ ID NO: 35560 - protein, 116 aa, Sorghum bicolor
  Clone ID: SORBI-28MAY03-C69732_1.pep
GKVIPELKGKLTGMSFRVPTLDVSVVDLTVKLEKGATYEEICKTVKEASEGELKGILGYTDEEVVSQDFVGDGRSSIFDAKAGISLNPNFVKLVAWYDNEWGYSNRLLDLALHVTK

SEQ ID NO: 35561 - protein, 119 aa, Sorghum bicolor
  Clone ID: SORBI-28MAY03-C69745_1.pep
QHWIQDKRPGNWMKDLEGYPAFVLVNRVTGDAIDASVARGNPLKLKAYNPCYLDKSILWTKSRDMGGGFRCIHMLCNLSLNFNVLKLKVDGEQDGTKLVLSYWSMESDNLQLQWKIVPW

SEQ ID NO: 35562 - protein, 165 aa, Sorghum bicolor
  Clone ID: SORBI-28MAY03-C69145_1.pep
PSPPSTLPSRTPTLVTATQSPTPGALAPCPGAACPPPAQPPTPSPSGPGSSPCACSAAWTPPAALAARGASPVSRLPPPSAVPCASPSFVPASPFPSAVPVPAPPCAACPARARPPSTLYVTLLLSTGLPVRHIGLYIGLHLIWCVVIPESKLESAYDPALMQHV

SEQ ID NO: 35563 - protein, 182 aa, Sorghum bicolor
  Clone ID: SORBI-28MAY03-C69118_1.pep
TRPPACGTALHPIPKPGAEAQNPLSAAAPAPWAAPPSCSPPSSSPPPRSASDPPLLPPPPRSSSPRPRRPRAACSCSPRPPRPAPSPPRPLLPRPPPFRTAPARTPRRHRPELLSPSGPASSTDLPLPGTAPARPFLMTSLPSRPDAVCRTGRKPLSPPASPSRLTGLDSSVRFQGRMWRSW

SEQ ID NO: 35564 - protein, 247 aa, Sorghum bicolor
  Clone ID: SORBI-28MAY03-C6915_1.pep
GRVGQNGHSKGYGFVRFSKREYANTAKRQKNGIELQGKRLDVDLSMDQDTVFFGNLCKEWTSEEFEELIHKTFKDVVSVDLAMASNRSFSNKRNINRCFAFVRFTSHAAAARVIRIGSRTDFMLGDLHPAINWADKESHVDPDEMAKIKSAFVGNLPEDVNEEYLRKLFEQFGEVVRVAISRKGQCPVGFVHFANRSELENAIEEMDGKTVRGPDRGPSFRIQVSVARPAADNDKKRSREEVRTRRS

SEQ ID NO: 35565 - protein, 174 aa, Sorghum bicolor
  Clone ID: SORBI-28MAY03-C69261_1.pep
MIATPMHFIPSSTIQKCLEIWRTYSHVPRIHLGMKLFGIKCLNLVSKEKISRKFNVDTGLIVKEVSAESNAEKLGVRMGDIILSVNGEDIATAVELENKLLDISKAHLEQGIVPDSGVDVLLALGVFNATKCARGRILLRARLSNDEEIIEEGKYPVIYKRPNVAAPDVSFSSG

SEQ ID NO: 35566 - protein, 191 aa, Sorghum bicolor
  Clone ID: SORBI-28MAY03-C69303_1.pep
MSGMQIFVKTLTGKTITLDVESSDTIETVKQKIQDKEGIPPDQQRLIFAGKQLEDGRTLPDYNIQKESTLHLVLRLRGGSGMQIFVKTLTGKTITLDVESSDTIETVKQKIQDKEGIPPDQQRLIFAGKQLEDGRTLADYNIQKESTLHLVLRLRGGSGALLFLRPSSAHPCALLCRVLLAWLTALQISSF

SEQ ID NO: 35567 - protein, 245 aa, Sorghum bicolor
  Clone ID: SORBI-28MAY03-C69821_1.pep
EAAEFAVLESSNGKSFDNDYILSVASGITNGKPSNNGASSLIEEKEREVSVATVDTRASASSSNGKVQVGSQKSAAKNGTPYLERSKSDNVDGNMCASSTGVVRLQSRRKAEMFLVRTDGFSCTREKVTESSLAFTHPSTQQQMLMWKSPPKTVLLLKKLGDELMEEAKEVASFLHHQEKMNVLVEPDVHDTFARIPGYGFVQTFYSQDTSDLHERVDFVTCLGGDGLILHASNLFRTSVPPVVS

SEQ ID NO: 35568 - protein, 148 aa, Sorghum bicolor
  Clone ID: SORBI-28MAY03-C69839_1.pep
TVNVRKPAKAKDGYYGNVFAFGLAASTLREVADGDILALVRLVKDAKARVPYTFADGAAYIADEMGGRLKGLDGYDTLYVTSWWNLGLDDVDFGSGGAERVIGNMERKVVPGCILCGRKDKADGVAAMALCVKQEHVETFHAELQSLK

SEQ ID NO: 35569 - protein, 89 aa, Sorghum bicolor
  unsure (1)..(89): unsure at all Xaa locations
  Clone ID: SORBI-28MAY03-C6984_1.pep
PTRPNEVSAAEKELLDEITDLEKQRDELEAQLKKVNISLNAAAGRLKQTREERDQFDEXNNQIIFSLKKKEAYLSCSIGLCYDWKSGLE

SEQ ID NO: 35570 - protein, 61 aa, Sorghum bicolor
  Clone ID: SORBI-28MAY03-C69843_1.pep
RPDGQWTGERGYVQNVFSRMKNIVNPSSVGAILCGHKQMTEEITRVLVADGLSKDRILTNF

SEQ ID NO: 35571 - protein, 155 aa, Sorghum bicolor
  Clone ID: SORBI-28MAY03-C7000_1.pep
MGGLGGAGGGGGGGEVGLPALDVALAFPQATPASLFPPAVSDYYQLDDLLTNEEKVLRKKVQGVMEKEIAPIMTEYWEKAEFPFHVIPKLATLGLAGGTTKGYGCPGLSLTATAISTAEVARVDASCSTFILAHASLVVPTIALCGSESQKQQYL

SEQ ID NO: 35572 - protein, 74 aa, Sorghum bicolor
  unsure (1)..(74): unsure at all Xaa locations
  Clone ID: SORBI-28MAY03-C6987_1.pep
LFVNLKGTCACLFFFXKKRTLFNIYASPIRTSEAAKDLELYWLGADILVLCITVMFDKALDSSHHSTRRVTGKM

SEQ ID NO: 35573 - protein, 151 aa, Sorghum bicolor
  Clone ID: SORBI-28MAY03-C69415_1.pep
MLAAARPASAHLLLLVPLPSPPRLSRPAPTRRLYALAPARRPAAVRARRESSPPAAPAPADSLDCVGTGSDVECLIDAGAKDAASPLLPARSPAAPGASKDDGKKSEGDAAAVSASLLWEWASLVSPFFFWGTAMVAMKGGIPRTGPFFVA

SEQ ID NO: 35574 - protein, 157 aa, Sorghum bicolor
  Clone ID: SORBI-28MAY03-C69472_1.pep
LSHIIGEKGVLCISILASIAYALLYGVAWASWVPYFSSSLGIIYVLAKPAIYAIISGEVLSTDQGKAQGFIATVQSVAILLAPLFMSPPTSYFISEEAPFDCKGFSFIVASFFLVISFCLAWMLNPGNKDKGTKSVVSDSPDEEAAQAPLLAKWPRP

SEQ ID NO: 35575 - protein, 128 aa, Sorghum bicolor
  Clone ID: SORBI-28MAY03-C69529_1.pep
METTSTTNGQPGRGAMWELERNLDQPMDAEAGRLRNMYREKTYPTIVLLQLAFQSLGVVFGDLGTSPLYVFYNIFPREIEDTEQVIGALSLIIYSLTLIPLVKYVFIVLRANDNGQGGTFALYSLLCR

SEQ ID NO: 35576 - protein, 187 aa, Sorghum bicolor
  Clone ID: SORBI-28MAY03-C69557_1.pep
PRARDRGGAPPRRPPPPPPPAALSPLRDMADSPRRRYSRSPSYSRGHPKARSRSQSPARSQSRSPVPDPRSQARSRSRSHEREEDAVNRGNTLYVTGLSSRVTERDVKDYFSKHGKVVGCHVVLEPHTRVSRGFAFVTMDTVEEAERCIKYLNDSVMEGRNITVEKSRRGRPCPPTKMLSSPIPTLA

SEQ ID NO: 35577 - protein, 77 aa, Sorghum bicolor
  Clone ID: SORBI-28MAY03-C70192_1.pep
MCPIKKEMTGESSSPCSSASTSSEHHQTVWTSRPKRPAGRTKFRETRHPVFRGVRRRGNAGRWVCEVRVPGRRGCRL

SEQ ID NO: 35578 - protein, 133 aa, Sorghum bicolor
  Clone ID: SORBI-28MAY03-C70201_1.pep
LATKVCSSWMASAADWHLMAGVVKWKPASYEQMEHTRVAAERLSFRSNSAKYHDTGHLGHFGKDDNLICRSLKSISKPKARQYVIAKVHNKDVDEGCSSKDDEIISSPFQREEGNQLRALESYFSKLYPTQQL

SEQ ID NO: 35579 - protein, 151 aa, Sorghum bicolor
  Clone ID: SORBI-28MAY03-C70214_1.pep
MGERRRLPAGAGACLLAVAMVLQAAAVVGDGGGLLDPRQLEKFVDELPDMPRLRGYGVTDGGALVAGNLTIGMYDTTWKFHRDLPATRVFAYGTSKETATVPGPTIVAMRGVPTHVTWANHLPERHFLPWDPTLTTARAPDGRGIPTVVHL

SEQ ID NO: 35580 - protein, 83 aa, Sorghum bicolor
  Clone ID: SORBI-28MAY03-C70266_1.pep
NPLRELGIHGHAFVCAGNLGKLTECDLRKFPVTDFVQTFRSSAGFGVVVPPRLFRIEMNYCYILNQLDHDKGKTGIQFNFSSP

SEQ ID NO: 35581 - protein, 69 aa, Sorghum bicolor
  Clone ID: SORBI-28MAY03-C70293_1.pep
ISVLPMNFMSFSAALVEGMHTLCHVDMSFRIQMMLSQDFNGFSSQDTEIYASVVCGSTTLNLKMLRYKQ

SEQ ID NO: 35582 - protein, 97 aa, Sorghum bicolor
  Clone ID: SORBI-28MAY03-C703_1.pep
ASAQRPPAVRTDPGTLNALGKDVGTQYRAGIYYYTAEQEKLARASLAEQQKKWEDKIVTEILLAKRFYPAEEYHQRYLEKGGQSAEKGCTEPMRCYG

SEQ ID NO: 35583 - protein, 80 aa, Sorghum bicolor
  Clone ID: SORBI-28MAY03-C69750_1.pep
LPEIKSFRARSRFRRIIEKIKLQARIEKLKAMEEDPENSDLSAIFSEVARAKLADDKEEKEVLRVTQEVEKDVKRRSFQA

SEQ ID NO: 35584 - protein, 207 aa, Sorghum bicolor
  Clone ID: SORBI-28MAY03-C69794_1.pep
MAEQLILKGTLEGHNGWVTSLATSMENPNMLLSASRDKTLIIWNLTRDETQYGYPKRSLHGHSHIVSDCVISSDGAYALSASWDKTLRLWELASGTTTRRFVGHTNDVLSVSFSADNRQIVSGSRDRTIKLWNTLGDCKYTITEKGHTEWASCVRFSPNPQNPVIVSAGWDKLVKVWELSTCKLQTDHIGHTGYINTVTISPDGSLC

SEQ ID NO: 35585 - protein, 147 aa, Sorghum bicolor
  Clone ID: SORBI-28MAY03-C69787_1.pep
MTTTTSSKATGPWSRLSAAEAAVNRAVAGSRVGAYFKLDARKSTFTKELRAGAATFLTMAYIISVNAAVLTDSGGPCTARDCTPVPTANSTVVVPPGPECTVVGANPGYQQCLARTKSDLIVATAVAAMAGSFAMGVFANLPLALAP

SEQ ID NO: 35586 - protein, 108 aa, Sorghum bicolor
  Clone ID: SORBI-28MAY03-C69808_1.pep
MADKGLEDVPEGQIESNYDETVDSFDDMNLKSELLRGVYAYGFERPSAIQQRAIMPVIKGHDVIAQAQSGTGKTATFSISVLQKIDTNVKQCQALILAPTRELAQQIQ

SEQ ID NO: 35587 - protein, 161 aa, Sorghum bicolor
  Clone ID: SORBI-28MAY03-C69820_1.pep
RQTRSCLRFPSSLPSPKPKRVAFYPAKTAAMSFAGMLNRLHGQPESYDKKAKYRFGRTLGAGTYGVVREADGPTGKVAVKIILKRNVKGNEQMVYDELEMLQKLKHPHIVKFVDWFESRDKFYIVTQLATGGELFDRICEQGKFTEKDAAETIKQILLAVD

SEQ ID NO: 35588 - protein, 206 aa, Sorghum bicolor
  unsure (1)..(206): unsure at all Xaa locations
  Clone ID: SORBI-28MAY03-C69546_1.pep
MAYTSSLHLPKHLLLPSPRRTRHRRPSSFVPVSAAANKINGGVNGHHAPEKPALPNGKAPQHINGHVNGHGKKGVNGHVNGRHAGNNRIHLXSVSTGGGGGQDGSGLRVAFQGAPGAYSEFAAKTALPGCETVPCRAFADALAAVERGAADRAVLPVESTMEGTALRNYDLLLRHGLVVVXEINLFVHYCLLAMPGVRAAEVRRVI

SEQ ID NO: 35589 - protein, 168 aa, Sorghum bicolor
  Clone ID: SORBI-28MAY03-C7043_1.pep
ARGVLEVLLINFPRGVLYGCGDLIFSSHMIFTLVFVRTYHKYGSKRFIKFLAWFMAIIQSLLIIASRKHYSVDVVVAWYTVNLVVFFVDNKLPEMPDRTSGLPLLPLSSKDKEARQKEEKDSKLKDEFHKLLNGNHVDATDRRQRAQMNGRHDEDINHALSEATANGT

SEQ ID NO: 35590 - protein, 167 aa, Sorghum bicolor
  Clone ID: SORBI-28MAY03-C70459_1.pep
MAHAQEIQLQIRGTPDKESVHEDAGDEPKADTRWSTRVSFRWWMTVVVDMLMVLCGTTVATLLGRLYYNSGGNSKWMATLTQSGGSPLLAVPLLMTPASSADERRPPASKMLAVYAGVGVMIGFDNLMYSYALQYLPVSTFSLVAATQLGFNAITSRLINAQRFTAL

SEQ ID NO: 35591 - protein, 115 aa, Sorghum bicolor
  Clone ID: SORBI-28MAY03-C70465_1.pep
RRRWWTRRTRTQTRRCSPWATRGCRGRRASPSSSSSSPSSRPRRRRRPRPTGTRAGTTASASRAPPPARPGRARRRRRRRRRRNRSSPVRRRRRRARACATAGSSRRGPRHGESR

SEQ ID NO: 35592 - protein, 176 aa, Sorghum bicolor
  Clone ID: SORBI-28MAY03-C70481_1.pep
MQAAAAVRHPRLFSPSPGRAARHRRAPSTVRMALREDGPSVAIVGATGAVGQEFLRVITDRDFPYRSLRLLASERSAGKRLAFEDREYTVQDLAAPGAFDGVDIALFSAGGSVSRKYGPAAVASGAVVVDNSSAFRMDPEVPLVIPEVNPEAMGNVRLGQGAIVANPNCSTIICLM

SEQ ID NO: 35593 - protein, 95 aa, Sorghum bicolor
  Clone ID: SORBI-28MAY03-C70537_1.pep
EGKMAEARKKEMAQEKPTEQQQEEEAMPRADSMGMAALQRRPASGSRGLLVNVAVAVAVLLGITVYVWHSLKNATGGAGEHGHGHLGAGSYRDEM

SEQ ID NO: 35594 - protein, 96 aa, Sorghum bicolor
  Clone ID: SORBI-28MAY03-C70495_1.pep
GLSVQVQVVRIFTDMSISPSLSPRQCPDRYAFRAGRNLPDKEFRYLRTVIVTAAVHRGFGRRLPCHQFTNFLDLPALGRRQPPYMVLRLCGDLCFW

SEQ ID NO: 35595 - protein, 158 aa, Sorghum bicolor
  Clone ID: SORBI-28MAY03-C70032_1.pep
MASAPLASSLLCSSSASTSRSAAMPRVIRIPIFSKNQYRPPLRPLRRVVRRSLQQEQEQRASPVSVASGEQQEEATASHHVGGVDEAKASGHVGEADKGGQGEGDGEEKRSTDEQQEVDWKSDEEFKKFMGNPSIEGAIKLEKKRAERKLRELDREPD

SEQ ID NO: 35596 - protein, 113 aa, Sorghum bicolor
  Clone ID: SORBI-28MAY03-C70116_1.pep
LEQRSLRRVDEFRDCMKRRNDTRACGLARHLAGGRRHVVPRQERGWKNVFKVRPSAVTKFLVRFKPLTDAAASASPEESRFPFDVTTGPGYVYHCHILDHEDNEMMRPMKIVR

SEQ ID NO: 35597 - protein, 128 aa, Sorghum bicolor
  unsure (1)..(128): unsure at all Xaa locations
  Clone ID: SORBI-28MAY03-C70152_1.pep
GDLNYRLEGISSMPARKMIEENRQSKLRGKDQLLQEAEKGEVFNGYCEGTLSFKPTYKYDVGSSIYDTSSKIRVPSWTDRILFKVGHSSGLDAVLSSYESLDCVGSSDHXKPVKAHLCLRVRSDGDAD

SEQ ID NO: 35598 - protein, 178 aa, Sorghum bicolor
  Clone ID: SORBI-28MAY03-C70183_1.pep
MAASPALLSLTPAVSRHPHLLFSPCPPPRHVRLAPPLAAATPSPGGNGPGPGPGVFLSPRALSQLDELAAFRYEHAFPHGLLTVRALTRGPDDDAVAEALVRLLASSFSETVRWAPAQRYAQLLTFVIRRYLHDRRGLAPHAAVLVGFYRPADAGSDDSAASEEGGRDDEGGEGEGGD

SEQ ID NO: 35599 - protein, 225 aa, Sorghum bicolor
  Clone ID: SORBI-28MAY03-C70648_1.pep
HEPPTSSHILSHRPTAIRPQRPIPAIFEKRKPTLADPNRPWRRRLFRHSASSSRPPPPPRHSRRGRRAGPGPRPPPAAPARPASRQRPRRRRRPSQRTAASSAIWLDGTAGTTTSAGSPRAAADRSTTAVVDKLRAVAEAAADRAEMHDIIGRQRDNWNHLLLHSTNSLTLAASVMAALAPAAPVTMAAVNRIQPSQLAEEQRNATRLWRQLERDVRATLELRRD

SEQ ID NO: 35600 - protein, 124 aa, Sorghum bicolor
  Clone ID: SORBI-28MAY03-C7065_1.pep
LEGGAQQGLMTNRTVEKEHPHALLILTNCFIRVVSFAIQPPTRFTAVKRANCKKVLPTPHPSMRSIMLHLAIKAYNDCLSCRASQLYPALHFLEKRWWLFTHQNFTKTVNNMFICNSLEVCICI

SEQ ID NO: 35601 - protein, 185 aa, Sorghum bicolor
  Clone ID: SORBI-28MAY03-C70664_1.pep
MGSTSTTTTSSSSSATRGGGAHVLLLPYPGAQGHTNPLLEFGRRLAYHGFHPTLVTSRYVLSTTPPPGEPFRVAAISDGLDDGGAAACSDVEVYWRQLEAVGSETLAELIRSEAAEGRPVRVLVYDPHLPWARRVAKAAGVPTAAFLSQPCAVDVVYGEVWAGRLPLPVVDGKELFARGLLGVEL

SEQ ID NO: 35602 - protein, 203 aa, Sorghum bicolor
  Clone ID: SORBI-28MAY03-C70704_1.pep
DPKNMNAPLIEPTGIDNNSGIIMPFYDADTGVLFLAGKGDGNIRYYEYIEDQIHYLTEYKSNVPCQGMASLAKRCVDVNTNEIVRLYKATATVVEPISFKVPRKSDLFQDDLFPDCPSAEPALSAGEWSSGKTAAPKLTSLKPGFVQKETKASASFNPVKQEASGPQSEAELRAEYEKLKARVAYLEAEVIKKDARIKELENK

SEQ ID NO: 35603 - protein, 194 aa, Sorghum bicolor
  Clone ID: SORBI-28MAY03-C70762_1.pep
GQRRATPPECRSQQSRGEPRRQRGWEAPEQEASQARRPQGRRGAAHNRGRRSPAETHQPSPWMQRRPVGARPQAQGRRQRPRGGPPWQRRAAGHSGAEASHPTRQPCVRPREERMSPNQARPRRCPLFLLLVAAQERIRYGRIGLVASAPSGSPPHTQERERGRWGERERARGRDEFFFAFPPSVSSRKAATEP

SEQ ID NO: 35604 - protein, 96 aa, Sorghum bicolor
  Clone ID: SORBI-28MAY03-C70728_1.pep
EKINNGLSVVNEKVKSVDQRLQVSDKTMAALLAAERKLNDTGSAVKTNRYVSAGTSWLNGAFSKVAKAGHVAGSRTREKFQLAVSNLTAKGPAVVA

SEQ ID NO: 35605 - protein, 159 aa, Sorghum bicolor
  Clone ID: SORBI-28MAY03-C70313_1.pep
IQQPWPPRRRARAASLTPSPSPRPSSSTCPRRPAPMATARPRPHQTTSSSPSSRGSSWRRTSTTNSSTSFPTTPCSSKPRNRTRRSSLTQPRLAPTALPRARAPPPPSRRPPPPTQPSSSCPRRTPMRDCTTSPTTMSAPSSCPHKVVAARSSSRVRRN

SEQ ID NO: 35606 - protein, 160 aa, Sorghum bicolor
  unsure (1)..(160): unsure at all Xaa locations
  Clone ID: SORBI-28MAY03-C70345_1.pep
LHSSKRPPPHTSARPAKTPPTSKPYLAPPPPARHVRRVRGGGGSSLPRRLILALHPRPPPPPPPPPASSTPALPPAIARGLPRPRRPRGPRAPAGRGGRQALRAPRERQRARVRRXPPSKPTSGATATGAPAVXRGGGGAEAREQRGRGPGPGPGPAGGG

SEQ ID NO: 35607 - protein, 157 aa, Sorghum bicolor
  Clone ID: SORBI-28MAY03-C70359_1.pep
MSEVSVINQAEVEDAGAAGQLDLPPGFRFHPTDEEIISHYLTHKALNHRFISGVIGEVDLNKCEPWDLPGRAKMGEKEWYFFCHKDRKYPTGTRTNRATETGYWKATGKDKEIFRGRGILVGMKKTLVFYRGRAPRGEKTGWVMHEFRLEGKLPQPL

SEQ ID NO: 35608 - protein, 260 aa, Sorghum bicolor
  Clone ID: SORBI-28MAY03-C7037_1.pep
MADTASSSSAAGPSPVDAASLAAVAEAAPPEEMTLVVKWRGQEQTVRMVGDDTLGELKLRICEVTGVLPKRQTLLYPKLILKDIDDSTLLSSIPFKPNGKISMIGTIEEEIFVGQEDDPELLDDFDFEQNEATAIKDKDVYKQKLKRRASQYKIKLLNPCRKGKKLLVLDIDYTLFDHKSTAENPMELMRPYLHQFLTAAYSKYDIMIWSATSMKWVELKMEQLGVLGNPDYKITALMDHLAMITVQSENQSRKKTFDCK

SEQ ID NO: 35609 - protein, 166 aa, Sorghum bicolor
  Clone ID: SORBI-28MAY03-C70438_1.pep
LILSLFELSFEKVIRVRTARWVLRMQMYTNLVASVVSVVGLLASGDWRTIPGEMASFKDGRARYVLTLVGTAVSWQAAAVGVVRLIMRVSSLFANVTCTLALPLVPVFAVVLFGDKMTGIKVVAMLMAVWGFLSYMYQHYTDGRRAGNAECRVCATRTASDTLLPA

SEQ ID NO: 35610 - protein, 108 aa, Sorghum bicolor
  Clone ID: SORBI-28MAY03-C70831_1.pep
MEEMGKRVVRTVRVRNISDLATEREVREFFSFSGEIEHVDIRFDTGASGRTAYVTFKDPKALEIALLLPGATIVDQIVNITPAEDYIYIPVTEQQLMVHEVTSTSSAP

SEQ ID NO: 35611 - protein, 103 aa, Sorghum bicolor
  Clone ID: SORBI-28MAY03-C70828_1.pep
MSLPAISLYTSPPGAVYSSEFDPTSRGSSPSTTAAPPPPAASHRLPSGGGGLSCLFSSPAAAAAPPRAPAHDDLGALWHDRSDDLSVAGGGYSYSHSHSSSPL

SEQ ID NO: 35612 - protein, 126 aa, Sorghum bicolor
  Clone ID: SORBI-28MAY03-C7084_1.pep
RKHSRRNPHRNSCLPDRRPSRRPQTLVDTSAESAGSRRRRPATPLPVADSLPLTDGSTTLLPSTDDGPAPCDHGGIRPSAGRCYLVAVAARPGDGEKQRVGRIQHGRLGSGLWMREVATSELLDLG

SEQ ID NO: 35613 - protein, 190 aa, Sorghum bicolor
  Clone ID: SORBI-28MAY03-C70851_1.pep
SVAVDVWMLAVPMWYLRKLKLHWKKKIGVAAMFIVGTFVTVVSIIRLQFLVDLGSSHNPTYDQTDISIWSTVEINVGIICASMPALRVILVRVFPSLGGSSYDSSKYNNYGEHYGRKSHIMSRSRARVELPSHTGDSIHTPEHGGIELQRTFHVQYSENDEQSLVNGESKFNKTQVTTQMRSESPSDRSL

SEQ ID NO: 35614 - protein, 124 aa, Sorghum bicolor
  Clone ID: SORBI-28MAY03-C70869_1.pep
LPSIGPERDFEGIGGWRLGGDDETWTTINSRLELPDKQHHGRNHHRSPSGGPTTPGEGGYLMMKGRNRSPGAKRLASPNSSRTRTPSGPRIAFTNKSFIDSYFPSLKTSPKGLKKLPTQGVVDA

SEQ ID NO: 35615 - protein, 233 aa, Sorghum bicolor
  Clone ID: SORBI-28MAY03-C70877_1.pep
MDDWENWEEAAEKDVKEIKKDTKFADEESEAVDIDAKNETAIKSQPKNPEKNAKKEKASQLAKKWEEKEKQYDNVIGGDKKGPLTAEERRKAQQLSEASDAKNTVDLFGGFIEQTESQNLKTEQAFIDYAKKIAEILAQEDRKKYIQEFMKELLQQIYPKLTSLEYEQIHSKCTILFNQKTKEEKAGPGAKKKTTQPKLNAAKGSNAAKLMDFDEDDDEYVPRGRNDLYDDFM

SEQ ID NO: 35616 - protein, 164 aa, Sorghum bicolor
  Clone ID: SORBI-28MAY03-C70550_1.pep
ELRGLLRVLRAKDEHQYLKVGKLVLAVNRGLAVAGPALAGTAAVAAAFIGAGGDGAASTSAWASGAAVACGALAACVNTVEHGGQLGMLFELLRNCAGFYRKVQEDIEAVLGEADVERRENGEVFRTKVALLLGRDAAELRQFRRMASASVKDEDIKDYAGKLF

SEQ ID NO: 35617 - protein, 134 aa, Sorghum bicolor
  Clone ID: SORBI-28MAY03-C70587_1.pep
QKAEDQFGANHPKVGIILTCIARMYKMKAKSESSTSIMVQEGLYRKALEVLKAPAINSEGTSKQVDWRDIISLARGEYAELLLIQSNRKAEGERMKQWAEDAWRNRRLTLAQALEFSEPSKPTLVVDTRIGRVV

SEQ ID NO: 35618 - protein, 144 aa, Sorghum bicolor
  Clone ID: SORBI-28MAY03-C7062_1.pep
HEQLRMVARLQVKEVAYRLAERGVALAVTDAALDLILSLSYDPVYGARPIRRWPTRPVVTELSKMLIKEEIDENSTVSIDASPSKDELIYKVDMNGGLVNAQTGHKSDILIQVPNGGINGGAAHTVKKMRLMEDDQDDDDMEEE

SEQ ID NO: 35619 - protein, 159 aa, Sorghum bicolor
  Clone ID: SORBI-28MAY03-C70636_1.pep
MANNRTYEEYEPAVEWSRNPEADAVKISLPGFKREDIRVLVDNHGHLRTRGERPIAGNRWIRFQKDFELPANCNADGIRAKFENERLTITLPKNTPLPPMPAPPKRPPHMAAAVPEPPVRPTVPLPTVPAAPLAPAPPAVKPPVEPRPSMSRKTYAPVA

SEQ ID NO: 35620 - protein, 87 aa, Sorghum bicolor
  Clone ID: SORBI-28MAY03-C71021_1.pep
CRVRRGPSPPALGRPALPPPLLAAAVACLAASAARAALASAARDAPPLWLPAAAPPPPRIPRALPARPLAPPARSAQQQSRRRHPQR

SEQ ID NO: 35621 - protein, 155 aa, Sorghum bicolor
  unsure (1)..(155): unsure at all Xaa locations
  Clone ID: SORBI-28MAY03-C70957_1.pep
PALTAAALHLDEPRAHVFLGNGSGDKIDGWCLDTGATHHMTERWEFLSKLDSGVXGSIKFGDASAVEFKGVGSVVFTAKTNEHWLLTGVYYIPALRNSIISLGXLDENGSRMEIEDGILRIXDRHRRLLXKVNRGANRLYILHVQVAQLACSGGA

SEQ ID NO: 35622 - protein, 101 aa, Sorghum bicolor
  Clone ID: SORBI-28MAY03-C71046_1.pep
TAGSRWAVVMSRNAGFTSQVVELDFLYPSEGIHMRWDNGYRITATAATWDQAAFILSIPRRKPTDETQETLRTSAFPSQHVKDKWSKNLYLASICYGRSVS

SEQ ID NO: 35623 - protein, 94 aa, Sorghum bicolor
  Clone ID: SORBI-28MAY03-C71048_1.pep
SGNISFDSNGDPVILDPACYYGHNEAEFGMSWCAGFGGDFYNAYFQVMPKQPGFEKRRDLYLLYHYLNHYNLFGSGYRSSAMSIIEDYLYVRAA

SEQ ID NO: 35624 - protein, 229 aa, Sorghum bicolor
  Clone ID: SORBI-28MAY03-C7106_1.pep
QMIMARIYSVLAKSRDKLDLYQELLARLKESQRSLGEATADAELPKSASDRIKAMGQVLSKARDLLYDCKEITERLRAMLQSADEQVRSLKKQSTFLSQLAAKTIPNGIHCLSMRLTIDYYLLSPEKRKFPNSENLENPDLYHYALFSDNVLAASVVVNSTIMNAKEPEKHVFHLVTDKLNFGAMNMWFLLNPPGDATIHVENVDDFKWLNSSYCPVLRQLESAAMRDY

SEQ ID NO: 35625 - protein, 160 aa, Sorghum bicolor
  Clone ID: SORBI-28MAY03-C71081_1.pep
MSSRMAGAAVLRHLGPRLFAAEQAAVSGLTARGVMPAAARLLPARMASTAAEAAREDAGAKQHGGTGKQEEAAGGGQSKKAIVSYWGIEAPKLVKEDGTEWKWTSFRPWDAYTSDTSIDVKKHHAPTTLPDKAAYLIVKSLRVPMDLFFQRRHASHALLL

SEQ ID NO: 35626 - protein, 168 aa, Sorghum bicolor
  Clone ID: SORBI-28MAY03-C7078_1.pep
MFETNVDSESLLALCKLVDRYIAEVASDPNLSVSSFVDLVTSMPETARPTHDGLYTAIDVFLKLHPGLPKMEKRKISSLMDVKKLSKGACIHAAQNDRLPLRVVVQVLFFEQLRAAGAAAAATPNVSVARCMARLAEEEEEDDHEHWKEGRALPEPPTPGALKRQLSL

SEQ ID NO: 35627 - protein, 175 aa, Sorghum bicolor
  unsure (1)..(175): unsure at all Xaa locations
  Clone ID: SORBI-28MAY03-C70790_1.pep
MDPSQMMFPIWGAPPPVALQPPSEDHAAAPSAQAQPFLAPPNPNRGWKRKNPAAAYQPPALGDLQVQNRAKARRWFKNNNNGGGGGNPNPNQTRKYFFPKNKNNKAAAPRNTTSFIIRAKRAGGIASLVSPCPVTPAVLPTPRLSPSREGLADMAXAQWGVDGYGSMKGLIRLRS

SEQ ID NO: 35628 - protein, 191 aa, Sorghum bicolor
  Clone ID: SORBI-28MAY03-C7080_1.pep
MADGGGGGPPAAAAALKDQGNEQFKAGSYLKAAALYTQAIKLDPDNATLYSNRAAAFLQLVKLSKALADAETTVKLKPQWEKGHFRKGCVLEAMERYEEAIAAFQIALQHNSQNAEVSRKIKRLSQLAREKKRALDVENMRSNVDIAKNLESLKTELAAKYGDAETGQSIFSFIVNVIESAIKVWHDTGNV

SEQ ID NO: 35629 - protein, 211 aa, Sorghum bicolor
  Clone ID: SORBI-28MAY03-C70802_1.pep
MSKFVRSSKFRHVFGTPGKKEECWDGIQMSKNAWDSDYLDVNGKYIAVCWQTAGGGAVGILDAAKPGKLGKVGLLTGHKGPVLDLQFSPFNDNLVATVSEDTTVKIWQIPQGGLTETTEDAAQTLSGHGRKVGTCNFHPSANNILATSALDFSVKIWDIEAGKEQFAVPGHTGIIQSCVWNYDGSLLATYCKDKKVRVIDPRSSNVVSEAE

SEQ ID NO: 35630 - protein, 65 aa, Sorghum bicolor
  unsure (1)..(65): unsure at all Xaa locations
  Clone ID: SORBI-28MAY03-C71112_1.pep
LTNGVMSLHTPXVGMGVLLCTFMQSSVTLFVHIWLLSSWWADSGWWIDLFLDDFVDIEIHMLMLL

SEQ ID NO: 35631 - protein, 91 aa, Sorghum bicolor
  unsure (1)..(91): unsure at all Xaa locations
  Clone ID: SORBI-28MAY03-C71175_1.pep
MGRYVGGADECERLAESGKLREMMRWVKARGEACAAKDGRGCEGCGGARFVPCWECGGSCKVVAADGGTPTTXERCGKCNENGLMMCPICH

SEQ ID NO: 35632 - protein, 212 aa, Sorghum bicolor
  unsure (1)..(212): unsure at all Xaa locations
  Clone ID: SORBI-28MAY03-C7121_1.pep
RTRGGQGGTSQVYRGCLANGKELAVKILKYSDEVLKEFVTEIEILSSLNHKNVISLVGFCFKNDDLLLVYEYLQRGSLEEILHGEKECKSIFGWTERFSVAVGVAHALDYLHSDNNSRPVIHRDVKSSNILISECFEPKLSDFGLAVWAADVTSQMTCNDVAGTFGYLAPEYFMHGKVNNKIDVYAFGVXLLELISGRKPLCTGCPKGQESL

SEQ ID NO: 35633 - protein, 191 aa, Sorghum bicolor
  Clone ID: SORBI-28MAY03-C71238_1.pep
MEGVHSLLARPNSAPFAFSQPPLRRHHRPPPPGPSACRAASRWADRLFADFHLLPTATAAADPPAAAPSSSPFVPLFPDAADRALPLPVDFYKILGAEPHFLGDGIRRAFESRIAKPPQYGYSTEALVGRRQMLQIAHDTLTNQSSRTEYDRALSEDRDAALTMDVAWDKVPGVLCVLQEAGEAQLVLATG

SEQ ID NO: 35634 - protein, 197 aa, Sorghum bicolor
  Clone ID: SORBI-28MAY03-C71250_1.pep
MAETVDDKVSYFQAVTGISDADLCTEILAAHNWDLQLAVSSITANPSPSASASTSSRGDPAPSAPLSADAEFVAPPPPPPMQLPLPPQQQQPGIAWRLVTLPFYVVSGGVGLVAGTFRLGAWVAGGVLSRSLSLLGLAGQAGSGDRLLELPPSAAEAADFVAEFAREFGAGRGPSFVAEGFADALQRAQREFKLLFV

SEQ ID NO: 35635 - protein, 165 aa, Sorghum bicolor
  Clone ID: SORBI-28MAY03-C71244_1.pep
MPSGSATQFRYTQTPSKVLHLRNMPWECTEEELVELCKPFGRVVNTMCNVGANRNQAFVEFADQNQAISMVSYYASSSEPAQVRGKTVYIQYSNRQEITNNKGTGDSSGNVLLVTFEGVQPNDVTIEVIHLVFSAFGFVHKIATFEKAAGFQALTQYTDAPTALE

SEQ ID NO: 35636 - protein, 201 aa, Sorghum bicolor
  Clone ID: SORBI-28MAY03-C74742_1.pep
MATTPASALPKSGAVSKGYNFASTWEQNAPLTEQQKAAIAALSHAVAERPFPPNLEKSSGKDGGVAVPEKESALEEAGAMDAVLVNTHQFYKWFAELESAMKSETEEKYRLYENTLQERVNTCDGILKQVDDTLNLFEELQSLHSSVATKTKTLHDACDQLLVEKQRLIEFAEALRSTLNYFDELENVSSSFYSQNMNIGN

SEQ ID NO: 35637 - protein, 135 aa, Sorghum bicolor
  Clone ID: SORBI-28MAY03-C74744_1.pep
MEAQATATVKEALAALYHHPDDAIRTAADRWLQEFQHTLDAWQVADSLLHDESSNLETLIFCSQTLRSKVQRDFEELPSEAFRSLQDSLYVLLKKFNKGPQKVRTQICIAIAALAVHVPVHFELSRRLLGPLCSP

SEQ ID NO: 35638 - protein, 212 aa, Sorghum bicolor
  unsure (1)..(212): unsure at all Xaa locations
  Clone ID: SORBI-28MAY03-C74762_1.pep
MLQSYXGAERFQKALASYILLDAYSNAKTEDLWAVLEEESGEPVKDLMTTWTKQQGYPVIYAKINGHDLELEQAQFLSDGSSGPGMWIVPVTSCCGSYDAQKEFLLKDKTDKINIKEFAASQSADGEKNQNIWIKLNIDQTGFYRVKYDDELAAGLVNAIKAKKLSLMDKIGIVEDSYALSVACKQTLTSLLRLLNAYNDESDYTVLSHVTS

SEQ ID NO: 35639 - protein, 159 aa, Sorghum bicolor
  Clone ID: SORBI-28MAY03-C74782_1.pep
ATAGRWEDVARVRRLMDERNVSKEAGRSVIEVQGEVCEFQCGGLCHPQAEQVYAMARDMMRKIRAEGYVPDTRDVLHAIAEEEKETPLLYHSEKLAIAFGLLHTRSGDTIRITKNLRVCRDCHEATKFVSHVFDREIVVRDRNRFHHFKDGLCSCKDYW

SEQ ID NO: 35640 - protein, 90 aa, Sorghum bicolor
  unsure (1)..(90): unsure at all Xaa locations
  Clone ID: SORBI-28MAY03-C71334_1.pep
SGRWISFQVGAATTAPASXPTYNLVHPAGGGASASNSMELDGMAAADIGGRGGGPAEFEFDKGRVTPWEGERIHEVAAEELELTLGVGAK

SEQ ID NO: 35641 - protein, 170 aa, Sorghum bicolor
  Clone ID: SORBI-28MAY03-C71483_1.pep
HISTRTWNRRSSYHITTVNTISNQLKNWQAKADLKTVTKLRGAMYLPKPINQLLVATIGLNVRGQALLVSSPWEAERRRLDPNFEHLMRQGFVSMEPIQNAGFSFIAGILWQLSERKEDEPIIGGMRPHWNSVRYRWAAIGEEESEFTAGHVVQNDSERLFLGSSLIGLV

SEQ ID NO: 35642 - protein, 120 aa, Sorghum bicolor
  Clone ID: SORBI-28MAY03-C71453_1.pep
KAAAIITLLFIIAINLAIGILPHADNFAHIGGFASGFLLGFVLLARPQFGWMERSELPQTNHPPKYKLYQYVLWVAALLLLVVGFVIILVMLFKGKNGNDSCHWCHYLNCVPTSRWKCDT

SEQ ID NO: 35643 - protein, 167 aa, Sorghum bicolor
  Clone ID: SORBI-28MAY03-C71506_1.pep
PPLTFLFQRASTTPTPLRPSANHRLLLIAATTTLGVLGSKKWGGSNKKQIWSGTPVIRTRRGDLGRGDFWPLPASPRRGPNQDHYFFLLPCPRPNRKAWFLQIASWRGPKIRRPSTLAGIVGAEEGLEAAVVALVSSLVNLPPCLVSCFIAGIRPDLEERVAGLGAV

SEQ ID NO: 35644 - protein, 73 aa, Sorghum bicolor
  Clone ID: SORBI-28MAY03-C71538_1.pep
GTCLCEGWRRGSSGSARRLAPRLLPIQVRCEKLVFEKEDDVAGLIELIVLHKVTKLIISGAADRQYSRNYAES

SEQ ID NO: 35645 - protein, 62 aa, Sorghum bicolor
  Clone ID: SORBI-28MAY03-C71539_1.pep
YWVLLVVAVRRALPSGDDTSIFFFCSSNNRKDTVNNGFIKFITFYWLLTCLFELAFCMTSDS

SEQ ID NO: 35646 - protein, 167 aa, Sorghum bicolor
  unsure (1)..(167): unsure at all Xaa locations
  Clone ID: SORBI-28MAY03-C71092_1.pep
MAPTAPTQRPTMRHSSAFLIPPSPPPSSSSPAPGPDPDPDDDDATVALVVLNQPLPRFAPLLWSRAAARVCADGGANRVFDGMPALLPGQDPDEVRTSYKPDVIKGDMDXVRPEVKEHYSNLGTRIVDESHDQDTTDLHKCIAFIAENYPASNKSNFSILVLGALGG

SEQ ID NO: 35647 - protein, 86 aa, Sorghum bicolor
  Clone ID: SORBI-28MAY03-C71097_1.pep
MGYYDDDGHYNSFRAGAHKLGDRIAHGGRRDIEIDIHEGPRPSADCLPNTVSIPCHHIRLGDFLMLQGRPCQVIRISRRLWSRLLR

SEQ ID NO: 35648 - protein, 187 aa, Sorghum bicolor
  Clone ID: SORBI-28MAY03-C71101_1.pep
LAPAPPAPRSPRPPPRAPLRPGRRPLAGCPPAAAPPPVAGPPPAPPPARGLPPPAGPPPRRPPPARHRPAAARPPPATCPPPPPPIPRRLTAAPRLPPASPPPQRPRCPPAVHPPAGPAPLQLPPRSLHGAYSAPPLPSPQPRSGVEGAGALQCGAWQVGPPSPGRCCTSALMLGVICHRVEGKGDL

SEQ ID NO: 35649 - protein, 145 aa, Sorghum bicolor
  Clone ID: SORBI-28MAY03-C71108_1.pep
MAALGHDPIREWILTEGKATQIKGIRSIGGGCINNAQRYDTDAGPFFVKTNSRIGPEMFEGEALGLKAMYDTKSIRVPLPYKVDSLPTGGSFIIMEFIEFGPSRGDQSVLGRKLAEMHKAAKSDKGYGFHVDNTIGSTPQINTWT

SEQ ID NO: 35650 - protein, 188 aa, Sorghum bicolor
  Clone ID: SORBI-28MAY03-C7167_1.pep
SRPAGSRKDTVCSDSPEQLLSLHPYPDPAIASHRIRIMGLCLSVALWKEKLYGDSRSVRGRVVVHKVAGVEGGDCEYGILGGDADGVLGVEQKPPPAAAVAAVAPAAAAMGMRSGGGVEGAAAAVSGGTPVRPIWQRRVLMGVKCQLPRFSGMILYDESGRPVCSGIRDRARDQEKHAAAISVLRDLL

SEQ ID NO: 35651 - protein, 121 aa, Sorghum bicolor
  Clone ID: SORBI-28MAY03-C71690_1.pep
MAQPFSPHTPSSSWVTRRPPTSTSSPSASTTRTSASPIPGCRPRRRAVAPAASLHLGPGEIAEVSRNKVLIAATVASAIGQLSKPFTSGKNGGAGAGLDLRTIFRSGGMPSTHSAVKTSDY

SEQ ID NO: 35652 - protein, 129 aa, Sorghum bicolor
  Clone ID: SORBI-28MAY03-C71710_1.pep
MQGEYRSSSEESAAAAAAAAAAAAAAAMAPLAAAAAAAVKMEAEQAAMAAAGAAGPQLGSAHQHHQQQMQPRRQYRGVRMRKWGKWVAEIREPHKRTRIWLGSYATAVAAARAYDTAVFYLRGRSARLN

SEQ ID NO: 35653 - protein, 233 aa, Sorghum bicolor
  unsure (1)..(233): unsure at all Xaa locations
  Clone ID: SORBI-28MAY03-C71721_1.pep
MYVIEDKGGAIALMLASLLFLGTWPAVLTLLERRGRLPQHTYLDYSLTNLLAAVLIALTFGQLGXGKRGMPNFFTQLSQDNWPSVLFAMAGGVVLSVGNLSTQYAWAYVGLSVTEVISSSMVVVIGTTLNYFLDNRINRAEILFPGVACFLVAVILGSAVHASNAADNEKKLSGSTNANKLGTSGTVEPSKKVLDKDAPKDLENGASGAKQVDRAEAGTAEYLIELEERRSIK

SEQ ID NO: 35654 - protein, 115 aa, Sorghum bicolor
  Clone ID: SORBI-28MAY03-C71754_1.pep
YYFTRKFDYLDLIASSHDNPTKAFHKKNCTGPIGGEPPVWHCTEEIQATGPENLPNAGPCPESQTDLGQQHCNQADEAPQPGQCALQLKLVVGVFCARPGFEPRLVDTTTTSHTT

SEQ ID NO: 35655 - protein, 82 aa, Sorghum bicolor
  Clone ID: SORBI-28MAY03-C71752_1.pep
YTCLPETEQAKLLSLAHMELRNSMIVEHYSHQSWPDMIHCQEGSDIIIILLSLLIRLRQPFFIAKKAIQIVSPFQIYNNSVY

SEQ ID NO: 35656 - protein, 205 aa, Sorghum bicolor
  Clone ID: SORBI-28MAY03-C7129_1.pep
KALHKNFHELNGKMVEVKRAVPKEQSPGPIARSPVGGQNYAMSRVHNFLNGFNQGYNPNPLGGYGMRVDGRYGLLTGARNGFSSFGPGYGMGMNVEGGMSGYFGASSGFVNSSNGRQIGSYFNGSSNRLGSPIGYVGLNDDSGSILSSMSRNVWGNGNLNYTGNPTNTNSFAPPGSGGGIPGDEISWGSLTSAHGMGNISSLGSG

SEQ ID NO: 35657 - protein, 230 aa, Sorghum bicolor
  Clone ID: SORBI-28MAY03-C71314_1.pep
MQIFVKTLTGKTITLEVEPSDTIEQVKQKIQDKEGIPPDQQRLIFAGKQLEDGRTLSDYNIQKESTLHLVLRLRGGMQIFVKTLTGKTITLEVEPSDTIEQVKQKIQDKEGIPPDQQRLIFAGKQLEDGRTLSDYNIQKESTLHLVLRLRGGMQIFVKTLTGKTITLEVEPSDTIEQVKQKIQDKEGIPPDQQRLIFAGKQLEDGRTLSDYNIQKESTLHLVLRLRGGAF

SEQ ID NO: 35658 - protein, 89 aa, Sorghum bicolor
  Clone ID: SORBI-28MAY03-C71320_1.pep
KIKNKKHTFLMESTSFYYKENTDIRYAHRPLALSTTIHRSPDSQISLATHRQHHTVRSSVPGEFRWLCKLRSVITLCRCTTSEKQMRKP

SEQ ID NO: 35659 - protein, 165 aa, Sorghum bicolor
  Clone ID: SORBI-28MAY03-C71358_1.pep
MDPQAEAGAAAVLGADPAALTALLADLTSPANEARSRAEQQFHSLRGSHPDALALSLAHLLLSPAHPSAPIAAVLLRRLIAPSSQSFVYPALSPATQSSLRALLLSAASAPALPRSVSRKLSDAVAELASFLLPANAWPDLLSFLYKSIDSPSSPPGLQESALNI

SEQ ID NO: 35660 - protein, 87 aa, Sorghum bicolor
  Clone ID: SORBI-28MAY03-C71127_1.pep
SVPFCLLTMDSLLVPPELYVGAPEAAPAPAPVDAPQGSPPAADAPSVAADHADHKSKKSTASSAVVSRPVAALAATAVCSVVLASLL

SEQ ID NO: 35661 - protein, 183 aa, Sorghum bicolor
  unsure (1)..(183): unsure at all Xaa locations
  Clone ID: SORBI-28MAY03-C71937_1.pep
WGRRLDTAIGVARALVFLHHECRPAVVHRDVEASNVLLDRDGRARVTDFGLARVVRPGDTHVSTVVAGTVGYVAPEYGQTWRATTKXGDVYSYGVLLMELATGRRAVDGAEDECLVEWGRRMAKEGWRSSSEKAAAVGTVSWELLMLGMRCTADAPQERPDMPDVLAALLDVAENSGAHLQFT

SEQ ID NO: 35662 - protein, 168 aa, Sorghum bicolor
  Clone ID: SORBI-28MAY03-C71946_1.pep
GGRPVGVLVAGGGPCPCHDCPPGPPSCFRPHWCSQRISVPGLPSRSASLPEWPRSWRLRVARPDGVLGPGAVPARCRACRLREPSRVLPLCLSLPSALCSCAGCGTTFISRTSSGRMCLLTGVCQLMGNGCLGSLDGAAAMRFFSVSGGAGGSRTVPECCVVGPMRRC

SEQ ID NO: 35663 - protein, 169 aa, Sorghum bicolor
  unsure (1)..(169): unsure at all Xaa locations
  Clone ID: SORBI-28MAY03-C7195_1.pep
ARGPFIAALVNNMWRSTTPEEVLAIFLLELKALVEMHLKHPVRNAVLTIPVAFSRFQQTRIERACAMAGLHVLRLMPEPTAVALLYAQQQQQLVNDNMGSGIEKIALIFNMGAGYCDAAVAATAGGVSQIRALSGCTAGGXDILQNIMRHVVPILTNYMLARQWIESSR

SEQ ID NO: 35664 - protein, 249 aa, Sorghum bicolor
  Clone ID: SORBI-28MAY03-C71962_1.pep
LITLKLYACNFSGQVPPHIFNLTQLGIINFHSNSFIGTIQLSSFFKMPNLFRLNLSNNKLSIVDGARGSSWASIQNFDTLCLASCNMSKLPNSLKHMHYVEVLDLSNNHIHGPVPQWAWDNWINSLILMNISHNQFSSGIGYGPTISANMFVIDISYNLFEGPIPIPGPQNQLFDCSNNQFSSMPFNFGSYSSSISLLMAPRNKLSGEIPRSICEATSLMLLDLSNNYLIGSIPSCLMEDMSRLNVLNL

SEQ ID NO: 35665 - protein, 146 aa, Sorghum bicolor
  unsure (1)..(146): unsure at all Xaa locations
  Clone ID: SORBI-28MAY03-C71996_1.pep
MGAMAEVVQEGCVENRQPLAASSSSVSDGSSCGGGGRAGTSPPVSSSGNSISVLRRTSGPIRRAKGGWTPEEDETLRKAVEAFKGRNWKKIAEFFQDRTEVQCLHRWQKVLNPELIXGPWTQEEDEKIIDLVGKYGPTKWSIIAKS

SEQ ID NO: 35666 - protein, 143 aa, Sorghum bicolor
  Clone ID: SORBI-28MAY03-C7203_1.pep
EVDEKDVNLDAAFSVHAGIAHTRWATHGVPAPRNSHPQSSGAGDEFLVVHNGIITNYEVLKETLTRHGFTFESDTDTEVIPKLAKFVFDKSHDEEGDVTFSQVVIEVMRQLEGAYALIFKSPHYPNELIACKRGSQLILGVMK

SEQ ID NO: 35667 - protein, 120 aa, Sorghum bicolor
  Clone ID: SORBI-28MAY03-C7157_1.pep
PQRMVACEYCEFELPAVDLHEHQDVCGNRTELCQTCRKYIRLREWIGHEIQCHTNSNGSADTSSARAIPERELRPPPPVRPARPARPAHASPHKRLLFTIAVTGIAVMIGSILFQRDESF

SEQ ID NO: 35668 - protein, 112 aa, Sorghum bicolor
  Clone ID: SORBI-28MAY03-C71590_1.pep
SVVAVATSLGLERGFADSVFGMSVVFAAIVMYDAQGVRREVGNHARVLNKFWILKEKAPLEYSEVDMASEFLKQAYIEEDYRLSESVGHTELQVTVGALLGFAVSLAVYATL

SEQ ID NO: 35669 - protein, 115 aa, Sorghum bicolor
  Clone ID: SORBI-28MAY03-C71634_1.pep
YMDRLSRIYKMYEEPLDAAKEYLLTNILAKRGGGRVRERSQSIQAINYIEVPGRVTVPGVGPAELPRRRAALAPARVPAPVSLVPSARRRGLAAPGPAVGRPLEAQVVQRRALTV

SEQ ID NO: 35670 - protein, 249 aa, Sorghum bicolor
  unsure (1)..(249): unsure at all Xaa locations
  Clone ID: SORBI-28MAY03-C71640_1.pep
MLPALRPPRRLPVASLRRRLCTPSSSGTGKSDLPVDAAAVAAATAKARAEAXSRARAEAYKQVQNFDWSSGADWKTAANILFTVPPKRKEFGLDFHLVQLFFVCMPSLAVYLVAQYARREIKRMEGEAEEKREKDEELEKQKQLEEESAKEDADSKLSKVLDRVDTLEAVVKEIVDDKRKLSSPDLPTKEEVAKKDKASPGKASDSKNDSQPVTVKSKDISCAANAPANTAKPNIKGICDKAFPVESES

SEQ ID NO: 35671 - protein, 178 aa, Sorghum bicolor
  Clone ID: SORBI-28MAY03-C72057_1.pep
VGTPPPPRARLRLLPPADDATRAGRLLAPRHTAAALHHPVVTACRHTLPRSIAHTAVRKKTMEGADGKQDSETTFIVKVHREPAIIINGVPDLPSDSTAGSQSLVKIDTKPQVDPRFGGWLEGRKVQKLFGDRHYVGKVAKYDSESNWYNIIYDDGDQEDLEWRELEEILLPLDITVP

SEQ ID NO: 35672 - protein, 121 aa, Sorghum bicolor
  Clone ID: SORBI-28MAY03-C72093_1.pep
KLPCRSRTATRSRRASAPRRRFRPAGCSARVQSKPAGQRARAFELEQARSRGGDAGASASVSACTASLFFSSFNVPCPSLLIRNGGGVRVRPRRRPGRVQSSRRCSFPRASFVCWCCLLHR

SEQ ID NO: 35673 - protein, 176 aa, Sorghum bicolor
  Clone ID: SORBI-28MAY03-C72094_1.pep
MAAVASAAAAVDAVAALFSLIMAVAAPLFDSQVVLPVSLYPAPLVDIFRWFTAEFDNYIVADAPPFLRGLVWLDLAFLWPVSVANLYGILARRRWSATTSLMAGVYMLTYLSAMFGEMLGSGTATPKLLGLYLLFLVFAVASVARGLCSCSTQATPAAAGPSSPALAARKKEGLDP

SEQ ID NO: 35674 - protein, 119 aa, Sorghum bicolor
  unsure (1)..(119): unsure at all Xaa locations
  Clone ID: SORBI-28MAY03-C72121_1.pep
AENVXQDEHGTLYQIADCGPIVAAPDYINTGYSQDQGIPLHGQQEVISPWPQNPQDLMDFGYPFEPVAMNFNTYEDSGASTSAQLNFGPHHHPQPGSTSLAAAPPWMEHDQGPSCSGYP

SEQ ID NO: 35675 - protein, 150 aa, Sorghum bicolor
  Clone ID: SORBI-28MAY03-C72128_1.pep
DARHCEWRYHGEWVLPFRHEGFFDSELDAWVGLHKDGGICSCQVVSHSSTSAMQPDWKMVKDKLWCEDKVARGPTLTYMGGSRFCIVECVVREGLDYEDAFGDCDGCMLHITMLGLKHNHKGELQTIGRTTNSYLVSKHLSSFSPVAFWM

SEQ ID NO: 35676 - protein, 160 aa, Sorghum bicolor
  Clone ID: SORBI-28MAY03-C72150_1.pep
MSKRRQEQDQGQGQGIGKRLQKQKHLYLVLDDWAKGFSIHKIDVANPHLGEPPVLRLVAPVPCCPMSFAALGSNIFTVSNRHRGTLVYDTETAALATGPCLPDPLLGGINNFVSAADTLYAFAYFFAKRQHSFEVMSTDSAKQGLCPSTPTLDWSWQSVP

SEQ ID NO: 35677 - protein, 200 aa, Sorghum bicolor
  unsure (1)..(200): unsure at all Xaa locations
  Clone ID: SORBI-28MAY03-C71783_1.pep
MVSLKLQKRLAASVLKVGARKVWLDPNELNELSMANSRQNIRKFIKDGFIIXKPAIIHSRSRARASAEAKSKGRHTGYGKRRGTREARLPTKVLWMRRTRVLRRLLKKYRDSKKIDKHLYHELYMKVKGNVFKNKRVLMEAVHRQKAEKAREKTITDQLEARRAKGKAARERKAARREERLAAGLHLEAAAQPAKATGKK

SEQ ID NO: 35678 - protein, 101 aa, Sorghum bicolor
  Clone ID: SORBI-28MAY03-C718_1.pep
GPAMSRRREGGALGDEATNASRWLLPRAMAASTASVMASTLAFMEWKGPVGCHGYLSGERELRRCPGEVPANVPFLWPFLSVSERALLITCESGKVCVLIK

SEQ ID NO: 35679 - protein, 149 aa, Sorghum bicolor
  Clone ID: SORBI-28MAY03-C71853_1.pep
MDPAARGGGHSIAEEAARLWADFPVRVDWAAVAAQCASLWAHARALVLVPAVRLLVFLSLAMTVMILLEKLFVCAVCLAVRAFRLGPHRRYRWEPITAAGSNGAAAGDDEESGGGGHGEAKYPMVLVQIPMYNEREVYKLSIGAACALE

SEQ ID NO: 35680 - protein, 241 aa, Sorghum bicolor
  unsure (1)..(241): unsure at all Xaa locations
  Clone ID: SORBI-28MAY03-C71888_1.pep
MQGDLNKLDFDLNNVYDCAAEWIKKHAKISVSSIDRVWNKLGNANWGDIGTLQVLIAIFHSMIQFYGEPKYSLDELATEHSSRLQSRRSERHLVDRQANGNGLFRFQQRSHSPEIVEVQEEAAVDVKPHETLRLEIGSVVLMDDSYTQKGFQINDILTDSDPPIYTSTPVEEPAKTYLLYVGSSPSHLEPAWEDMNSWYQVQRQTKVLTVMKQRCISSRYIPQMVSSGRXIHXXPCNKPSS

SEQ ID NO: 35681 - protein, 255 aa, Sorghum bicolor
  Clone ID: SORBI-28MAY03-C7191_1.pep
ARGSNSICSDNTSLDVQISQAEHHSKEDLAATVVQSAFRAFLARRALRALKGIVLLQALIRGHSVRRQTTETLQCMQALVKAQARVRARQVRVALENQVARKKIPEQDDHENHVREVEGGWCGSIGSMEEMQAKALKRREAAAKRERAMAYALTHQRQAGSKQQISTSLQGLELGENHWGSNWLDRWMAVRPWENRLLDCNAKESLPTHEDKKDEEANSQITPKGKVSTSNTPGLSKKKGVTTKSHIQMLVYLLH

SEQ ID NO: 35682 - protein, 187 aa, Sorghum bicolor
  Clone ID: SORBI-28MAY03-C72216_1.pep
SLAATALQPPPPQPPLRSSHGHAVHRGEVRRLGPAPPAPSPRAWIWVRAPRRPRVWSCRPGRPSRVRGVACGCPCARPVGPVTVRCAGCALSSCSASRPSPPGAFPLCLCRDGVSGVPFWHAPGSVPRVGSAPAWAGLVVCGLALQAAGLGAGSPLSVRAPGRPFKLSADKHIRQQVLVLRDPLLCE

SEQ ID NO: 35683 - protein, 78 aa, Sorghum bicolor
  Clone ID: SORBI-28MAY03-C7226_1.pep
DFIDNHWKVKKEILDKLGLDSSPVKSKKNKSISTYFSKRCLPPEEAVNALAASPELRLKSKTKSGTEAPQINLFPSKQ

SEQ ID NO: 35684 - protein, 156 aa, Sorghum bicolor
  Clone ID: SORBI-28MAY03-C72393_1.pep
LEKIRIMWESILPRSTYRKSMCHVLGSVFSRITRDMLLIDDMAAEETLQLQGLIHLALENLSSLFLSLVENDDGSTKFLDHDTWIQLDGILPSLKKFRKLAELLDMSLKSITACWESGDLARCGFTSSEVQNFIKAIFADSPLRKECLGWIIRTPA

SEQ ID NO: 35685 - protein, 108 aa, Sorghum bicolor
  Clone ID: SORBI-28MAY03-C72452_1.pep
AHSLISNRFKTKHSFGKHFNLSTPSGMLPRPCRWLGCYCRLPSTLNVLLVCKLQLNFRVVTESVDFQTLGSIQHRGEDLKRGTEEGRSTPDGRQPPENVHMTKGYACS

SEQ ID NO: 35686 - protein, 178 aa, Sorghum bicolor
  Clone ID: SORBI-28MAY03-C72413_1.pep
SGASGLAILTVAKAGAILTYKLGTGLVVARRSDGSWSAPSAIVSAGFGWGAQVGGELMDFIIVLRGPEAVQTFCSRMHFSLGAGVSAAAGPVGRVLEADLRAGDKGSGVCYTYSCSKGAFIGVSLEGNLVATRMDANLRFYGDPYLTTSDILTGNVERPNAAKFLYTALDDLYSGLDC

SEQ ID NO: 35687 - protein, 260 aa, Sorghum bicolor
  Clone ID: SORBI-28MAY03-C72043_1.pep
MYPLLLGFLVLLLVAGEVVVAAVPTGAQQSNGDKEVLVELKRFLQNNNRVNRGAYDAWQESDASPCGWAGVRCDNASGRVTSLDLSGSSISGPAFGNFSRLPELAELDLSDNTICAPGDIDQCHGLVRLNLSHNLINGSLDLSGLTRLQTLDVSWNRLSGGVAANFTAMCAADLAVFNVSTNGLTGNVTGTFDGCARLEYVDLSSNNFTGELWPGVARFRQFSAAENNLTGSVPPATFPDGCKLESLDLSANYLTGSFPD

SEQ ID NO: 35688 - protein, 167 aa, Sorghum bicolor
  Clone ID: SORBI-28MAY03-C72050_1.pep
MSDESPPPPAPPAQADEKSQPAEHAAGSWGGWGLSIFSEISRSAVEVAKSAIADIQQPPEQETGPGTGSGEKDQEKEPEGEGEEEERRKAALDKLEKASEDSILGQGLKAFDSSVETITTGTWQALGTAWKSGSLFVQKLENSASSLAETIQQGELPAKASAIAPTI

SEQ ID NO: 35689 - protein, 150 aa, Sorghum bicolor
  Clone ID: SORBI-28MAY03-C72055_1.pep
MEAASSRWTPAAGLLLLLLLLVPFAAIPSRAATPAASSTAIFQLQGNVYPTGHYYVTMNIGNPAKPYFLDVDTGSDLTWLQCDAPCRSCNKVPHPLYRPTANSLVPCANALCTALHSGHGSNNKCPSPKQCDYQIKYTDSASSQAVDMTS

SEQ ID NO: 35690 - protein, 164 aa, Sorghum bicolor
  Clone ID: SORBI-28MAY03-C72067_1.pep
FNSNLLQLELTIILNQFFKAQIRNFIHKVQQMSNIQLTKKLLQLLSLFSSFRAIFLFLLKLLRLNFFNKNLNFTHNRLNFLFFWLNFFNHNLVKFLQKGLSNLNIWLFLRLLSLSLLRIHATNKFKRTMRREESNLRFRLSLRLGLRSHSSKARSSIFKARDSM

SEQ ID NO: 35691 - protein, 53 aa, Sorghum bicolor
  Clone ID: SORBI-28MAY03-C72600_1.pep
SSIMALCVRWYPKERKQTPRKQKTHRAMDDIKESIAELKYYKDNIFKPQKSKR

SEQ ID NO: 35692 - protein, 145 aa, Sorghum bicolor
  Clone ID: SORBI-28MAY03-C72628_1.pep
MDPPGPGDEGEAAQPQPLEWRFAQVFGERAAGEDVQEVDIISAIEFDKSGDHLATGDKGGRVVLFERTDARDQNAIRRELERQDGPVTRHPEFRYKTECQSHEPEFDYLKSLEIEEKINKIKWCQTANSALSLLSTNDKTIKYWK

SEQ ID NO: 35693 - protein, 116 aa, Sorghum bicolor
  Clone ID: SORBI-28MAY03-C7267_1.pep
PAAGVKCRVADWGCFSADVVGLGMLLLGRCHRPQGKERRSSMSGSRLPAARLKARRGGVPTARLKARSGGARRRVPGFQRRDSRQGEVEFRRRGSRQGAAKLGRRRHTDGRQEPRA

SEQ ID NO: 35694 - protein, 125 aa, Sorghum bicolor
  Clone ID: SORBI-28MAY03-C72737_1.pep
PRGSLVKRLSFFRRSRSRSRSSRASSSPKDGLVGNGMAAAPAPAPPVGLGHMRRFTSGRAAFQDFVWREEERRSRDSDEEFEDDGFVAHSAPLVLGGGVVASEPRKEVNLWRRRPMAPPTPLELP

SEQ ID NO: 35695 - protein, 98 aa, Sorghum bicolor
  Clone ID: 30163118.pep
MVAMQQLLLLFLLLVYLRPSFSQTNSQDVAALKALMDNWKNEPESWTGSTDPCTSWVGISCSNGRVTEMRLASMNLQGTLSNAIGQLSALKYLDLSNN

SEQ ID NO: 35696 - protein, 57 aa, Sorghum bicolor
  Clone ID: LIB3476-031-P1-K1-E3.pep
TSPRIAIRVSSGLLQLVLRPNPEEHVMVAMQQLLLLFLLLVYLRPSFSQTNSQDGKP

SEQ ID NO: 35697 - protein, 114 aa, Sorghum bicolor
  Clone ID: SORBI-28MAY03-C72765_1.pep
MSAAFKAFLNSPVGPKTTHFWGPVSNWGIILASVADTQKPPEMISGNMTGVLCVYSALFVRFAWMVRPQSYFLMATHSCNEVVQLYQLSRWARAQKFFGRREVGGPTIKTDPKP

SEQ ID NO: 35698 - protein, 214 aa, Sorghum bicolor
  Clone ID: SORBI-28MAY03-C72165_1.pep
IIISFNITKPPTPPQLSMTIKVVFNNQTHRISKHPVDYKTLLQKVTEIFGAQLPESWTLQYLDSDEDKIMLNSQEDYKTLLEEEVGSENKSVKIFVFPLEGRVSQSQVKIEESVPEAVIEAEKKEEEIIVEEKTEELIKENKPVEEEIVVSKEEEEKVLIEEQQPKVEIQPEAPIERESQQEAQFEMHPLHRIFLNFLRPHQETQQKFTVEEQQ

SEQ ID NO: 35699 - protein, 219 aa, Sorghum bicolor
  Clone ID: SORBI-28MAY03-C72173_1.pep
GPPRRPVPEFPRPRRPPAPGPGPPPPALPPLPGPRPPPPPAPPVPRPPPGGPPPPPPPPPGPGPPCPSPLPPPPPPPPPPPPPPPPPPWPPPPGAPPPPPPPWAGCRGAPRPGPGARGPPPPPTPTGGAAGAWGPPPRPPPPPPAPPPGARGSAPPRRPGAPRPPFWAGLGYFSRQHLLFKKCTHMSTVQAWKHGFHSNQQCCKGQKRNQHLMNQMLLL

SEQ ID NO: 35700 - protein, 129 aa, Sorghum bicolor
  Clone ID: SORBI-28MAY03-C72181_1.pep
MNPDNFTHKTNEALVAAHEMASEAGHAQLTPLHLAAALAADKGGILRQAITGASGGDGAAGESFERVLSNALKKLPSQSPPPDSVPASTALIKVIRRAQSAQKKRGDSHLAVDQLLLGLVEDSQISDCL

SEQ ID NO: 35701 - protein, 226 aa, Sorghum bicolor
  unsure (1)..(226): unsure at all Xaa locations
  Clone ID: SORBI-28MAY03-C7221_1.pep
WKRDPALDAAISRDRRFRQASRLVREVLLSPGRRLLFRYLTKRRERIKLPVRVPTFLRRYPTLLAVSAPPEPVASPSPHLLAFLDFASRLYELHAPFLASRLAKLIMISCTRALPVSKIAAAKRDFGLPDDFLVSLVPRYPGLFRLVGDPGPDSSGNAFLELVAWDDTLAKSVIEVQADKEADVVGIRPRPNFTVKLPKGFYLKKKMREWMRDWXELPYISPYADA

SEQ ID NO: 35702 - protein, 124 aa, Sorghum bicolor
  Clone ID: SORBI-28MAY03-C72196_1.pep
RGGREREREREREREREPLNMAESRRSPMAGDTTLGRPRLGRRAAAPPRRGSPRLGTASEPPRHHAGVSTLGDGLAWAIMTEGEGEGGGRSAARAAPPLPRRGRTWGEMEETPRLGRGEDIGFF

SEQ ID NO: 35703 - protein, 203 aa, Sorghum bicolor
  Clone ID: SORBI-28MAY03-C7287_1.pep
NLQASKPERWNIFRERTGIWGKNDFVRNGFVDHINTTKDSTDYLWYTTSFSVDESYSKGSHVVLNIDSKGHGVHAFLNNELIGSAYGNGSQSSFSVKLPINLRTGKNELALLSMTVGLQNAGFSYEWIGAGFTNVNISGVRNGTINLSSNNWAYNIGLEGEYYSLFKPDQRNNQRWIPQSEPPKNQPLTWYKVNVDVPQGDDP

SEQ ID NO: 35704 - protein, 101 aa, Sorghum bicolor
  Clone ID: SORBI-28MAY03-C72922_1.pep
LDNSLKLCNFATGKFLKVYSGHVNRQYCIQSAFSVTNGKYIVSGSEDNCVYIWDLQGRNILQKLEGHTDTVISVSCHPTENKIASGGLDNDRTVRLWVQDS

SEQ ID NO: 35705 - protein, 168 aa, Sorghum bicolor
  Clone ID: SORBI-28MAY03-C72927_1.pep
KFLNLRQRSFSSPPNLRPRSFCSRKRRSASNPRSAHLVPVVPVPTSSSSSTGRAASSSSVTRLLRRHPYQRLPPTLLRSCVLASLRSSAASLHESSPTLISCLHGRYSATAPQPRLLCADALLRPCVPAPQASSGSPPPRFLRWMLCRRRDLHTQTRDLGGDRSLQQS

SEQ ID NO: 35706 - protein, 76 aa, Sorghum bicolor
  unsure (1)..(76): unsure at all Xaa locations
  Clone ID: SORBI-28MAY03-C72946_1.pep
LVYFPQSLWRQWFIQPSQRRSFRDRNGKKKHNTKKGKAAREKIYQLHMPIWRQPYVSSYNACMHMHDMTLXKFSAH

SEQ ID NO: 35707 - protein, 241 aa, Sorghum bicolor
  Clone ID: SORBI-28MAY03-C7298_1.pep
MGSQVILPLAHTLEHEEFLEVIRLEGHSLCHDEVVLSRDMYLLQLCSGVDENAAGACAQLVFAPIDESFADDAPLLPSGFRVIPLDAKTDPPSGTRTLDLASTLEVGSGGTTRASSDASSTCNTRSVLTIAFQFSYENHLLASVAAMARQYVRTVVASVQMVAMAIAPFRLGGQLGMRQTPGSPEAHTLARWIGRSYRFHTGAELLRTDTQCTDASLKALWQHSDSIMCCSLKAAPVFTFA

SEQ ID NO: 35708 - protein, 197 aa, Sorghum bicolor
  unsure (1)..(197): unsure at all Xaa locations
  Clone ID: SORBI-28MAY03-C73007_1.pep
PGKGKIPSEIQRSKSVRPLGAPPNPSRIPQILAEIPQSSVLAPPPPPPPPPPPPCDPGPPRLLSQPQPLPRISSTPRVSSRSRSLRATAATDWRDRPVIQDRPSSAREAGGAPPAEIHSRPEAAAPSYSSPPPPPRPAGTRVXVGWRSTRAWIGSSSFLRSVVFILQARNINLYRRSRSLYISPFFRGVQLNPHAPR

SEQ ID NO: 35709 - protein, 122 aa, Sorghum bicolor
  Clone ID: SORBI-28MAY03-C7246_1.pep
AYNEALVDARITNGGIIHSTFLESLMKRVGDIFAELPNLEDNLHRYLSMGTWPDTQNDIVVLSWYLHWYNIPPPHVVASAVEKVRPRVPAGVSMLPLLRLLLPNTHLVGLMEIEKLHIVMEY

SEQ ID NO: 35710 - protein, 241 aa, Sorghum bicolor
  unsure (1)..(241): unsure at all Xaa locations
  Clone ID: SORBI-28MAY03-C72492_1.pep
LSPFSSPLPGPVPPHARSPVARAAAPRRRPGAHGAPTTETWRPGPCCCIAVKRTRLTRSRGRGCWILCRLRSGSEEDAPSRRRIRPKHPTANPNSERGKCLLLAHLRLLDLKCKLPTTCASSSSPPQPTPLTRPRPSQRPTSASSSTAYASAPTACTPRPSPSPPLTAGPSPTRSSAQPLPPIPLPPXSLPSTLRLPRSPPRLTSPTSGPLPTASSLPAASSPSARSTSLLPPQLLRSLPA

SEQ ID NO: 35711 - protein, 149 aa, Sorghum bicolor
  unsure (1)..(149): unsure at all Xaa locations
  Clone ID: SORBI-28MAY03-C7250_1.pep
SIDVSRCNHVSSLGLASLIDDQRFLRKINVGHSLHEIETCLLSKLSTIGETLTVLRLDGLEIFASNLQAIGSTCKNLVEIGLSKCNGITDDGIVSLVAHCCDLRTIRVTCCHLLTNDALAAIAEDCRKYECLRLESXCPFICEKGLERI

SEQ ID NO: 35712 - protein, 303 aa, Sorghum bicolor
  Clone ID: SORBI-28MAY03-C72553_1.pep
MTSSGTGAQQLPRTEARSLSGHEGAVLAVRFNRDGNYCLSCGKDRTLRLWNPHTGAHVKTYKSHAREVRDVHSSSDNAKLVSCGADRQIFYWDVASGRVIRKFRGHNSEVNSVKFNEYNAVVVSAGYDRTVRAFDCRSQSSDPIQTIDTFQDSVMSVNLTKTEIIAGSVDGTVRAFDIRMGRETVDNLGHPVNCVSLSNDSNCLLANCLDSTVRLLDKSSGELLQEYKGHTCKSFKMDSCLTNDDAFVVGGSEDGYIFFWELVDAPVVARFRAHSSVVTSISYHPTKACMLTSSVDGSIRVWT

SEQ ID NO: 35713 - protein, 158 aa, Sorghum bicolor
  Clone ID: SORBI-28MAY03-C72514_1.pep
TLIAMSTRREIVSYHPLPAPGVTNSLKDEIQSKVTETVSNAINSFDPNALPRHIEGALGTAGNLINSFEPKWSGKKEFDFNGEADFLDGYQCPDEYWGSAPVKVQKPVNIKNLLGGVIAIIGRNLGNTEVEQPKDTKNSVSFLGSSDDGNTFLHSSVY

SEQ ID NO: 35714 - protein, 196 aa, Sorghum bicolor
  Clone ID: SORBI-28MAY03-C73088_1.pep
RLAQERMAGTGTKCPVFLFFSVNASGQFCGVAEMVGPVDFNRNMNFWQQDKWNGFFSVKWHIIKDVPNPQFRHIILENNENKPVTNSRDTQEVKFSQGTEMLNIFKNFACKTSILDDFDFYENRQKVMQDRRGKPLTTSFDHPLPKAEKTAEIKRQTHATVFGRAKSNEGQGNNVSEVVDAACSNKEQPNKVATQC

SEQ ID NO: 35715 - protein, 160 aa, Sorghum bicolor
  unsure (1)..(160): unsure at all Xaa locations
  Clone ID: SORBI-28MAY03-C73099_1.pep
MAPPARPPRVGEDMEEGTGESSPPPRSPRAFNPDLHGVQRKICERLRQTARHDRTLADPTFNARFARHLERLPRRYLLDLDLEDKVDDVLLHWRILDECADPNKRPVFHARFLKYKTVPMEDDGIGHSQGQEEPYXKLLEELSLERRKTVDRNDSMSISS

SEQ ID NO: 35716 - protein, 169 aa, Sorghum bicolor
  Clone ID: SORBI-28MAY03-C73120_1.pep
MWPGCGGRFYWAPESAPSAGQARGVAVLFAWVWSDEAQLRPFVELYSSLGWRCLVCHPDLVALYLSEKATSLATGVINELVKELRVKPVPTVLASFSGGSKGCMYKVIQLLDGICEGDATMKDYRLVRNCICGQIYDSSPVDFVSDVGTQFLQKPAVGIHLSQLYYVHG

SEQ ID NO: 35717 - protein, 187 aa, Sorghum bicolor
  Clone ID: SORBI-28MAY03-C73123_1.pep
MALKKLLRLFCVGKKDSKKKGKSIDPLWRASASLSSVSVTANKTHLDPCSSGTGTVCVQNHEPECSSMVSSWARTEHGTESTDHMSFKQFDVVQDFSDHHYAKTSAGKVTKDWVKAIQSEWSLLQKNLPESIYVRVYEDRTDLLRAAIVGPAGTPYHDGLFFFDVRFPSEYPKCPPKVYYHSGGLRL

SEQ ID NO: 35718 - protein, 181 aa, Sorghum bicolor
  Clone ID: SORBI-28MAY03-C73139_1.pep
MAAAHATKAAHAADDHDASPLPLPWPRPAPLLVILSLLAGASYLALTRVPAFASSGRLVPAALLPIAPPRPHDSRSRDSCAGFYAGAGPSRAVTASVEEFGAVGDGATPNTAAFRRAVAELEARAGAGGARLEVPPGRWLTGSFNITGRFTLFLHRGAVILGSQDPEEWPLIAPLPSYGRG

SEQ ID NO: 35719 - protein, 189 aa, Sorghum bicolor
  unsure (1)..(189): unsure at all Xaa locations
  Clone ID: SORBI-28MAY03-C7641_1.pep
MAMLQPALALPFLLLLLTAAAAGLPGGRTLVFILAGQSNMSGRGGATNGTWDGIVPPECAPSGRILRLSPALRWEEAREPLHDGIDVGNVVGIGPGMPFAHAVLAATSSGSDSVVVGLVPCAQGGTPIANWTRGTELYERMVTRARAAVAECSGRXELAGVLWFQXGEADTMRREDAELYRRRMETLVH

SEQ ID NO: 35720 - protein, 181 aa, Sorghum bicolor
  unsure (1)..(181): unsure at all Xaa locations
  Clone ID: SORBI-28MAY03-C76425_1.pep
MATGGKPAAPQPPPAAPSSSDRALESVHFSSGNPRIEETRGVVVLHPDPPAAASWSHLPVGRKPRVCVLAVPNHMTYADFCRFCGAFVPHTLEMRIVRTDGAEDQYSVLINFDTQSSTDSFYKHFNGKQFSSLEXGDVCQVRFVEDVHYTQLIEHAHTSVTNLAEQPTCPVCLERLDQDPG

SEQ ID NO: 35721 - protein, 93 aa, Sorghum bicolor
  Clone ID: SORBI-28MAY03-C7643_1.pep
IVPAYTMPPDAQHATVLRVVIREDFSRTLAERLVLDIEKVLHELDALPARVPSGDLAALAAADPRVRAMEKQREVISLWKRAVLAKKKTNGVC

SEQ ID NO: 35722 - protein, 122 aa, Sorghum bicolor
  unsure (1)..(122): unsure at all Xaa locations
  Clone ID: SORBI-28MAY03-C73409_1.pep
MDPSVAPGIVKEELLEQQQPLQDGVGDXAGGAPRPMEGLHEVGPPPFLTKTFDLVEDPATDAVVSWSRAGNSFVVWDPHVFADTMLPRLFKHSNFSSFVRQLNTYRVGTGDPVRCQVPIVLF

SEQ ID NO: 35723 - protein, 186 aa, Sorghum bicolor
  Clone ID: SORBI-28MAY03-C73423_1.pep
MASHLHRLLLVFLPSLLLFRRGPPPPPPTTPCPSAAVYPVVLVPGNTCSQLEARLTDAYEPPPESPQCGARERGRWFRLWRNATAMDDPAVKPCIVDQFRVVYDPAARDFRNVPGVETRVIGFGSTADFLADTQANKDLCLGTLVEALQQAGYRDGETLFGAPYDFRQAPAAPGLPCRAFARFTRR

SEQ ID NO: 35724 - protein, 166 aa, Sorghum bicolor
  Clone ID: SORBI-28MAY03-C73460_1.pep
PARCPLPLSLVVSGSDPPAAPSMRPLSSQDPIPLALPRCSPRPAGTPALSASRVAPPVMLAGLQRPLLVARILADLLLQGPLGVAHLVPHRRLRLSQLVAGPLVQSGALPRPLSSGLPTGLLGADYLAHQLGPHSHRQTSHARPPRRRGPCSWVPWGRCVPRADHC

SEQ ID NO: 35725 - protein, 133 aa, Sorghum bicolor
  Clone ID: SORBI-28MAY03-C73500_1.pep
MSVFCTFQAGGELADYIIVLRNTDAIKTFSGNAHMSIGAGISASAGHFGRAAEADFRAGDGGYAACYTYSCSKGAFVACALNGSVVSTRDSVNARFYGGPIKASEILLGSLPKPPAAATLYKALSVLFDKINK

SEQ ID NO: 35726 - protein, 181 aa, Sorghum bicolor
  Clone ID: SORBI-28MAY03-C73489_1.pep
FEVPRGKYYLVDAGYANTPSFLAPYNEVPYHTEEQDESNFQPMDYRELFNVRHAQLHRHIKRTVGLLKMRFPILNVATSYRKDTQLKIPSAAVVLHNIIQRQGGNEELLCEQTIPFASHKTVDVPSGDDTYGYDVSAFNSECDMGNALRGGIALRMWADYQSSISACMSDFRIEKAGLKEY

SEQ ID NO: 35727 - protein, 128 aa, Sorghum bicolor
  Clone ID: SORBI-28MAY03-C73683_1.pep
ATSTRWGTWPATSTTASTSPPTTQTATTSRAASTPSGVTTSTTAAPAGTSGAPSRRLESSSRLRHVMTMQPCREEGIGSRGGYQDTNRPLFALLLLKTRIYQYLSWSDSGLFFLVIIFFFFQSFPTKG

SEQ ID NO: 35728 - protein, 103 aa, Sorghum bicolor
  unsure (1)..(103): unsure at all Xaa locations
  Clone ID: SORBI-28MAY03-C73015_1.pep
YSLAYNQTTFVRSCKTMLYSLRKPPXKHERAILDACSAYMSGTIVGSSVGSALKYARDKCFADFHKSLTLYTEHLRTEFAANRRRMLELEREVSPAQEIVPSS

SEQ ID NO: 35729 - protein, 112 aa, Sorghum bicolor
  unsure (1)..(112): unsure at all Xaa locations
  Clone ID: SORBI-28MAY03-C73030_1.pep
SNVTMEKVKVPIRFSRGADDHSDDNYDRTALPRISXVLISDVVGVDLQRAPMLEAVPGAVYEEICFRNFSLRGIRRQDRWHCESVYGEAHEVFPAPCEEFRKNGSSSWCGFI

SEQ ID NO: 35730 - protein, 95 aa, Sorghum bicolor
  Clone ID: SORBI-28MAY03-C73033_1.pep
QYMWNHLLIEICICHGILPLFPILLMVFCCGFLWYIHSQQDPPGLTFARLEQIIKLCLGESGVASMSIFQEYLVCNKIFHIGMEKLAMKNSPILP

SEQ ID NO: 35731 - protein, 51 aa, Sorghum bicolor
  Clone ID: SORBI-28MAY03-C73048_1.pep
IGSIKGYMEAGASAVVLSDTIFDNQLMKDRKFSEISELANLATLEALQFTK

SEQ ID NO: 35732 - protein, 149 aa, Sorghum bicolor
  Clone ID: SORBI-28MAY03-C73072_1.pep
LLLGYDQVVKIADFGVARLGSQEGQMTAETGTYRWMAPEIINHKPYDYKADVFSFAIVLWELATSKVPYDNMTPLQAALGVRQGLRLDIPASVHPRLTKLIRQCWDEDPDLRPTFAEIMIELQDILHYIQAPKGPSRRSRAKMQKKSEG

SEQ ID NO: 35733 - protein, 121 aa, Sorghum bicolor
  Clone ID: SORBI-28MAY03-C73646_1.pep
SEATAARGVVPLHVPLQQRFPVADGTMDVVRAGHAVNRWIPEAALEFLWYDADRVLRPGGLLWVDHFWCRRSDLEGVYATMLRRLGYKTIKWVAADKSVAGGGNSGKDEVYLTALLQKPFS

SEQ ID NO: 35734 - protein, 149 aa, Sorghum bicolor
  Clone ID: SORBI-28MAY03-C73653_1.pep
PAVPLLVPRESVAPCTLGGYDIPAKTRVFINTFAMGRDPEIWDSPLEYLPERFENGGGEIDLKDPDYKLLPFGGGRRGCPGYTFALATVQVSLASLLHHFEWALPPGVAAEDVNLDECFGLATRKKEPLLVVVRKSDDYEFKGEELNEV

SEQ ID NO: 35735 - protein, 52 aa, Sorghum bicolor
  Clone ID: SORBI-28MAY03-C73662_1.pep
YSEIRHSNVKMIYRLQEHDYTSTSSSRNELGKHDDCTRTMPPLLYVNMTFVR

SEQ ID NO: 35736 - protein, 150 aa, Sorghum bicolor
  Clone ID: SORBI-28MAY03-C73671_1.pep
SALRFGCMEAGKVSVENYTFDPEVARKELAAMIALHEYPLCIVDHVGFRRFVTALQPLFKMVTRNTIRKDIMEAYTEERKKALSYMAFTKFRVSITTDLWTSDNQRRGYMAITAHFIDDSWVLRNIIMRYCSCFNYPTRQANYACGIPNF

SEQ ID NO: 35737 - protein, 169 aa, Sorghum bicolor
  Clone ID: SORBI-28MAY03-C73675_1.pep
PQEDSLNMPVDMVVGTPGRILDHIKDGNMVYGDIKYLLLDEADTMFDQGFGPDIRKFLAPLKNRAAKPGDQGFQTVLVTATVTKAVQKLIDEEFEGIVHLRTSSFQKRVSTARHDFIKLSGAENKLEALLQVVETLISPSLLRTYICLSVHSSLELDSCIQNPQNWFYI

SEQ ID NO: 35738 - protein, 112 aa, Sorghum bicolor
  Clone ID: SORBI-28MAY03-C73684_1.pep
DKMPINGTEDEVAALRKRMEEERGKVKEKKEKKVGNGLSGNKHAANVAAAGAGADKLENGKKGDAASAKRFKASDHAPAHANKEVYASIFTSSRKSDFKETYSCRSLPLGRN

SEQ ID NO: 35739 - protein, 233 aa, Sorghum bicolor
  Clone ID: SORBI-28MAY03-C73159_1.pep
SDRALNTTVHPPPPPPPPPFPAPPAGSVPALPAAGRPPPPPPPPPPPPGGASAVPFAPFSRSDKLGRIADWTRNPPGPAAFAAARDAVFDFAGLEDSVGLASADDSSFRLVDGKPPPRHPRFGPRWRFQQRPQLPQRRDEEVEARRREAEKERARRDRHWQQNRRTHHQFNRGGPSSSSAKPSVDIQPEWSVKEQIPFSSFSKLSFAVADQPEDLLVCGAVEFYDRTYDRVTP

SEQ ID NO: 35740 - protein, 222 aa, Sorghum bicolor
  unsure (1)..(222): unsure at all Xaa locations
  Clone ID: SORBI-28MAY03-C73160_1.pep
ARDSYLLSLPPDNARAPLPVSPPRRPRPPPPAPAAPAPPPRPAASAPPRPRRRAPPPPAAAPRPPPGPLAACPRSRVGAGRRPRGGETALQAAHAAVRGGVTVLEVVMTTPGVLEVIEDLCRSYPSLTFGVCQSDITLXGTVLNAADARKAIEAGAQFLMSPGTVLVVLLARHASCALCIPGVLTPTEVLSACSAGAKVVKVYPVSVMGGEAYMSALKKPFP

SEQ ID NO: 35741 - protein, 147 aa, Sorghum bicolor
  Clone ID: SORBI-28MAY03-C73230_1.pep
WLVRATVGNYAACLLGRALTCRYHKGDDYLEIDVDIGSSAIASAILHLALGAVTSVTIDMGFLVESQSEEELPERLFGAVRIAQMEMGAAKYVELPPDEAMPETAGRAGAGFRVSSAKVVNHSRQQDHAGGKVGRSMSCPERESGGK

SEQ ID NO: 35742 - protein, 213 aa, Sorghum bicolor
  Clone ID: SORBI-28MAY03-C73254_1.pep
ETEVQRPPAPPFAQRTPSPPNEISPQSTPRRRPAMCPTKPDRPGQAATAAGSVEKSWREEAVAAGSLRLVDLDRGANGWASPPGDLFHLRARGYFNSGGGKRGKAPSAADWLLRPAGVDWLRSHARLDHVLARDDNSVAAAFRRARLRKDPTAHFLLAVNLQVPGRPDAYSAVFYFAAEAPIPPDSLLGRFIHGDDAYRNARFKIANRIVKGP

SEQ ID NO: 35743 - protein, 182 aa, Sorghum bicolor
  Clone ID: SORBI-28MAY03-C73316_1.pep
METDSTSTTTPLFLLCATTVTIALVSLSLVLLVRGRKNRKADAGRLPPGPPALLFLVKFLALRRSIFDLAPLLRDLHARYGPVISLRLFRTLVFVADRRLAHRVLVQGGATFADRPPPVDPNSLFTTGGHDVSSSPYGAYWRLVRRNLAAEALQPARVALFAPARRWACDGLVDRLCDAGAA

SEQ ID NO: 35744 - protein, 93 aa, Sorghum bicolor
  Clone ID: SORBI-28MAY03-C73335_1.pep
CFASYSEVFSSWMHFCAVRVFVESILRYGLPPSFLSAVLTPSTKSEKKVRSILEELCGNAHSLYWKSEDDVGIAGLGGETEAHPYVSFTINFL

SEQ ID NO: 35745 - protein, 205 aa, Sorghum bicolor
  Clone ID: SORBI-28MAY03-C73758_1.pep
IDRPSTSATHSHSMDPSWVVLDRSVSLIARTGEKTTRGAGTSEFDTETWDVIEDEEAGVVLDNAIEEKKPMGVVDWVQDGLVRFVPELTKAPKISTISLLLPATPREIRAQLESVTVACADKNLLVLFTAPDSPYHASSGRYLVYDAEADTFIAPPRIDLEQFREVFGYVPAIVHLGQGGNFTLAVVVQSHLSSQYSGVVVVALH

SEQ ID NO: 35746 - protein, 62 aa, Sorghum bicolor
  Clone ID: SORBI-28MAY03-C73780_1.pep
VGAMGAGGVGVDWPLVRTWSITPAAHRQCMCTSYHDCRWPPVTTCCNQFLWSCRHVFPLPLI

SEQ ID NO: 35747 - protein, 133 aa, Sorghum bicolor
  unsure (1)..(133): unsure at all Xaa locations
  Clone ID: SORBI-28MAY03-C7381_1.pep
MPKLSCRVLCAALLIASLAALLVRFPIHRLLSPHAAMDPDSELEFEMPGVLRVYKTGRVERFDGTETVPPSPDGDPANGVASKDVVLDAAAGISARLYLPAGVDPGKKLPVVVFFQRRAFMVHTXAXPLYHIY

SEQ ID NO: 35748 - protein, 88 aa, Sorghum bicolor
  Clone ID: SORBI-28MAY03-C7384_1.pep
MSQNNPSQLLPSELIDRCIGSKIWVIMKGDKELVGTLCGFDVYVNMVLEDVTEYEYTAEGRRITKLDQILLNGNNIAILVPGGSPPDV

SEQ ID NO: 35749 - protein, 96 aa, Sorghum bicolor
  Clone ID: SORBI-28MAY03-C73845_1.pep
MSSSRFSPVLQASDLNDFIAPSQDCIISLNKNTSSSRRLQNKQKETTVSSKPPEEAVKISLKDCLACSGCITSAETVMLEKQSLGDFIDRINSDKA

SEQ ID NO: 35750 - protein, 194 aa, Sorghum bicolor
  Clone ID: SORBI-28MAY03-C73536_1.pep
LPPRPAPTHPAWPPPTPPPPPPLPAPGPPSRPRPPSPPPPAPAPSAAPPPPPPPPRRRPPRAPPPPPPPPRPPLPPPPPPPPAPAPRAGPPPGPPPPPPPPPPPRRRRRPPPAARPRPPAPPPPPPRAPPPPPRPRRPPPPPRAPSPPPGRPLPRPPPPRPPGLPAPRPRRPAPRPPPAPPPRRQGVQCQGLLP

SEQ ID NO: 35751 - protein, 173 aa, Sorghum bicolor
  Clone ID: SORBI-28MAY03-C73590_1.pep
MATSTTTTTPLVVSFSRSCRCPYPHRHSPGKPKPKLPPLRSLSLSLSLRTGPLAVLPRRRRDVSAAYGDGDMDDDFGDFDPDDADGVSEDDDVDNEQDYDVDYDRLLAPVVKPPLGPAAAEEGDIAMVTADSFVSTRESASDTVVDYTVDEDEFHKIRLLHCDFLIRKVPDPD

SEQ ID NO: 35752 - protein, 166 aa, Sorghum bicolor
  unsure (1)..(166): unsure at all Xaa locations
  Clone ID: SORBI-28MAY03-C73592_1.pep
MDPEDSSEFEEDNDDXEEEDDDLMLLILPAVYLASTGIGTLDQTSMVTDATAIETPSQVSKFNDAEWICKVLEDDRGQGYDKLRVEPHILLELSRYLRSNDLLRNTRGVSVEGKIGMFIYMLSRNASFQKLNDRFKYSTETIHRHIXACFDAVTPMTAEFVKPPLT

SEQ ID NO: 35753 - protein, 167 aa, Sorghum bicolor
  Clone ID: SORBI-28MAY03-C73642_1.pep
YTEALRRNPKDPRVYSNRAACYTKLGALPEGLKDAEKCIELDSTFSKGYTRKGAIQFFMKEYDKALETYQAGLKHDPKNQELLDGVRRCVEQINKASRGELSEEELKERQNKAMQDPEIQNILTDPIMRQVLTDLQENPRAAQAHLKNPGVMQKIQKLVSAGIVQMK

SEQ ID NO: 35754 - protein, 131 aa, Sorghum bicolor
  unsure (1)..(131): unsure at all Xaa locations
  Clone ID: SORBI-28MAY03-C74065_1.pep
MKRPTGGKGGAVDPSPLQSRCKECHGALVVVGADSGMHASAVQGSTMGASRMGSSYVVLSKNNRSQGLGIPPRPQSAAAPHIEPNQPPRPIEGSYIMLPPPAASIXSEGVGRQLLPPSVNSSSSMPGNNSG

SEQ ID NO: 35755 - protein, 116 aa, Sorghum bicolor
  Clone ID: SORBI-28MAY03-C74067_1.pep
MLPRKRGVDAGEVQDLHNKAPRAAAPAQDRDKEVVAEMAARAPEIDEDLHSRQLAVYGRETMKRLFGSNVLVSGLQGLGAEIAKNLALAGVKSVTLHDDGKVELWDLSSNFFLSEK

SEQ ID NO: 35756 - protein, 129 aa, Sorghum bicolor
  Clone ID: SORBI-28MAY03-C7407_1.pep
HDPFVHAPRSRRPNPSNPSSAMADDHYSSKRKYDDPSPPPRRTGFSSGPPPASPPAGGAPSYNSVPPPPDEIQLAKQRAQEIAARIFNAAEAKRPRVDNGDDDVGGYGGGAPWAAAVAVGVAASAAEDS

SEQ ID NO: 35757 - protein, 98 aa, Sorghum bicolor
  Clone ID: SORBI-28MAY03-C74121_1.pep
NSDDSFKAELMEVFVTLQGRYPYCFVHQTVLPTTIDLSQKMFTNPERTGAKEEKLGYWGYTLKVVLPGDRVELLFNISWQAYNDSCQAYKIKYIISYY

SEQ ID NO: 35758 - protein, 146 aa, Sorghum bicolor
  Clone ID: SORBI-28MAY03-C74139_1.pep
MASSSAAAAAAFVVLPFPSPSSSDDSDDADTLPPPPVAEPEAASPHHPPPPQLHQLERDCNLAMKGLARAGDVDQVVHLFSDLMLSATSAGVPPSVLCYNTLLNALAEDGRAVEARMVFDGMLAAGVAPNASSFNILVKLYAWRTA

SEQ ID NO: 35759 - protein, 171 aa, Sorghum bicolor
  Clone ID: SORBI-28MAY03-C7415_1.pep
AIEFIVSTFYGQVVMLSTHPYGCRVIQRVLEHCDDPKTQQIMMDEILQSVCLLAQDQYGNYVVQHVLEHGKPHERSAIIEKLIGQIVQMSQQKFASNVIEKCLAFGNPVERQVLIGEMLGSTSESEPLEVMMKDQFANYVVQKVLETCDDQQREMILTRIKTHLNTLKKYT

SEQ ID NO: 35760 - protein, 167 aa, Sorghum bicolor
  Clone ID: SORBI-28MAY03-C73691_1.pep
MDNGKPEAQHSGVRPPPPMASPSPSVSLDEDEARRAIVLDGAPHALPTTGSADVRPGSAAVRPGSAAVRPAATALGSGRPPKPILKKTCRLATPGAPAPTTPEASTEGGVRPLKSIGFTIKLTPASGSSSRQESLAHESVNDSDPIPISDGEEDEDTDFGTKKKLTS

SEQ ID NO: 35761 - protein, 224 aa, Sorghum bicolor
  unsure (1)..(224): unsure at all Xaa locations
  Clone ID: SORBI-28MAY03-C73742_1.pep
NGPGRTPPADSNPTIPIXSTFPIARQSAPAAAAMADEAKAKGNAASAAGRFEEAVQHFSDAIVLAPDNHVLYSNRSAAYASLGRYAEALGDAERTVALKPDWAKGYSRLGAAHLGLGDAPKAVEAYEKGLALEPSNEALKSGLAQARQAASAPRRPVGSGADAVGKMFQGPELWTKVAADPTTRGYLDQPDLVQMLREVQRNPSSLNSYLSDQRMVQVLTLMLG

SEQ ID NO: 35762 - protein, 219 aa, Sorghum bicolor
  Clone ID: SORBI-28MAY03-C73747_1.pep
MGRTGVASASSGGGAGWPCGGGLNLGVKLNVLLLLSVVATNLVSLYHLSLRAATVPPLLLQHQQQQRDGDEDLVLIRQLDAIRAGVSQLNHLRSSSPPPPPPPAELVLYSRLAPVASACSAHPDLLHRYMSYTPFAPCPDDALSLAEPLLLRGCHPLPRRRCFSPTASASASKLLPTDPFSPLPDAAVRWPKEGKCKSFSCLPPSLGFDVARTEAARFL

SEQ ID NO: 35763 - protein, 155 aa, Sorghum bicolor
  Clone ID: SORBI-28MAY03-C73755_1.pep
MDAMELNLLLLLVALSAAYVYYTTRRRRSPQRLPPAPPGWPVIGHLHLLSEMPHHTMAELARAMKAPLLRLRLGSVPAVVISKPELARAALTTNDPALASRPHLLSGHFLSFGCSDVTFAPAGPYHRVARRVVVSELLSARRVATYGAVRVKELR

SEQ ID NO: 35764 - protein, 134 aa, Sorghum bicolor
  unsure (1)..(134): unsure at all Xaa locations
  Clone ID: SORBI-28MAY03-C74395_1.pep
TSRHADATFVTVLLQDGTGGLQVLLDRGGWVDVXPLPGALIVNIGDFLQLVSNGRFRSVEHRVLANKSRDTPRVSVACFFNADAKRSTRLYGPITDGGSAPLYKSVTAREFVAYSYSKGLGGRPLGHFRLGAED

SEQ ID NO: 35765 - protein, 151 aa, Sorghum bicolor
  Clone ID: SORBI-28MAY03-C74426_1.pep
MCFELADQQRGGGGGGAGWPAKRRAGAGGGQDEGAGMAMAAAGTGEVMSEYYQAQELSTMVSALTQVVAGGPWAGSAAGAAPRGSAPEQQPMHGGYAQEIGAPSPELAGSQPASPTPRAAAPASVARPPAAAPRLPPSACTLSFNLCFVTT

SEQ ID NO: 35766 - protein, 86 aa, Sorghum bicolor
  Clone ID: SORBI-28MAY03-C74430_1.pep
NRESSFSPTAEFRFRPPPIHRQPAFHSPSPLPPGTPHTAQQAARGGGAIAHLAARPSPTSVAPANGRAFPGGREREREREGGGRER

SEQ ID NO: 35767 - protein, 282 aa, Sorghum bicolor
  unsure (1)..(282): unsure at all Xaa locations
  Clone ID: SORBI-28MAY03-C7447_1.pep
HEGFIHGNGLRDVAITGDKGVIDGQGEVWWNMWRRRTLEHTRPNLVEFMHSTGIXSSNIVLKNSPFWNIHPVYCDNVVVTNMMILAPHDSPNTDGIDPDSSSNVCIEDSYISTGDDLVAIKSGWDEYGIAYGRPSSGITIRRVRGSSPFSGIAIGSEASGGVRDVLVEDCSIFDSGYGIHIKTNVGRGGYIRNVTXXYVRMSGVRISGVRIAGDVGDHPDAHFSQLAVPLVDAVRISNVWGVNVQHPGSLEGIRSSPFTRICLSNVKLFGWRKNDPAWRCKD

SEQ ID NO: 35768 - protein, 192 aa, Sorghum bicolor
  unsure (1)..(192): unsure at all Xaa locations
  Clone ID: SORBI-28MAY03-C74458_1.pep
LGSPPRAPPRPPPLAPPPPPPPXPPPPPPPPPPPPPPPPPPPRAPPPSPPRPARAPAPLGPPPASARAPPRGGARARAPRAPPRGGAGARAPPRGGAPPPRPPRPAXARPPPPLRPRAPPPPRVPVPRPPXAAPPAARRPRPPRRQAPRRPRLPVPRRPPGPRLLRLRQGHRAGRAVRRVSSWVVGEVRLGC

SEQ ID NO: 35769 - protein, 206 aa, Sorghum bicolor
  Clone ID: SORBI-28MAY03-C73867_1.pep
TEDRADLCSFLVRDILLVSHVSGDRRRPRVLHPPSPPPTTCPLRSRRQRHLIHDVPPQISSAAGRSGMRSEQIGKPPAEPRTSSAAAALGSVTMSLGGSFASHLGKSFCCTLGSLAGYSEPWSPSSPLAPSRRVVSHRVCFPCFQGTSRVLRWQPLVPLSLLPPCTRGYAWPAPPPPAPGGLRLPPPMPPLCVLLNTAGRSWCPLL

SEQ ID NO: 35770 - protein, 157 aa, Sorghum bicolor
  Clone ID: SORBI-28MAY03-C73905_1.pep
MVTNQDAEAASAAAPGAGATVDAMRLASRWRSQAEWACAAAELESEPAPSELNTVNSSGLFSVVSTDKLSVKYLGSHHHGHDVGVVQADRPAPTRRAVYYFEMSRRPAGDSGRSAFRGADGRLYVGRRPGRASGPCGTSGDIIGAGINYLSQEFFFT

SEQ ID NO: 35771 - protein, 244 aa, Sorghum bicolor
  unsure (1)..(244): unsure at all Xaa locations
  Clone ID: SORBI-28MAY03-C73911_1.pep
LLLVRGGLLAGAVLGAVWLAPPPPAVPPPLPPPPAPPRRPAGGRXPPGAPPAWAPPPAPSPPPPVPGPPAPPPPXGPRSLLPRVPPTPPCRRAMPQGPGLLWSPPAGLRGPPGSPPAGSMLALLPPWGAGPAGPGLGSRPVPHGGRAVCPASRGPHGGHYPHFRVHCLLCLLCAMPSSPRPPSPCSGALILHRGALGAPPSGSVGPPGSSPPAPVPLPSSPAAPGCSGTAPSLTAQSAMSPRYS

SEQ ID NO: 35772 - protein, 168 aa, Sorghum bicolor
  Clone ID: SORBI-28MAY03-C7392_1.pep
LPRYLTVPPPDSAQQVKKIDEETLREVIGMGYDKNLLVESIQNRLQNEATVAYYLLLDNRLRTTSGYLGAECQEAMDSSFSNIASYETPSSARGNRQQIFMESPVGLRPHFPAERKWALGLQSRAHPREIMTEVLKALQELNVYWKKIGHYNMKGRWSPGFPGQIHNN

SEQ ID NO: 35773 - protein, 112 aa, Sorghum bicolor
  Clone ID: SORBI-28MAY03-C7395_1.pep
MTKQVVVVDTALVAPSEETPRQPLWLSNLDLAVPRTHTPLVYYYPAPAQGGAALGTGSFAPDRLRAALAVALVPFYPLAGRLGVGPDGRLQIECNSNGALFVVANADLTPTF

SEQ ID NO: 35774 - protein, 108 aa, Sorghum bicolor
  Clone ID: SORBI-28MAY03-C74653_1.pep
RDHLLVPRERKNAFLWKKVEELILEDSRIDQYPKVIKGESKVVYEWQASGSLSAKIKKVQGARVKSRTGGGAIKFAEEMGACLVEVREQGSCDLIREERSKAKLTSSD

SEQ ID NO: 35775 - protein, 111 aa, Sorghum bicolor
  Clone ID: SORBI-28MAY03-C74696_1.pep
KKLSYRVVYPLELKLSSSSSDAVADCEYSLFAVVVHLGSGPNQGHYVAKIKSHDHWLSFDDDNVEMIPESTLQTFYGSSREYSGNTDHGYILFYERIGGNGDEKTDSSDGV

SEQ ID NO: 35776 - protein, 198 aa, Sorghum bicolor
  Clone ID: SORBI-28MAY03-C74701_1.pep
HEAGIHRDVLLLSKPQIFITDYFFKATLDDNFSLADIEVDVEIDSHKKDREHVPTLSIEATLFDNSGLSISIDAGLSYANAVNLKPKPNPTGSPCRGFHGYVLGGKIENPKLWSSEHPGLYTLVVLLKDANGKLIDCESCQVGIRNVVLAHKQMLVNGCPVVLRGVNRHEHHPRLGKTNLEACMIEDVILMKQNNINA

SEQ ID NO: 35777 - protein, 223 aa, Sorghum bicolor
  Clone ID: SORBI-28MAY03-C7472_1.pep
AEVEKLSQTVRELEEDVLQGGATANVVRDYQRKVQEMNEEKKIRDRELARAKVTANRVAVVVANEWKDANDKVMPVKQWLEERRFLQGEMHQLRDKLAIAERTARSEAQLKEKLQLRLKVLEEGLRGPPSGSSRPPMEGKSLSNGPPRRLSLGGVDSISKISPNGVLMRRSPSFNSRSSLSTSSCLVLKHAKGTSKSFDGGTRSLDRGKVLGSGPHSLNRSTD

SEQ ID NO: 35778 - protein, 131 aa, Sorghum bicolor
  Clone ID: SORBI-28MAY03-C74735_1.pep
FESLLPLRTSRHSCCQAQGGLGLPHAPGAIDRSERRRLGIGPGHGGESRRRMSSDAAGGQRSISNSARGDAAAAMPTSSPFVVGDSSGGAGSPIRVDRMVREHGRRYDIFASDAMDTDGAEPASAYAGPFA

SEQ ID NO: 35779 - protein, 163 aa, Sorghum bicolor
  Clone ID: SORBI-28MAY03-C74153_1.pep
MAQLPPRAPSALPQDHWSAAGAEFLGFAAARRGAHRRSASDSAAFLEVVPMDDVIGGGGSGSAGDDFDRLDDEQLMSMFSDVDAPAVSDGAGERAGDAAQLMDVGDAEDGMAASSPAGARAAADGVADPKRVKRILANRQSAQRSRVRKLQYISELERSVTSL

SEQ ID NO: 35780 - protein, 147 aa, Sorghum bicolor
  Clone ID: SORBI-28MAY03-C74224_1.pep
VGIVFQFLERYFLADTVLEEVTFGWPRQKADLRLKEQLALNLQNAFNSVGLTTISLDEDPQALSGGFKRRLALAIQLVQTPDLLLLDEPLAGLDWKARADVVNLLKDLKKEHTILVVSHDLRELYPLVDYSWRMEMGGSLKEEGLPV

SEQ ID NO: 35781 - protein, 199 aa, Sorghum bicolor
  Clone ID: SORBI-28MAY03-C7430_1.pep
MHWKLRSLNENLGDMTQPGNIYNPNHQQVTLSRNEPSPSYNNMDSNRNALQQYAQGPSDRHIEQMYHGSNFQQDTTRPTPSNYFEEGRVDGDSQLYQPDGDALPGIEGFQIAGEPRPGFQLTACGFPTNGTTLCNFQWVRHLENGTRQSIEGATMYDYVVTADDVGTLLAVDCTPMDDNGRQGDLVTEFANNGNKITCD

SEQ ID NO: 35782 - protein, 199 aa, Sorghum bicolor
  Clone ID: SORBI-28MAY03-C7428_1.pep
TLFIMQSTLDPLLALVALAFSWWLCSLLTAKKVQKTMTQKQKQSKVLSEQMLTQGLPNSPKIQFLSPSKIGFGRTTSRSSATQYGRSNLANGGLICSALTKRVVPNEDDEDHYSTFHNIQPRKYSKEEWEDFTQKSTRKALAECTATPEFAQWVADNARRLQVGKEEDNFSEEETIEGSNSEETGDEADGAPGLIRLWG

SEQ ID NO: 35783 - protein, 133 aa, Sorghum bicolor
  unsure (1)..(133): unsure at all Xaa locations
  Clone ID: SORBI-28MAY03-C7427_1.pep
GGPSPAPAPARCQVDGCNVDLTDVKPYYCRHKVCKMHSKEPRVVVNGLEQRFCQQCSRFHQLPEFDQLKKSCRRRLAGHNERRRRPPPGPLATRYGRLAASFGEEPGRFRSFMLDFSYPRVPTAMRDGXQSST

SEQ ID NO: 35784 - protein, 84 aa, Sorghum bicolor
  Clone ID: SORBI-28MAY03-C74797_1.pep
MDGGSGNASGGGGGGSGGASTCCYYALLGIRKNASATDIRTAYRRLAMTRSYKWHPDRWASDPGAAGEAKRRFQRIQEAYSGKA

SEQ ID NO: 35785 - protein, 78 aa, Sorghum bicolor
  Clone ID: SORBI-28MAY03-C74807_1.pep
LHDCRCLPRQYPYDVVKKICYYVYQMYTRDKINLLVSPNGLPASMYTHLQFYLFLLLIRSCNMIFWTSPLQCLFGITV

SEQ ID NO: 35786 - protein, 240 aa, Sorghum bicolor
  Clone ID: SORBI-28MAY03-C7482_1.pep
MVHRPFIRKAVSNIFYQFVFETDRHNGIAELLEVFGSVISGFALPLKEEHKIFLWRVLVPLHKPKSVGVYLQQLTYCVTQFIEKDPKLASSVIIGLLRYWPITNCQKEVMFLSEIEEILESTSQAEFQKCMVPLFRRITHCITSSHFQVAERALFVWNNDHIISLIAQNRQVIMPLVVPALEQNIQNHWNQAVLNLTVNVKKMFSEMDDDLFSSCLAKYKEEEEKRVSLEAKRKLTWEKL

SEQ ID NO: 35787 - protein, 198 aa, Sorghum bicolor
  Clone ID: SORBI-28MAY03-C74820_1.pep
HFIASNNDCGVREYDMERYQLFKHFRFDWPVNHTSLSPDGKLVIIVGDDTDALLIDANSGKTINSVKGHLDYSFASAWSPDGLTFATGNQDKTCRIWDARNLSQSVHVLRGNVGAIRSIRFTSDGQFLAMAEAADFVHIFDIKSDYNKRQELDFFGEVSGMSFSPDTDTLYVGISDRTYGSLLQFGRLYNYSYLDSLL

SEQ ID NO: 35788 - protein, 156 aa, Sorghum bicolor
  Clone ID: SORBI-28MAY03-C74845_1.pep
FYFTSKFFGLKKSSSLSDFMFAGEQSCNQDLSTLRKKYPNRSDEDFSRYCFSMAYIVALLHDSLGVPLDDKRIEYSNQVGDVQVEWALGAFITLMQNTSLKPLHTAAEPIHSNRPLFAVLGMFLLCGVLFVSRWRKPKTKIIYDLEKGRYIITRIS

SEQ ID NO: 35789 - protein, 200 aa, Sorghum bicolor
  Clone ID: SORBI-28MAY03-C74864_1.pep
MERLDASTSSSPLSPSTSHGERAASAVSGGRGFTTMPDPTAKPPSPRPRRRRRLCGLCLGTALLALLVSALVHAVASPPRRPAPGPASARFSVVIDGGSTGTRAHVFATGHDGRPDLARSTVMRVSPGLSSFAADPARAGESLKSLIDFARDEIVGSGGAAREAEVRLMATAGLRLLEERAQEAILASCRDVLRASGFRF

SEQ ID NO: 35790 - protein, 216 aa, Sorghum bicolor
  Clone ID: SORBI-28MAY03-C74480_1.pep
MAARTPTMVHLLVTLVCFLISSARTSSSSASSSDVDAFLSCLSADVPPSIIYTPANNNFSSVLVSSVRNLRYYDYDVTPGPGTTTIVSRPLAIVAATEPAHVQTTVVCGRRHSVHIRTRSGGHDYEGLSYASIDVDPHRRHFAVLDLAALRAIHVDASRAEAWVESGATLGERFGAAAAANAPLVPVTETVTVFSIRRLRNESAVDLITKWQAIAP

SEQ ID NO: 35791 - protein, 196 aa, Sorghum bicolor
  Clone ID: SORBI-28MAY03-C74488_1.pep
MSATEPAAGLASDGYDRRRELLQAFDDTKAGVKGLVDAGVTAIPAIFRHPPESLEATSSPPPTDVVASAGTIPVIDLAAAAPRGEVASQVKRAAETVGFFQVTNHGVPRELMAGVLAGVRRFNEQQPEVKRRFYTRDTARKARFCSNYDLFQSAAANWRDTLFCELAPDPPRPEELPEAVRYEHTRRHTNPRSMHY

SEQ ID NO: 35792 - protein, 122 aa, Sorghum bicolor
  Clone ID: SORBI-28MAY03-C74494_1.pep
LLILILLLGLQTSSAPQCEASSCGCWCCEAWATAYSFRQPTSKLIGASTGSCFDCFLFVWYLGIPNQVKEETDPWHHAVKTDPRHHAKVLYALLAPTHRRASICNSCSFLFQISPILLVRWS

SEQ ID NO: 35793 - protein, 152 aa, Sorghum bicolor
  Clone ID: SORBI-28MAY03-C74574_1.pep
MVFASGSGAAGGPQVLTARFVRHVVLGRWFMGFACLLILSASGATYIFSIYSKVLKSSLGYDQRTLNTLSFFKDLGANVGVISGLINEVTPPWVVLAMGAAMNLVGYLMIYLAIDGRTARPPVWLMCIYICVGANSQSFANTGALVTCVKNF

SEQ ID NO: 35794 - protein, 114 aa, Sorghum bicolor
  Clone ID: SORBI-28MAY03-C74550_1.pep
ARGPIGAYVLNVRVAGALYDVEAAKQHGGSLVGAGDKTCIGVECFRKSFLIITAATVAGALVSLVLVWRTWNFYKGDIYAKFRESADAAEAEAEDLKRPKETAEAETEVNGRKQ

SEQ ID NO: 35795 - protein, 70 aa, Sorghum bicolor
  unsure (1)..(70): unsure at all Xaa locations
  Clone ID: SORBI-28MAY03-C74624_1.pep
AGSSSTXXRPRIRSSRSSRRAGPGRGGRDGALLARDPARVSRRTGDRIGSCEGGGAAGVTDSHPAHRAVG

SEQ ID NO: 35796 - protein, 137 aa, Sorghum bicolor
  Clone ID: SORBI-28MAY03-C74917_1.pep
VGLVAALLAVRYKWWMDPVGAILIALYTITTWARTVLENVGTLIGKSAPAEYLTKLTYLIWNHHEEIQHIDTVRAYTFGTHYFVEVDIVLPGDMPLSQAHDIGESLQEKLEQLPEVERAFVHVDFEFTHRPEHKAEV

SEQ ID NO: 35797 - protein, 80 aa, Sorghum bicolor
  Clone ID: SORBI-28MAY03-C74950_1.pep
ITLIGITNTEFNQLKGQTILFYYQKEKNKTNTSHSSLAPLMAANTCQKNRDKRKLRYAKDSEKTASNAQVLLSFCWFLAA

SEQ ID NO: 35798 - protein, 218 aa, Sorghum bicolor
  unsure (1)..(218): unsure at all Xaa locations
  Clone ID: SORBI-28MAY03-C75003_1.pep
LRGPLRVPPSPPLPPPPPPPPPPPPPPLPPPRPPPPLGPGPFPPPLAGVGSRPPPLPAGLPRPRAVPPPPPPSPSAPPPPASAPPSPPSPPXSPSPSRGFALSPPPARGSPLLAPPRPRPPLPSSPPPLRPSGGYCRPSLFALPLRVASPAPSAAAARRCPLARCRTARPRGRALRGGPTRRPKGRRAGPVFVPFVGGLPCEQRIWEVSIFSNLLIEA

SEQ ID NO: 35799 - protein, 152 aa, Sorghum bicolor
  Clone ID: SORBI-28MAY03-C74982_1.pep
AMVGSSWWCWFVGNRGGPSIWRLTGNALHGPGAVVPHRWGSGAWLARPTRKARLHPPAHFAWPGLGRSRNPCHGRPRGLRSLPQHTPRGPPVCAWTPPPLRGILRAAGPPWSRGVAAEHLAGDSPQAASPPSYQLPGGWQQPARRGGGPPLP

SEQ ID NO: 35800 - protein, 184 aa, Sorghum bicolor
  unsure (1)..(184): unsure at all Xaa locations
  Clone ID: SORBI-28MAY03-C7501_1.pep
AAALAARTVRLTWAETLGKWALGELAFGIKYYMRQQGNLQHEYAGSDSVLLDGPEVRQELISLLGYLNQCMYFSKKPYNVFLEYGGYGQNDVLIKKSKARXLLKPAFTIVRDRSSQCFLLFIRGAISVKERLTAATGAEVPFHHVVVQEGHVSNLVLGYAHCGMVXAARWXAKQAIPCLSKQWS

SEQ ID NO: 35801 - protein, 100 aa, Sorghum bicolor
  Clone ID: SORBI-28MAY03-C75017_1.pep
MAAEAGSRRGAAARREAQEAAVGAAARVLFYPTLLYNVVRSKVQAEFRWWDEVDQVVLLGAVPFRRDVTRLQKLGVHGVITLNEPFETLVPSSMYKASGL

SEQ ID NO: 35802 - protein, 128 aa, Sorghum bicolor
  Clone ID: SORBI-28MAY03-C78060_1.pep
PQSAPPRRSSCRAVSNRGLSPERDSHGGSGDESSSPAAADHPPWRPSPSPMRRTPCRRRQTNSMPSGFAVCLSPLVRPSPGRRHRHVQPPDPGSFSCELRPSPLHSLSSAASVTRCRSRKLADCGRFR

SEQ ID NO: 35803 - protein, 114 aa, Sorghum bicolor
  Clone ID: SORBI-28MAY03-C78086_1.pep
EMSCFSHSHLLLRVGKLQQMTKKKCQTDAEHIQSDDIQQCIKTAEAIHSHSILALRAFFFFFDQSAQSLACQQKSQDGNRKRKQGVCTSRIITVFLQKKKKKSMKGLITYTNSG

SEQ ID NO: 35804 - protein, 221 aa, Sorghum bicolor
  unsure (1)..(221): unsure at all Xaa locations
  Clone ID: SORBI-28MAY03-C78133_1.pep
MLPTTATASAPPPPPAAGPASSSSSSSPXASRXXRAPPGPXAXXAAXRELLAXARARAAAXREAVXGGPXSSGYAXVVESPLSHRITDEALLALTDRARGRLRSLHLLGCPRVSDAGLLRVVERNPNVTELFVPRCTGLTADGLVKIIHFLHGHKGNLSRVRLHGICKMTNHHLDVIKSLVCRGSQQQDAQALYYNHRVHEVLNTDDGRPIDVDVCPLCRN

SEQ ID NO: 35805 - protein, 64 aa, Sorghum bicolor
  Clone ID: SORBI-28MAY03-C78137_1.pep
QVSLVQTFVIIFSEWSWDNDTKYKRKICFLETKKRNICFELPKIGIGYLSCIDDQGQYPWRQKN

SEQ ID NO: 35806 - protein, 128 aa, Sorghum bicolor
  Clone ID: SORBI-28MAY03-C75244_1.pep
KDEIWLVPLMPFQLLQYGPDEMQGAGHADEAWMSPASALLQEPGGSNDQVRGERPLVLAPDHHGRLSSGARRWTAQQITNVLWGFSATDATDVHTLNAMITCCGYPHFFQGRGWHRAGGSSGDARLCQ

SEQ ID NO: 35807 - protein, 211 aa, Sorghum bicolor
  unsure (1)..(211): unsure at all Xaa locations
  Clone ID: SORBI-28MAY03-C7527_1.pep
VEVADIKRLNGLSTDLQMFAHKTLRIPLPGRHPPSSYQENGSYESDDRECTPRRIHEDILDSILKTPKPKVSPAMSLLQGYYGLAPPPKRDQTSEGTEMAVYSKGKSAFLDVEPWLEPPNSDPFPLQNRKTRSLMIGSSLDGDTDENGDSERFIRRRQKADGELXPREENGGDFLASAGKGLALRPKSSNRPDMNKSQQNLFAMAEPLFVN

SEQ ID NO: 35808 - protein, 224 aa, Sorghum bicolor
  unsure (1)..(224): unsure at all Xaa locations
  Clone ID: SORBI-28MAY03-C7536_1.pep
NRRKEKRTPPPSALPPPSSASAPPLFNPSPSAIARSSSRSRREPHAFPCLALPSLSSPPPLPAYLPPVSPPAARLPSPRACLLSDAGGPPRRPAXPPRGDSKPGHGARRRRQPRPPARXRSSSSSCSPRHSPSELPRQRWTSRRQRACPRRWRQTRTRSSSTSCRGRSSSSSRRRGPRSPTPTPCPTPCRRPSAAPAGGSQPRANERGPECGRRAGLRTAPLPV

SEQ ID NO: 35809 - protein, 130 aa, Sorghum bicolor
  Clone ID: SORBI-28MAY03-C75420_1.pep
NPDGIRCVKETLPYQNYSQPLDLYHDMRMYDLVVKVASSMEKVPVTVINITKMSDYRKDAHTSLYSIRQGKLLTPKQKADPEKFADCIHWCLPGVPDVWNQILYTKILSKPSWQSNLSPPPSQSLPLPPQ

SEQ ID NO: 35810 - protein, 150 aa, Sorghum bicolor
  Clone ID: SORBI-28MAY03-C75362_1.pep
EVVFSKNATVRLIVAYWAHFIPNTEKYLKSLLYSNILCASSTYNHCGGKVEIKYYMVPGYNETGPALSQGGTMTGNRYPGFTRVNHGKYAVSDVRANIGTSNLIWDYFYTTAGVSFGTYNPNIVTQLQDIFDADWYSPYTVLVEPLDESV

SEQ ID NO: 35811 - protein, 179 aa, Sorghum bicolor
  Clone ID: SORBI-28MAY03-C75438_1.pep
HPLPRPRTVSSLLSRRRHSLLARSSPAWAGHCATSPPHQHTPSLPQQPWPSHRRTPPALPPPPTSHYRYPPPPPPGGSASWVPSPPPLTPSSPRRAAPRSPRWWRPSSCSRSSCTARTCAPSPSSPSTTTSTRTPTSTTSRASRRWPYRRPPATSPADAGSSTTSPSRRTARRTAPSSP

SEQ ID NO: 35812 - protein, 214 aa, Sorghum bicolor
  Clone ID: SORBI-28MAY03-C74871_1.pep
MPQGALLTSMSAPSPTLIPLTSIAELRQHHSQLIRLGVASHPAHARRLLSFLARDPDSHFPYASRLLAHHPAPHPALFNPLFSALPTRHAARLLALMLSLPLHPDHFTFPRILPGAQPLHLVAQLHALLLKLGFHAHTQSLNALLAAYLANARPDLASRVFRGGGGDALDVVSWTTLVGGLVKLGRVDDARELFDGMPERNLVSWNAMMSGYVK

SEQ ID NO: 35813 - protein, 194 aa, Sorghum bicolor
  Clone ID: SORBI-28MAY03-C74873_1.pep
MARIRGPRLAVLLALAVLAAVAVAAVAAAAAAEERAQSTYIIHLSPGHPALSAARANGGGEAVLRRLLPRRLRAPRPRVLYSYQHAATGIAARLTPEQAAHAAAGEGVLAVYPDKVRQLHTTHTPSFLGLTETAGLLPAAAGGASSAVVGVLDTGLYPIGRGSFAATAGLGPPPASFSGGCVSAASFNASAYCN

SEQ ID NO: 35814 - protein, 165 aa, Sorghum bicolor
  Clone ID: SORBI-28MAY03-C74905_1.pep
MAASAKLPVSKGIAGMDNDVVAAGGGKKAGRWGFVQFFFVLAVVLCVLLYAPRVLVLSPYGYSIDVGLLAPTTTSSPSSSVPAPQQQQRVSGGGNAGGGDGGHGRDDEVVLDNEVHSPCSSMRDNTICCDRSSVHTDVCFMSGDVRTDAASLSLLLFPPQQHRHD

SEQ ID NO: 35815 - protein, 160 aa, Sorghum bicolor
  Clone ID: SORBI-28MAY03-C74912_1.pep
EGDCRARPGPFFGLRYLAGSPVLAKMKLDLSEAVGYALTAPAGQMDLSLWERFYLQGIDSLMTLYELDYWPPQDKEVNQCSLTLPAVGLLQGCVGLRKLFVHGTTHEHFLTFFLKVPNLRDMQLREDYYPAPESDMMNTEMRAESWLRFENQLNIRLIED

SEQ ID NO: 35816 - protein, 90 aa, Sorghum bicolor
  Clone ID: SORBI-28MAY03-C7550_1.pep
ATRSDRDGDGHERRAVAALLLLLLLRMRKGSLVAACSVLKLLLFSLLCICNGSTLPIAGLVATNKKGMFLRSWRPLCWCSASGCHLLVAS

SEQ ID NO: 35817 - protein, 124 aa, Sorghum bicolor
  Clone ID: SORBI-28MAY03-C75516_1.pep
ERMRLDEEVLMDFFREHINVTKVESRVRILADMRELASAESLDSFTLIYTNILEHQPDCPPEVVEKLVAMREGIPRKEAKEVVQECKEIYENSLVDGNPQKSGFVFGKLKCLTAKKGIWRKLGQ

SEQ ID NO: 35818 - protein, 299 aa, Sorghum bicolor
  Clone ID: SORBI-28MAY03-C7553_1.pep
DAWASEALALREQAESLRSLVAKKIEEHKKISDKYNSQVIEIKSLKALVEELEQEKQELEFIADMYAKESSLSRTLADIEESETRARNQAEYLRSNLEEHSLELRVKAANEAEAACQQRLSFAEVELEELRTKVDASERDVVELKEAIRIKEAEGDAYISDIETIGPAYEDMQTQNQHLLQQLTDRDDFNIKLVSDSVKMKQACSSLLSDKLMLEKQLQQVNTSLESSKLKIARGEEQMNTCVAQAIKTSAENRHLTISLERIAVEVSNTDKELKWLRSSVGSSEKEYEQTQQKISELR

SEQ ID NO: 35819 - protein, 121 aa, Sorghum bicolor
  Clone ID: SORBI-28MAY03-C75600_1.pep
MEKTKLQLPLPLVHSERLWARPWRWAKTAFFIVAMLASLLLVCAPPLLVVLLDLLLPPALLSNFLRAQAHAPPVSSASAAGVSFAAALSGQARAFRFGSSLVDLPAVSAARSLLILCAYTA

SEQ ID NO: 35820 - protein, 181 aa, Sorghum bicolor
  Clone ID: SORBI-28MAY03-C7562_1.pep
ARGESPGIVPAGRLPRYKEVILLNDLIDCARPGEEIEVTGIYTNNFDLSLNTKNGFPVFATVVEANYVAKKQDLFSAYKLTDEDKTEIEKLSKDPRIGERIVKSIAPSIYGHEDIKTAIALAMFGGQEKNVRGKHRLRGDINVLLLGDPGTAKSQFLKYVEKTGHRAVYTTGEGASACGLT

SEQ ID NO: 35821 - protein, 122 aa, Sorghum bicolor
  Clone ID: SORBI-28MAY03-C75624_1.pep
SLMGTNQLACCSVNNFQRVQTSQPKAPLGESREKQIQFVCHSYKLRKGPMITFANGEVILDVVIRREALAPRPYAEIKTIGDALKMPLAWPFNRSKACCQQPRSQGVVGSSQRSSQGAAGSS

SEQ ID NO: 35822 - protein, 216 aa, Sorghum bicolor
  Clone ID: SORBI-28MAY03-C75018_1.pep
SGGTLSNKQTTELAPGLEASGQRFLMVVRFPSDKDCSASYFGTAAEHGDDDPLRYLPAGFLERTRGVGLCVPLWAPQVEILSHGAVGGFLSHCGWNSTLEAVAAGVPTLAWPRYAEQRTNAVMLSEGAGVALGPGQGGGIGDGDDGVVPREEVAAVARELIAGEKEGAAAREKARELQKTAAKAWAPADGPSRRAFEAVVAKWKEPDELPFGSLLG

SEQ ID NO: 35823 - protein, 266 aa, Sorghum bicolor
  unsure (1)..(266): unsure at all Xaa locations
  Clone ID: SORBI-28MAY03-C75042_1.pep
IVGWSGRSRRLRPGSSPPPPRVPPSPPPPPPLAPCPPPPPPPPARRLPPPPPPPPSAPPPPAPPQPARAPGAPAXPPSPPAPPPRVPPSAASPPPRGAAPVAATPLPGGSGRGPPAPXHPWPLPPPLPPPAPPPPPXPPPLPRRPAFRRWGPPAPSPPLRSTPDGVPPPLPPXPPRPLPFPSGGCREGSHPLWGWGSGWLCGGSPPPARVRGCSPDWLSSTGPLLPDGTLVASRVYSNPIYFDAQQIDIFLLAILNIFFCLPFYYC

SEQ ID NO: 35824 - protein, 201 aa, Sorghum bicolor
  unsure (1)..(201): unsure at all Xaa locations
  Clone ID: SORBI-28MAY03-C75059_1.pep
PPGSSARPSPASPPAPXPPLPPRPPPPSRPARPPPPPRRAGRRRRPPRPSAPPPEPTPAPAPFVPPAAPPPPRPPPPPPPPPPPPXGPPPPLPSEGSSXPPVPRGPPGLPPPPPPGAXRGPPRPPPRPRLAAPPAGVRPPFLRGPLASRPPPAGPGGPRPPPRSDALVSSDSPPRFPRGTSSSSANRELLGPQVLLLFPRP

SEQ ID NO: 35825 - protein, 126 aa, Sorghum bicolor
  Clone ID: SORBI-28MAY03-C75118_1.pep
VGEVVGNPVGYAARRALAATSQGDDYARSLVDYLEGVDAMNLPRSGISRAHLRAISWMGMSLHDSDFGWGAPVFMGPALMYYSGFVYVMQAPGKEGAVALALSLEPESMPEFRKVFADEVARLRTI

SEQ ID NO: 35826 - protein, 181 aa, Sorghum bicolor
  Clone ID: SORBI-28MAY03-C75217_1.pep
MATVELLSTELVVPAEETPAGAVWLSNLDLAARRGYTPTVYFYRTNNKPEFFEADAVKDSLARALVAFYPLAGRLGLDAATGRVQIDCTGEGAVFVTARSEYALDELLNEFVPCDEMRHLLVPATPAPNPPCPLLFAQVTRLRCGGVVLGLALHHSVVDARSAAHFVETWASIARGGGGGG

SEQ ID NO: 35827 - protein, 85 aa, Sorghum bicolor
  Clone ID: SORBI-28MAY03-C7571_1.pep
DLLWAMATLGFEDYIEPLKVYLQKYREMEGDSKLTAKTGDGSIKKDVLGHVGGSSSAAQGMGQQGAYNQGMGYMQPQYHNGDISN

SEQ ID NO: 35828 - protein, 70 aa, Sorghum bicolor
  unsure (1)..(70): unsure at all Xaa locations
  Clone ID: SORBI-28MAY03-C75712_1.pep
ALSVVKLCRPLEACHVVKSRFTCTFTHIYATSTPKVPSTYIHPFPSPESPKNILLLIQERIAXNIYVFPL

SEQ ID NO: 35829 - protein, 155 aa, Sorghum bicolor
  Clone ID: SORBI-28MAY03-C7576_1.pep
ARGEDAPGLLQILLNRGIGVEEIKLYGAEEDNEMIEDSTESNFEDLENVIANIFPKKGKGYLLSVSRYERGEKAIYCLSCLISLIEQSRYLQFRDCPVEWGWCRDLQSFIFVFTSHNRIVLERPEYGYATYFFEVVQSTPIEWQIRRLVVAMKLS

SEQ ID NO: 35830 - protein, 109 aa, Sorghum bicolor
  Clone ID: SORBI-28MAY03-C7577_1.pep
PVPCDRSQRSGALMGSYWWASDPGNSDSLRPKPEIRSSMWHALVGFSAVQRYLIHQQGRAKENVSARASPAREQQRARAKAVRARCEAPEVVARCRAGTRRRGWRASFR

SEQ ID NO: 35831 - protein, 96 aa, Sorghum bicolor
  Clone ID: SORBI-28MAY03-C75810_1.pep
MDAMEPSSGADAGRRVVLFPLPYQGHLNPMLRLAAALHRRGLAIIVLHTDLQPLDPANHPTEYRFESLSADVPAELMASKDIARVVMDLNASFAAP

SEQ ID NO: 35832 - protein, 216 aa, Sorghum bicolor
  unsure (1)..(216): unsure at all Xaa locations
  Clone ID: SORBI-28MAY03-C75823_1.pep
MLWAQGRKEWMPLSSIPELHSIATASKDQSTQAAAPDVDDDFAKFQKEVTAPGKEVKGSAEVGDVDRQDDERPATPPDGEEEFTDDDGTIYKWDCTLRAWVPQNDVSGKKDGYAVEEMTFALEEEVFQAPDIPGPSALEEINTPAEVKNKESDKAEKRGEKKQKSSQKPAXKKEANKPPDSWFDLKVNTHVYVNGLPDDVTVEEIVEVFSKCGIIK

SEQ ID NO: 35833 - protein, 167 aa, Sorghum bicolor
  Clone ID: SORBI-28MAY03-C75454_1.pep
MWPVVLMVVLILFGGPVTSASSAAGGGNNNATRAAGNNGGGNKPQHQKKPLAPALIVFGDSIVDPGNNNDIRTIVKANFPPYGNDFQNHRPTGRFCNGRIPTDFIASRLGIKDLLPPYLSAQPLDKHDLLTGVSFASGGTGFDPLTPQLASVISLPDQLTMFHDYLA

SEQ ID NO: 35834 - protein, 187 aa, Sorghum bicolor
  Clone ID: SORBI-28MAY03-C75455_1.pep
MALLTSPSRPRKQRCPSPTMLSLSPSLLSLILLLPFRSLLLLHRSSFPGSSCSPALPGAASRRGSAAGFQGDLRDIEFSWNHLPFSASRPPPAKLKIAVFSRKWPVASAPGGMERHAHTLHTALAARGHRVHVFTSPPPHTEAAPSAPAEGPQLHFLDGEPGQWRCDEAWKLYEAEGENDPFDVIHS

SEQ ID NO: 35835 - protein, 265 aa, Sorghum bicolor
  Clone ID: SORBI-28MAY03-C7547_1.pep
RTRGIEAKKRFEFLEAVSGTMDAHLRYFKQGYELLHQMEPYINQVLAFAQQSRERSNYEQAALLERMQDFKRQIDRESRWSPNGMNDSPNGDGIQTIGRSSHKMIEEAMQSASKGKVQTIRQGYLSKRSSNLRGDWKRRFFVLDSRGMLYYYRKQNSRPSSGYNQRTSIPSEHGSGLLSRWFSSHYHGGVHDEKSVARHTVNLLTSTIKVDADQSDLRFCFRIISPTKNYTLHAESAMDQMDWIEKITGVIASLLSSQSPERRLL

SEQ ID NO: 35836 - protein, 241 aa, Sorghum bicolor
  Clone ID: SORBI-28MAY03-C75494_1.pep
GLSPPAGGGVNVAEDAMGTGGKQPATPSSEDNKLLKRLSIGPKMRDALLFRRSGEKDEEQDRDGFFKRLLRDSRDKDDDDGDREGFFSRLLKDSREKDNEEEEGDRDGFFRRLLRDSKEEDMELTPSSDGLLKRLFRDKEDKQGEDDEKEGFFRRMFKDKNEERRDSIHARHGDEERVGKSVEDDDKEGFFRKIFKDKNEERKDEGHQKPDEREKVGANIEEDKRDGSFRQLFKDKNDEKK

SEQ ID NO: 35837 - protein, 84 aa, Sorghum bicolor
  Clone ID: SORBI-28MAY03-C75927_1.pep
SQEKACRSFLREPTMISCSFNFFHLAIHTWKENYDVSDIVMGPASETRAEALKHSETFSSPLVGPNNLLVAWLFSRRHFTIFFW

SEQ ID NO: 35838 - protein, 105 aa, Sorghum bicolor
  Clone ID: SORBI-28MAY03-C75928_1.pep
GGLAGGCSAYLTTPLDVIKTRLQVQGPTFRYNGWLDAITKTWASEGVHGLFKGSVPRIIWYIPASAFTFMAVEFLRDHFNGKVDADAHELTSLSIDTRSEVEKSA

SEQ ID NO: 35839 - protein, 129 aa, Sorghum bicolor
  Clone ID: SORBI-28MAY03-C7594_1.pep
MLRRGVLLQAAVHLLLLLAVARSPLAYASEADHKYKTEEPVKLWVNKVGPYNNPQETYNYYSLPFCQPSENPSHKWGGLGEVLGGNELIDSQSDIKFIKNVDKGAICTIELDAQKVEQFANAIENSYWF

SEQ ID NO: 35840 - protein, 197 aa, Sorghum bicolor
  Clone ID: SORBI-28MAY03-C75943_1.pep
MAASPSSPPAAAGVGGQSVIPLPLAPSPHLTNFFVWREFVWGGIAGAFGEGMMHPVDTLKTRLQSQAIMTGAKAQKNIFQMVRTVWASDGLRGFYRGISPGVTGSLATGATYFGVIESTKTWLEIANPNLSGHWSHFIAGAIGDTLGSFVYVPCGVMKQRMQVQGTQKSWASAAAKGSISQTHGTQMYGYYNGIFHA

SEQ ID NO: 35841 - protein, 165 aa, Sorghum bicolor
  Clone ID: SORBI-28MAY03-C75998_1.pep
MAAAAAAAVAHLSVHGRLRRSPEHRPSTSSSSAPAHRPSLLRCRAFKQETDGGGGDRDSDPSEPDARKRRKGPLYKLKAAIQGLAGSRSAAAEVYGGEHQYQRAVEKAEEIFFSVATQLGRYAITMMSSGVVLGVGFQLSGGDSQMNELIWYSWLGGVIIGTMIG

SEQ ID NO: 35842 - protein, 127 aa, Sorghum bicolor
  Clone ID: SORBI-28MAY03-C76022_1.pep
HGGGRYEEDDEYKKPSGGGYGYGASSGGGHGGRYEEEDYKKKPSGHSGGRYEEEEGYKKASGHSGGKYGKEEDDKKKKHGEDESEGGGIGDYLKLAQGFMKKQDGEGESGGGMGDYLKLAEGFLKKR

SEQ ID NO: 35843 - protein, 119 aa, Sorghum bicolor
  Clone ID: SORBI-28MAY03-C76228_1.pep
MPSLLLSRYSWAEMLPLPGSSSPGIARGCGWQHLGAYVNLGSFYLVGIPTALFLGFVLKMEAKGLWMGISCGSIVQFLLLAIITFFSNWQKMSEKARERVFSDEPSDKEPLESDGSNLF

SEQ ID NO: 35844 - protein, 109 aa, Sorghum bicolor
  Clone ID: SORBI-28MAY03-C7565_1.pep
MVCSQLTAAGASSLAAAAVRSRAHSPAAAFAQLRSTPRIASAGLSVKGNRAALPLVAAAGPAAAAPVADLDGPPATEKQPIIVIDNYDSFTYNLCQYMGELGLNFEYTE

SEQ ID NO: 35845 - protein, 137 aa, Sorghum bicolor
  Clone ID: SORBI-28MAY03-C75654_1.pep
GKDCTESASCFAGSYGYIAPECAYSLKATERSDVYSMGIVLMELVTGLLPTDKTFGGDMDMVRWVQSRMDAPLPAREQVFDPALKPLAPREESSMAEVLEVALRCTRAAPGERPTARQVSDLLLHVSLDYYRACEKR

SEQ ID NO: 35846 - protein, 121 aa, Sorghum bicolor
  Clone ID: SORBI-28MAY03-C75671_1.pep
GGARMRRARAWAHGFPSESASGSDEAGELKEVAVTASCLREKERESRQQRRPVSQCMGRAAGRRGIEWHRLRPPLEGVVVLGEWRSCSAELAKQRRERGRLRLAVGGVSRAEQGRGERWSR

SEQ ID NO: 35847 - protein, 170 aa, Sorghum bicolor
  unsure (1)..(170): unsure at all Xaa locations
  Clone ID: SORBI-28MAY03-C75702_1.pep
CASTSHLRISPPARLPPLLAHPPPDDRPSPPAGPRTSAPTACPRMFATTDRAAAHRTSPPSANLPTMSSPAAAXRRRERWPQRCCASRWRCWSAPRRQTRRSSTRPPPRFSPAPTTTTSSPSAPSPTPAATPRAPTLSPPPAPPPPPRGHASTSPSARTSSTTSWWRASS

SEQ ID NO: 35848 - protein, 119 aa, Sorghum bicolor
  Clone ID: SORBI-28MAY03-C75688_1.pep
SLLAKARDSHCTRVATIELAMVQTMAARQRERRCHWHGATRRPAHAEEAARASSRRRWPPQAVTTATRFLICGEPLMRRRRWRDFLMRGMPLMRHRRSGSLIRCGGAAEPARGLLNPDL

SEQ ID NO: 35849 - protein, 80 aa, Sorghum bicolor
  Clone ID: SORBI-28MAY03-C76132_1.pep
GLVSEGKGVIFANNSMDQPRVSWRTKAVGPWQEEALRSPYVGWGRDRRIRPDQRRSPGRCGCALTSCTSPHQERGRERKR

SEQ ID NO: 35850 - protein, 95 aa, Sorghum bicolor
  Clone ID: SORBI-28MAY03-C76152_1.pep
MVAAAALDAMAGTRWGRGLGLVTAVWVQCISGNNYTFSNYSHALKTLMGLTQLQLNGLSVAKDVGKAFGLLAGLASDRVPTWLLLAIGSLEGLLG

SEQ ID NO: 35851 - protein, 161 aa, Sorghum bicolor
  Clone ID: SORBI-28MAY03-C7617_1.pep
ARGWLHGAMHQRGVFSWENRMKVVTGTAKALAYLHEAIEPKVVHRDIKSSNILIDDEFNGKVSDFGLAKLLGSDKSHITTRVMGTFGYVAPEYANTGMLNEKSDVYSFGVLLLETVTGRNPVDYSRSSNEVNLVEWLKTMVANRRAEEVADPSLEVRPSIR

SEQ ID NO: 35852 - protein, 101 aa, Sorghum bicolor
  Clone ID: SORBI-28MAY03-C76171_1.pep
VAPVRVISPERAIKFAPIGLANMLNTAGAVQAFEARKDAGGVTAEVSVKGDGELVAYSSARPRLCKVNGEEAEFAYKDGMVTVDVPWSGASSKLCRVEYVY

SEQ ID NO: 35853 - protein, 123 aa, Sorghum bicolor
  Clone ID: SORBI-28MAY03-C76174_1.pep
PLLSRALDTGDLGGLVDPRLEMKWLNEVEMFRMIEAAAACIRHSASRRPRMSQVVRVLESSAEIDLTNGVQPGRSQLFNVANTAEIRMFRRMVAGAQDDDSSDLTQYDWSRGSDAAPSSRIAF

SEQ ID NO: 35854 - protein, 122 aa, Sorghum bicolor
  Clone ID: SORBI-28MAY03-C76220_1.pep
GNKGCKVVCEDVRLSTCKIKKAGIGGPLINLDGSFVGMNFYDGSGVTPFLPRDKIVDVLSGVNSLPSECGYNHPMPINVISGARKGIKKNKWPVPKPYWYHGGLEASVHDLGNHKHIGRRLN

SEQ ID NO: 35855 - protein, 130 aa, Sorghum bicolor
  unsure (1)..(130): unsure at all Xaa locations
  Clone ID: SORBI-28MAY03-C75854_1.pep
MASLYVVHHTSLPLSPPHQLTAPEPPRAPPPSSRLPAVPSSSHXSAPSLDPRRLPPPSRATAKRRSGTTTPSSSALYSPTATAPSTETQHRRKSSVPAPTDRAATAGARGRVSAPGIARSGSWSCPWRSG

SEQ ID NO: 35856 - protein, 103 aa, Sorghum bicolor
  Clone ID: SORBI-28MAY03-C75872_1.pep
MDCSQDSQEESHQRRENGEEAEKAADYGNALSRKEATEELLGCVVHSEEEAYRLYCDYGHRIGFSVRKGKQSYFIGTKNIRTKDYYCSKEGLKYDEPVTEANF

SEQ ID NO: 35857 - protein, 95 aa, Sorghum bicolor
  unsure (1)..(95): unsure at all Xaa locations
  Clone ID: SORBI-28MAY03-C7591_1.pep
SVDNIDMALREIKRVLKPDGLYVFIEHVAAPDGTLLQFVQGALDPLQQFVADGGHLTRKTXXSIRDVGFSSLSLDSVRLSNAYIISPHVYGVACK

SEQ ID NO: 35858 - protein, 57 aa, Sorghum bicolor
  Clone ID: SORBI-28MAY03-C75925_1.pep
FQEAALNSTLNLQDVQGLVTWGDGDGMLRTGVFDRPTPRPPRAVLQKAPGHDGALRM

SEQ ID NO: 35859 - protein, 164 aa, Sorghum bicolor
  Clone ID: SORBI-28MAY03-C76322_1.pep
AYVDFLVEQACVSLRQLYQQGARRIAILGMPPVGCVPLRRTLAGGLARDCDPARNHAAQLYNSRLKEEIARLQEELQCQKIGYVDIYDILQDMITNPCKYGFEVSTRGCCGTGEFEVSLLCNQVTATTCPDDRKYVFWDSFHPTERAYEIIVDYLFPRYIESLL

SEQ ID NO: 35860 - protein, 65 aa, Sorghum bicolor
  Clone ID: SORBI-28MAY03-C76328_1.pep
RRPPAAGSAGAGTTGRAPACVHDGSDEGAEGFYEAERDKGQFLCLVCEGSGARVGKRFAGCAALV

SEQ ID NO: 35861 - protein, 132 aa, Sorghum bicolor
  Clone ID: SORBI-28MAY03-C76332_1.pep
KIDAVKYIELLEAEIDELSRQVARKSSQGSNELLEYLKSLEPQNLKELTSTAGEDVVFAMNAFIKRLLAVSDPEQMKTTVSETSANQLANLLFWLMIVGYSMRNIEVRFDMERVLGAPPKLAELPPGPGESI

SEQ ID NO: 35862 - protein, 202 aa, Sorghum bicolor
  Clone ID: SORBI-28MAY03-C76335_1.pep
RGFTPTQSSEKPSGPHLNPPPVEDIIHVISHSSFRVNGEQAAKETRSESIDVDKRLNMVREEIGVRSIEPNLIPSGPIDSATVNPNVAEANTTFQKPASTDTIKLPTIPEGNFSTMETNNGFKQEAAPAKEILDVTSFRQRAEALEGLLELSAELLEHSRLEELAIVLKPFGKAKVSPRETAIWLAKSFKGTMNDEASRSST

SEQ ID NO: 35863 - protein, 92 aa, Sorghum bicolor
  Clone ID: SORBI-28MAY03-C76367_1.pep
MAARSSSSPPEDDYETEQKKQAAADVLFHYSQFVMVCIGEDVRPTDLRLHLMKEVSGMPTSLKEPQQAASSPASSGEPSSSGMMKGDKNEIS

SEQ ID NO: 35864 - protein, 243 aa, Sorghum bicolor
  Clone ID: SORBI-28MAY03-C7639_1.pep
ATGLLFVVMQPPIKLSWVYRSDFITAAHLSDDDISIYGFVASKPTWPSWLLIATVVLTLAAVTSIIPVKYVVELRALYAVAVGITLGIYISVQYFFQAVVLYPLLVATIVSAAVFVVFTHLPSESSTRVLPWVFSFLVALFPVTYLLEGHLRSKSFADEDEAEKFTNMLAIEGARMSLLGLYAAIFMIIALEIKFELALLLREKAADRGMHGPSSRSSAFPPKARLLQQQRAHAAPTFTIKRL

SEQ ID NO: 35865 - protein, 165 aa, Sorghum bicolor
  unsure (1)..(165): unsure at all Xaa locations
  Clone ID: SORBI-28MAY03-C76406_1.pep
APPPDPGPPTPPPRRPPWPPPPPPGRPPPPPPXPPPPGPPRPPPPGPPGHAGAPRRPPLPPPPWPAPPGPGPPPPPPNPPPPRPPPPPPPGPPWGPRPGGPGPPPPPPAPPAPGPRPPPPGPAPAPPGAPPPPPPPAPPPSAPPAAPPAASPWTPPGGPPARAPP

SEQ ID NO: 35866 - protein, 142 aa, Sorghum bicolor
  Clone ID: SORBI-28MAY03-C76057_1.pep
MAVGYIVMALAMPGSLFIGSVVVGICYGVRLAVTVPTASELFGLKYYGLIYNILILNLPLGSFLFSGLLAGLLYDAEATAVPGGGNTCVGAHCYRLVFLIMALACVVGFGLDVLLCVRTKRVYAKIHESKRLSRSAVAQRVG

SEQ ID NO: 35867 - protein, 101 aa, Sorghum bicolor
  Clone ID: SORBI-28MAY03-C7608_1.pep
MDETVPALVTGQASTDAVTEQPVNVYIWDMDETLILLKSLLDGSYAGAFDGLKDREKSTEIGKRWENLILELCDEHFFYEEIENYNEPYLNALNEYDDGRD

SEQ ID NO: 35868 - protein, 114 aa, Sorghum bicolor
  Clone ID: SORBI-28MAY03-C76092_1.pep
MGDLPKRINCWKQFMASCISVENHWGAGLPGTYTGQGRAASNGGHPPGGERMPGSIRRARAHTRRATPPASRATAGNGRGANQSGCPEGHRPGGRGPGEGAGGHGRALPQRRGR

SEQ ID NO: 35869 - protein, 103 aa, Sorghum bicolor
  Clone ID: SORBI-28MAY03-C76101_1.pep
GYDCNDAVERGEGVEGAVLPQRGVVHVVPPGLHRRRRQTHHGRATFHHSLASSSSSSSSEPDQAAESNQMLGSRMQSKQRRASDQKPKLEEIKIRRGGRIGDC

SEQ ID NO: 35870 - protein, 191 aa, Sorghum bicolor
  Clone ID: SORBI-28MAY03-C76440_1.pep
RAHNKVMAEHPRSPCRPTHSPLLELPSVPIVPPSHLEDLQRKTGNSRAKSAPPRALATKEDSSACSSSTIGYAETTNQSEPSEPDSPTYLVPSCKCLIPDTIIQKHDIENKASSEVNTTNCEKKITSNGAISLSAAMVQSSDTTELEFICKDGIPSSQVGQCSDTVTVLSDEDKFTVQELLSSVPDLSSLC

SEQ ID NO: 35871 - protein, 136 aa, Sorghum bicolor
  Clone ID: SORBI-28MAY03-C76508_1.pep
PRGQVYDPKIDRWEVMPVGMREGWTGLSVVIEGRLFVISEYERMKVKVYDAEADSWDSVSGPPMPERIMKPFSVSCLDSKIVVVGRGLHVAIGHVQKEPAGDPDSRSSGYSICWQDVDAPKEFSDLTPSSSQILHA

SEQ ID NO: 35872 - protein, 164 aa, Sorghum bicolor
  Clone ID: SORBI-28MAY03-C76560_1.pep
MAYRELELTLLSAQDLKSVNLITRMDVYAVVSISGDPLTRQCTPPDTYGGRNPCWDATFRFAVPPTSTAAAGASASLHVLLRAERFLGDRDVGEVVVPLAEILAGATGVGPQPPKVASYQVRKLHRWEPRGVLNVSYRLGPVVAPVVEWPTPAEKPAAVTAVYA

SEQ ID NO: 35873 - protein, 224 aa, Sorghum bicolor
  Clone ID: SORBI-28MAY03-C7657_1.pep
LSPGAVNCGSTHDTGNMFPLNTPENLGVCSEQTGVCPKESSFVALREGFGDLGLSFWECPRSPRDDPTSQILDTSTKATDNPGEVENYPANDQPKQGPVSGAVEANPVPVEDEHDSALHPCPSNERDSAMGLANLGADTETCVDVHSDKWTDVSISGSGEDFTSAKIASKKRNNPGDRITALDGSLVGSANDDESARERDGPFSPPQQRSVRPRVILDIASDSD

SEQ ID NO: 35874 - protein, 229 aa, Sorghum bicolor
  Clone ID: SORBI-28MAY03-C76572_1.pep
LLVFRATRNCTWVGELWVHYLLSLERIRASEEELQHVFERAIQCSFSTIQEYLNIYLTRVHGLRRRISDGLDFQLIRQTLTDAAEFLSPQLGINELLRLYAYWAKLEHSLGKDLSAARGVWENAIKKSGSVFEVWVQYISMEIEMGHVHEARSLYKRCYSKRFAGSGSEEICHSWIRFEEENGTLDDYDLAVKKVTPRLKELMTFKSQEEAKVEAYPNPNDNSNANDSS

SEQ ID NO: 35875 - protein, 81 aa, Sorghum bicolor
  Clone ID: SORBI-28MAY03-C76591_1.pep
MQRSRRALLRRTAAAQEQSAVAEAEAAANGRKRRLYGFSASLVVASWVAVLLLHSLVGHGDSQRDGGGCAVDLTVVEPALN

SEQ ID NO: 35876 - protein, 151 aa, Sorghum bicolor
  Clone ID: SORBI-28MAY03-C7624_1.pep
LPQIVELADIARCIANTPLDEESALSQMVTCIEDLQEIVNRRKHEALTVQTFGTRIEKLHREKYLQLCDSVDMDKVDSASTIMDEEDDVVRSLRASPVHPVKDRTSIDDFEIMKPISRGAFGRVFLAKKRTTGDLFAIKVLRKANMIRKNA

SEQ ID NO: 35877 - protein, 304 aa, Sorghum bicolor
  Clone ID: SORBI-28MAY03-C76242_1.pep
MDLASFITSVLTSFVIFVALVLVFTWLSRRPGNAPVYYPNLLLRGVDPWEGRGRGTRSPVGWIRDAISASEPDVVAAGGVDAAVDLVFLSSVLSILVYSGIVLLPVLLPVAATGGALVGIPPNPNNSSESTQDFSAIERLGVGNVPEGSMRLWAFLLSVYWVSFVTYFVLWKSYKHVSNLRATARSTPDVKPEEFAVLVRDIPRSSPDETIKDFVDSYFRALHPNTFYRSMVVTDHTKADKIYQEIEGHKQKIARAEAIYANSKTESNPEGTKPTHRTGFLGLIGKKADTIEYCSEQIKGLLPK

SEQ ID NO: 35878 - protein, 183 aa, Sorghum bicolor
  Clone ID: SORBI-28MAY03-C76254_1.pep
MEERVPLLPQYTLRNDDGREEKCGGGGGVRWWRELLAREAGKVGCVALPMAAVSVSQYAVQVASNMMVGHLPGVLPLSASAIATSLATVSGFGLLIGMASGLETLCGQAYGAKQYDKLGMHTYRAIVTLIVVSIPISLLWAFIGQLLMLIGQDPLISKEAGRYIAWLIPDTRILVRRPAHLLQ

SEQ ID NO: 35879 - protein, 238 aa, Sorghum bicolor
  unsure (1)..(238): unsure at all Xaa locations
  Clone ID: SORBI-28MAY03-C76260_1.pep
ASSHFSLPIPIPILAVAVSIGLPCPATPPPPRRRPAPPCPAXPPSLERLPVPSPPPPPPPGPGPPLPHHRRPRGPLPHRPTPLPXPPAAPPPLTSPPPAAPPPSSHLQPPGPPRHTAPPPPRPPLLSPPPTSPTPSAAPTPSLSPPASPAPASNAPPPSAPPPTRHRPLPTPAIAVDPTHSGAGKNPSSNKSSSSSPGAPSRNPSAPFGSLGTGVVIAIAAGVVALLLLSLLVTAVWF

SEQ ID NO: 35880 - protein, 242 aa, Sorghum bicolor
  Clone ID: SORBI-28MAY03-C76700_1.pep
MLRGLEKHQRNNGDDTSPEANNSGELDDRRSLECSTSTEAPGNSGHRSRNRAPDDDSFDSESSSSGPPTVKRSTAVAALLPPFSRPTPSKWDDAEKWISSPTSNRTGRAGPTAGTVPKKSALAFPEHGGRPPAVAKVVTDVPTNTGPLVKNSDGLADPDLLKPAHNASIVDEPAPAVRSVSMRDMGTEMTPIASQEPSRTATPIIASSPTSSRTPTPQRTTELSVSNIDSNKMEMSEEELQI

SEQ ID NO: 35881 - protein, 208 aa, Sorghum bicolor
  unsure (1)..(208): unsure at all Xaa locations
  Clone ID: SORBI-28MAY03-C76704_1.pep
PYSQQRVFAVQVFELHRLIKVSLRQINNFFRLMLMGRLTYGCFNLKFDLTIXFMLTCKQVQKLVAASPHLLIEGDPCLGKSLAASKKKLAGDVEKQLQSAKNNDEVQPTQQQQLEHSKENTEANQPSPSQDDAAGVQHNNQAAINGAVSSNPPSMPTPSDNKQNSWCIPPPPSQWLVPVMSPSEGLVYKPYSGHCPPAGSFMAPPFFA

SEQ ID NO: 35882 - protein, 93 aa, Sorghum bicolor
  Clone ID: SORBI-28MAY03-C76701_1.pep
KKKKKKIRGNHLSDSRSPSPDSSRRGSATPASPRCSSSRGVQSSPLRRCHTAPRRLHPVSVPSPAPATPPPLLPPPRPPTPPPPRPSPSKNTS

SEQ ID NO: 35883 - protein, 227 aa, Sorghum bicolor
  Clone ID: SORBI-28MAY03-C76710_1.pep
SSSSLPRASASAPFPPHAAAPGHCQVGHTMEQPPPASSSAPAPAPQSLVSRARTAIHSAAARVLTDIKADLRDAEGFGGRSRAPSPRTSLDREAEVSATGREPDVKPPPSPRDEVLEVSPSGNEDCSNIPTELTCSTKLTFPPASVVKQLVSAIENGKSFKSMSDMRYTGDQLLKDKGGLSLSVVKSLVRRDKEERSSSEFFGDEETQSLMYSLFKLEEQFSLEGSQ

SEQ ID NO: 35884 - protein, 87 aa, Sorghum bicolor
  Clone ID: SORBI-28MAY03-C76727_1.pep
SSSSSSTTTASASSSRASSSGSSTAAAAPTFVSLPSAHSSTTAPAPASAVVSPSVTVGAKELPSSAADVVIRGSGLGGRGAVKVASR

SEQ ID NO: 35885 - protein, 212 aa, Sorghum bicolor
  unsure (1)..(212): unsure at all Xaa locations
  Clone ID: SORBI-28MAY03-C7674_1.pep
ISASTVDFHPSREGVSAIEFDRKGIYLASVTLSGCLTVHDFETLYCSKYSPSCSMPDESSNYVIHISNRIPLNSVRWNPGNQDEIACTSSQSDKVFLFDIGYVSSAPTEVLHKGKSKFPALYSESCKSLTDITFTSDDKSRMFACGLDGAVYMWDRRSSKTHCLELMASPESQFNTVKLTVDNRTVFGALKMXTIHVWDLRGGGHQLLLKPQ

SEQ ID NO: 35886 - protein, 80 aa, Sorghum bicolor
  Clone ID: SORBI-28MAY03-C80252_1.pep
VSRYREKRRTRLFAKKIRYEVRKVNAEKRPRMKGRFVKRTTLPPLPRPPPQQQQKQLPRALPHVGMVLAPPPGANGRFQF

SEQ ID NO: 35887 - protein, 120 aa, Sorghum bicolor
  Clone ID: SORBI-28MAY03-C80273_1.pep
DLFAKARKSSRTNPFIGADKDSSTAFAQPTVLRGHAMYNFLVRMLTVMSMLDSRAEIRENTIKFFMETEFCEFSPELEDHFEIFEHIRGFNVTIVTSADTKDETSLLWSGFTLNDEGETK

SEQ ID NO: 35888 - protein, 169 aa, Sorghum bicolor
  unsure (1)..(169): unsure at all Xaa locations
  Clone ID: SORBI-28MAY03-C80338_1.pep
RTSCSWRLPLVLEILVLFAALLGSAQCQSSQGGDGGGGGAAANLTVVGAVFCDACSSSSFSXSSYFLPGVKVRLDCMIKVNSNSKEEIKITAEKVTNSYGAYQLDIPAIDGFECAAPGATAAESFCRAAVLDNSSALCNVPAVTTTVGHISFPSHEPNACFYSLNSLYY

SEQ ID NO: 35889 - protein, 352 aa, Sorghum bicolor
  Clone ID: SORBI-28MAY03-C80345_1.pep
MATITAAARWSSPTRLQLLNSRRLRFSASAAPPTSTAGFGWADALRVDVDSGHGDESDLSGYFRKVKTCNRGMDKKGQFVEFSVEDQVVGYIHKRFIEHIRDFHDVFTIVLGNNGSNSVEHVSLHSSLRTPEDRTHAIGSVVKMLGEMIPGIRDELYPVTSSYGMPVYFSLERAAAPYFGIKAYGVHMNGYVNKEGQKFLWIGKRSDVKQTYPGMLDHLVAGGLPYGISCKENIIKECEEEAGIPRSISTNATSVGAVSYIDIEGFRYKRDVLFCYDLELPSDFVPNNEDGEVDSFRLVPIPHAASIIRRTEFFKPNCNLVIIDFLFRHGYINPDSRGYLELMQTLRSGDCS

SEQ ID NO: 35890 - protein, 119 aa, Sorghum bicolor
  unsure (1)..(119): unsure at all Xaa locations
  Clone ID: SORBI-28MAY03-C8050_1.pep
PTRPTNLVSLDLYLNNFTGSIPDSLGKLLKLRXLRLNNNSLTGSIPKSLTAITALQVLDLSNNNLSGEVPSTGSFSLFTPISFANNPNLCGPGTTKPXPGAPXFSSPXPYNPTTPAQSP

SEQ ID NO: 35891 - protein, 200 aa, Sorghum bicolor
  Clone ID: SORBI-28MAY03-C76832_1.pep
MEAPAPWRVLEFYSGIGGMRYSLMASGVRAEVVEAFDINDVANDVYEHNFGHRPCQGNIQTLTASDLDKYKAHAWLLSPPCQPYTRQGLQKHSADARAFSFIKILNLMQDMSYPPQMLFVENVVGFEVSDTHDQLLEVLSSLNFNTQEFILSPLQFGVPYSRPRYFCLAKREPMRFRNASVNNKLLQTPMCLSMTLNSTS

SEQ ID NO: 35892 - protein, 267 aa, Sorghum bicolor
  Clone ID: SORBI-28MAY03-C7689_1.pep
ITEKQAKMGLVCRVHSNDKSKFKLLYFELEENGGLSLALQEDSVKVGKVTAAGMYFLGFPVYRFEQNNLAAAAKDSDGAFFKRLDSFQPCDIHELKPGTHFFAVYGDNFFKTASYTIEVVCGESFPAEKEMLRNVEAKILTKRAELSKFESEYREVLAKFTEMTSKYTQEMQAIDDLLKERNEIHASYTNNPPLKRSSSRNKGKSPSKVAKTDTEKQPQKEKKVKDHCMAGYGSDSDNSKSEKKSKERFPRKKWLNIPFKLDRRKTC

SEQ ID NO: 35893 - protein, 167 aa, Sorghum bicolor
  Clone ID: SORBI-28MAY03-C76844_1.pep
PIALETAAAAGHAAPEQSSIQDLDSAVSDTMDVSYEKFADPSNSDLPSAVDVEQSENGSSEHLGSAVVKGATGNEGYSGIESSEQTDDELAGDEGSLVNVENSADKQENQETVPMEETAMSDGTSITSMEDALEPNNDLPPEPEDMSNHTPDPSNGKSVNGNRNVFQ

SEQ ID NO: 35894 - protein, 175 aa, Sorghum bicolor
  Clone ID: SORBI-28MAY03-C7691_1.pep
VVRPGARETPLKGYTSSQQESPYTMQRVDSKPTVHGCEDDARSTLTSNRSMTDDLTRTCRSETNYSKGVSEHGHFDSIQEPDLQPNCFSRTLKLQKKLLSSGAAHTICLRIQPHNKMDFLPKKEFDTYFCAYEPYEQCSRSNSRATYSSRDDDLWSKNSRFGSNLLCWRAPKQSM

SEQ ID NO: 35895 - protein, 112 aa, Sorghum bicolor
  Clone ID: SORBI-28MAY03-C76922_1.pep
LGFKDSSRASFWNASCMCRKIRCDEKSYKVFGIKQGHKGMSGSHLDIRYVYSCLENKMKPNHFIMRLENGYETTTPHVPFDQILRAFPPDLFIFFLQKILVGEIPTSAQNFN

SEQ ID NO: 35896 - protein, 149 aa, Sorghum bicolor
  unsure (1)..(149): unsure at all Xaa locations
  Clone ID: SORBI-28MAY03-C76931_1.pep
PIILDVWAQHIADPFISIDAVEVLEFXAIKNSPGCLQPLVSRILPTIGSILAKPKVQPDGLVAGSLDLLTMVLKNAPAAVVKAVFDTCFVSTVQIVLESDDHGEMQVHAKTRFICVRHNLLPPLSLLPVQDKGIVVVQISSWLAKSLVL

SEQ ID NO: 35897 - protein, 103 aa, Sorghum bicolor
  Clone ID: SORBI-28MAY03-C77164_1.pep
MWKQFLGKISRKSPKSSGAGGGGSPPAKSPSSRGAANGAEAELSASSPAAFPAPSGAETREDVFLRKLNVCCVVFDFAAERGRDSPEVERKRQVLVSLVDCVS

SEQ ID NO: 35898 - protein, 247 aa, Sorghum bicolor
  unsure (1)..(247): unsure at all Xaa locations
  Clone ID: SORBI-28MAY03-C766_1.pep
RSAVWAIYVWGGGTDELMDGPNASYITPTALDRWEKRLEDLFEGRPYDMYDAALSDTVSKFRGGIQPFKDMIEGMRLDLWKSRYMTFDELYLYCYYVAGTVGLMTVPVMGIAPDSKASTESVYNAALALGIANQLTNILRDVRXDARRGRIYLPLDELAQAGLTEEDIFRGKVTDKWRRFIEGQIQRARLFFDEAEKGVAHLDSASRWPVLASLWLYRQILDAIEADDYNNFTKRAYVGKAKKLLSL

SEQ ID NO: 35899 - protein, 143 aa, Sorghum bicolor
  Clone ID: SORBI-28MAY03-C76603_1.pep
GNEEIPPISWPREGIQSITGVEQPSCLLEKRLPERADSSSGTPSLLPLIRAVVAGTRTAQGGRRIGGEEEDAAAGLLKRGKDEVTSPPLISIRPRQTPAADDAVAPTQTTASAGSKAAATPDQASGQQSREDGRGGHPTGRRT

SEQ ID NO: 35900 - protein, 157 aa, Sorghum bicolor
  Clone ID: SORBI-28MAY03-C7660_1.pep
PTRPGSSPCASLRRCFLFLPAAAMASGDNSKQRSEEEWRAVLSPEQFRIIRQKGTELPGTGEYNKFYGDGVYNCAGCGTPLYKSTTKFDSGCGWPAFFEGLPGAINRTPDPDGRRTEITCAACGGHLGHVFKGEGFKTPTDERHCVNSVSIKFSPSS

SEQ ID NO: 35901 - protein, 155 aa, Sorghum bicolor
  Clone ID: SORBI-28MAY03-C76622_1.pep
FGPKAVELMTFGQPRIGNPAFAVYFGEQVPRTIRVTHQNDIVPHLPPYYYYLGEWTYHHFAREVWLHESIDGNVVTRNETVCDDSGEDPTCSRSVYGMSVADHLEYYGVTLHADSRGTCQFVIGAANSVYSYVREVDGSIILSRYPEEPQALESM

SEQ ID NO: 35902 - protein, 131 aa, Sorghum bicolor
  Clone ID: SORBI-28MAY03-C76691_1.pep
MMDVVYHEEYVRNPRGVQLFTCGWLPPASSSPPKALVFLCHGYGMECSDFMRACGIKLATAGYGVFGIDYEGHGKSMGARCYIQKFENLVADCDRFFKSICDMEEYRNKSRFLYGESMGGAVALLLHGKDA

SEQ ID NO: 35903 - protein, 130 aa, Sorghum bicolor
  unsure (1)..(130): unsure at all Xaa locations
  Clone ID: SORBI-28MAY03-C77035_1.pep
MSTVGSGSLSPPAAAASSPPAVVEDTSSHWAPHGPVLTACVVGINVLMILLIFFFFWRYFSGKRRGPSSASSGDDDGASSSASLPVASPXHGRRPATSGAAARTTARSPGDDVASALPVYVYSSSAGGGG

SEQ ID NO: 35904 - protein, 119 aa, Sorghum bicolor
  Clone ID: SORBI-28MAY03-C7702_1.pep
MMLWMPSCSWLNLVVSIIFRIRKLQCLFFISSLYRQAKALAEKNELDMQQQREQAERHRLAETLYFEIKRWAAGKEGNLRALLSTLQYVLWPKCGWQPVSLTDLITAAAVNKVTKKQHF

SEQ ID NO: 35905 - protein, 131 aa, Sorghum bicolor
  Clone ID: SORBI-28MAY03-C77044_1.pep
RSWGSALAWTRSDPNGAALVQVSVVPSRRGRGRRCPPPGGRGPPPLRGASGVAPSRRWCAACRRGTTAGRRGDVTLRIRAQGQAASRPGSARAPFRGSGGGWAVCALTPARGSGAQGAGFLLPQVLWPALW

SEQ ID NO: 35906 - protein, 67 aa, Sorghum bicolor
  Clone ID: SORBI-28MAY03-C77093_1.pep
LKYQSDEAAQCYICLVEYEEGDCLRILPCHHEFHLTCVDKWLKEIHRVCPLCRGDVCRSDAPSRKVS

SEQ ID NO: 35907 - protein, 104 aa, Sorghum bicolor
  Clone ID: SORBI-28MAY03-C7711_1.pep
FQWFGTWCINPVFFMYLHVLIKKNSCCSWQSHDRTERYLSLPQLKPDSAGEKSIGRLYLDSTPLRDAAARRTRTGREGTTSRWRLRSLFRQGSARAGVVGREYL

SEQ ID NO: 35908 - protein, 72 aa, Sorghum bicolor
  Clone ID: SORBI-28MAY03-C76750_1.pep
VMVTMNERTGARSAATSELKPVTQSDRGGCVYCLCCLFMLILFKLLLRMAMACTLSLCSAVCFLNVIYYGEW

SEQ ID NO: 35909 - protein, 275 aa, Sorghum bicolor
  Clone ID: SORBI-28MAY03-C76781_1.pep
KRRARFATHINMIVLKYTAVLLLLFCFRDSACNNFDPCSNPANQNLTVPFREVAISYTSLDAAYRQNIYLYDATNCYLLNAQYYSVYQNETATPMTFSLYLLGSLQNVCNNRTILGTIDLTSTFPTSKSLITYSKNFVNATVASFSVVGTFSNGTVSSPVNATFGEVLFSSNRTRPYDQSQTDELVTYDNSPCTIRTGTDSQLVVPLYSHSAPVDLQFANGTVMHFIFPTNLICTSRHDQMKQYYQQCTCRAGTQTQSAEETRISLLNTVEAADC

SEQ ID NO: 35910 - protein, 223 aa, Sorghum bicolor
  Clone ID: SORBI-28MAY03-C76813_1.pep
VPSSLKLRSTIITTASSRINGSHVTIPKFIHHDNISMRGRGGRVRRSSDPQEWHPPDAASMGRMCQHGDPTTRPNRGREGGGEVSAGTGSGRKGPALVPGKWRAGGQAVSTPQGPAEGPQSKGPTTAGHGPAASGACLWRGEVTKADRPPGSHRPQQSGNPAEDPRRRHPGACPAQQTVAGGRGAAGRRSLRGRNGKREAHGGSTIAGPTPTGRKQEASLQEP

SEQ ID NO: 35911 - protein, 194 aa, Sorghum bicolor
  Clone ID: SORBI-28MAY03-C76818_1.pep
DLASLTSPLVAGPRPGGNSDTRAVTRSKKLHWGAISWAHGAIDSQQLASSRLLSSGTCAPSFYLVIICSSLLCSVGVLAPRSQTTAAQAVRPSARAAPAPRARARRQSLRQQHALLCSAQWAHRARDLQQRQPRRLAPAGGAAEPPALEPRRGRGRRRGRRWPAAGAARGARSAGGRAAPSAGRGSSTTPTGPP

SEQ ID NO: 35912 - protein, 52 aa, Sorghum bicolor
  Clone ID: SORBI-28MAY03-C774_1.pep
ALHDSTARNKSFDVRDDVGSEQGSELYELVAHLPDKANNYLAPALSVLEKNT

SEQ ID NO: 35913 - protein, 129 aa, Sorghum bicolor
  Clone ID: SORBI-28MAY03-C77342_1.pep
WRLIKVSFIAWAEHQNLVLLEGHKVQNSFIFECSLRYKTILLYFFHLFSELGLCFHETSEGRQKNFFCFVIWRSLWYTCQAHYFVPLFLRLCTSVLYISLSIINSPREIFMVPEHAQECGPSVFSFGCK

SEQ ID NO: 35914 - protein, 173 aa, Sorghum bicolor
  unsure (1)..(173): unsure at all Xaa locations
  Clone ID: SORBI-28MAY03-C77425_1.pep
MGGAKAEDKPAAAAAAAAAADDWCYQFGNKNAFDLKAPKKSPLPLRMVVFAMTMLCGISICSMCMKQLGSDGWSRIVKIEVAEQPCNKSTVPPSEVQFVHYPQPITYSREECKCNAVRFFAIISSQRSGSGWFETLLNSHMNVSSNGEIFSXKRRRSNISSIINTLDKIYNLD

SEQ ID NO: 35915 - protein, 206 aa, Sorghum bicolor
  Clone ID: SORBI-28MAY03-C77432_1.pep
KAAAPSAPVGAYPPALQRPSSSPPSSMQAPLSLSLSNLRFRSFSHSPRASWATMTAAVVRAVAAGGRHGGCRPPWAGGQGDGSSGRPSPWRRPPSSSSLRKAWRSFSLSLNAGRAMRDGGQALAWRRSSSSSLLSVPRAAWQTPLPGVAPARRVPSPWTGHGPCVRPVHGRPQPRRRDNSHRVPPDASCGVAPLHDLCAGCQIWRG

SEQ ID NO: 35916 - protein, 217 aa, Sorghum bicolor
  Clone ID: SORBI-28MAY03-C77456_1.pep
MADLAAAAAAPPPATDLFGEPIEAHPPWFKPDAFLRAGFDPDAYVAELRSYVPLESLAAELRAHLAALRAELVGLINRDYADFVGLSARLKGVDAAAARMRAPLADLRDKVAAFRAGASAALAALRAGLEQRAAATAARELLELLLDTSHVVSKVEKLIKELPTAPSDSSNAEVPNNDTGTPNVEAGTGVRETQSILLERIASEMNRLKFYISHAQN

SEQ ID NO: 35917 - protein, 78 aa, Sorghum bicolor
  Clone ID: SORBI-28MAY03-C77486_1.pep
DAKRTARGAPGPLYDYAFRLEQDMNKSMETAKEENYRVYLFRIPAAESLASLPAASLVRSASLSEILDPKTESSTQSP

SEQ ID NO: 35918 - protein, 196 aa, Sorghum bicolor
  Clone ID: SORBI-28MAY03-C77482_1.pep
MEATAPALSLSLALHSSPAVARRSAGKPIFAYLHRGGPSTASSVHLRASRTPASSPVWRRRRRGSGLVVRAEMFGQLTTGLESAWNKLRGVDVLTKENIAEPMRDIRRALLEADVSLPVVRRFVSSVSDKALGANAIRGVRPDQQLVKIVHDELVQLMGGEVSDLVFSKSGPTVILLAGLQGVGKTTVCAKLAFYL

SEQ ID NO: 35919 - protein, 149 aa, Sorghum bicolor
  Clone ID: SORBI-28MAY03-C76935_1.pep
LTQQNGEEPRRTSPPTCPFTSNNFQLLVGHLEHACTHSSLISICCCCYRAQTRTPTPKDACHHHHPPLTCSACLPCLALPEQSAPSQRLTPDNPRRRRCRRRPWRRPWTHRQPPPPPLWVAARRWRGKAGTWRGAAATRRRSRRGTGGR

SEQ ID NO: 35920 - protein, 128 aa, Sorghum bicolor
  Clone ID: SORBI-28MAY03-C76943_1.pep
SLRTEVLAPKRNKKNTYAKQNHAYSTPLSHRPPSRRHLALHSALARDHDVRPHDQCDLQGAIAKPPSSSRLRHHRPSSVGPPLHHQSTSIISATTPCDLHRQLNVGTDVPMRRRHTRPFKHRDPGTSL

SEQ ID NO: 35921 - protein, 246 aa, Sorghum bicolor
  unsure (1)..(246): unsure at all Xaa locations
  Clone ID: SORBI-28MAY03-C76968_1.pep
RRNRNKQVWTESAKMVTAVXGGQDRRLKSPFLTKKDYPAPDGRSDTPKXLKVIDMGEDEYDPPVILGRPFLSTVKAIICIETGEVHMHFPSEKVRCYFTDPNHIVEDSKQVRTRRXRRNRSQRRQIIKDGWADYEGEVVRSEGILLEQNCPEETVAPSQVWREKIVIHEEEAPPEPPTTPSSESQDDRGNGESRSEDLKTPNALPRGPLGCVPFPCCSFFIVGLLTQVLLTAVRMLPTFKYTYATC

SEQ ID NO: 35922 - protein, 101 aa, Sorghum bicolor
  Clone ID: SORBI-28MAY03-C76992_1.pep
FSSSLPSACAFSSIMHGCPYSPCALLWWPFLWSSSFGALLLHPRCGQIWRGCTNGDEYLCFFVPSDSPPYAHRTSLIPTAKLTSILYTVQFLLPTHLVELR

SEQ ID NO: 35923 - protein, 250 aa, Sorghum bicolor
  Clone ID: SORBI-28MAY03-C77001_1.pep
LLGCGTVEKPSRGRAGREGKRTPRDRRRRRGAVPPGRTRAEELWEREVGSLPPKRFANSVMASKEYVQSLNIQKRLRKHRGCVNTISFSADGSLLLSGSDDRTLVLWDWQEAAPTLSFHTGHRNNVYHALFMPVSDDRSIVSCAADGEVIHSQIEEGGRVITDKLVELEFAVHRLAVEPASPHTFYCCCQDSSVWHFDLREGNAMELFKCRAAAYYPGENTALYAIALDPRKPCCFAVAGSDQYVRIYDT

SEQ ID NO: 35924 - protein, 145 aa, Sorghum bicolor
  Clone ID: SORBI-28MAY03-C77536_1.pep
DAAMSHAALGGPGSVHPAWTGRRHEPCRAVRRRLTCLTRHLFVRPRKRRARRGRRRLPAVDHLEYIYFSFLYREAVPVRPEAGRARDRRRAFIGAAGSRIPTALPCSALHQRLRREPYLLLLLASGTKRHDDELRPCLVCKIFTF

SEQ ID NO: 35925 - protein, 181 aa, Sorghum bicolor
  unsure (1)..(181): unsure at all Xaa locations
  Clone ID: SORBI-28MAY03-C77570_1.pep
MSRHAAPAAPPPLPERGEMDEVVEADPDAEAEDQEERWARLLPELLSDVVQRVEASGGERWPARKDVVSCACVCRRWREAAVAVVRPPAESGKITFPSSLKQPGPRESPMQCFIKRNKKNSTFYLYLGFTSSPVDKGKFLMAARRFRRGPHTEYIISLDSEDLSQGSNAYMGXKLRSDFWG

SEQ ID NO: 35926 - protein, 163 aa, Sorghum bicolor
  Clone ID: SORBI-28MAY03-C77581_1.pep
MSRPPSPMLSVPEKKTAAAELFRDRHFFGAASFSEIRDARAVVAVPNPQAQPPASRRALLLRYHRLLFSARDDPCAFDETLSFAWHDAFRPHLKHAAASLRFEKAALVFNVGAAASRIAAAVSRATEEGVRAACGEFQRAAGAFRAVGEMMEEEEATTVDMSS

SEQ ID NO: 35927 - protein, 204 aa, Sorghum bicolor
  Clone ID: SORBI-28MAY03-C77594_1.pep
MAPLARTLRSLSQAAAAREGPLLAWLFSSRSAAFSSSAPPEYDMPSVTWGVIQGRKERLVSRVLALDFLRSAGVSDPAGELEAVELPSSLEVLQERLDFLLRLGLSTDDLSNYPLLLACSLRKNVIPVLSYLEKLGVTRARLAAFVRAYPACLHASVAVDLAPMVKALRGLDVDRQDLPRVLERYPDVLGLKPDGTISTSVAYL

SEQ ID NO: 35928 - protein, 134 aa, Sorghum bicolor
  Clone ID: SORBI-28MAY03-C7755_1.pep
FLILIRYLKYHDLHGGEQESRKSNYTDLVNKYYDLATGFYEYGWGDSFHFAGRYPGETFREAIKRHEHFIALQLGLKKGMKVLDVGCGIGGPLIEIARFSSAMITGLNYNDYQILRGKGFILTFLFGIKNLFGI

SEQ ID NO: 35929 - protein, 154 aa, Sorghum bicolor
  Clone ID: SORBI-28MAY03-C77630_1.pep
MKLRNTAITRANSACFPMGDRVGVKYNSVNEGEERKGGHGIPKVSMVPLIFLIFYEVSGGPFGIEDSVKAAGPLLAIVGFLLFALIWSIPEALITAEMGTMFPENGGYVVWVSSALGPFWGFQQGWAKWLSGVIDNALYPVLFLDYVKSSVPAL

SEQ ID NO: 35930 - protein, 154 aa, Sorghum bicolor
  Clone ID: SORBI-28MAY03-C77198_1.pep
NVLDHPCEFSSISKSGFTCNWWVPVAPQRGGARGDDGRCCRRGGRGHRLRPPSGATLMAGEEEQLGFHRAYARRGQRQHQGEAVPCGTAGAWSRRSMAGDGDTHRRGAASQGHHHRRLRGGEREPRLASGGSDRAGIAGALPVRRVRWGREEWR

SEQ ID NO: 35931 - protein, 158 aa, Sorghum bicolor
  Clone ID: SORBI-28MAY03-C77222_1.pep
APEYCHANFTKYFTGRFWSDQRFAGTFVGRRPCYFNTGVMVLDLERWRQAGYTQRIERWMEIQKSPPGRIYELGSLPPFLLVFAGHVAPIEHRWNQHGLGGDNVLGSCRDLHPGPVSLLHWSGSGKPWARLGAGRPCPLDALWAPFDLYGPAGAGESR

SEQ ID NO: 35932 - protein, 233 aa, Sorghum bicolor
  Clone ID: SORBI-28MAY03-C7727_1.pep
PTRPTESRNHDSEHRHLSNLPVSGIPEYSMTAFGIGVPRYDSGSQQRLRSYAHHHPLIHRPTPRSGSNLVAPLGSVPAVVAETRGHGHGARGHMYQQSMHSSVQGSPFPPTTRRVRPRALTITSFIAATSSGEIGGPRAHGFSAPGAVNRSVSDAEGISRPIDRPYTWGREGFAPFPWIPAEGESHWWGTFNPMQNHAHGSFTRRPAGERMPQSHPENGYRPVPPSQRMPPFL

SEQ ID NO: 35933 - protein, 218 aa, Sorghum bicolor
  Clone ID: SORBI-28MAY03-C77300_1.pep
GPGSGRCRRTATTGCPRRAGRTGATATAPPITMAADKKPDRRATHSIALPRLGHRFLAPGLPRGGGGRCCCFDHPTKTPCRRAMASSGGAARLLEAETEGSTQTAGKAAPALLDLNWIASRSPGSWRIGAWSGGEASGNPCEVRRGKWGWTAEQSSSRMRRRHPPTHRGRQAGDFPLSSVPSPRLACHRSAFLSRRGGVTVESAAAAYCICRYDLLIF

SEQ ID NO: 35934 - protein, 161 aa, Sorghum bicolor
  Clone ID: SORBI-28MAY03-C77708_1.pep
PLCLYSDSASPPSPSAPARPPPPSSCVAPGTPSPPGPLLGSRRLSSCPQRRLCSWPHSPVRGLSLPSAPSLSPSSIGSEPAAATSRRTGVEVVPCCWPSSPAFAPLPPAVPPAGPSPKSPCAGPSPKSPFWMWPGLAPAPAPISLPSVRRCSDNLVLVCHT

SEQ ID NO: 35935 - protein, 173 aa, Sorghum bicolor
  Clone ID: SORBI-28MAY03-C77687_1.pep
VNDIVKELEQLESKIKEILLSSDQSKNLIGQQQIRSPADSNILAVDPTLELRFAFEPKKDISCCLQLTNLTEASIAFNIKTNRTKYYTEPSKGIMPPCSKRYVLVTLPAQEEVPPSNDMQCHDMFLVQSVHVSKELTSDDEIPGDLFEEAMTEKVVDVVKLPIVYVARAQFTQ

SEQ ID NO: 35936 - protein, 93 aa, Sorghum bicolor
  Clone ID: SORBI-28MAY03-C77709_1.pep
LLVKKLHPLQGLDDKSFEREFRNLRGIDHENVVRLLGYCYALKMKFVTHNGELVRAKEMERVLCFEYMQGGSLDKHISGGSCHLDSPTWVLFR

SEQ ID NO: 35937 - protein, 153 aa, Sorghum bicolor
  unsure (1)..(153): unsure at all Xaa locations
  Clone ID: SORBI-28MAY03-C77721_1.pep
KKKKKNKTSFHGSASARSHDCSYSEGAIPAHRAARGRGEQPPAPPLPPRPCAAAPPSPPPPRAPXAPRPPRRPGGASAPRGPPAPPSPPPPRPPPPPPPSPQAPRRPPXPPLPHRLPLPPLQPASPHTSPRPVPAPPRRHQVPQAPRACAPST

SEQ ID NO: 35938 - protein, 199 aa, Sorghum bicolor
  Clone ID: SORBI-28MAY03-C77755_1.pep
ARGGYSARGPRPRRPPRDPPPRPPSPSALCRFRAQDSCSGVLVLWFPCGVPLSLLVLCTWLLLPLLALPRPWPHSLHASRAPPVLATRAPGALAPGTPCPGAVGEPRPPLVPRTCWSLGERWPLLLEHLLRARFCRMLLLLLLVHCVCVVSRLSRDGGIDCGLSVRSLGVFQRINSAMFSCLHSCLAPYLFHSFWVKQA

SEQ ID NO: 35939 - protein, 174 aa, Sorghum bicolor
  Clone ID: SORBI-28MAY03-C77761_1.pep
IPQSCRPAPLAPPAASHHASAACGRPAHPRPPYALPAAARSRIPLLRSLAPVRPCLSPPSQDPSPPCGRAPRRALPRASPRGHPCWHLFSLTVVPLAEWMSPRDRDPKAPPSGEAKPECRRVLSLPIASDPCHCRPCRCPRRTDELRHCPKHWRTCLHWLHLKLCPIPSRCHLD

SEQ ID NO: 35940 - protein, 132 aa, Sorghum bicolor
  Clone ID: SORBI-28MAY03-C77488_1.pep
RDAELRVKIVEERARFDRDPKTFRESYNEEQEKLQQQISSARSNLGAVQIDHDLRVKISKVCSELNVDGLRGDIVTNRAAKALAALKGRDSVTVEDIATVIPNCLRHRLRKDPLESIDSGLLVIEKFYEVFS

SEQ ID NO: 35941 - protein, 123 aa, Sorghum bicolor
  Clone ID: SORBI-28MAY03-C77502_1.pep
PNEEENLDILGDDDGNASPNNLASGQGASLRGFDINVPNQDNMDDEIADVDVNDEADEGLNAADALRAQVNAEGQQEQDSSSSSGSSSSSSSGSGSGSGSGSSSSDSDGSDADSASSGGDVDI

SEQ ID NO: 35942 - protein, 86 aa, Sorghum bicolor
  Clone ID: SORBI-28MAY03-C77508_1.pep
QGYLASLLPRCPPACPFFPFSSSLSVATRPLRRRGPAPFRLSESDDMENNLNRTFSLLKARGMVQSGDLVIALSDMLQSIQVMNVP

SEQ ID NO: 35943 - protein, 194 aa, Sorghum bicolor
  Clone ID: SORBI-28MAY03-C77890_1.pep
MEAVRASAAWVASRSSHVTVDLQEIEKVVDQIKGDVPKVEWDFEGIHYFDNGTLTVQYLFVLDALNFCFWPDKDLSYDHLASGLKLALEKDKNALDSDRLQNYTGPQLRQLLNWPRPLPIEEERVRLLHEVGLELERSLGGQAANLVKSAGNSAATLIELITRHFPGFRDHSLYKGHQVFLYKRAQIFVADLWG

SEQ ID NO: 35944 - protein, 233 aa, Sorghum bicolor
  unsure (1)..(233): unsure at all Xaa locations
  Clone ID: SORBI-28MAY03-C77908_1.pep
MAPSPHRRRLLLILPVLVAAAVLWGALAADAGADTCKAWLVQSIPTDMPHLRRVPGVLSTGDVLQWLSGNATNSLDILAQYWQFLAQPNNPKSGDYGFSESDMKRFGADEGRLVYKALENAADRKIKIRIVQHSGFAPDFDKESADLAAGRPNVENATVLFEDWXGSGVVHAKVWISDKKDVYIGSANNDWKSLTQVKELGIYFANCPQIXKTVEVYFQNLWTLSNPHSTSYT

SEQ ID NO: 35945 - protein, 300 aa, Sorghum bicolor
  unsure (1)..(300): unsure at all Xaa locations
  Clone ID: SORBI-28MAY03-C77984_1.pep
VWEDSSLLWSNAHSTPRPRPTHTRAPAPRTPPSLPPRGPRSRRPTAPRHRSPXPPPPPPPPRCPAPPPPPTVSLPSQANHPKSRAFPPKSPSRYQQHTTPRTRSPPDPLHSAPPEAEARCSSRTACPRTRPPPPPPRARTRSRPRPRAARRGRTAGTRGLSPRTSTSPRGRPSTPPSSSSSSSRSPPPPPSSSCAARRQTPPRCSASTAPPARARAAPPSSRTRTSPGPRSRRSRSRPVAPSRRSGPSGGSWSPSRPRPPPRWPRSRASRAGSSSPSAIPARPRGGSSRAPSSSPSSCRR

SEQ ID NO: 35946 - protein, 218 aa, Sorghum bicolor
  unsure (1)..(218): unsure at all Xaa locations
  Clone ID: SORBI-28MAY03-C780_1.pep
LPXDTAHVRRPXXGSEQRXERNRKQREYRAMIRAATVANTPGQGDNKKPHLVCDVEPISGASEGQMTEAVHSTLAPSLSPYLLGEKSPQETGVSAICQPSIHLGQENIDLTDSMDWLHRNDQYVRKQRPPLAPLQTESSNGTVINPGATSDNIKLLRSRSWYINMDATKKAKLLQQRRDYKRARAVDSSNRSCPTLPDEQNDSRMLQTHVKPMCTDAN

SEQ ID NO: 35947 - protein, 136 aa, Sorghum bicolor
  Clone ID: SORBI-28MAY03-C7792_1.pep
LHSTSPRWVHNFYLAALASFYAKKVEAGLKKYKPDIIISVHPLMQHIPLWVLKWQGLQNRVVFVTVITDLNTCHPTWFHADVNRCYCPSEEVAKRAALDDLQPSQIRVFGLPIRPSFCRAVLVKDDLRRELELDPE

SEQ ID NO: 35948 - protein, 154 aa, Sorghum bicolor
  Clone ID: SORBI-28MAY03-C7802_1.pep
MASLRRLPVAVLLAVAVPLLFLCPAEAGTVGVNYGRVANNLPNPAAVVQLLKQQGVGQVKLYDADPTVLRALANTGIKVVVALPNEQLAAAASRASYALLWVRRNVAAYYPATQIHGIAVGNEVFASAKNVTAQLVPAMTNVHAALARLGLDTP

SEQ ID NO: 35949 - protein, 159 aa, Sorghum bicolor
  Clone ID: SORBI-28MAY03-C77631_1.pep
METPPPRRWPPGFRFSPTDEELVLYFLKRRIVSGRPSPYVADVEVYKSHPSHLPERSALQTGDRQWFFFSRMDRKYPNGSRASRTTGDGYWKATGKDRFICGGGRAVGNKKTLVYHHGRAPRGERTDWVMHEYTLLADALPPAAQGRESYALYKLFQKS

SEQ ID NO: 35950 - protein, 65 aa, Sorghum bicolor
  Clone ID: SORBI-28MAY03-C77644_1.pep
KIACLSDFLFMIQHTGGSIQLSGYNFRIETRPEWITRIEARPEWIMVIHSESGGAFSSAAVHRNT

SEQ ID NO: 35951 - protein, 146 aa, Sorghum bicolor
  Clone ID: SORBI-28MAY03-C77674_1.pep
EAAHAYDEAAKAMYGPKARVNFSDNSADANSGCTSALSLLASSVPVATLQRSDEKVETEVESVETEVHEVKTEGNDDLGSVHVACKTVDVIQSEKSVLHKAGEVSYDYFNVEEVVEMIIIELNADKKIEAHEEYHDGDDGFSLFAY

SEQ ID NO: 35952 - protein, 129 aa, Sorghum bicolor
  Clone ID: SORBI-28MAY03-C77676_1.pep
QAEVPDWTGQPSGKELSRYRSDPVASRWAATGWRPPAGGACYAAIVAVGRGGPGSCCCPLPGSVFGRPLRVPDARGLLPAQPGPAGTWWRRGSRGGGGAWWSTRGVQLSSEDSRCPGFEEGAMIVLTTI

SEQ ID NO: 35953 - protein, 141 aa, Sorghum bicolor
  Clone ID: SORBI-28MAY03-C77679_1.pep
KLDDLMEQTSHLASLVNSSVDTLTCLHGLEQSLARFSEPPQFSGVVLTSNNDRKRLSVIFEGLASDLLSYDERRGMRGIDYWSLKHGDPAEVRFVLGKVIMDTMYDKLPCESTEDEDAAATVEPAADLAGGRSLPPLSSLF

SEQ ID NO: 35954 - protein, 259 aa, Sorghum bicolor
  Clone ID: SORBI-28MAY03-C7816_1.pep
ARGDGGDRATAEAVAVSGAEQQWRKTRLISLMEDVCRRYKQYYQQLQSVISSFETVAGLSNAAPFASMALRTMSKHFKCLKEMIMSQLRNTSKVVANDGIGKDDMANFALMGGGAGLLRGNNVNAFGQPHNIWRPQRGLPERAVSVLRSWLFEHFLHPYPTDSDKQMLAKQTGLTRNQVSNWFINARVRLWKPMVEEIHNLEMRQVQKNTSVDKNQLGMQQIQHSTDSSGKLSDPSNSQRGQSSGMTRNLSSSASRHIQ

SEQ ID NO: 35955 - protein, 231 aa, Sorghum bicolor
  Clone ID: SORBI-28MAY03-C782_1.pep
MGAAAADLEARQLRILGRIADLELAVQQHRLGALSVSAAPSENGEADAGATEARLSALLATRGVRDFAFRRVPADYYDRSLEERRSLLRADSVAQLCKSIVMVNTQAAADVVDCSVRKNSKYYVIVVQYNARLNAENIKNFLYELNEKQIPKKRFNMRLAPEEESHKLTGFVHNAVTCIGMETNIPVIIDEAITKLDEDFFWLGGGEVDLKLGMRTSQFLSAFSPFVVKCS

SEQ ID NO: 35956 - protein, 209 aa, Sorghum bicolor
  Clone ID: SORBI-28MAY03-C78261_1.pep
VAFLLVVASHGVNPDPTPSTRHETLRDTPTASPSTCPSSLFLPSLSTQARSTGSTSADVSVRLNFSIPFLLPKSEPDPRRETLQPDRGGRGAGCPARISPGPSHGRGRRRAPSPPPPATTGGGDRKRGCASPVLPPPPPGSHKRRREDGGGGFDRRRPVRRPVGGGGHEQDDRRYGNGLGVVGGRGGDGRYMNHAPDWSDSGRGGWKEG

SEQ ID NO: 35957 - protein, 316 aa, Sorghum bicolor
  Clone ID: SORBI-28MAY03-C78309_1.pep
MAEPSPNPTVVLHACLGVGHLIPMVELAKQLLRRGLAVIIAVPTPPASTADFFASSASAVAALAAANPAVSFHHLPPPDYPVPDSDPFLQMLDALRLTVPSLTAFLRSLPSVAGLVLDLFCGDALDAAAATGIPAYFYYTSCAGDLAACPCLPHYFATTEGGPSFKDMGKALLHFPGIPPIPASDMPHTVVDRTSRTCASRIVHYGRVPEARGVLINTYEWLEARAVRALRDGVCVPGRPTPPVYPIGPLIVKGEEAAEEVERHACLSWLDAQPERSVVFLCFGSLGAVSAAQIKEIARGLESSGHRFLWVVRSPP

SEQ ID NO: 35958 - protein, 85 aa, Sorghum bicolor
  Clone ID: 30975871.pep
QEHLQATTNITPYPSGLSGALVQWYRKPNMPQDQSRTKKCGEVHFSQGKPTSQCHLEVSSSKSKVQQKCCASKLSSNQRAKMSVI

SEQ ID NO: 35959 - protein, 37 aa, Sorghum bicolor
  Clone ID: LIB3476-039-P1-K1-H3.pep
KEQERDLEEFFQSTAGKFQTDMGKAWAAEIASRRKTK

SEQ ID NO: 35960 - protein, 204 aa, Sorghum bicolor
  unsure (1)..(204): unsure at all Xaa locations
  Clone ID: SORBI-28MAY03-C78320_1.pep
HEAPAPPPPPRLATPPXAPPPRTPAPAAAPPAPWAGPRXPPFPPPAPPRRLAPAGSGCFSCPVPPHAAAPVPRAAGAPPPPXPSGAPLRAPRPPRRPPPAPAPPPPPRPPGPRPRLRRPAPRPAPPPPPPPGPSAPPPPPPPPPPAPPPPPRPPARARPPPPPARTPRRRVRMLLRQRGRGALRALQEDQLLHHQRRAHPQGRT

SEQ ID NO: 35961 - protein, 168 aa, Sorghum bicolor
  Clone ID: SORBI-28MAY03-C78312_1.pep
MAPPPPEDLQCAVNGNCAAPPGKPLAALAARDGELRWLRRCVEAAAKGFAIGGGLKGGLALFSVLVRIRSRRSPRSRKAGAMTNDEAVVLAVKETVRYGLFLGTFAGSYVSVDEYIAAVWGRKRTARWRSLLAGLIAGPSMLLTGPGTQHTSLAIYILMRAAGLASRC

SEQ ID NO: 35962 - protein, 102 aa, Sorghum bicolor
  Clone ID: SORBI-28MAY03-C77782_1.pep
EGSKKILQVLATILLLNTINYFSKNHSSIAPSNRKVTPKTKVLQYYTFNNNPVARKICIEKYISKQEHMPRQQEGFRFSSSTISQMVALELPIGWCFIWMSS

SEQ ID NO: 35963 - protein, 126 aa, Sorghum bicolor
  unsure (1)..(126): unsure at all Xaa locations
  Clone ID: SORBI-28MAY03-C77797_1.pep
KNWIRARKLVLVRXTSSTPRPAIESSESIVRAASLPPAMESESPRIEASKVVRSSTIMSASGLSLLAGTTIPPKRDQPGAFSRASSMKEGPSELSSGVQNSAEPSPRRSGASTLFGGLGFLRSYTS

SEQ ID NO: 35964 - protein, 109 aa, Sorghum bicolor
  Clone ID: SORBI-28MAY03-C77825_1.pep
GYEDVPATDEQALVKALAHQPLSVAIEASGRHFQFYSGGVFNGPCGSELDHGVAAVGYGSSKGQDYIIVKNSWGSHWGEKGYIRMKRGTGKPEGLCGINKMASYPTKDQ

SEQ ID NO: 35965 - protein, 192 aa, Sorghum bicolor
  Clone ID: SORBI-28MAY03-C77846_1.pep
MASSSARPVVAAVLLLCLLCGGSAWLQAAAEARPPHHMDSDSDDFFSIVGYSPEDLVHHDRLIKLFEEWVAKYRKAYASFEEKLHRFEVFKDNLHHIDEANKKVTTYWLGLNAFADLTHDEFKATYLGLRQPETKKTTDSRFRYGGVADDDVPASVDWRKKGAVTDVKNQGQCGSCWAFSTVAAVEGINQIV

SEQ ID NO: 35966 - protein, 168 aa, Sorghum bicolor
  Clone ID: SORBI-28MAY03-C78510_1.pep
KGKGFEGVTTRWGTRRLPRKTHKGLRKVGCIGAWHPARVSWSVPRAGQNGYHHRTIINKKVYRIGKAGRDDTGSTEFDLTKKTINPVGGFPHYGVVTEDFLMLKGGVTGTRKRAITLRKSLVPQTRRLALEKIQLKFIDTASKFGHGRFQTLDEKKKFMGLRKKDRTV

SEQ ID NO: 35967 - protein, 80 aa, Sorghum bicolor
  Clone ID: SORBI-28MAY03-C78522_1.pep
AYCTNHAPITFMRRFFTSFSNLAQVFLPLRKSMRLKGATRPIVVQSQIGKFTKLKRHSGMPDTCQSSSSSSSSAAAAAAN

SEQ ID NO: 35968 - protein, 141 aa, Sorghum bicolor
  Clone ID: SORBI-28MAY03-C78569_1.pep
MKPPAGGSGKGGAVDPSLPRFRCQECRRALVVVGVDSYADRLPAHAAPGNHASSVQGSVMGASKMDNSYVVLSRQNKSQGPRIPPRPPSAAPVHTDPSQSTRAIEGSYIVLPPPAASIYKTPASEGGGAQLTAPGVNSSSP

SEQ ID NO: 35969 - protein, 109 aa, Sorghum bicolor
  Clone ID: SORBI-28MAY03-C78591_1.pep
MGRRLDVLLGRTTKQTARLKSLLGLAVTRLGVVRGHRQVRCGQARGDVEQLLRLGHTDRALARAEHVVREQNALDVLAELEAYCALIVERAALVDAHRECPEELREAAA

SEQ ID NO: 35970 - protein, 220 aa, Sorghum bicolor
  unsure (1)..(220): unsure at all Xaa locations
  Clone ID: SORBI-28MAY03-C7859_1.pep
MEGNIFFQNKEVSLNGRSETSVQSSTGDNKVDKNDANNGRNNKSNVVVQNGCLPRGATDKTNQREYHGDMVRKTARSFLYELCAANYWKPPEFELCKDEGPSRGPGXRFFGTLSKITLFMQFSILAKLKYIYHXRFGLYCLANYSKYGKQCRCRVTYDLCLFTCRFTCKVLIQITGTSATLLECYSDPKLQKKAAHEHAAEGALWYLKQLGYLPKDDYRV

SEQ ID NO: 35971 - protein, 107 aa, Sorghum bicolor
  Clone ID: SORBI-28MAY03-C82803_1.pep
EMKLLKYLLNIEEPEERFGALATAFFPGDEHEAKDEDALYTTPKELHKWIKMLLDSYHLNKEETDFMDGRKMSDPVIIQRLTLLKATIEEEYMKQYIHPEEESMDDN

SEQ ID NO: 35972 - protein, 122 aa, Sorghum bicolor
  Clone ID: SORBI-28MAY03-C82806_1.pep
EWFRGVMNEVAERDARGDVVELHNHCTSVYEEGDARSALLVMLQALHHAKSGVDVVSGTRVRTHFARPNWRDVFKRVACNHQGQRVGVFYCGDQKVTPELRRLSQDFSHKTTTKFVFHKENF

SEQ ID NO: 35973 - protein, 83 aa, Sorghum bicolor
  Clone ID: SORBI-28MAY03-C82827_1.pep
NCTPEDRSVNTGVGDGWSRGEPVACKQAPSFCRYLTKGSPDISSGADNWFNYPDYMPVASHHLKANQTTSLIHILSVQRLKHF

SEQ ID NO: 35974 - protein, 147 aa, Sorghum bicolor
  Clone ID: SORBI-28MAY03-C82907_1.pep
MAVMTDMPAAVPAAAGSDKDAEKLRFIEEMTSDVDAVQERVLAEILARNAGTEYLARCGLAGATGRDAFRARVPVVTYEDLQPDIQRIANGDRSPILSAHPISEFLTSSGTSAGERKLLPTIKEELDRRQLLYSLLMPVMNQYVPGL

SEQ ID NO: 35975 - protein, 191 aa, Sorghum bicolor
  Clone ID: 30161143.pep
MKAGPPPHVATLATPGMGHLIPLAELAKRLASRHGATATLITFASTASATQRALLASLPPAVSSLSLPPVDLSDLPRGAAIETRMSEECARSLPALTRLLSELGETMATATGTRLVAFVADQFGTDSFDAARDAGVRTRCLFIPMNLHALSLVLDLPDLAASVPGEFRDLAEPVRLPGCVPIPGSDVPSPL

SEQ ID NO: 35976 - protein, 112 aa, Sorghum bicolor
  Clone ID: LIB3476-040-P1-K1-E12.pep
MENGTSNGSTGGAACCNGNGAVRGPHVAMLATPGMGHLIPLAELAKRLASRHGATATLITFASTASATQRAFLASLPPAVTSLSLPPVDLSDLPRGAAIETLMFRECARSVP

SEQ ID NO: 35977 - protein, 100 aa, Sorghum bicolor
  Clone ID: SORBI-28MAY03-C78747_1.pep
TASDPYTPVKSTNTGRRHWSGLETSARARTLRTGPTTAHGAGERAAAAAAAGAGRRGRDGGAGGGGGGGGAGGGRGASGGAGGDRGAGGRARGRRASPRY

SEQ ID NO: 35978 - protein, 91 aa, Sorghum bicolor
  Clone ID: SORBI-28MAY03-C7880_1.pep
KRRKVLKTRIDERGREVTEVVWEGEASADPRVRKNVNTTAATASGATLPSKPKPAANTDKSKAPSKAAAGNKKPAKAGTKQGSIMSFFKKV

SEQ ID NO: 35979 - protein, 82 aa, Sorghum bicolor
  Clone ID: SORBI-28MAY03-C78809_1.pep
SNAERSAFLHHVHGDSTSLPQCLLPMMNGQTMHPEQEIILCHGIPQSYQSSHLNESPTYLISHMGIHSKSVSPSSLQFLYKT

SEQ ID NO: 35980 - protein, 123 aa, Sorghum bicolor
  Clone ID: SORBI-28MAY03-C78820_1.pep
EVAFSALEGLNKQSFLTELGNRMHKGLLNHWQKFTFSPSGGLRLKRDITEYGDFVRSFNAPSIDEKFELLGIVANVFIVAPESLASLFEGTPSIRKDALRFIQLRDDYKTAKIASMLNNIMSE

SEQ ID NO: 35981 - protein, 345 aa, Sorghum bicolor
  Clone ID: SORBI-28MAY03-C78367_1.pep
FLSVLVRFLGCENSLCVDNKSETAWWSGVVVLYVMHLITYFTNIIGVVTIALISVVSILGLICLCRSVYFQLWIKRRGYQRLSYFNGPWLTRITLMLVAFWWGIGEVVRLTFVNGEGRLISNRTWQVNVCKFYIISNLGFAEPGLFLLLSFLLSAALQKQELGTLNRKWNRKTIRAVFILCSPCLIWEACVVFVGGHVSSDDGQRSKVSKYWYSASASHNGNITCTYPLLSSVFIGAFYIILTVYVMFVGRQMLSLVINKGLRRRIYMLIFATGILLPRATLLGLSVLPWPGEVIHEALVFVSFLVLMLAAMVGIVILVYFPVADTFAIGDQEHIEMQASREMIL

SEQ ID NO: 35982 - protein, 200 aa, Sorghum bicolor
  unsure (1)..(200): unsure at all Xaa locations
  Clone ID: SORBI-28MAY03-C78405_1.pep
EGVVIPERHGRAQSRTRQQRKGGCSPGGQRVDGPGCGRHGRGASPRSTGALTAPTGAGTGAGRRGGPPGPYLGRPGHPVGRGLGGGTPGGTRGAGGRGPGGAAAASRRAARGGRRGGGGAGRAGGASGTAGPPPRGTGGAAGGAAAAAEPGERAAAAGEARTQQSGGRGXGGGGEGGAGRSGGSGRGGGTNAEGGGAEPA

SEQ ID NO: 35983 - protein, 198 aa, Sorghum bicolor
  unsure (1)..(198): unsure at all Xaa locations
  Clone ID: SORBI-28MAY03-C78409_1.pep
MSDGKDALDLSAIGAALPNSAELSAEDKAHLVASIKNTLEGLASRHTDVLENLEPKVRKRVEKLREIQGQHDELEAKFFEERAALEAKYQKLYEPLYSKRYEIVNGVVEVEGVTEESAAETPAEQKGGDETSAEPKEEKGVPAFWLNAMKNHEILAEEIQERDEEALKYXLKDIKWYRISEPKGFKLEFHFDTNPFFK

SEQ ID NO: 35984 - protein, 211 aa, Sorghum bicolor
  unsure (1)..(211): unsure at all Xaa locations
  Clone ID: SORBI-28MAY03-C78455_1.pep
IGLPPPPAPPRPPPPPPRPPAPPPPPPPPTPGPPQQLPAASPRPPXPPAPRPPPSAPSRPRRPPPASRPPAPAPPSPPPARPRPLAAAPPGARHPCPATPPRAVPAPPPPPRPRPPAAPLGAAPPQXPWVPAWPRGGPGPPARGGPRRAGPPSLPARRAGSSLPVLPFPPGLRALRCGSRVGGPCVWRGRPRPCVTRGASGSCGPPLSAVP

SEQ ID NO: 35985 - protein, 89 aa, Sorghum bicolor
  Clone ID: SORBI-28MAY03-C78489_1.pep
LAKTRELEDEYGKVKTENDKLQLEVERFMMELGASVEEKDAAAKAFDGGKDEILTELEDSKIMKVEVTQDNKNLIKTKNDKLQWDAFDS

SEQ ID NO: 35986 - protein, 175 aa, Sorghum bicolor
  Clone ID: SORBI-28MAY03-C79065_1.pep
AHFQAESLEVTMPVFVVTKTMRCTWLRAARQVSTTSEPDLSANQNQGDTSNTEQANLTASVEVQTAIELNNTEQGNLTLSTEVESMGLNTTEQGTCTGTIQVRPRGETMGKEIDSISHGLGCPIPIIIKKGKRRPEAPMQAAKLASESGTIMRKNIKIYPNWTKYYKNNGEQLEN

SEQ ID NO: 35987 - protein, 138 aa, Sorghum bicolor
  Clone ID: SORBI-28MAY03-C79064_1.pep
MAATEGQWLLMATGRTPTNIAVIKYWGKRDEALILPVNDSVSVTLDPDHLSATTTGAVSPSFPSDRMWLNGKEISLLGGRFQSCLREIRKRARDFEDEEKGVKIKKEDWGKLHVHIASYNNFPTAAGLASSAAGLACF

SEQ ID NO: 35988 - protein, 83 aa, Sorghum bicolor
  Clone ID: SORBI-28MAY03-C79086_1.pep
QYKERWRHDDDDGGRFGRSNSRMEERWRHKDGNDGDKENLIQSPEPTPRVAREVEAEVEELHHHHPFHGFGQQRPEAMLLLSQ

SEQ ID NO: 35989 - protein, 82 aa, Sorghum bicolor
  unsure (1)..(82): unsure at all Xaa locations
  Clone ID: SORBI-28MAY03-C79089_1.pep
ARGNEVGLPGYSPVGIQGTGGSRSMNLEAFPPGYXDLRENHLGGASGSVINPQARSQESVEFSDETRRKAIQRELRRRQKFR

SEQ ID NO: 35990 - protein, 68 aa, Sorghum bicolor
  Clone ID: SORBI-28MAY03-C79098_1.pep
LLGNGEDTNEVLSANLGNLKLDGSSENYDETRDSKEDNVENTDTADFVIVDKATKEASSTDEQFNAEN

SEQ ID NO: 35991 - protein, 103 aa, Sorghum bicolor
  unsure (1)..(103): unsure at all Xaa locations
  Clone ID: SORBI-28MAY03-C79122_1.pep
RPVILRYPYKRFNPAWESMSGARHVFLLLCQFVNYLEVVHLPVYYPSEQEKXDDPKLYANNVRKLMAVEGNLILSALGLAEKRVYHAALNGNSLPRALHQKDD

SEQ ID NO: 35992 - protein, 204 aa, Sorghum bicolor
  Clone ID: SORBI-28MAY03-C78610_1.pep
KKKKKKKKKIWLRYEGSQHVRTKFGSPSNVSLGIHPKKRDRKRHRGKSLESSPRTMLRKKPHLTAFIGYKAGMTHIVREVEKPGSRLHKKEVVEPVTIVEAPPMVIIGVVGYVETPKGLRTLSTVWAAHLGEEVLRRFYKNWYRSKQKAFTKYAKKVAEDKANTVTRELDRIRKYCTVVRVIAHTQIRQLKLRQKKAHIMEIQI

SEQ ID NO: 35993 - protein, 167 aa, Sorghum bicolor
  Clone ID: SORBI-28MAY03-C78616_1.pep
YLFTGLGIYPTSTYRIIDRLIVPNMYPANHYMDPYHSHYRNHAPYPYYPPPRWEIPSGHPRAMDSSYYYRPPSCGTWPYNHDMHHSHPSELHCCCNQTYPPGYYSFRPPFPQELPPPRLYYHGPFPQHPNAWPSYFVPSHPYPVDHTPYGYDKFKGPLLWMSKSCVP

SEQ ID NO: 35994 - protein, 163 aa, Sorghum bicolor
  Clone ID: SORBI-28MAY03-C78641_1.pep
FSSQLQPSMSGDCTATAAPTRHPQATGWQPAPSNLFANWNWTGARRQVPTRQRNASHPPATSRPHGGSADNEDPSKQRATDRAHPQGAASAPPHANAERSRERSPKVRATAAPRSQRGPSPRPNPQTAGRCIPTYRAKAMMSATPTWGSTPVPDREPSRAQGP

SEQ ID NO: 35995 - protein, 243 aa, Sorghum bicolor
  Clone ID: SORBI-28MAY03-C78698_1.pep
MSAIYMSQLSTALPLMEGDHHHHHHHHQGHFQAFTLPKDPPILFPFVISNSSASESSLSYGSADHHLLRQHRQTMLEPQHMIGGSSSAASSVFATPFPTVESIRDDMIEPASYDPYDMGKLHQVVGGGSSMDACSWTPPAAKMRITRKATAADPSGAGKKPRRRAHQAAGYDADINMSGQPNLGVIRVCSDCNTTKTPLWRSGPCGPKSLCNACGIRQRKARRAMMAAASASGLPAVPATDSG

SEQ ID NO: 35996 - protein, 221 aa, Sorghum bicolor
  unsure (1)..(221): unsure at all Xaa locations
  Clone ID: SORBI-28MAY03-C78743_1.pep
GRYRTHPDPHRPPPPPPPPPPLPPSPSPPPPPPRLPAPARSPRARPRPPARPAPXPPPPAGPPPPPPAAPXPWLSPIPPPPXERPPGPATRAAPGPAPRGPRRRLPPPPPPPSPPGAPPAPPAAAXPPPPPPPPPALPGARSRCVRFGWQRLQPRGSPRRPQVRAQEWRPAVAVVGRAVASADPLSCDVASRGRRRLWWGCLASTRKPFPGGSQRDAAGAY

SEQ ID NO: 35997 - protein, 174 aa, Sorghum bicolor
  Clone ID: SORBI-28MAY03-C8293_1.pep
ELESMTMPTIGHPPYIMEEIARSCKNFTELKIMGSFDQQFASAILQFLPKLKVLSLRCSKVSMDALQCLLNSMEYLEVLNISHCLLLVIAANGRKQVVHELDSQIFERASRLREFHYCQSRLCVACQRMVVDEGIMRWYRYEDWFWRPDEVRSLDLQDYGKLFDAGCERLTSVE

SEQ ID NO: 35998 - protein, 134 aa, Sorghum bicolor
  Clone ID: SORBI-28MAY03-C7928_1.pep
DNCSMQLVSKPEQFDVMVTPNLYGNLVANTAAGIVGGTGIMPGGNVGQDYAVFEQGASAGNVGNENIVEQKKANPVALLLSSAMMLRHLQFPSFADRLETAVKRVVAEGTHRTKDLGGTSTTQEVTDAVIASLD

SEQ ID NO: 35999 - protein, 206 aa, Sorghum bicolor
  Clone ID: SORBI-28MAY03-C79297_1.pep
APRHRNPTAAARSGRRTPPPATSSSGSGRCGRSPSRPPARSLASKCYLPLLTPPRPARGHCRSPTDAIGLRPIQKIRGPDALPHTHPPAATVIPGGGPPHGPARPPADRLGRRPRDRLVGRAAAARGSDEAAGAPAGLDRIQSLSPAPPLLLLFCSLRVLAVAALARCGVVLDERRRCEEVDGARTGGRDGAPALLEEKKKVVTGV

SEQ ID NO: 36000 - protein, 214 aa, Sorghum bicolor
  Clone ID: SORBI-28MAY03-C79299_1.pep
PTQRFPLPALSRSPRLRPPILKSPPSDIRLPAILTFSSLPEPPRGLAPEISTMASSPPSSGVLPPSYPLRLREPPLTLRNPRSILPVADLAALLLRAAYDGDVPQLKTLVKRLRKAGKSVDEAMTEIRASWYKGQGPLHMAALSGKTAVCKLLIKDLRLAVLAAASAAVTPLRLALLAAPSAAASGRRPPLHPAPTRAAFDGCTPLHLAATRDA

SEQ ID NO: 36001 - protein, 76 aa, Sorghum bicolor
  Clone ID: SORBI-28MAY03-C7933_1.pep
MAAKAISSPVPVEWYPTLAVLMVSVGLMFTASFFIYEATSSRRSRSLAKEIATAAVASVFLGFGSLFVLLASGVYV

SEQ ID NO: 36002 - protein, 181 aa, Sorghum bicolor
  Clone ID: SORBI-28MAY03-C79337_1.pep
MGRKRNESGYLTAALEEREEAEEQTEEGDEEEGEEQTEEGSCGEDQAEAEAETLAQEAVEPPKLAEGFYEIEAIRRRRLRRGQLQYLVKWRGWPESANTWEPLENLKACSGIVDAFNKRSRSPRSSRKRKRKTATTPTSDPNPSRGKRGRPPRSEARSMQGIHASEVKKLPCRTSSRRANN

SEQ ID NO: 36003 - protein, 172 aa, Sorghum bicolor
  Clone ID: SORBI-28MAY03-C78924_1.pep
MPTAADPAAALPLTLDLEDFKGDFSFDALFGGLVDELLPEYRGEDDAAPAPPPPPPVLGAAPPVFPAVDELLGLFKHSCKELVDLRRQIDKRLQNLKKEVAVQDAKHRKTLGELEKGVDGLFDSFARLDSRISSVGQTAAKIGDHLQSAESQRETASQTIDLIKYLMEFNST

SEQ ID NO: 36004 - protein, 118 aa, Sorghum bicolor
  Clone ID: SORBI-28MAY03-C789_1.pep
ARANQTLQNNMPSRVLKKRLFQLTNRPLQDNKKEKPKTRPTCLQCLKQIREHLTKLVQTLNGDEAAGQNSSYGHSIHPIQLMLSHCSVGCINAKQSTNCWAIFTTEVSTGGMSYGYCC

SEQ ID NO: 36005 - protein, 281 aa, Sorghum bicolor
  unsure (1)..(281): unsure at all Xaa locations
  Clone ID: SORBI-28MAY03-C7896_1.pep
HEGNVLAMSFAPRDSHEAQVQFALERGVPAVIGVLGTIKLPYPSRAFDMAHCSRCLIPWGANDGMYMMEVDRVLRPGGYWVLSGPPINWKVNYKGWQRTKKDLEAEQNRIEEIADLLCWEKVSEKGEMAIWRKRVNTESCPSRQEESTVQMCESTNPDDVWYKKMKACVTPLPDVKDESEVAGGAIKPFPARLNAVPPRIANGXIPGVSSQAFQKDNKMWKKHVKAYSSVNKYLLTGRYRNIMDMNAGFGGFAAAIESPKSWVMNVVPTIAKMPTLGAVYE

SEQ ID NO: 36006 - protein, 100 aa, Sorghum bicolor
  Clone ID: SORBI-28MAY03-C78961_1.pep
KKDVPMIFLFRGNTLCRLISLLANDYDKDAKQLNGTQKSRVHSKEEVQDFLRVPVRRLISRLVKIHMRPLPDLIKNWEKVSSKLNGTKFAHFLNGLSYVK

SEQ ID NO: 36007 - protein, 109 aa, Sorghum bicolor
  Clone ID: SORBI-28MAY03-C7899_1.pep
PTRPLPRSAASLTRAQARSQGSDLPRVGGSPSAASNDGGAVPGSAAASAAPPTFCRQSPRALACVLRAPADDPALDDSTGTAGVKFSRAQGFHCSQWSGPIQLVPKGIM

SEQ ID NO: 36008 - protein, 220 aa, Sorghum bicolor
  unsure (1)..(220): unsure at all Xaa locations
  Clone ID: SORBI-28MAY03-C7942_1.pep
VGLSEQIRREITTMRLVAHKNIVELHEVMATRNKIYFVMEYVKGGELFDKIEKSGKLTEAVAHKYFQQLISAVDYCHSQGVYHRDLKPENLLLDENENLKXSDFGLSALSESKRQDGLLHTTCGTPAYVAPEVISKTGYDGAKSDIWSCGVVLFVLVAGYLPFQGPNLMEMYRKIQNGNFRCPSWFSHKLKKLLYKILDPNPNTRISVQKIKESTWFRKV

SEQ ID NO: 36009 - protein, 168 aa, Sorghum bicolor
  Clone ID: SORBI-28MAY03-C79420_1.pep
ATDVEEQKPQQDQAPPDAVEAASSSVVLPVRLGRFKNVDDDAESSSSTGATSRIDRRRCYSMGSYQYVLADEHLLVSVHLRHGNAGGGAGTACGTSSSAAVTAASSSDEQHQGKKVFARGDSFSVSKIWQWRGSKRLPGGLCADDGLPWAPAAKDDHASANTRQHSDT

SEQ ID NO: 36010 - protein, 95 aa, Sorghum bicolor
  Clone ID: SORBI-28MAY03-C7944_1.pep
SKVLLPKEMFTRTASAGGGGDDSSMVAATAAASSPPPAATAPEASESARTPPTKLSSPPALRGGGGQDYDTASARGIGIGWWWCIALVYLLPHLV

SEQ ID NO: 36011 - protein, 247 aa, Sorghum bicolor
  Clone ID: SORBI-28MAY03-C7945_1.pep
ARGKQDGGSGGNKKVDWFKEVASCDMFHGNWVRDDSYPLYPEGSCPHIDEPFDCYLNGRRDLVYQKLRWQPSGCSIPRLNPTDMLERLRGKRLVFVGDSLNRNMWESLVCILRNSVKDKRKVFEASGRREFKTEGSYSFLFTDYNCSVEFFRSPFLVQEWEMKVSSGKKKETLRLDLVEQSSLKYKDADFLIFNTGHWWTHEKTSLGKDYYQEGDHVYNELNVMDAFHKALLTSAKWIDANVNPTKT

SEQ ID NO: 36012 - protein, 106 aa, Sorghum bicolor
  Clone ID: SORBI-28MAY03-C79465_1.pep
MDHQGEDFLSGILLNRDAAHVSGLDDNGIPLTAQETQSSPEVEAVASHGNKGTKRSKNFSVDEDELVCEGWLIASKDPFHGANQNRTSFWGKVHAYFEKHNKGTTP

SEQ ID NO: 36013 - protein, 148 aa, Sorghum bicolor
  Clone ID: SORBI-28MAY03-C7955_1.pep
MRSGLLSLCFHLALAITLATSVPGLVHSRVIDLKLQPKPIPQPEPKPAPQPDPKPEPKPTPQPDPKPTPQPDPKPEPKPAPQPEPKPAPQPDPKPEPKPTPQPKPKPTPQPDPQPEPKPTPQPNPKPEPKPTPQPDSKPEPKPTPQAP

SEQ ID NO: 36014 - protein, 189 aa, Sorghum bicolor
  unsure (1)..(189): unsure at all Xaa locations
  Clone ID: SORBI-28MAY03-C79158_1.pep
RLASPSPLLPPPASRRPPRPVPPPPPPPPPPSPRSPAPSPXPPSPPRPPPASPPPASGPPSPVLGRRPPVRACRPCRGPHPAPRPALSSSAPALGPRRAAPPPPAPPLGSPPSLPPARPPPPPPVRPPSPPLRLRRRRGGWFLFSLHAALGFCAPSLLLTPRIPVELFQRTTGRLLRSFQHFDSLSCGS

SEQ ID NO: 36015 - protein, 146 aa, Sorghum bicolor
  Clone ID: SORBI-28MAY03-C79163_1.pep
MGVQRYRFFCCGCGANAAAGDREGDDDGDFGVFDDKAQAEKGVEAGPRGLSLAQVKAMTGGFTSAVVGEGGFSTVYLARLSGALAAVKVHRSSERLHRVFRQELDTLQRVRHPHIVRLLAFCDQQEEGVLVLEFAANGNLHERLHG

SEQ ID NO: 36016 - protein, 249 aa, Sorghum bicolor
  unsure (1)..(249): unsure at all Xaa locations
  Clone ID: SORBI-28MAY03-C79188_1.pep
FVVVETIEFADDEYEGLPVPLTLEELKRQKRMENLGEGEAMDLAEPAKEVEMEMDEEEMQLVEEGMRAAPRGENDGGAQVNVAGDDDAPMRIVKNYKRPEERIPAERDPTKFVVSPITGELIPISEMEEHMRISLIDPKYKEQKERMLAKIKETTLAPDDEISRNIVGLARTRPDIFGTTEEEVSNAVKAEIEKKKDEQPKQVIWDGHSGSIGRTATHALSQPQGGEEQFDASNVPGPAPLXRPGMPLP

SEQ ID NO: 36017 - protein, 169 aa, Sorghum bicolor
  unsure (1)..(169): unsure at all Xaa locations
  Clone ID: SORBI-28MAY03-C792_1.pep
NFYPGVRAAHEVGVLDGQGFSVNIPWSRGGVGDNDYIFAFQTVVLPIAAEFAADITIISAGFDAARGDPLGGCDVTPVGYSWMTSLLADCSNGRLLVILEGGYNLQSISSSATEVVKVLLGDGPNRASFVGSPSREALKTVSQVLKIQQRXWPVXGPTYASLQAQXGSV

SEQ ID NO: 36018 - protein, 130 aa, Sorghum bicolor
  Clone ID: SORBI-28MAY03-C79717_1.pep
MAARLAAASAALALALVGMCCAAGPATALGMNWGTQATHPLPPKAVVQVLQDNGIKKVKLFDTDPAAMSALAGTGIEVMVAIPNNMLADLADDAGKAKDWVKRNVRRYDFDGGVTIKYVAVGNEPFLESY

SEQ ID NO: 36019 - protein, 199 aa, Sorghum bicolor
  Clone ID: SORBI-28MAY03-C79722_1.pep
AAAPPRGAPRPPPNRWSQRPPWPAAAPPSSPSSAPPRAPPRPVQPLAPGGAARREVEAVAAPPRPAPARRLRRRGSEPRRPRPRAVRRLWLCAGSPEAAGSPPQGDSAGHDSVGVVEPAGIAGLGFRAVVPRPAAMWVRAVRDPPVAICPHIPRDTWHSVPPAPPRFKPPGDPPSPSRFKPSDDAFVMEDELISESDSG

SEQ ID NO: 36020 - protein, 179 aa, Sorghum bicolor
  Clone ID: SORBI-28MAY03-C79726_1.pep
MPWPSRRTPRRLSSRRRSSIFFKTRVRLLCDSNMGDFDAWVSLINAAEGTSADDIDVISLVYHSFLLEFPLCYGYWIKYAAHKARLCTTRYVVDVYEQAVHAVPHSVDIWVSYCGFGISAFEEPAHIRSLFERALSLVGKDYLCYHLWDKYIEFETSQKQLIQLATIYINTLKFPTKKL

SEQ ID NO: 36021 - protein, 223 aa, Sorghum bicolor
  Clone ID: SORBI-28MAY03-C7974_1.pep
KTAPVDKDRVSVILEPSTENMAHQETHNSIGERLVTLENAKECHDTDKCLELPTSGASTKLDVFKDVSGSLPEACSPVNASDLSGHGNISPNLSPLAGTSQEDRNSKLAPEVFRDSRMQHTFLSNEKLQESSDVSNVAISQGSNIKSLILEELKESDVCDAFTRGPNRIEQEAETYGREKFSFSDGSLLLPSHFHNKGAKINLVSEKVQKVEIDKKVGPCAHP

SEQ ID NO: 36022 - protein, 95 aa, Sorghum bicolor
  Clone ID: SORBI-28MAY03-C79758_1.pep
IDARRSTVIYRVKQLDHSVVDAMRSSHLSTQPSDSNNQSINQQHASFHSHHSTTTPILLANQLTDGDYICTHMILPIDRPTLDAVTNTHCCCSSA

SEQ ID NO: 36023 - protein, 174 aa, Sorghum bicolor
  Clone ID: SORBI-28MAY03-C79341_1.pep
MAVGGLLRGLVSPARGAAAWLPCHEPFASWHPWLPSLPRLRPPASDGFKLLFVLLLFSAALAEVRYIASSSMAPTLRPGDRAVAEKVTYLFRRPSIGDIVFFKVPSAAQNYGVNKDVVFIKRVLATPGDFIEVRQGQLIVNGIALKEHYTATHALYTTEAMVRACFSSLCAWAP

SEQ ID NO: 36024 - protein, 227 aa, Sorghum bicolor
  unsure (1)..(227): unsure at all Xaa locations
  Clone ID: SORBI-28MAY03-C7936_1.pep
PRVRLNTFANCTGLKVNYRKSMMLPVNLSEERLDHLSRTFGCSKGTLPFTYLGLPLGLTXPLVSKCERRLLSVSNFLTQAGRLELTNAVFSALPTFYMCSLELPKTVIKQIDKYRKNCLWRGSDINGRGKPKAAWEMVCIGKQEGGLGVIDIEKQNKALLMKNLHKFFNKEDIPWVQIVWEKHYPNGKLPGVSKKGSFLWRDNQKNLQHYKXVVQIQVNSGETCLFW

SEQ ID NO: 36025 - protein, 183 aa, Sorghum bicolor
  Clone ID: SORBI-28MAY03-C79375_1.pep
ILKEEDKWKAKRIELLELEKQAGTGKKTKKNSTKVARPREDNNDHEKEATDATAAAETGGRKRSDGVKKVTENLRRGGGEACLEALDKMWAKKEVAVNEKEKAKQERFLTALELDKEALEVEKKRLVTEEKRAQAEDKRAEADLMKQEKEIMFADTNSLNPLQRQWLEMMQKEIVSRRCGNSI

SEQ ID NO: 36026 - protein, 73 aa, Sorghum bicolor
  Clone ID: SORBI-28MAY03-C79383_1.pep
KTGIKVDRAKEMLGTFSPQLEPYTYVTPEDTTPSGMFARGSYSARTKFLDDDRKCYLEINYTFDIRREWPSTS

SEQ ID NO: 36027 - protein, 107 aa, Sorghum bicolor
  Clone ID: SORBI-28MAY03-C79406_1.pep
FPTRYYCYIIRHNSCNFVSCKSYSQQLRINNYFQCFQDSTFSVEEWEAILELLSVVIELIWRSEIVSIFNYVRFNSKDLFSCNMFLIVNETFLTTTEVIWYPFCDCN

SEQ ID NO: 36028 - protein, 187 aa, Sorghum bicolor
  Clone ID: SORBI-28MAY03-C79225_1.pep
MAPNEAANITTPSEPESVGGSEMSSEDTAAARPLLSSSSPSPSLSPSAASAAPVLESIEELDRRYAPYARRDAYGPMGLGPLSAAEAARLAFAAVVLVPLRVMAGVLVLVVYYLVCRVCTLRVEEEREGGEGDGYARLDGWRRAGVVRCGRALARAMLFVFGFYWIREYDCRFPNAEDDDVDQSKET

SEQ ID NO: 36029 - protein, 151 aa, Sorghum bicolor
  Clone ID: SORBI-28MAY03-C79902_1.pep
ARGPTSGDPLRGPFSRQPREPGHKPIAASGSLPDGGTPPRFAAGGRGEPGKATPGSKEHSYGAAGPAQPRKETQDASKQGRWKGGPTQAKAKSPTRKDQRERTVREQGGSRPGMTRPPVRGSPREGLARGQQRRNEAGKQRTNKAHKARGM

SEQ ID NO: 36030 - protein, 143 aa, Sorghum bicolor
  Clone ID: SORBI-28MAY03-C80039_1.pep
MAARPPPPPPPAAAPAPPRSPLPPVAPPSRLRGRRAPAARGRQAGCGPRAGVLLLLLAPSRPVQAVRARLPPRARSPRQSAHLVRALAAALGTAALGSALLTTWSRDISWPLRPGRLLPLFWLPALAALIYSTITSLGEMLDN

SEQ ID NO: 36031 - protein, 150 aa, Sorghum bicolor
  Clone ID: SORBI-28MAY03-C80101_1.pep
QSTGPSNAEYLKSLVFGSGEERSRREEIKLQDIQRRWVASNRWAEAAQFALARSLTSSHSDLLALEAAEGNNILRRTKDAVITLQSVLEGKHNTEIDESLTLYQVPADRWWPSLYKVVEGLATMSRLGRNRLQQPAYNFENNGSIDWDQM

SEQ ID NO: 36032 - protein, 162 aa, Sorghum bicolor
  Clone ID: SORBI-28MAY03-C80127_1.pep
MATTTFPTSTPFFAAHHQGPRRSQPSISAAVYGGRGRRWRPLRVACEKVVGIDLGTTNSAVAAMEGGKPTIVTNAEGARTTPSVVAYTKSGDRLVGQIAKRQAVVNPENTFFSVKRFIGRKMNEVDEESKQVSYRVMRDDNGNVKLDCPAIGKQFAAEEISA

SEQ ID NO: 36033 - protein, 171 aa, Sorghum bicolor
  Clone ID: SORBI-28MAY03-C80194_1.pep
MAKPKPSSAGAKSAAAAAAPAPPATVHSALVTYTSMLALLSLCPPFVILLWYTMVHADGSVVRTYEHLREHGVLEGLKAIWPMPTLVAWKIIFGFGLFEAVLQLLLPGKRFEGPISPAGNVPVYKANGLQAYAVTLITYLGLWWFGIFNPAIVYDHLGEIYSALVFGSFVF

SEQ ID NO: 36034 - protein, 151 aa, Sorghum bicolor
  Clone ID: SORBI-28MAY03-C80225_1.pep
AINVGISVSRVGSAAQIKAMKQVAGKLKLELAQFAELQAFAQFASALDKTSQNQLARGRRLRELLKQSQSNPLPVEEQVATIYTGTRGYLDSLEIEQVKKFLDELRKHLKDTKPQFQEIISSSKTFTEQAETLLKEAIQEQLERFSLQEQT

SEQ ID NO: 36035 - protein, 161 aa, Sorghum bicolor
  Clone ID: SORBI-28MAY03-C79668_1.pep
MTSAAVRREPAAGHRRYWRWSKADFFPEPSFQSWRAYGGALLSTGPRLRDRVTSRSSEAVEAGTLLAQSENPLRRCLSWVDLAFLGFGSVVGSGVFVLTGQEARFDAGPAIPLAYAAAGFSALLSSFCYAELATEIPSAGGSFSYLRVELGDLAAFIAAGN

SEQ ID NO: 36036 - protein, 106 aa, Sorghum bicolor
  Clone ID: LIB3476-042-P1-K1-B3.pep
GRMTVTQLAAAGSAGGPSGGAAGSGGAPVADVALRKIFVGNVPADMPSERLLAHFASYVSQRTALFLRCVTTVGSISFEMVVLNSEVLSAYMDACIFWLLLMWNVE

SEQ ID NO: 36037 - protein, 133 aa, Sorghum bicolor
  unsure (1)..(133): unsure at all Xaa locations
  Clone ID: LIB3478-018-P1-K1-E5.pep
DGRMTVTQLAAAGFGXGPSGGAAGSGGAPVADVALRKIFVGNVPADMPSERLLAHFASYGEIEEGPLGFDKQTGKFRGFALFVYKTPEGAQASLVDTAAWAKPRQLSSQLWMPSFPGAGLLRADDGPAAGAVT

SEQ ID NO: 36038 - protein, 190 aa, Sorghum bicolor
  Clone ID: SORBI-28MAY03-C79677_1.pep
LSLILLLSPTGIIQRDSMCSYPQRARRRVYGYWSRPNTASAAAYIHKMCHFLVEQPTMARSNCTEFNLRNNALRSSYNSLELEEFPKQSLKFLRALADYSGNTCDAGAQTAQRLERSFTRRTARRSEILRARTSSRAGEVAARRKVALRAGSKHTKRGFRLRSAGDAGEAREAVGWSGLARPPGGAQRRP

SEQ ID NO: 36039 - protein, 188 aa, Sorghum bicolor
  Clone ID: SORBI-28MAY03-C79679_1.pep
MASSPSVSFLELCLSFLCFVVFYYFHIRSKRKNPVIPLDWPLVGMLPALLGNLHHLHDWITSLVVASPLNFLFTGPPRSGMQFFVTADPANVRHVFTSNFANYPKGPEFEEIFDILGGGIFTADGESWRRQRAKAQLLMSSAPFRAFVSRYSRAKVDTALLPLLSHFAATGDAFDLQDVFLRLTFDTT

SEQ ID NO: 36040 - protein, 202 aa, Sorghum bicolor
  Clone ID: SORBI-28MAY03-C7970_1.pep
VKCSLVYMDFEGRSDGRSVKSVIAHVAPLKLVLVHGSAEATEHLKMHCTKNLDLHVHAPQIEETIDVTSDLCAYKVQLSEKLMSNIISKKLGEHEIAWVDAEVGKEDEKLILLPPSSTPPPHKPVLVGDLKLSDFKQFLENKGWQVEFAGGALRCGEYIMVRKIGDSSQKGSTGSQQIVIEGPLCEDYYKIRELLYSQFYLL

SEQ ID NO: 36041 - protein, 62 aa, Sorghum bicolor
  Clone ID: SORBI-28MAY03-C80693_1.pep
IRLKHMICGYNCNLSKHLGIDKVLRFTGRADGMTGSPTLAIIDHNVVLEQKKYHLNNHCLLG

SEQ ID NO: 36042 - protein, 181 aa, Sorghum bicolor
  Clone ID: SORBI-28MAY03-C80686_1.pep
EEALALFAAMRRAGGVRPNGVVLLGVLSACCHAGLVDEGLRHLGAMEDAYGVAPGVEHYGCAVDMLGRAGRLDEAEALVAAMPVPPDALVRGSLLAACRACGDVERAERVMRWMAAVDRDGEAGDHVLMSNMYASEGRHVRALQLRKQMRKSKIVKDPGCSSIEIDGVVHEFRAVPANAIA

SEQ ID NO: 36043 - protein, 113 aa, Sorghum bicolor
  Clone ID: SORBI-28MAY03-C80719_1.pep
RLPRLGAAATQQRHVRPPRRPASPSRQCRPCWAAGCCSGGGVNKGRRRAVWQRGAHGPRTRRALHLQQLQQPAADVKVYMDISVCCKLASWLRYVANDHAASISSSDFIIHRS

SEQ ID NO: 36044 - protein, 215 aa, Sorghum bicolor
  Clone ID: SORBI-28MAY03-C80738_1.pep
MPLLSAQPRLRPDAHHHHHRALLPPSAAASLLPSPSCSGIRSRRRPARTGLRVVSPETSSTVATDAATTAGAPPEPTRGRADKSKWAEFAARVSGEWDGFGADFTASGDPVELPENVVPEAYREWGVQVVDWQTQCPTLADPATPCALHYRLVRLLPTVGCEADAATVHTSHQRHAASAAAFAYAGAGSYVAAWPRGPAPVLEVEHCVVRPGAPA

SEQ ID NO: 36045 - protein, 179 aa, Sorghum bicolor
  Clone ID: SORBI-28MAY03-C8073_1.pep
TKVTHHPLLLQILSEEIGCDSDEIIGMELNVCDTQPSCLGGGNNEFIYSGRLDNLASCYCALRSLMDSSKMAEQLSNEKAIRMVAMFDNEEVAPDSMQGAGAPTMFQAMRRIIDSLMHQSMGEGALERAIHSSFLGSADMAHALHPNYAEKHEECHRPELQKGLVIKHNANQRYATSAV

SEQ ID NO: 36046 - protein, 60 aa, Sorghum bicolor
  Clone ID: SORBI-28MAY03-C79778_1.pep
RSIVFRIFLALVFTFHKKQGSKKLDGFYFHVSDVCCFCCYIWHHQHQGSAYNTTTLGACY

SEQ ID NO: 36047 - protein, 213 aa, Sorghum bicolor
  unsure (1)..(213): unsure at all Xaa locations
  Clone ID: SORBI-28MAY03-C79838_1.pep
LLLSLLLYHPRRAAAHLPAVGRHLRHHHRNCGRSCSPRRGGGARRQSQSHRPHRRGHGRHRRGHRCCCCRPCTPSRRRVARCPCPPQREWPGWWTPRRCRRTAAPRRXERGEEPXRRCGRGGAGAPAARRPPPRGWRSRSRRRCRRRRHGRSRATDPARRPSPWPWSPPVPAGAPWEEEDLPASPRSDSPDRDSHQHNQEPMLLPSCFFYLLV

SEQ ID NO: 36048 - protein, 129 aa, Sorghum bicolor
  Clone ID: SORBI-28MAY03-C79854_1.pep
DEAATHLLARGVGGSAAHGSRASTDGDLPMPAPYRLPAPATVDPADPNLAMADPTPAVVGWAPAMADPMDLAQPWRVRRLAARASRYPAASSTAWRHLCLIHSSMDYLSRRTLLASIRFPWAVPRDALL

SEQ ID NO: 36049 - protein, 149 aa, Sorghum bicolor
  Clone ID: SORBI-28MAY03-C79861_1.pep
SSSSQGEKESKEEEVAAAASHGHRPGSRTPGPPRGRRKERHAQGRDDAGGSREGTGEAHWEILLRARAIETQCYVIAAAQAGKHNEKRESYGDSIIIDPWGTVIARLPDRLSTGFAVADLDLSKVEAVRTRMPISEHRKFDSDWKPTTI

SEQ ID NO: 36050 - protein, 165 aa, Sorghum bicolor
  Clone ID: SORBI-28MAY03-C7988_1.pep
DAWADAWDTVLLDAISWRIPLVSDIPTIIFGADVTHPETGEDSSPSIAAVVASQDWPEVTKYAGLVCAQAHRQELIQDLYKTWHDPQRGTVTGGMIRELLISFRKATGQKPLRIIFYRDGVSEGQFYQVLLYELDAIRKACASLEPNYQPPVTFVVVQKRHYTRI

SEQ ID NO: 36051 - protein, 115 aa, Sorghum bicolor
  Clone ID: SORBI-28MAY03-C80848_1.pep
VCPGLTHAQKLGISYSDGEDNFIEQTSESREHHGESAVESSIQDQSSSIILISHPVTSRQDEALESGSGSQDHGNIVVTSDSDSDSDSTSRDNIVGANTEELMEDIEGTSGQDKR

SEQ ID NO: 36052 - protein, 191 aa, Sorghum bicolor
  Clone ID: SORBI-28MAY03-C8099_1.pep
LQYLAVSGNELSGKIPPELGNLTSLRELYIGYYNSYTGGLPPELGNLTELVRLDAANCGLSGEIPPELGRLQNLDTLFLQVNGLTGSIPSELGYLKSLSSLDLSNNALTGEIPASFSELKNLTLLNLFRNKLRGDIPDFVGDLPSLEVLQLWENNFTGGGARRLGRNGRLQVVELLFNKVNGTLAAEVLAG

SEQ ID NO: 36053 - protein, 113 aa, Sorghum bicolor
  unsure (1)..(113): unsure at all Xaa locations
  Clone ID: SORBI-28MAY03-C81069_1.pep
SLPPLPPCPPPARPRPRPRALASRALSAGGPPPPGAPPPSPPVPSPAPSSPPSPLPAPFELFVCPPLCDGLPGFIRWPCPLPGPVXAPPLPVSAPLARRSARVSKAVRPFLWL

SEQ ID NO: 36054 - protein, 366 aa, Sorghum bicolor
  Clone ID: SORBI-28MAY03-C81123_1.pep
MSAATAAAAARCVPLRASPPETAKSPASVPTSSAASASAPLRAAAVAAGPGGRLPVPPLRCSSSSPENSAPPDLGLLLEVEGVLADVYRFGNRQAFNVAFRSLGLDCANWTEPIYADLVRKARGDEERMLAIFFDRIGWPASLPTSEKGTFIKSVLREKLKALEEFSGSDSIPLRPGVEKFIDDVLGEGIPLAILATYGRNGEKISRSIAMKLGPERISKIKIVGKVEVEESFYGQLVLGKGVTSGLDEQLVREAQKSASAEKQRIAEEVASILKLSVDITASESSDKVIAALRAGSEYVGCDVQNCVLVAGSQSGVLAAERINMPCIVVRSSFTARAEFHSAKAVMDGFGDTDLTVSKLLSKRWS

SEQ ID NO: 36055 - protein, 170 aa, Sorghum bicolor
  Clone ID: SORBI-28MAY03-C81164_1.pep
MDSEPDFELRGLDIDVELDPEDLQPSVPLKKVPGGDLFEAARAGDCDRLALLLEAGANVNARDRWDSVALYYACLAGHAEAARMLLEAGAVCAERTFDGDRCHYAALNLRLRWLLKPFEARPPPLAPLPAALRATFLACPANRTAFLEMLQGSAGAESAALAAAAGFGPK

SEQ ID NO: 36056 - protein, 166 aa, Sorghum bicolor
  Clone ID: SORBI-28MAY03-C84726_1.pep
IEPWLSSTCALALVLALSVGASVARGSEPWWNETQVYTTTANSGGSNGVFVGLTLIQSAAAKGAVCLDGSLPGYHLHRGFGSGANSWLVNLEGGGWCNDVSSCVFRKGSRRGSSNHMERQLQFTGIMSNRPDENPDFYNWNRVKVRYCDGGSFTGDGSDAAAGLYF

SEQ ID NO: 36057 - protein, 132 aa, Sorghum bicolor
  Clone ID: SORBI-28MAY03-C847_1.pep
GEGRRTTLTHTPATRAPPLTRDLVRRHRRPTPPRPKKLGLPPCGPAPAVPDRVIDRGPDRPEASVTSARRRPGLPPARSRTSPASIEGTTSFTDRYVCPIRFPVTSFTGRFLRDFICDVCSIRSSFYFLFIY

SEQ ID NO: 36058 - protein, 118 aa, Sorghum bicolor
  Clone ID: SORBI-28MAY03-C84804_1.pep
HATASRQVRTEGKGSCSPTPQPGRAVKRGPAGSSRSRRGAGPDRQHRHGGPSESQQHNAARVRERREHKGGDESRGIVGPPIHCHAAQAWLKKAGSRETARRTDDSREPEAAAGEKRT

SEQ ID NO: 36059 - protein, 186 aa, Sorghum bicolor
  Clone ID: SORBI-28MAY03-C84946_1.pep
TESALKGSHFIELCAQRHIPLIFLQNITGFMVGSKSEASGIAKAGAKMVMAVSCAKVPKITIIVGGSFGAGNYGMCGRAYSPNFLFLWPTARISVMGGIQAAGVLAQIEKTHKKSQGVEWSKDEEEAFKAKVVEAYDREGSPYYSPARLWDDGVIDPADTRRVLSLCLSASAKPVPEDTRYGVFRM

SEQ ID NO: 36060 - protein, 140 aa, Sorghum bicolor
  Clone ID: SORBI-28MAY03-C81239_1.pep
NKPNTTEEGFHLNKQGGCWHVVPNTYIQAMQRVYNNSRELLNIQGFIVTLWFLLAMCYVKGTKGGTKSATDTGGNVFKPAFGSHHHCRCSFRNAEVLVCSWLRNRSSGGRAVRRSAAALLPDAGDSLWDCSRRVAYLGQS

SEQ ID NO: 36061 - protein, 180 aa, Sorghum bicolor
  Clone ID: SORBI-28MAY03-C81241_1.pep
MAASGPPPNSPFAPCSTPTPAAAAAAPMAASGPPLEDCLRLLRGERDEQKLAGLLVATNLCRAGDSDAVSKVYRAVGPRFLRRLLNTGLGKVEGGKEEEREAYLRLAVTVLAGLARVPEVAADEGVVSTVPLVAEVITKSTDPAITEECFELLSLVAIASEDGAYKFCEPGVVDMISFKS

SEQ ID NO: 36062 - protein, 133 aa, Sorghum bicolor
  Clone ID: SORBI-28MAY03-C8125_1.pep
VTFMDIVAYLKPKYVLMENVVDILKFADGYLGKYALSCLVAMKYQARLGMMVAGCYGLPQFRMRVFLWGALSSMVLPKYPLPTYDVVVRGNTPNAFSQCMVAYDEKQKPHLKKALLLGDAISDLPKVENHQPK

SEQ ID NO: 36063 - protein, 182 aa, Sorghum bicolor
  unsure (1)..(182): unsure at all Xaa locations
  Clone ID: SORBI-28MAY03-C81338_1.pep
MSKPADQQPSDMQVDSSSAVEEKPAIRFSINVLELMREAQMQHGLRQSDYTRYRRYCSARLRRLYKSLKFLHGRGKYTRRNITESTVTDVRFLHVVFYMAERAWSHAMEKKTAGTNAQQRIYMLGRFRKAVKWASLFSQLCSVKGDSRTSLEAEAYASYMKGALFFEQDKNIXAAMINFKNT

SEQ ID NO: 36064 - protein, 127 aa, Sorghum bicolor
  Clone ID: SORBI-28MAY03-C8131_1.pep
ARGLATVNQKILPLPGDVDVICGGPPCQGISGYNRNREFDAPFNCERNKQIIVFMDVMQFLKPKYIYMENVLDILKFADATLARYALSRLVSMHYQAKLGVMAAGCYGLPQFRMRVFFGGLSSKGGK

SEQ ID NO: 36065 - protein, 147 aa, Sorghum bicolor
  Clone ID: SORBI-28MAY03-C81628_1.pep
MQGGVSGFQNAPVTRAVVLASGLLSVVFSAQRRARALGISYQDTITNFRLWKIFPSVFAFQSTPELMFGLYLLYYFRVFERQIGSNKYSVFCLFTITASSLLEILSLVILKDTNYISTLASGPYGLIFASFVPFFLDIPVTSRFRIF

SEQ ID NO: 36066 - protein, 189 aa, Sorghum bicolor
  unsure (1)..(189): unsure at all Xaa locations
  Clone ID: SORBI-28MAY03-C80767_1.pep
RGRRAPPCRLPPPPPAPPPPXPPPRRLPPPPPPPPPRPRRPPPSAPAPPAPPRPPPPPPRPSPPPRPAPPPAPRPPPLPPPPXPPPPPPPPPPPPPPPPPAPPPSRPPPPPPPPPPPAPTSPPPPXPPPPPSPPSAPHPARRPPPRPPPAPPPPHGHPRERAGALRSGHVLPELHPQPHGGGRQHPGPP

SEQ ID NO: 36067 - protein, 202 aa, Sorghum bicolor
  Clone ID: SORBI-28MAY03-C80772_1.pep
MAMAPYPVLQQQIHLGHASKPTATASVHHHGHGNPNADAVAPSLRRSFPADARGLRALIKVLPTSSASAAVAVHAHATKLGLDRERTVRNGLIALYLACGERAAATALFDAFPGDGPDVVSWTAMVTGHGRLGFTRDAVALFFAMLDLDDGVSVDAVAAAAGFAACAEARDLALSREAHRRVAAARVALDVVAWNALVDMYA

SEQ ID NO: 36068 - protein, 193 aa, Sorghum bicolor
  Clone ID: SORBI-28MAY03-C80777_1.pep
MVMGALFPWLAWLLLSLAGSIYLLGHLVHDRRRRRGLPPGPHPLPVIGSLHLLGNQPHRSLARLAKTHGPLMSLRLGAVTTVVASSPAAAREILQRHDAVFSNRRSVPDAPGAHARNSTVWLPNAPRWRALRKIMGTELFAPHRLDALQHLRRDKAQELVDHVGRLARNGEAVTVGRVAFTTSLNLVARTVFS

SEQ ID NO: 36069 - protein, 254 aa, Sorghum bicolor
  Clone ID: SORBI-28MAY03-C80806_1.pep
MVASSAASAAAAAADFTRWAETFGTEKADAAKAALASATTLATSSASAAASASSTAASSAYAAASDLTLIAKEELEWVKKEYSAHEQIVFSKIKEGVVMAIMNPGIAAGSATLAGIVLFKRPRSYLIQRVQRMFVSKETLLSGVQAEVNHMRQTVNLVSNERQKLLDRAATAEKRFQKGWNTLREEGRSIQHELSEIRDIGNHAVGLKGIIDQLPRAHASEFRSEISGLASQVKKEKRVLNAALTKIVNYGVPI

SEQ ID NO: 36070 - protein, 154 aa, Sorghum bicolor
  Clone ID: SORBI-28MAY03-C8084_1.pep
VALNLPPPPPLPTEPHRSATLPSQGGHSLPTQINHQLYQPEHYYVPQSNYGPLAPASHSNLQISNTNNPTPAIPQVNPGPPTNQIGNLAQLQHSMPLHVDRASQDFSSQLQQQNLGPGAAQAPEEDKSKKYQATLQLAQNLLLQIQQRGSGNQS

SEQ ID NO: 36071 - protein, 315 aa, Sorghum bicolor
  unsure (1)..(315): unsure at all Xaa locations
  Clone ID: SORBI-28MAY03-C80934_1.pep
MVKLFLQVPAECDSVNTAAVEERKTLFRNVESIIKSVTRSAGRYEARLWLCATVSLVHSLSYRGQRDLFLDLLEMKNSRRDVAARLLRMIFDKKPKVVGSILARKGHMLEEARRGNPKRIMQWFGHSAVTGESTHKKGAKALSQFAFVNRDMCWEELEWKGKHGQSPAVVATKPHYFRDLDVLQTVENFLEYVPDFWSSDELXANSIKDGEILQIDAEYFVDQFLYLMYEENSKDAWHAVEDFLMDEQFSSLCQHLLIHLDEHRLLDFLKSLGKLINPTLQCKELAFPCCWLEVLLSGHCDHISFDDLVLLNCVI

SEQ ID NO: 36072 - protein, 91 aa, Sorghum bicolor
  Clone ID: SORBI-28MAY03-C81561_1.pep
GSNPEYFAVLIKYVNGDGDLSAVDLMQTGAGASWASMQPSWGAVWKLNAGSALQAPLSIRLTSSSGKQLVASNVIPAGWTPGATYQSSVNY

SEQ ID NO: 36073 - protein, 94 aa, Sorghum bicolor
  Clone ID: SORBI-28MAY03-C81486_1.pep
YLCSSVHSSQHKMSTVVMRVDLECEKCYKKIRKVLCKVQDKVSIRTISYDEKNNTVTVSGPFDAEEVADRLTSDAGKVITDIHVVGGFGGFALG

SEQ ID NO: 36074 - protein, 126 aa, Sorghum bicolor
  Clone ID: SORBI-28MAY03-C81577_1.pep
IQISILERKELHSIAWTSGAVLPFVGFAVAMFLFYSTVPIILKICGATMLNLSLLTSDMWAVLIRIFAYHEKVDWIYFVAFAATAGGIVLYSYKGSNEVEETPQVAGASDEHGKDRDEEAGTRNPV

SEQ ID NO: 36075 - protein, 89 aa, Sorghum bicolor
  Clone ID: SORBI-28MAY03-C81599_1.pep
TDIKVGGEAHVNELRLTYIKEWRFSLLVSQRDRLMKNEGYRNEKNTGGHSVTRRHCNGENVNSSTHFDGHDAMISASSLVFQAPMPVQY

SEQ ID NO: 36076 - protein, 127 aa, Sorghum bicolor
  Clone ID: SORBI-28MAY03-C81601_1.pep
ARRLYGYNRYYRGGGITLTATPRCAYPDQRLQGALATELFGRVHVRLFGGDLQCEWGQFESWDKWAKAYPGSWVFVGVVASPEADGDAYMSQKDLYYGILRFAHKEPNYGGLMIWDRYYDVKNHYMV

SEQ ID NO: 36077 - protein, 137 aa, Sorghum bicolor
  unsure (1)..(137): unsure at all Xaa locations
  Clone ID: SORBI-28MAY03-C81161_1.pep
PGPAPCSPLLPAASGRGPRAPRPPPPASPPLPARPRPAPPPPWPPPXAPPPPSPPPSLRLASPPHXPSARPPRHPAARIAAPYAARRAAPRPARRPTRGAPPRPAPRAGGPPPPWPAGARPPPAWGRGRAAARRLGG

SEQ ID NO: 36078 - protein, 230 aa, Sorghum bicolor
  unsure (1)..(230): unsure at all Xaa locations
  Clone ID: SORBI-28MAY03-C81210_1.pep
SSILCRKAEKLNKTNQAAKTLAPPTEWSPSLLRAPPWLLRRLLHSSRHIQHGLRTVTPATSAASSSSSYSPFPFRCLPDLLPSRVLSPRLLSTSGRDDDRNKPWSFAADSGDPDPFANEDAAAAGAVEGPTVRSTRAADEPWAAGFGGEDGDNGDVFEGIYKEAASAAPARGVAAPAGNDEQWTLSGDDEEKDPFAAAVLGXGFEGIQSEGAGLDDLDAGEDPDDELKRQ

SEQ ID NO: 36079 - protein, 145 aa, Sorghum bicolor
  Clone ID: SORBI-28MAY03-C81224_1.pep
MDIMQTSDSSHHGIVENSPYRIPYDRHAEGGQLGASWYFSRKEIEENSLSRRDGIDLKKESYLRKSYCTFLQDLGMRLKVPQVTIATAIVFCHRFFLRQSHAKNDRRTIATVCMFLAGKVEETPRPLKDVILLSYEIIHKKDPAA

SEQ ID NO: 36080 - protein, 169 aa, Sorghum bicolor
  Clone ID: SORBI-28MAY03-C81234_1.pep
SGSPVYSPGSPEYTPLTPPKRSGSPAYTPAAANYTPRSPSSSSLSDFFHDFDRHCTSPGSACSSRAVSPEYTPASASGCCSPPDYFFCYTPPPSAGYSPRDASPEYTPSIPLISLPRRAASPDYTPSSPSVVSDAASRTSPPSHRRFHPYQRSRTSCCQSRRSSSQHGY

SEQ ID NO: 36081 - protein, 113 aa, Sorghum bicolor
  Clone ID: SORBI-28MAY03-C81238_1.pep
MFDRINAPKAASWCSLGFSSPRLALILSRHARAAALMAAAPAPADAKAEAAKMDLLEDDDEFEEFEIDQEWDDNEEGNEAVQQWEDDWDDDDVNDDFSLQLRKELEGNNAQKS

SEQ ID NO: 36082 - protein, 151 aa, Sorghum bicolor
  Clone ID: SORBI-28MAY03-C81708_1.pep
SVVERLSRQSKRVYLAQPVGVAAGAHAGPRPCTGAPLDDTAASTERISGSRAANQMSSSTVWPRREKRARASQATCGPNTSASLPRAHGIAAAGRRGLTEQAGELAGGEKPEPQKTHRVSQRPETGEEEVAYAPDLTAGDGDDDGGEIMED

SEQ ID NO: 36083 - protein, 257 aa, Sorghum bicolor
  Clone ID: SORBI-28MAY03-C81745_1.pep
MKFGKRLKKQVEESLPEWRDKFLAYKRLKRLVRLVSAAGSSSPRRRRRGSAAEEAAFVRLLDAEVDRFNAFFLEREEDFVIRHRELKETAKKVAEDAWRRRRPPSAAETTSVRKEIVDLHGEMVLLLNYSAINYTGLAKILKKYDKRTGRLLRLPFIDKVLGQPFFATELISRLVRECEATMEAAFEASRGTSARTTPVAAAGQGIFRNTVAALVTMGELRSGSSTYGHFSLPPMAPPESDLLRCVCVQVAAGPASI

SEQ ID NO: 36084 - protein, 171 aa, Sorghum bicolor
  Clone ID: SORBI-28MAY03-C81794_1.pep
MASLVLVVAMVLSLSQLSVGSRRLMELYIPPPSDQLTDHHGGVLSGDIRVTTLWYGSFTSAQKSIVYDFLLSLTAAPSATATPSVGQWWGTIDQLYLSSAAASGTRVLLDARTQVSDEAYSLGKSLTLAQLEQLAARAGAKKGGIALVFTDENVAVEGFCSSRCGKHGSAA

SEQ ID NO: 36085 - protein, 115 aa, Sorghum bicolor
  Clone ID: SORBI-28MAY03-C81877_1.pep
DDADVDDWLPRFVVLQGQCLYYYLKSTDLSPQESTLLCDVVEVGQLPNFVPEDEKPRYAFYLLTRQGLKFECSSTSEIQVDSWVRALSSDCKLRDGAGDDDKMKTPSSQVEAGSW

SEQ ID NO: 36086 - protein, 252 aa, Sorghum bicolor
  Clone ID: SORBI-28MAY03-C81943_1.pep
MMQPPPPQQQQQWAMAPPPPPQYYQAGHPPPPPPQFYQAGPPPPAMWGQPPPQAAPAPAPAPSGGGAGDEARTLWIGDLQYWMDENYLYSCFSQAGEVISVKIIRNKQTGQPEGYGFIEFGNHALAEQVLQNYNGQMMPNVNQPFKLNWATSGAGEKRGDDGSDYTIFVGDLASDVTDFILQDTFKSRYPSVKSAKVVFDRTTGRSKGYGFVKFADLDEQTRAMTEMNGQYCSSRPMRLGPASNKKNTGGQP

SEQ ID NO: 36087 - protein, 132 aa, Sorghum bicolor
  Clone ID: SORBI-28MAY03-C81391_1.pep
ARDALQTLSSFCSLSVVTSRQDVIKNHTLEWIEKYYPGLFEQIHFGNHFALEGRSRPKSEICRSFGAQVLIDDNPRYALECANDGMRVLLFDYDNSYPWCKTGVDELHPLVTKVHNWEEVEEKLLSWVVPES

SEQ ID NO: 36088 - protein, 186 aa, Sorghum bicolor
  Clone ID: SORBI-28MAY03-C81336_1.pep
MAMAFASCASTRSAAGDAFSYDDVGSSRGYRLVTARGRSFVELEGIVFDSERFCYRRTSSLLDSPPRSGSPDYTPGSLDCSSQRSGSPDYSPATPDPATPSSQRSGSPVYSPASPEYTPLLKPSSRRFGSPDYSPATPEYTPLTTSSQRSGSPVYSPASPEYTPLLTPSSRRFGSPDYSPASPEYT

SEQ ID NO: 36089 - protein, 154 aa, Sorghum bicolor
  Clone ID: SORBI-28MAY03-C81421_1.pep
LASSRLALCHQRLIIPIITAFILVVSSRLSFVNPAKPLLFSFSQHHSTVSLWVALSGCVPTVCKSARNSVHFYDAFQTVFIPGRRRLCWIVDHVRKHSRCPAFGSASFAFQGTLNIENRRRQKLPPTNQPNSSVSAINQNHLTFYHHQGDHDHW

SEQ ID NO: 36090 - protein, 114 aa, Sorghum bicolor
  Clone ID: SORBI-28MAY03-C81459_1.pep
RLEAPRTGPAMSMATAAPVRMPMPAMGPMPQQHGHHAQGMGVPSIWPPAAAPGPEWGYSTQPYGSYSGPPAGGYYGGAYGPAAGHWPYGGGYGRNPYAQQQYYEEEPSAGCSVM

SEQ ID NO: 36091 - protein, 319 aa, Sorghum bicolor
  Clone ID: SORBI-28MAY03-C81482_1.pep
VEPPGLFRGRGEHPKMGKLKRRIQPSDITINIGKGAPVPECPIPGESWKEIKHDNTVTWLAFWNDPISQKDFKYVFLAASSSLKGQSDKEKYEKSRKLKGHIQRIRENYTKDFKNKDVTRRQIAVATYLIDKLALRAGNEKDDDEADTVGCCTLKVDNVTCMPPNKIQFDFLGKDSIRYFNTVEVEELVYKAIEGFRAGKKPGEGLFDKIDTTRLNAHLKDLMPGLTAKVFRTYNASITLDGILHEETEDRTLLEKIAVYQRANKEVAIICNHQRSVSKSHESQMIKLNEKIDELKSQMEELKADLSKAKKGKPLGYDK

SEQ ID NO: 36092 - protein, 121 aa, Sorghum bicolor
  Clone ID: SORBI-28MAY03-C82059_1.pep
REFSPVQQSANGGPIGYRYRPDDHDRREVDRFQINLQNLNMRSSSSPNNQVDAEWIEQYEPGVYLTLVSLCDGTKELKRVRFSRRRFGEHQAESWWNDNREKVYEKYNVCGTDRLSSVTTA

SEQ ID NO: 36093 - protein, 141 aa, Sorghum bicolor
  Clone ID: SORBI-28MAY03-C82066_1.pep
MQIFVKTLTGKTVTLEVESSDTIANVKAKIQDKEGIPPDQQRLIFAGKQLDDDRTLADYNIQKESTLHLVLRLRGGGRGGYPIMSVPWDLINLARKHNETKMICRQCYARLPPRSKNCRKKKCGRSNELRSKKKFISEFNI

SEQ ID NO: 36094 - protein, 121 aa, Sorghum bicolor
  Clone ID: SORBI-28MAY03-C82069_1.pep
AAMAKSKQLLQGRTGTAATLVVSYFAVCGVTSLLFRAAVVKGRAEEGSFGLALPGRLLVGAVLVCVLVCVNLLGLLVQSVFYYACKAFHNQQIDRTALYEHLGGYLGEYVPLKSNIQMESL

SEQ ID NO: 36095 - protein, 125 aa, Sorghum bicolor
  Clone ID: SORBI-28MAY03-C82090_1.pep
MAKLKAARATDVPSALPPEPDIAADLDGLAAAASSCSCIRAGAAEATTTAAEGRPLVVIGHRGKGMNTLVSPDPRLRGDVRENTLRAFNDAAASHPAVAYVEFDVQVTKDGCPVIFHDNFIYTQQ

SEQ ID NO: 36096 - protein, 123 aa, Sorghum bicolor
  Clone ID: SORBI-28MAY03-C82206_1.pep
MKDQRKCKQTCFSRQLLEKMDGCFLLNNRVNLCGESSSRTCVFHLPAISASVISLAGAGDCLVGGVLSALCAGFDIIQSVAIGVAIAKASVESGANIPDDISAASIADDAQCVLHSAKVVWCK

SEQ ID NO: 36097 - protein, 268 aa, Sorghum bicolor
  unsure (1)..(268): unsure at all Xaa locations
  Clone ID: SORBI-28MAY03-C821_1.pep
MAPASLPLSVSCAPGSSCPLAVTSPGSSVAAASSSQLPASSRSSERRRVPGLALPAAPGVGGRKGGGRWRAGISSFSSFLPPFFTGNKGEKDAEKAARLKEELLDAIAPLERGAEATPEDKERVEQIVQQLEAVNQVKEPLKSDLLNGKWELLYTTSTSILQPQRPKYLRPFGKIYQAINADTLRAQNMETYPYFNQVTANLVPLNARRVAVKFDYFKIFXFIPIKAXRSGKGELEITYLDEELRVSRGDKGNLFVLKMVDPTYRVPL

SEQ ID NO: 36098 - protein, 290 aa, Sorghum bicolor
  Clone ID: SORBI-28MAY03-C81620_1.pep
WLEEPICIGRHAFGDQYRATDMIINGPGKLKMVFVPDGADPMELDVYDFKGPGVALSMYNVDESIRAFAESSMAMALSKKWPLYLSTKNTILKKYDGRFKDIFQEVYEEQWKEKFEANSIWYEHRLIDDMVAYAVKSDGGYVWACKNYDGDVQSDFLAQGFGSLGLMTSVLLSSDGKTLEAEAAHGTVTRHFRLHQKGQETSSNSIASIFAWTRGLEHRAKLDKNDSLLDFIHKLESACVETVEFGKMTKDLALFIHGPKVTREFYLSTEEFIDAVAQQLRGKIQLPTMV

SEQ ID NO: 36099 - protein, 239 aa, Sorghum bicolor
  Clone ID: SORBI-28MAY03-C81634_1.pep
QTHTHTHTHTHTHTHSCPRADLPPPSVLPRSPCPSFSRCSLPPGRPPWQQPTRPCPGRRSARARPCSPPRSCVPALALVLSLLRRWPWCSCHVCRAYLTGSWARDFTNLGDWYAHLLRDSPSGTVHVHVLGCTVTANPANVEYMLRTNFDNFPKGKAFAALLGDLLGGGIFNVDGHAWRHQRKMASLELGSVAVRSYAFRIVAQEVEFRLVPVLAAAADAGAVVDLQDVFRRFAFDTIC

SEQ ID NO: 36100 - protein, 184 aa, Sorghum bicolor
  Clone ID: SORBI-28MAY03-C81636_1.pep
MEKSSSENATPLKLFGSWASSYTHRVQLALRLKGLEFDYVEEDLGNKSDELLRHNPVHKKVPVLVHGGRALPESVIILQYLDDAWPETRPLLPADAFDRALARFWCHFADDKLGPAVGAVFASTGEDQEAAVRQVHENLALLETELRDGAFRGRRFFGGAEVGLLDVVLGCGSYWLAVFEDVTG

SEQ ID NO: 36101 - protein, 85 aa, Sorghum bicolor
  Clone ID: SORBI-28MAY03-C8165_1.pep
FVGRCRYLSKCPELQSELMGHGLGNWSSRRYQIYLEAEQHEEQLFGKNGKIEHKLSKRYITLTTGAPTILTSTDCKLGCLFEPRA

SEQ ID NO: 36102 - protein, 183 aa, Sorghum bicolor
  Clone ID: SORBI-28MAY03-C81664_1.pep
MASKSQLLSFIAIAALASIIIHPCASVEFHRKLSSWSSGGATWYGAATGAGSDGGACGYQGAVDQAPFSSMIAAGSPSIYNSGKGCGSCFQVKCTGNGACSGNPVTVVITDECPGGACLNEPGHFDMSGTAFGAMANPGQADKLRNAGVLQIQYTRVPCNWPGVKLTFVVDAGSNPEYFAVLI

SEQ ID NO: 36103 - protein, 236 aa, Sorghum bicolor
  Clone ID: SORBI-28MAY03-C82319_1.pep
MAPRDLLLLLLAAVLLPSSSTAADPDAVQDYCVPETGAGARDRAVPVDLSLLPSYPCRSPANLTAADFASAAVRAAGNFSADTGFAGVSVTPATFPALHTLGMSFARADLSAAGGVNPPHYHPRATETALVLSGRVYAGFVDTGGRVFAKVLEKGEVMVFPRAMVHFQMNVGDEPATVYGSFNSENPGIVRIPATVFGSGIKEGVLERAFGLSPEELRRLEKRFGPPKTKTAEMDD

SEQ ID NO: 36104 - protein, 117 aa, Sorghum bicolor
  Clone ID: SORBI-28MAY03-C82321_1.pep
GSSICIGFSSQGHEASELGLEAGHCKVFMESEDVGRTIDLSVFGSYEELYGQLADMFGIEKAEIMSPLCYRDAAGAVKHTGEEPFSDFMKVARRLPIIESPEGRLQKPLIEYMMERA

SEQ ID NO: 36105 - protein, 165 aa, Sorghum bicolor
  Clone ID: SORBI-28MAY03-C82363_1.pep
ARYAKPGGWNDPDMLEVGNGGMAYGEYVVHFSLWAIAKAPLVIGCDLTRVSKETLGILSNAEVIAINQDRMGVQGKKVKKYGNDLEVWAGQLSRHRKAVLLLNRGTTSSASITAAWPDVGIRRGVTVEARDVWKHETLQGRFTGSLTAVVGPHSCKLFVLTPVPR

SEQ ID NO: 36106 - protein, 168 aa, Sorghum bicolor
  Clone ID: SORBI-28MAY03-C82395_1.pep
MAGISRAIRACAAASRRALAAASGAALPKEEAAAAGAGVRAAATGRTGRDQEDGRRVQWVFLGCPGVGKGTYASRLSQLLGVPHIATGDLVRDALATPGPFSKKLAEIVNHGKLVSDEIIINLLSRRLEEGEEKGELGFILDGFPRTIRQAEILEGVTDIDLVINLKL

SEQ ID NO: 36107 - protein, 306 aa, Sorghum bicolor
  Clone ID: SORBI-28MAY03-C82406_1.pep
YVQGSITFHDVIDNAHDGGVAQIRLEGVYIWPFRQLRMVANSGADGEPLQEEDYFLSNPYHLLRIFSSQVFQESSEEKNQRKNSLTYDMEKHCNTELAAKVVRVSSNPNDGEHEKYRLEGLVESPAVDDDGECFSPILLNATSLNVEVYYNKAVNYTLMVTFISFLQVLLLIRQMEHSNTQSGAAKVSILMIGQQAIMDAYLCLLHLTAGILVESLFNAFATAAFFKFVVFSIFEMRYLLAIWKASRPLNSGEGWEIMRRELSVLYSRFYGILLGGILLMYELHNFLRPLLLLMYSFWVPQIITNV

SEQ ID NO: 36108 - protein, 107 aa, Sorghum bicolor
  Clone ID: SORBI-28MAY03-C81910_1.pep
NLLMDEMKEQLKSANSDFPKTDLIQFIKYLLPTLERDAYPLFRTLRQKYKTSTDRDPVFQELLDEIAAKFYNIQRQNPLEGLFSEMFKIMHEKRILCRCFRLNHWLG

SEQ ID NO: 36109 - protein, 141 aa, Sorghum bicolor
  Clone ID: SORBI-28MAY03-C81950_1.pep
MDDVHGRIEVFPQYFVPSKEAMETPDGLSTSKNNLDSPPSSRRRSWTPRRVKGAASILNLLSIPRIRWSMSNEDDDKIELSRAEVETLRTEIAEAEERESHFKARLENIDEVLRFARLSGYLYIRSRWSQLPGEPPILDDA

SEQ ID NO: 36110 - protein, 113 aa, Sorghum bicolor
  Clone ID: SORBI-28MAY03-C82039_1.pep
APVIEYVRSAEEEDDDEAEETDDDAELELTLAVGGAGAKKRYGEYPSGGESLLSSSTESDVLTVSGREWRQARGTPYHKRRPAPGLDVVQVEDGVGVQPPPPLLFHWLTLKMA

SEQ ID NO: 36111 - protein, 122 aa, Sorghum bicolor
  Clone ID: SORBI-28MAY03-C82045_1.pep
DLKDIPKKACDRRINEFVKRARAAKIHAYIIGHLKKEMPTMMGKAKAQQRLIDSLPDEFAKVQREYHLPSGDFPYVEHFKEVLSGYSFDKFEKVKPKMIQAVDDMLGYDIPELLKNFRNPYE

SEQ ID NO: 36112 - protein, 135 aa, Sorghum bicolor
  Clone ID: SORBI-28MAY03-C82053_1.pep
MAIAQYSSTMKASCVVLVSILLLATLAAADASSSSPPSSLGRHPALVLGRKGRELGQSSGYHYQHQSKHMQMLQPEEVAMEVKKPKEEEAKAGWTADQGEDAEAGLIYSADYSGVAMHAGSPPTAKPKHRHPTKP

SEQ ID NO: 36113 - protein, 168 aa, Sorghum bicolor
  Clone ID: SORBI-28MAY03-C8253_1.pep
RAPSPASRGPRPRPPSPASSGPRPCAPADLARLLPRRGSGRADPRDADLARLLLHADPIPSGIDGHGGGGGSKFAQPPFALFAPTPPSPPPPAPTICTRPRTSAPNLCTLSPDVTPLPCSTPPSPQMGLSSATVPHGPSFVIPASSTPPPICYTLSQRGQKWLWVVRP

SEQ ID NO: 36114 - protein, 153 aa, Sorghum bicolor
  Clone ID: SORBI-28MAY03-C82603_1.pep
MSGFGDGYVGTAQDAVKIRRLEKQREAERRKIEELKNKSADGQPGLLQFGSSTSEILETAFKKETVGLVTREQYVEKRVNIRTKIEEEEKEKLQKLQQEEEELQMQKRKKRRVKGDPRLSFFDDIENGSDEDDFEKQETKKNGPVKLGKDPTV

SEQ ID NO: 36115 - protein, 210 aa, Sorghum bicolor
  Clone ID: SORBI-28MAY03-C82606_1.pep
MAVGGEGARQRQRGCSCTKADFFPEESFSSWSAYGRALRSTVSRLADRVTSRSLETTELHEVRARSGADMKRDLTWWDLAWFGVGAVIGAGIFVLTGQEAREDVGPAVVISYVVSGVSAMLSVFCYTEFAVEIPVAGGSFAYLRVELGDFMAFVAAGNILLEYCIGGAAVARAWTSYFATLLNHQPSDFRIHASGLDANYSELDPIAVVV

SEQ ID NO: 36116 - protein, 122 aa, Sorghum bicolor
  Clone ID: SORBI-28MAY03-C82654_1.pep
QLMDQGNQLMDETDQAIARSKQTVHETINVGTETAAALKAQTEQMSRVVNELDSIHFSIKKASQLVKEIGRQVATDRCIMAMLFLIVAGVIAIIIVKIVNPHNKDIRDIPGLAPPVSRRLLR

SEQ ID NO: 36117 - protein, 117 aa, Sorghum bicolor
  Clone ID: SORBI-28MAY03-C82657_1.pep
NGLVPDVVTYRVVAENLIEEGSLEEFDTLFSAMEKNGTAPNSQMLNALVRRLLHRGDISRAGAYLSKLDERNFSVEASTTSMLISIFSSDEYQHHAKSLPKKYRILNEANSSALIKK

SEQ ID NO: 36118 - protein, 96 aa, Sorghum bicolor
  unsure (1)..(96): unsure at all Xaa locations
  Clone ID: SORBI-28MAY03-C82229_1.pep
GGTEGKARQASSHPPTNAGQGAGSGRQLSGAGRSGGGDGSXGGGGRPGTAGPGGGGREGAGRLPGTAAPMGAGGGGTTARGGNGLREAGGGGRRGG

SEQ ID NO: 36119 - protein, 182 aa, Sorghum bicolor
  Clone ID: SORBI-28MAY03-C82243_1.pep
MMIPWGGVGCCLSAAALYLLGRSSGRDAEVLRSVARAGSMKDLAAILDTASKVLPLVVAVSGRVSSDTPLICQQSGMRGVIVEETAEQHFLKHNDAGSWIQDSAVMLSVSKEVPWYLDDGTGRVYVVGARSAAGLILTVASEVFEESGRTLVRGTLDYLQGLKMLGVKRTERVLPTGTSLTV

SEQ ID NO: 36120 - protein, 187 aa, Sorghum bicolor
  Clone ID: SORBI-28MAY03-C82290_1.pep
MRPPRSAVPAMALALALVVALLALATTAVARHSYTTTIVPAPAERADEEVRRMYEAWKSKHGRPRGNCDMAGDEDRLRLEVFRDNLRYIDAHNAEADAGLHTFRLGLTPFADLTLEEYRGRALGFRARHRGGPSARAAASRVGSGGTRSHHRRPRPRPRCGDLPDAIDWRQLGAVTDVKNQEQCGGC

SEQ ID NO: 36121 - protein, 86 aa, Sorghum bicolor
  Clone ID: SORBI-28MAY03-C82317_1.pep
NSPPTYQYSPPPYNYLSSPPPAQYSPPLPPNAPKHLHPNAPPAKSPPASPQPLYQYNTPPPPNDVMPSTMPPLHSYQSPPPTNQLS

SEQ ID NO: 36122 - protein, 73 aa, Sorghum bicolor
  Clone ID: SORBI-28MAY03-C82318_1.pep
CESKLIPRADDTEEVVKERLRVYHDLTEPVEEFYRTRGKLLEFNLPGGIPESWPKLLQPLNIEAPDNKRSAAA

SEQ ID NO: 36123 - protein, 221 aa, Sorghum bicolor
  Clone ID: SORBI-28MAY03-C82950_1.pep
MALSHLSRRLLSPTAAAAAAHLPTHKTFAHGRDPFVLLNPGRRFFSASSNPSPNPSSTPSESSQGAPSAPVSPDEMRHQEIEGPTVERDTSPLADETRRELDALRRTVQRLSGSLALLGGAHLAAGAWIAYGAPPLGVGSPAAVQGVAAFAFPFAVPLVLRRAIKPIAFFQKMEANARLQVLTLSLQATKNVTLMLLRTRVMAIACALGVSVASVAAVLMR

SEQ ID NO: 36124 - protein, 157 aa, Sorghum bicolor
  Clone ID: SORBI-28MAY03-C8298_1.pep
MLPQHHQGSMPQALSFLPEVLRLLQLPPDPRRRPPPDPRRGPDLCTRRRPSPRRRRPPPLDPLSPPPAPVPSPVLQPPAPLPPVPPAPGQPALPAGAGGYPLRHRPPGSFPPPPPPWSQQNGWRRRRRRREEGGERYLWARIEAAVEGKAGDTALSL

SEQ ID NO: 36125 - protein, 124 aa, Sorghum bicolor
  Clone ID: SORBI-28MAY03-C82994_1.pep
HNHAPRTHRARHCTCLAQAPEEPHTQRRTECGCAWDCLSAPPALPASPLPSPRSVPLTVSGDPRPRSARLCWTPARAVSVPRSLAWLPPDPCNLQTALGFAPAAPLFFPPTFASSLPPRFERQH

SEQ ID NO: 36126 - protein, 87 aa, Sorghum bicolor
  Clone ID: SORBI-28MAY03-C83049_1.pep
WSRPPRIERWRFASSPMPMLMSMPRGSHKTDHLKARFLLLATRDWSPQARLFLGMNFLVSVGFVGNALWLQQMQCCKLVRSTPWACK

SEQ ID NO: 36127 - protein, 218 aa, Sorghum bicolor
  Clone ID: SORBI-28MAY03-C83070_1.pep
SRVHVHSGDLENATVPRAGGQEAHTDWTRGPGRGPRAGQHNARPKHSRRGPERRHGAQHPSRQYERVARQPHPPPPPPTNKPRRQAGRTNNNTQSRTVGSTSRDVPAPPGRVPAQSQDDVAQHSPGADRGGGATAPPAAAAGVPGRMVSYHATPTPGREPGQEGTNLGLWTWAAQQAVGPSRDHRIGQTTTEGKGHRSPKATRGKTGRRRPKGHPKRV

SEQ ID NO: 36128 - protein, 193 aa, Sorghum bicolor
  Clone ID: SORBI-28MAY03-C82420_1.pep
MSMTGQLKGHLWLVFTMLFVTSAMHSEGASSFAPPSLSISPTYDPVIKVIGKVYCYRCFNEAHPDESHGKKHLEGAMVKVTCQANVQALVAFGYTKSNGKYSVILKGLPISNNYGADSCKVELHGAPGGSDCNVPIELNLSGLSVYSKSSEEVVFKANQIMAFASKNTFGCSKPQTQPPIHPYSSPPLPYQYP

SEQ ID NO: 36129 - protein, 103 aa, Sorghum bicolor
  Clone ID: SORBI-28MAY03-C8243_1.pep
YCYSSLVRLPRPGREGSRPLRTSPALLDLRRTPDTAEMQNPSGHHPATAAPSSAPSKGKSSAPNPSGHHAATPAPSGTPSKGKSAAAQAAVFGPGAPLPTTTL

SEQ ID NO: 36130 - protein, 222 aa, Sorghum bicolor
  Clone ID: SORBI-28MAY03-C82471_1.pep
MAPMKVYGWAVSPWMARALVCLEEAGVEYEVVPMSRCGGDHRRPEHLARNPFGEIPVLEDGDLTLYQSRAIARYVLRKYKPELVKEGDLEGSAMVDVWMEVEANNIEPTLWPIVRHCIIGQYVGRDRDQAVIDENLEKLRKLLPVYEARLSVCKYLAGDDITAADLCHFGFMRYFMATEYAGVVDAFPHVKAWWDALLARPSVQKVMAGMPPDFGYASGNIP

SEQ ID NO: 36131 - protein, 148 aa, Sorghum bicolor
  Clone ID: SORBI-28MAY03-C82501_1.pep
GETTTANRNKLAACIAAILAPSTATATCWGVDVNGWVPYAVTVTAWFVSTVCLWAFVPQARAPKLWGVPLVPWLPSASIAINVFLLGSIDSKSFMRFGYWTAALLVYYLFVGLHASYDTAKALAAESAIAKVENGDDKPARGPVHNGV

SEQ ID NO: 36132 - protein, 152 aa, Sorghum bicolor
  Clone ID: SORBI-28MAY03-C82507_1.pep
IPYHYTQLTRSAHPPTPPVPPPRILGRFKDRRCRLQHFSTGIVATPHLDSPCYLASVKPHQPPGKTRRWLLPSLFLPPSLRAGALGTMHRNRLAKMRTLICPRRGMVRLAASCCCCRSIVAAGGFLLTKARESGDWRAVWLVSCVSDVRVRS

SEQ ID NO: 36133 - protein, 218 aa, Sorghum bicolor
  Clone ID: SORBI-28MAY03-C84956_1.pep
YALPSGAGAVLKPARAAFEKEIEGLPTTRSVGDLPPELRCPLCKEVMKDAVLTSKCCFRSFCDKCIRDYLINKSMCVCGATSILADDLLPNKTLRETINRILEAPPTSSTENVGSMVQVQDTESALPVQPKLRSPAVSAASKEEAKASTPVEESPDAESLNGAKATNIDASSSDKKATTVPDIAEGTMDSKKAKEDKPVETTPVAKDSQEKFPAGEQA

SEQ ID NO: 36134 - protein, 207 aa, Sorghum bicolor
  Clone ID: SORBI-28MAY03-C83179_1.pep
MAAAVPTPSPFLASTRRFGFAPRLRSLLPAAAMSSAAVSASAPSPSSGTGEEAQAAPLPHSTLEIAGARRGLLSGFSSLRAPYRAFPVLASNRHVETIFAAFTRSLPAVKLRRECLRAPDDGAIALDWVSGDDRALPMDAPVLILLPGLTGGSDDTYVRHMLLRARSKGWRVVVFNSRGCADSPVTTPKFYSASFTGDLRQVIGHIL

SEQ ID NO: 36135 - protein, 112 aa, Sorghum bicolor
  Clone ID: SORBI-28MAY03-C83181_1.pep
MDSHAAGSSSGGSGDGAAQARRNSRKPKYSKFTQQELPACKPILTPKWVISVFVLVGVIFVPIGIVSLRSSRQVVEIVDRYDDACVPAGVTDKLAYIRNESIPKACTRNLTI

SEQ ID NO: 36136 - protein, 130 aa, Sorghum bicolor
  Clone ID: SORBI-28MAY03-C8319_1.pep
MAAAGLRKGNARLPPEVNRVLYVRNLTFNISSEEMYDIFGKYGAIRQIRLGNAKDTRGTAYVVYEDIYDAKNAVDHLSGFNVANRYLIVLYYQPAKMSKKSDVKKKEDEITRLQEKYGIGSKTPGPGSSD

SEQ ID NO: 36137 - protein, 204 aa, Sorghum bicolor
  Clone ID: SORBI-28MAY03-C83208_1.pep
MWQTRGLLLVAVVAAAAALPDGAWAAAAGRCTTSTPIKTYDKCIALPTQGATLAWTYDARNATLDAAFTGSFISPSGWVAWGVNADAPAMTGARVLAAFSDPSTGALLALPFVLSPDVKLQASPLVSRPLDIPLLASSASLASPARTVRVGARVTVAATIRLSPNRTRGHFVWNRGLYVQGYSPTIHPMDASDLASHATVDILT

SEQ ID NO: 36138 - protein, 94 aa, Sorghum bicolor
  Clone ID: SORBI-28MAY03-C83229_1.pep
MVDPGGIANWSVTHVDWSEGKWHPRSYRAADVNYQLLKNITSVNENFHITSDDKKVMTRTPCMWNGTKRPCYLFARKFYPESLNNLLKLFSSYT

SEQ ID NO: 36139 - protein, 133 aa, Sorghum bicolor
  unsure (1)..(133): unsure at all Xaa locations
  Clone ID: SORBI-28MAY03-C8324_1.pep
MPDTDVDTEMREAAAAAAGAPAGDDDGEGDTEEEEEEDEDDEDEVDEDDEEELPAAAPAPTEEQPAPAPISALPGNPNQLTLVFQGEVYVFESVTPEKVQAVLLLLGRXELPPGLAGMVLPNQNENKGYDDIL

SEQ ID NO: 36140 - protein, 75 aa, Sorghum bicolor
  Clone ID: SORBI-28MAY03-C86812_1.pep
SLSINPTPDVVVPPTLIDPAQSPATYPCPLRTRRRVGRPKEKRADPRIAIKRAVRCSRCKGYGHNKATCKVPVST

SEQ ID NO: 36141 - protein, 151 aa, Sorghum bicolor
  Clone ID: SORBI-28MAY03-C86824_1.pep
MEMIDAELRLGPPGSNSDVVVTVVQPTRTPASAAAKRRPESSVVKSEASGTDDHDDAAPASKVQGVGWPPVRAYRKNAFHAAAEARRATKGGEQQGSGLYVKVSMDGAPYLRKVDLRTYGGYRELRDALDTLFGCFSSSAAADGGCQFAIA

SEQ ID NO: 36142 - protein, 211 aa, Sorghum bicolor
  Clone ID: SORBI-28MAY03-C8694_1.pep
TRPVSWYATVALETMKKYGGIYLTPFSHRLAEDIDDPELQRLRCRVNYHALRFKPHIMKTSSEIVNKLRSEGHFMSIHLRFELDMLAFAGCIDIFKPQEQKIMLKYRKEHFAEKELIPMERRRMGKCPLTPEEVGLILSAMGFDNRTRIYLASGELFGGKRFMKPFKTMFPRVENHSTVGPGKLEENTQGLARSAVDYMCCLLSDIFIPTY

SEQ ID NO: 36143 - protein, 179 aa, Sorghum bicolor
  unsure (1)..(179): unsure at all Xaa locations
  Clone ID: SORBI-28MAY03-C87008_1.pep
MGHGKEAKTRPDPKVEIQEKGEIFFFYRPKVDKDEAHSPDDVQRMYIVLRPESTGGRGVEEKQASDSGKEGRKRHQQGDAAGQEGSEQKGAEGGHGKEEVNIEEQPLLRLVVMGKKSLPDPAKHSRPYWGYVELVTTKVEDIKDALKEEEYSTATRGKRHRPXARALGEGVYRILKHES

SEQ ID NO: 36144 - protein, 122 aa, Sorghum bicolor
  Clone ID: SORBI-28MAY03-C83401_1.pep
GGGSDGPEDESFKQSLYEMIQILIATVAFILVYIHIIRGEELYRLARDYTRYMVTGKRTARLKRAMLNWRQFSESITKKDDAQEDYYGRYTSESTWWQQPQQLARRMEEVCRGYLRPHAQES

SEQ ID NO: 36145 - protein, 64 aa, Sorghum bicolor
  Clone ID: SORBI-28MAY03-C83406_1.pep
QAWAWPLTSLAADSSKKKSSAAIYQNAIFMALGCYLSIQSLWIKQMAILIGTTIISLVIYFKKQ

SEQ ID NO: 36146 - protein, 241 aa, Sorghum bicolor
  Clone ID: SORBI-28MAY03-C83425_1.pep
GEICSKLRWAQRFHIIKGVASGLLYLHERWEKVVVHRDIKASNVLLDADMNAQLGDFGLARLYDHGTDSQTTHVVGTVGYLSPELLRTGKASPLTDVFAFGIFLMELTCGQKPIKENEQGGGGGGGGHVMLVDWVLQHWRNGSLVATVDAGLRGEYDVGEAELVLKLGILCSHPFANARPGMGQVMRYLDGVTPLPELTPTDSSFDVLAMMMQGEDFGMSSFSHPDTVASFGTISNLSGGR

SEQ ID NO: 36147 - protein, 225 aa, Sorghum bicolor
  Clone ID: SORBI-28MAY03-C83437_1.pep
MGKYSDGGKDSGEAGGAAGYPLVAVCIDKDKNSQNALKYATETLAHKGQTIVLVHVNTKGTSGEHHPSSPCHDDVAGYKQPTDPQMKDLFLPFRCFCTRKDIQCKDVVLDDHDVAKSVVEFAAHAAIEKLVVGATTRSSFVRFKAEICSSISKAAPDFCTVYVVSKGGKVTSVRQAVRQAPAVSPLRTIIQGPKPEPVHAQKWTPPPPSSGTPMLQENHIMYVSY

SEQ ID NO: 36148 - protein, 168 aa, Sorghum bicolor
  Clone ID: SORBI-28MAY03-C8344_1.pep
TRLTQIQARSIPHLLPTRPVMGAAKTGSGKTLAFLIPAIELLYHLRFSSRNGTGVIVVCPTRELAIQTHNVAKELMKYHSQTLGYVIGGNNRRSEADQLAKGVNLLVATPGRLLDHLQNTKSFIYKRLKCLVIDEADRILEQNFEEDMKQIFKRLPQNRQTVLFSATQ

SEQ ID NO: 36149 - protein, 215 aa, Sorghum bicolor
  Clone ID: SORBI-28MAY03-C83448_1.pep
ISFFSPLNPRAARSKHAHPPTSPRRCLPVSGVPPPAKLQSRRLCAHDLCHSRTLGNGDGVATGCGRYGSGVPGPYGAPLLDSEQSLRPSRSTRTRRHGLGAGGAHLLVGGWFLDRQGGCGRCTPTLPAPSICTARTYCCSVVSCLLMSATAGCYSCAAHADSAGRRCLSMASQWQELEHQAPCPFPSPTRHFYYFVYRFLSYYASVHKFLCMAKL

SEQ ID NO: 36150 - protein, 109 aa, Sorghum bicolor
  Clone ID: LIB3476-047-P1-K1-C2.pep
EIAAEFTYATAYSAAANFVAVNTDAIFTAVHDANVIWPSAWADHHSTNSVHGDAVSYTERYSDKPLSNLSSLTSAGQAHKQTFLAPQTQSIAVNTPGISASPLLAEFTS

SEQ ID NO: 36151 - protein, 120 aa, Sorghum bicolor
  Clone ID: SORBI-28MAY03-C83071_1.pep
FPPNTTTDMDLITPAVLDNKYYVGLTNNLGLFTSDQALLTNATLKKSVDEFVKSDSKWKSKFAKSMVKMGNIEVLTGTQGEIRLSCRVINNGAGSSSSSAGLFELQMTTDNSAQEESAAN

SEQ ID NO: 36152 - protein, 71 aa, Sorghum bicolor
  Clone ID: SORBI-28MAY03-C83099_1.pep
GVVNVFQGFEVMGLGASYWKLGYCLALATLMGACVALEVNAWVVFCRKQQEEKLMRREVEDVVVKDRAAAF

SEQ ID NO: 36153 - protein, 133 aa, Sorghum bicolor
  Clone ID: SORBI-28MAY03-C8314_1.pep
MSDHQRIHPVDLEAGSNRPTAPLVPGGSSFRSDKGDPAATRSANHHQQQRAYVPGGPLPPPPRRVAPAAPLPPPPSRKRRGRGCCCRLLCCVVITAVVLAVLAAAAVGALYLALDPKAPRYSVDRLSVSAFQV

SEQ ID NO: 36154 - protein, 66 aa, Sorghum bicolor
  Clone ID: SORBI-28MAY03-C83151_1.pep
MASGEKKKTTTILVARKGRLRQRYDGEYRLVAGCVPYRVGADGQPQLLMVSTPNRDDLVFPKGGWE

SEQ ID NO: 36155 - protein, 94 aa, Sorghum bicolor
  Clone ID: SORBI-28MAY03-C83557_1.pep
MQGEEDVRAAGAAGDGALQAQRRAVVNHQLERGRGGEEGKSVKLFGVLLKDAAARKRGPCEEAVASERPIKMIRVGEPWVGVPSSGPGRCGGEN

SEQ ID NO: 36156 - protein, 232 aa, Sorghum bicolor
  Clone ID: SORBI-28MAY03-C8356_1.pep
QRSKVYKKNIPGHNMDTRATKKLRTETTGRTSVPLSKYHANSSNCSEANLSGHNNKGKGISIDILDSDQIGEADLRGVDLSTAGTCVNKNSSDINTEQGWTTTHNHIPKLPISFMGNTTTSSRREPGSSTRSNQNHGSAGGNHTSVSGATMMVPDRLGNKTIMNHKGWRKETSTSCHTGESSSAVDEPRGSLQSSKISAGRNHTSHQHNIPVITIDDISPEARPSSSGFTNG

SEQ ID NO: 36157 - protein, 147 aa, Sorghum bicolor
  Clone ID: SORBI-28MAY03-C8358_1.pep
ARGRKRNIPSIPMTPSQNPCKRRHPTPPPPSAASPAAPVALSLPGFVADRAEAAVRVERLLRYQFCDRALLEEALTHQSFSDGAFSYQRLEFVGDAALGLAFSNFLYLTNPTLGPGALSTLRAANISTEKLARVAVRHDLYPLLRRK

SEQ ID NO: 36158 - protein, 173 aa, Sorghum bicolor
  Clone ID: SORBI-28MAY03-C83647_1.pep
MGMESKKPYVIAIVVQLIYTGMFVVSKAAFNHGMNTYVFIFYRQAAASLLLLPIALVLERKNVTTLSPWLLLRLFFLALIGITFSLNLYNVSLKFTSATVASAATNAMPVVTFCFALLLKMEAVKLRSSSGLAKLAGVSLCLAGVFTIAFYVGPALSPVNRHRAFAASASPAP

SEQ ID NO: 36159 - protein, 143 aa, Sorghum bicolor
  Clone ID: SORBI-28MAY03-C83653_1.pep
RRQPLGPPEEVVEQGGDGAQQLDIGVVHVGEHVALVNGQHLELGAHPAVAHRILLHLGLVVPHGDPTDQSSRLPAAYKNHFLFLPLLTAEEPSHSSNRWGESRWGAASEWAGTEASRSGVAITSYRLQQGVGSEKVYIDDTKW

SEQ ID NO: 36160 - protein, 154 aa, Sorghum bicolor
  Clone ID: SORBI-28MAY03-C8367_1.pep
IPVTIGCGHEFCTKCALYLCSTTSSSTSIRGVPGSISCPLCRHAIVSFMRLTSTTPIKELPWTSASLALCAAGASTGPDHGRSLQRRSDMRRLRSSSVQLGCSSFRSIGSGKLSSIKLNCTGAEEAVPCLVSCLRPDVQRSSSYRERIRRYSEF

SEQ ID NO: 36161 - protein, 130 aa, Sorghum bicolor
  Clone ID: SORBI-28MAY03-C83246_1.pep
KRLTGNLIPKWVNRLARMGAVCNCILPVPLKISAARHDPGCQAEDSERKMLTGSFSCFSSISLCQRHFSTSSLSLRSPTKGTSWDANQSNSTRLKKSCQLRSLVLSYLANEAQGSIFFSSICSTTVFREG

SEQ ID NO: 36162 - protein, 193 aa, Sorghum bicolor
  Clone ID: SORBI-28MAY03-C83278_1.pep
MSAVNITNVAVLDNPTAFLNPFQFEISYECLVPLDDDLEWKLIYVGSAEDENYDQQLESVLVGPVNVGTYRFVLQADPPDPSKIREEDIIGVTVLLLTCSYMGQEFMRVGYYVNNDYDDEQLREEPPAKVLIDRVQRNILADKPRVTKFPINFHPEPSTGTGQQQQEPQAASPENHTGNGHGNGDGSKPEADQ

SEQ ID NO: 36163 - protein, 157 aa, Sorghum bicolor
  Clone ID: SORBI-28MAY03-C8328_1.pep
NGETTLQHCALKAAHRLCQVSEETKKAMGDAGFMPELVSILGASKSHEAREMAAESLCALVSVHRNRKRFVQEDRDVARVLQLLGPDEEKPTPAKRFLLSTVMHLTDSSSGRRKIMSSEHVRNLEKLAETDVPDAKRIVKRLGGSRLRSIFHGIWSL

SEQ ID NO: 36164 - protein, 144 aa, Sorghum bicolor
  Clone ID: SORBI-28MAY03-C83335_1.pep
MKQVWGRSSKDMTAMPPLRHRGAAKKPMWIIVLLSLVCVALMGAYVYPPRRYSACYFFASSVCTPFKDWLPAVARERTDEEIVSSVVIRDLLSMPMAVSKNPKIAFMFLTPGTLPFEKLWEKFLQVWSLTLIYPSSNFGVHKYE

SEQ ID NO: 36165 - protein, 161 aa, Sorghum bicolor
  Clone ID: SORBI-28MAY03-C83154_1.pep
MKKGSMMALLVPLAVAPLLSGPSSLATAASGGGGPVEWGKLGPHFYDQSCPHAQHILASIVGKAHYQDPRMAASLLRLHFHDCFVKGCDASLLLDSSGSIVSEKRSNPNKDSPCACVRLRLFNPARDAPPPGTLAAADALALAARDSTVMTGGPGWIVPLG

SEQ ID NO: 36166 - protein, 198 aa, Sorghum bicolor
  Clone ID: SORBI-28MAY03-C83918_1.pep
HEDPHDVSGKDDHMHIMNLTDIRVRLLNGVQAAYWGMLEEGRITQATANILMRSVDEAMDLVSEQKLCDWKGLKSNVQFPNYYRFLQMSRLPRKLVTYFTVERLESGCYICAAFLRAHRIARRQLHDFLGDSEVARTVIDESNAEGEEAREFLEDVRVTFPQVLRVLKTRQVTYSVLTHLSEYIRNLQKTGLLEEKEM

SEQ ID NO: 36167 - protein, 145 aa, Sorghum bicolor
  Clone ID: SORBI-28MAY03-C83921_1.pep
MNKDKAPMPGDGGPSDGLPPQSTRRAGAPPSSSTPPPEYDISRMPDFPTRSTGHRRAHSEILGLPDDLDLSAPGGGDGPSLSDENDEELFSMFLDVDKLNSSCGASSEAEAESSSAAGGGGEGAELGHAPRPRHQHSQSMDESMS

SEQ ID NO: 36168 - protein, 173 aa, Sorghum bicolor
  Clone ID: SORBI-28MAY03-C83943_1.pep
MASLRTLPLPVLVPLVVSALVFLGTVLRRLLRRQRPVYLLNYSCHLPDAERQVNLEVCEYFGLKCRRYSDDIADFMRLVYSKSGLGQETFAPPFIYSGKFEKTLAFAIQEAEEGLFAVVEQLLSKSDVSPGDISVLVVACSMFSPMPSLASMIVRRFKMRPDVKSYSVAGMGC

SEQ ID NO: 36169 - protein, 189 aa, Sorghum bicolor
  Clone ID: SORBI-28MAY03-C83951_1.pep
MSAPAPAPSAGGAGTMSRDAFRVAVTNTLERRLFFVPSFKIYGGVAGLYDYGPPGCAVKANVLAFWRQHSGGEERVPQVDCPCVTPEVVLKASGHVDKFTDLMVKDEKTGNCYRADHLLKDFCKDKLEKDHTLSPEMVQEYNRVLAILDDLSAEQLGAKIKEYGIVAPDTKNPLSDPYPFNLMFQTSIG

SEQ ID NO: 36170 - protein, 154 aa, Sorghum bicolor
  Clone ID: SORBI-28MAY03-C83965_1.pep
CNIVFRPSVCHPCHPTSHVILSHDTTIPHRFDSHPSPYLLLFRKRTGFSPAPSRCRHPHSTSCIPLLRSTTVVDQALRSSPNRRGELLNKALLCFSLPCSMAVWAAWCCSPLDRAEVEVEVRTQVTANHRDHMRWVGRLRRTWAPLLSSCAAPA

SEQ ID NO: 36171 - protein, 250 aa, Sorghum bicolor
  Clone ID: SORBI-28MAY03-C83480_1.pep
MALRPATIRLSPAAAGVISRPTTRRGAASALRLVPDGSCRRARKLRLCCAPEDDEWWATPVRPEDLVEPTGHGAEEVIAIRDALVGDPLRPVSLAFQEIVATGGNIFRCRCFHAGVMSGTLLLVAGICQLYKVAPNLFMDIVLAYMFYKLSVLAAELKRNGKANNICARIQCVLMAILFYKYNNPTKDSYYHFTEFIWGITILVYSCTVYYECIGLKHPRHHLEAMFKTILTTKGGLIKVLKRLYWELIN

SEQ ID NO: 36172 - protein, 195 aa, Sorghum bicolor
  unsure (1)..(195): unsure at all Xaa locations
  Clone ID: SORBI-28MAY03-C83501_1.pep
MEEAGVAVVASSKQSGGGVRGGGGPAPFLTETHHMVEERATDEVISWAEQGRSFVVWKPVELARDLLPLHFKHCNFSSFVRQLNTYGFRKVVPDRWEFANDNFRRGEQGLLSGIRRRKPTTPQSSNKSGGSGGVNVAFPPPLPPPPAPPASGTRSGXGGNERSSSSASSPPRADQLTSENEQLKKDNHTLSTELA

SEQ ID NO: 36173 - protein, 108 aa, Sorghum bicolor
  Clone ID: SORBI-28MAY03-C83534_1.pep
STKDFLESGLVQLDKSMEERVKAAASRGNVLRYVAEIESTGCQVGLKELPKDSALGRLRGSDNVVEIYSRCYQSSPLVIQGAGAGNDTTAAGVLADIIDLQDLFQTTA

SEQ ID NO: 36174 - protein, 171 aa, Sorghum bicolor
  Clone ID: SORBI-28MAY03-C83502_1.pep
MPTPVKSVLPVVLLGCGGVGRYLLRHIVSCRPLHANQGVAIPVVGVADSSSLLVAEDVHSNGLDDALLTQLCAAKSAGSPLSSLLAQGHCQLFKNPEARGKVIDAATTLGRTTGLVLVDCSATYDTVSLLNDAVGHGCCIVLANKKPLTGAYEDFQKLVSNFRRIRFESTV

SEQ ID NO: 36175 - protein, 169 aa, Sorghum bicolor
  Clone ID: SORBI-28MAY03-C84108_1.pep
PTGNASNSGQATQSATSPTPVSPIQKRNKRICSKKSLVWKYFSTGFRGQDPIATCNHCGQIYSCDQSTHGTSTLWYHLRNLCPEDPLKGPYSSQRQNRRLQGDGVGMQDRRAHDEGRRSRKPCHPRSWLHAVQLNRMHACIARNCRMSNSAACRAHHGLIEGRGPRRAM

SEQ ID NO: 36176 - protein, 138 aa, Sorghum bicolor
  Clone ID: SORBI-28MAY03-C84131_1.pep
DVRLLENLRHIRTVGAWPVATVWEQEKRVAVEGPVVCTTAGTGTGTGTAAAWFSSSGSVSPTPPVLTDDSVHGFAFASDLLWDPARWDRFPTSEPDQSQDSIKFVQRLVVADYNKTRPIPDYSNCSQIMVWRVDTTLL

SEQ ID NO: 36177 - protein, 250 aa, Sorghum bicolor
  Clone ID: SORBI-28MAY03-C84147_1.pep
MSVFGGDSWARDAQQRKRRLDDLLLPSTASSSPSTPDSFRKLPNGKLACLVCPHRPVLDTPLMLSMHNKGARHIAAESRLREKELSKKHEINKRLALSSDASHSNSGNLRTGIRPTNIKEKPLIEETRRAILEAQSSRFNDFKGKKASHDSKWTANTSSFDSNVAPSDVPMELSTGNAGSREWNCKGETSAGNQTQDKLFSDRQTEVRKRQELELRFTASGWKRDGHGRWYRDENVEFDSDEDDPNICLS

SEQ ID NO: 36178 - protein, 198 aa, Sorghum bicolor
  Clone ID: SORBI-28MAY03-C84176_1.pep
LIIYTSIVVWFVGGLTVFHLYLIGTNQTTYENFRYHYDKKDNPYRKSIAANFAEVFFTKIPPPMNNFRSWVGEGALEAGFYTPYIGLDVTIPREKIDLDMESKEVLVGGMQIPTVLQNIDYGSFEEGSDDKNRNAGKKSVHFPTAWAQGNGNAGTSAGAATAPPGQAGEVEVTVVGGPRTSTTLASADAFPHPPGRVV

SEQ ID NO: 36179 - protein, 184 aa, Sorghum bicolor
  unsure (1)..(184): unsure at all Xaa locations
  Clone ID: SORBI-28MAY03-C842_1.pep
MGDYTIHISTKLIDQLAGDDEKVKRKARXPKPKKKPIVQPHEEPPEFPSEPKTSSPAPAPAPGWPLQPPPMFLPVTPAPPPPPATMPEVEAIRSILKESESVLEKLEKQEAGARQELSKRAKELHDKEFKLPYQNPMPCTQERAGCLECYKANAKDPLKCAEAVKRFEACALMAVKAAAAATAD

SEQ ID NO: 36180 - protein, 95 aa, Sorghum bicolor
  Clone ID: SORBI-28MAY03-C83712_1.pep
PLESAGAAFPFCDQGDLFQNFGSGAMEDQCSLSLLDTALPHTANPQFAFQKQQRDFWEDGLQNALPTGSEQRQEDGLLVPNFDGQLQADQAKIEF

SEQ ID NO: 36181 - protein, 76 aa, Sorghum bicolor
  Clone ID: SORBI-28MAY03-C8372_1.pep
KSIQLSQYSNSNLDSSNRFAIMFASMLHGFFFSSIEGLNTYNVNTNNNNIAHIFEKVVTVFNCRVFLTLHKASCKG

SEQ ID NO: 36182 - protein, 165 aa, Sorghum bicolor
  Clone ID: SORBI-28MAY03-C83774_1.pep
DAIARGPPAPKTSTRCQPGHPLRLPSPAGAQIRRPAPHPAATTTRRPGARQAPFPPFPPCRVWSPTRAPGWASWPSPRSSPCPSASRRSGSSRAASPRRCTSATSSPRPSPRSASSPLSSPRTTSRSPRSPPRRSSSSTPSRPSCRSPRRCRSRSSTSSSPRPSR

SEQ ID NO: 36183 - protein, 142 aa, Sorghum bicolor
  Clone ID: SORBI-28MAY03-C83807_1.pep
TGPRARPPPSHSRTHSSSQKSSGQARQGEQSTRAAATQHITIHERSPAYSRQQPAMNLNRLTPAHHGAMRPPSVQGQGLARYGSAPGSLLAAIAESVTRGDPAPPPPPVSRSYSAESSGLTSCESSCRTDGGGGGRPPPLER

SEQ ID NO: 36184 - protein, 139 aa, Sorghum bicolor
  Clone ID: SORBI-28MAY03-C83866_1.pep
AGKTEDEQLNVFRFPPLVAPIKCTVFPLVKLEKFEVVAKKISKALTAAGISHIIDMTGNTIGKRYARTDEIGVPLAITVDNTISVTVRDRDSKDQIRVEVDEVASVVKEVTDGQSTWADIMWRYPAHTTSAADEEDAEP

SEQ ID NO: 36185 - protein, 151 aa, Sorghum bicolor
  Clone ID: SORBI-28MAY03-C84330_1.pep
TRKLSERADPRNRQLLQKRQFFHSHRAQPMALEQVFSDRDSEDEVDDDIADFEDRRMLDDFVDVTKDEKLIMHMWNSFVRKQRVLADGHIPWACEAFSQLHGRQLVQNPAQLWGWRFFMIKLWNPNILDARTMNTCNTVLQSFQEESTGLK

SEQ ID NO: 36186 - protein, 218 aa, Sorghum bicolor
  Clone ID: SORBI-28MAY03-C84418_1.pep
TPLATHPGIPPVSPVEAAAAAAATRSPTPHTTGRATATATAGAALTAVDLGPPGWLPWTRASRRQRRRPAFGGGGGLLPARGHHRRAHSETFIRLPDDDLLLDADADFGFSDIDFPSLSDDSPAASDPTPQPQPQAPPPQQPMPQQQAASSAPPRPPSGAHMRSLSLDAAFFDGLSLQGGGGGGGRGGAQEERVHGRVHLVVRGRVRADVVRAAGLRQ

SEQ ID NO: 36187 - protein, 162 aa, Sorghum bicolor
  unsure (1)..(162): unsure at all Xaa locations
  Clone ID: SORBI-28MAY03-C8443_1.pep
HEAKRRSQLPEPIEKEKGVSLWSMIKDNVGKDLTRVCLPVYFNEPLSSLQKCFEELEYSYLLDRAYECGLRGNGLMRILYVAAFAVSGYASTDSRPCKPFNPLLGETYEADYPEKGIRFFSEKVSHHPMVVACHCEGKGWKFWXDSNLKSKFWGQSIQLDPN

SEQ ID NO: 36188 - protein, 241 aa, Sorghum bicolor
  Clone ID: SORBI-28MAY03-C84443_1.pep
MKAIGNGGEWWWNLPSLRRKSDSRRRGRRNTDPRGRRRGPPREPLSSSSSSSESIEQGRGWPIEFPFRQAVTAASLTFTGDTIAQVRSRIVDRRRCCADSDTKELIPDILLNHDWIRALRMASYGFLLYGPGSYAWYQLLDRCMPKQTFVNLSAKVILNQIVLGPCVIAVIFAWNNLWLGKLSELPAKYQNDALPTLLYGFKFWIPVSIVNFWVIPLPARVAFMSSCSIFWNFYLSTTMSK

SEQ ID NO: 36189 - protein, 346 aa, Sorghum bicolor
  Clone ID: SORBI-28MAY03-C84452_1.pep
MAGEEAGRRGVPSLLNPPSASSEGQQEHIASDVTQLIGWTPLIELKRIADKEGVDARIVGKVEAYQPLCSVKDRSALRMIEDAEERGLISPGVTTLVELTSGNLGLGLVLIALRKGYRFVAVMPGQYSLDKQILLRYMGAELYLTDPALGFPGIDAKVEELKKELPNVHVLDQFKNKANPEAHIRWTGPEIWKDTAGKVDIFVAGSGSGGTVSGVGKYLKTQNPSIKIICVEPAESPVVSGGEPGKHKIQGIGPGFLPEVLDTTVIDEAVTVTTDEAMVHARRLAREEGLLVGISSGANLAACLKVASREENKGKMIVTMFPSGGERYMNSDLFAAAREECIAMTF

SEQ ID NO: 36190 - protein, 112 aa, Sorghum bicolor
  Clone ID: SORBI-28MAY03-C83996_1.pep
HYVVYWELMVRDGGASPEPDVFERCCLEMEEALNAVYRQGRNGDAIGPLEIRVVRGGTFEEVMDYAISRGASINQYKAPRCVSFGPIIELLNSRVVSRHFSPACPTYSPHKK

SEQ ID NO: 36191 - protein, 53 aa, Sorghum bicolor
  unsure (1)..(53): unsure at all Xaa locations
  Clone ID: SORBI-28MAY03-C840_1.pep
RTISTVLESLAWINKATKQATCSYFPQNSYMQSHVQVCXLIPSXXXXXCGPAA

SEQ ID NO: 36192 - protein, 105 aa, Sorghum bicolor
  Clone ID: SORBI-28MAY03-C84033_1.pep
QVNGELDTQNFMKFPDLNPAPARASSGASRKMMLTSKDLSFVGYTYKNFDAVKGLHQSADLQRSSSFTRHSTGSPSDTADMDSSMEPNGTDTHMRTGSCGDPMAP

SEQ ID NO: 36193 - protein, 201 aa, Sorghum bicolor
  unsure (1)..(201): unsure at all Xaa locations
  Clone ID: SORBI-28MAY03-C84046_1.pep
MDADLVQRCPEAGGRDFLLHHTSSPPSPSSGSAAASSSILQSLPLHVSFDRGYYLLVKAIQELRARKDGHVVTVGIGGPTGSGKTSLAEKVASVLGCVVIVSMEDYRTVAGGDDGSSDVDAIDFDSLARNLQDLVKGKDTMVPLVDFQEKKHTGWRQLRISSSGVVIVDGAYALHSTLRSLLDIRVAXVGGVHFSLLSKVQ

SEQ ID NO: 36194 - protein, 75 aa, Sorghum bicolor
  Clone ID: SORBI-28MAY03-C84058_1.pep
IPYFCAGQMYFARCSCWLAIASTFLLQSVCAFACPPCHVFACSSLFMISTQVFACSVNFRTKRFTSILTEWFLNC

SEQ ID NO: 36195 - protein, 193 aa, Sorghum bicolor
  Clone ID: SORBI-28MAY03-C84054_1.pep
MASLARALRQSNSRLSSRCPAVAASCRWISPTAAAGSPEAGAAVAPADPELPPPREPVGGARVELPPNPEDALEVFVDGHAVRIPKGFTVLQACEVAGVDIPRFCYHSRLSIAGNCRMCLVEVEKSPKPVASCAMPALPGMKIKTNTPVAKKAREGVMEFLLMNHPLDCPICDQGGECDLQDQSMAFGADRGR

SEQ ID NO: 36196 - protein, 261 aa, Sorghum bicolor
  unsure (1)..(261): unsure at all Xaa locations
  Clone ID: SORBI-28MAY03-C84612_1.pep
LLLVSLTFIIQGCSSSSCRCAVSLPPPGARPAKPLGLVLPAGDALPAPNPGPPPPAPAAPGPHPPAPPPAGAPPAPGAPAAPRPAAAGTERRARPQKEKALNCPRCNSTNTKFCYYNNYSLQQPRYFCKTCRRYWTEGGSLRNVPVGGGSRKNKRSSSSASASASTSASVTSSSMASAEGAAASKNPKLAHEGAHDLNLAFPHHGGLHAPEFAAFPSLESSNVCNPGGGMTSNGRGGGAGPXVGALSAMELLRSSGCYMPL

SEQ ID NO: 36197 - protein, 224 aa, Sorghum bicolor
  unsure (1)..(224): unsure at all Xaa locations
  Clone ID: SORBI-28MAY03-C84614_1.pep
LPASASAPPPPPPGLRPASGPRSSSPPSPGPAPRPAPSLXPSPAPRAPAPPRTCPPRARRARAAPASASPAASPPPPPPPPAPRPRPPTASASAAAPPPPPPPSPXPPRVPGAAPRPKVRLRGGAAAPPGGLPAGGARPPPXPPPAPPRPRRARGAAAPGPRRGRPPARPPPRAPPXPAPPPGRPPRPAPRSRARARPPAPPAPPSAPRSTSPASPSPTPSPPS

SEQ ID NO: 36198 - protein, 157 aa, Sorghum bicolor
  Clone ID: SORBI-28MAY03-C84649_1.pep
MGSQMKRTIFDEQTAKALKKWHKAVVKKKHHNKGSSHDSSETPSTDTATPAREAGEWQRLHDVPVRHLHRYKTIAHVGGARSPLSDSDYSDTDDTEPLSSSQTRHLIPPAKQRSLDTERAEVRVDVVETVAAVAPRDVLQDSFSFPRLLPPRHVPDK

SEQ ID NO: 36199 - protein, 80 aa, Sorghum bicolor
  Clone ID: SORBI-28MAY03-C84672_1.pep
CACLQVMAVLARPAKETKARRYWNWYHHSVGRAAVVLGVANVFYGLSLANERQEWSYVYGVFIGVFAVVCLVLEEWRRRH

SEQ ID NO: 36200 - protein, 157 aa, Sorghum bicolor
  Clone ID: SORBI-28MAY03-C84701_1.pep
TFPANIRRRVRPPLPDRYFGNALVRLGVTGAVRDVASEDLASVAGRIKGAIDRMDDELVRSAVDYWEMTELDSRPAKGTLLETDLQIISWLGMPMYDADFGWGKPGVMSRAESIRGGFVYLMSDGPADDAGAGGVRVLMCMEAANINELERLLYEKL

SEQ ID NO: 36201 - protein, 219 aa, Sorghum bicolor
  Clone ID: SORBI-28MAY03-C84232_1.pep
SSLLHQSPLNKPFFLRSNSFSQFHSLSPLLQPASAYSSSWVVVRLGTVPSPTSLVNVASTSTSKTSKMMSFRSTTHDGFVGHAAVNGAGAPVPWWAGAPMLCGEPLGLGRPVVAAFSPEDHCRDGRFQVLQGPPLDPLVPSLKAPVAHQQQTEKGLSAELLNLSVAHQGKGKKGSEHSATVALQSPFAIYNGRFELGLGQSMISADNSYADQHYGLISP

SEQ ID NO: 36202 - protein, 205 aa, Sorghum bicolor
  Clone ID: SORBI-28MAY03-C84237_1.pep
SGHQFLLSSAVRTLDPEEADWFYTPVYTTCDLTPQGFPLPFRAPRIMRGAIRYVATTWPFWNRTDGADHFFLTPHDFGACFHYQEERAMERGILPLLRRATLVQTFGQRNHVCLQDGSITVPPYADPHKMQAHLISPGTPRSIFVYFRGLFYDMGNDPEGGYYARGARASVWENFKDNPLFDISTEHPYTYYEDMQRAIFCLCPL

SEQ ID NO: 36203 - protein, 148 aa, Sorghum bicolor
  Clone ID: SORBI-28MAY03-C8425_1.pep
MGAAAAEVVAPPRPTSAKRRSTTLKFLFELEKPDGVVPGTAKLPPPSPEPEADSLIDKIASCNRVFTFADDAADECEEERDAKRERLVEVLGAVRSSGSAGNKQQQQQQPLDHRVMVALLKMVGANLFRAMPPSAYPALLPPDGVDEE

SEQ ID NO: 36204 - protein, 181 aa, Sorghum bicolor
  Clone ID: SORBI-28MAY03-C84283_1.pep
MPQQEQEQEQEQHQHQHQHQLPGLESVIVMKPSEPPEDEQPQEQEAKPRRIYQAWKGNNIFLCGGRLMFGPDAPSLLLTTFLIVAPTIIFCYQKKSRFYGSGEQQQLHQAAALVVTITTIMDLVFLSMTSARDPGIVPRNSRVPPEADEFLGSNTPSVDWSGGRTPRMRFRRTKDVIINGF

SEQ ID NO: 36205 - protein, 200 aa, Sorghum bicolor
  Clone ID: SORBI-28MAY03-C8432_1.pep
DAWAKAENMIAHKDEIYSRPKRTWFATEREKKLLAAAAKESLDQGKSTSGVISAKQAEDLRLKEKKRREHEKNLPRKKRRRLEAQREMLEDEDEDDEEAKENDRGKKPKKGQSLVDAAYRKAKSLKAASKRGPGAGKGKNEKNARQHSEKTPSRHEEMRELFENDMSEWKQGRSSKKNNNFAHKKSKNAFKSKARYKRRK

SEQ ID NO: 36206 - protein, 126 aa, Sorghum bicolor
  Clone ID: SORBI-28MAY03-C84971_1.pep
MAVERDVFGISGPTYLKPIDWNCEHNRRSVAASLVQAVYVLERDRQLSRLSVEALAPAWWEFFHFELIRKLIDDADMSIFGAIFEFNPPSSEEASVANAPRFVIAFRVHWVLPAPEEHGRSWCWIY

SEQ ID NO: 36207 - protein, 144 aa, Sorghum bicolor
  Clone ID: SORBI-28MAY03-C84975_1.pep
LGVSPQPLLVLQLASASTSSARSQGPAPAPAGEGSASSAHDVPSTRLAWIGIGSTSTSSSAASPAGRLRRRSMGYFLDSDPMLRRDRAIEPAAPVSRRRTTSCCSDRIPTCRPLRSGTRRRRPAAYICVRHSNGFSCGYDGDDY

SEQ ID NO: 36208 - protein, 195 aa, Sorghum bicolor
  unsure (1)..(195): unsure at all Xaa locations
  Clone ID: SORBI-28MAY03-C85006_1.pep
RIKQAHAHPGAPEGAEHEHQQQVRAAAVCATSEQEFSHLQAAVQEHQSSSTGSRATGGGGEEEAGEAEVQERRGCFFGRHRERHPSQDQDPPEARRRWVRWRGHRRRLRRAGGGAQASEDAGEEEEPEAVQQPHRGDGGQARQDEEEPGSRLWLGHLSXVISKYCXSRCRRSSRPYVLLHVIEPVCLRNFWLLSE

SEQ ID NO: 36209 - protein, 157 aa, Sorghum bicolor
  Clone ID: SORBI-28MAY03-C85030_1.pep
FLTESSKDLDSTAWSGPEMEVQMAAQGPKPTGRGSTPSPSDSHHGGGATAKPVPGYLRPSAGSCHHVCKYGGTHTFEDHKEAHSRPQQPRPPRKQPPPPAPAPAPAESHNHSRVLVKVRSVFRRRVGDSTTTATTQKPSKAAAAGKAKAGKEGVSVE

SEQ ID NO: 36210 - protein, 192 aa, Sorghum bicolor
  Clone ID: SORBI-28MAY03-C85041_1.pep
MSHHDGSKPYQPRRGPERHPQPADGMAAPPPAAVGPSVEHLVAAAAEAEALNRFAVEPQVHEQEVGEEEEEDEEEDEMEEEEDEQEGQHGGIGGEHVPMDADAAAAAAAAAGAQMDPHSAMVPGTVPPMATNQLTLSFQGEVYVFDSVSPDKVQAVLLLLGGRELSSLGGASSSAPYSKRLNFPHRVASLMR

SEQ ID NO: 36211 - protein, 242 aa, Sorghum bicolor
  unsure (1)..(242): unsure at all Xaa locations
  Clone ID: SORBI-28MAY03-C8447_1.pep
ARGSSPWSPLWTNIHDHLITPVVNLPLPAKVSDLWVQGTKTWDHQLLSTTFSHQAVQIIEETTVVLSDHEDILRWTPTTDGRCTTRSAYRYLATQEPHILPTQGPRSINSEANNILHKVWKSKTIPPLLKTFAWRLIRRALATGERAGRYSPHIDQHCSYPRVRENDIHLFFHCDLXKQVWSTATPPMPTNIIVADEDGVQQALPLLITNNPSDTTLRKTLFTLWYIWKACNDNRFQRKTWT

SEQ ID NO: 36212 - protein, 108 aa, Sorghum bicolor
  Clone ID: SORBI-28MAY03-C84478_1.pep
PPPARPRPRPRARSPHVVPLLPRCRRRRSARCWSTRRRHRRPGGPRPRCRDWNELGCMRVVCTRSRQSFHLWCSVMIDAMRRVMCASGQWQCHCICMSTRPHVLVPNL

SEQ ID NO: 36213 - protein, 174 aa, Sorghum bicolor
  Clone ID: SORBI-28MAY03-C84492_1.pep
GVDDNGTGEPAADLNGSKSKQLPRVAMYCTGGIRCEKASSFLLGKGFKEVYHLEGGILKYLEEIPKAESLWEGECFVFDKRVSVEYGLAQGTHKLCYGCKQPVSNEDMESPQWEYGVSCPYCFATKSEEEKERARARQHQFKTWGVIGGPDKGRSTKRPDANNAMESIQLPKSV

SEQ ID NO: 36214 - protein, 190 aa, Sorghum bicolor
  unsure (1)..(190): unsure at all Xaa locations
  Clone ID: SORBI-28MAY03-C8450_1.pep
HEGSAAVAAAIDLYTRSSLLLRPTGEGGGADFGAVELYLRDSRLTFSWPCSRLRGALGEEIGANPGAPAPCSPDQLAAIAWLLEDQEIPEAKIWLSAGLSAFLFLYTSILGCRPGKAEVTSDLPMGAGLGSSAAFCVSMSGXLWTAAGAVSVGASRGAEGWEVLEKADLELVNQWAFQGEKIIHGKPSGI

SEQ ID NO: 36215 - protein, 247 aa, Sorghum bicolor
  Clone ID: SORBI-28MAY03-C8459_1.pep
MLGLRARAAAQLPRPSPSSSSAPAASLSLARLVCASPLAALAPLASAPPSARATQPAFLSARWTAAPMRPGGTGGHSRPTTRVLCTATGSVQREGKELLVQHLLVGEKDVRLLVDLEKSIIAGGADLSDLAVEHSLCPSKENGGMLGWVRKGQMVPEFEEAAFSAPLNKVVRCKTKFGWHLLQVLAERDQCVLQDIDPEELHTKMQDPSFLEEAQLIDVREPDEVEKASLPGFKVLPLRQFGTWGPL

SEQ ID NO: 36216 - protein, 187 aa, Sorghum bicolor
  Clone ID: SORBI-28MAY03-C84578_1.pep
MGGDGDGTRALDQTPTWAVAAVCAVIVAASILLEGLLHHLGQLLNKKRKIALFDALEKVKSELMTLGFISLLLTVTGRYIAHICIPEGAANTMLPCRRQSGHSEAEEPEDHGRRHLSEDPTNLFSCPKGMVSLVSADGMHQLHIFVFFLAVFHVTFSFFTMSLGRAKTRIWKVWEKETCSPEYNYLN

SEQ ID NO: 36217 - protein, 152 aa, Sorghum bicolor
  Clone ID: SORBI-28MAY03-C85154_1.pep
RGPETSKLPKSFVSKVKENEERGLIVAWCPQLEVLAHPAVGCFVTHCGWNSTMEGLGIGVPMVAMPQWSDQPMNAKYIEDVWRVGVRARPDMEGVIRKDEVERCVRQVMDGEKSKEYMENAMNWREKAKRAMSEGGSSDRNIIEFLGKFGWN

SEQ ID NO: 36218 - protein, 205 aa, Sorghum bicolor
  Clone ID: SORBI-28MAY03-C85190_1.pep
MAGSNNVSVRVLLVSYPAQGHINPLFQLGKRLAIHHGVRCTLAVARSALGSSVPPGPGAVPVVAISDGCDLGGYDEVGDVHEYLARLQSAGSRTLDELLGSESSHGRPVRVVVYDAFLLWVPRVARQHGASCAAFFTQACSVNVVYDHAWRGDVKLPVDKVLAELPGLPKGLQLEPRDCSSFLTQQDDSSSTSTYLDLLLQQCQG

SEQ ID NO: 36219 - protein, 110 aa, Sorghum bicolor
  Clone ID: SORBI-28MAY03-C85160_1.pep
ELASYDQVKQTILKLPGFKDDVVIHLFAGLGAGFFAVCVGSPVDVVKSRMMGDSAYKSTLDCFVKTLKNDGPLAFYKGFLPNFARLGSWNVIMFLTLEQVQKMFVRKPAS

SEQ ID NO: 36220 - protein, 144 aa, Sorghum bicolor
  Clone ID: SORBI-28MAY03-C85223_1.pep
MAASSRISSPAWLLAAHWHCALLLALAGAARGHAGAALSSAFYDQSCPGAYNVVRRVIQSARVSDPRTPASLIRLHFHDCFVNGCDGSLLLDDDLPAIRTEKNVPANNNSARGFPVVDGIKRALEEACPGIVSCADILALAAEI

SEQ ID NO: 36221 - protein, 224 aa, Sorghum bicolor
  Clone ID: SORBI-28MAY03-C85287_1.pep
HSYKSSKLSSSPHGIPTGSSPVGSVPKSSPQSHHLTFHLLEKNKLQQQRYNKFKNQCLMERKKLGTGQSEQMNSLYRFWSYYLRDNFNEDMYNHFKKLALEDAAASYRYGLECLFRFYSYGLEKNFQPNVYEDFEKLTLEFYCNGDLYGLEKYWAFHHYRNPDSGRVDKLPELERLLREEFRTLEDFNKANKAKEKARETAEKGTGISSSSVAAAASHTKVETK

SEQ ID NO: 36222 - protein, 149 aa, Sorghum bicolor
  Clone ID: SORBI-28MAY03-C89901_1.pep
MGISSMPAPKDSLLGFVLYNAAASVAILSGLVRAALLFLGVAAAPSSSPWEAPEEERRQQQQGAVRVTPVGPTLADRFRSRFRPSRFGRRRGCGGSGDCRVCLVRFEPESVVNRLPCGHLFHRACLETWLDYDHATCPLCRHRLLPPAA

SEQ ID NO: 36223 - protein, 205 aa, Sorghum bicolor
  Clone ID: SORBI-28MAY03-C89906_1.pep
GSAPRPRDSDANPPPCFTFSLTHVATSPAPMACISCPTRPLFSFMASATPRWWTSALARRVPSFMLPFCRFSRFSHEPRNIATTNRVKDDGSGKPDRQLPISSANVITRSQNKHSAVTQGMKNITSGRILEVIAGDEKSDKDDCRVTSEFIYDKCDISGHIVKLTGYGEEDPRNATDNQRGETVASNDKEVSDDEEYTMDIILPK

SEQ ID NO: 36224 - protein, 219 aa, Sorghum bicolor
  Clone ID: SORBI-28MAY03-C89908_1.pep
MSWRWALARRVAALAATSGGGGGAAQAQRLLPTSSAAASTGLLGRHHMPLASQIRSKVVGCRGAALVSSRWLHDAQYQVRQDGASRAQEQQDPFARGADELSLLANRLRSMVAAEVPKLASAAEYFFKVGAEGKRFRPTVLLLMASALKFPLSESTEGGVLSILADKLRTRQQNIAEITEMIHVASLLHDDVLDDADTRRGVSSLNLIMGNKLSARAGY

SEQ ID NO: 36225 - protein, 175 aa, Sorghum bicolor
  Clone ID: SORBI-28MAY03-C8992_1.pep
HSLLLLLTPQVRSRFPFPPSPSSNELLVRTNSGPIRQVHCEVEVSIGIKESMSTVSGTRRAPRRQSQDGSADKVLVIIEASSRVAGSRRGPPTPVPGARNSPIDVEAIDDEVQAVSPSRVPPPRRNRRTRREPITVVDLEVESSREGNKHQRVVPVGHHLSSDSGAGCSLQVFIL

SEQ ID NO: 36226 - protein, 146 aa, Sorghum bicolor
  Clone ID: SORBI-28MAY03-C89974_1.pep
ILLDSCPEFFNSHDREFHVATLPYKPDFKVMPEGWDGTARDPDEVLYEISKKEDQMLYEEFVQRLEFNKKKVAGEVKCHKYSRRRPDNGWSYMVEKLGSQGKRGVGGGWKFISLPDGSSRPLNDMEKMYVKRETPKRRRRIIAPYK

SEQ ID NO: 36227 - protein, 191 aa, Sorghum bicolor
  Clone ID: SORBI-28MAY03-C85611_1.pep
MSKAAILAVVVALAVQLAAAADHPVGGDGSWDASGNGYDAWSAKQTFKQGDTLSFKFASSHDVTEVTKAGYDACSGGSNAVKSYTGTSATVKLSAPGKRYFICSVPGHCAAGMKLEVTVTAPAPSSKSKPRHQRSVAPTPAPAPATDGELPNVASPDAAPSPKSSDAATIAMLGGKAVVGLAVAVAAALAM

SEQ ID NO: 36228 - protein, 144 aa, Sorghum bicolor
  Clone ID: SORBI-28MAY03-C85618_1.pep
LELAARVDKDKDKVSGDGNSLFQLAASWQANKNFLVKGKLGPSKSSVALAFKSWWRPSFTFSVTAVNDHAKGTTSYGFGLRVEDLRQASYQRADPNYVMLTPSKEHLAPGVLREYGKRPMFQTQIDSGNYDHLPTELKPLGRIF

SEQ ID NO: 36229 - protein, 224 aa, Sorghum bicolor
  Clone ID: SORBI-28MAY03-C8565_1.pep
EDQRLNYVEMHAGNVGIKTDKLESLRIAVAKDSPMWETLDICIKIVDKNSLDLLVPRLAQMVRSAVGLNTRVGVASFITFLVQKVMVDIKPFTTILLKLLYSAVLEERSSAAKKAFASSCATVLKYASPPQAQKLIEDTTSLHSGGKNDQLSGAILIKAYLSNAADILGGYNAVVIPVIFVSRFDDDKDTSALYEELWEDIPTSERVTLTLYLPEIVSLLCDGM

SEQ ID NO: 36230 - protein, 162 aa, Sorghum bicolor
  Clone ID: SORBI-28MAY03-C85652_1.pep
RIAHQQLGNIQLVSQYLTILGTLALQLHDAGQAREILKSSLTLAKTLFDIPTQIWILSVFTELYRELEEKENEMENSDYERKKEDDLQRRLSEAYSHAFHQELVEKSRIQPLHMSSKQPEMAVPTANADLDIPESVGLSAPQPFLKRLVESEPVRRSTRRRQ

SEQ ID NO: 36231 - protein, 167 aa, Sorghum bicolor
  Clone ID: SORBI-28MAY03-C8507_1.pep
GRVGAFMFRETARLDPGATLFVNDYNVEGGNDPNATPDKYIAQIAALQQKGAAVGGIGLQGHVTNPVGEVICDALDKLATTDLPVWLTELDVSESDVDLRAEDLEVVLREAYAHPAVEGVMFWGLMQGHMWRQDACLINADGTVNDAGERVVDLRREWTSHARGHID

SEQ ID NO: 36232 - protein, 128 aa, Sorghum bicolor
  Clone ID: SORBI-28MAY03-C85102_1.pep
MLSPRGGPPRDPTARSALPSSSSTRHTDMEDDDDAGAGAGACGRVLEWEHGLPTEEVLTPLSHPLVPPALAAAFRIDVRGTGTAFPSSPAFDCPVVFAHNSPTSHLSFRCEDEDEDEDDEGEGEEGGG

SEQ ID NO: 36233 - protein, 143 aa, Sorghum bicolor
  Clone ID: SORBI-28MAY03-C8511_1.pep
MASGCYRSAETPANITNNAISQSQPQWTGPSPVDDSAVNSEMLNNQQLAIDEGTISVSSNYSQELLNSLTHALQSSGVDLSQASISVQINLGKRAVKRPVAPSNSKEPADPASSNELGHQLMMLGAGADNLSHTTKRHKPGNS

SEQ ID NO: 36234 - protein, 143 aa, Sorghum bicolor
  Clone ID: SORBI-28MAY03-C85119_1.pep
SQAMDSIDVWVLKDGWVPVHTVDLPITEIQAMRGIKRFGEPIIYVVLETLDMLIWTPEFFMVVDPSGSVLEYHQHHQDWILLPPHILKVRFEEQFFDPEDAVPFFWFPEVPASGFTQSSPAERSNQLTVHQGGKLSSYLSRRV

SEQ ID NO: 36235 - protein, 184 aa, Sorghum bicolor
  unsure (1)..(184): unsure at all Xaa locations
  Clone ID: SORBI-28MAY03-C85148_1.pep
KLVIRESLRLHPPAPLLVPRETTEPCTVHGREVPAGTRVVVNAKAIXMDPDAWGPDAARFVPERHDGDGDGADLGDHKPWHGSFALVPFGVGRRSCPGVHFATAVVELLLANLLLCFDWRAPRGEVVDLEQETALTVHRKNPLVLVAERRGVPCARSCVGRFVDMRSPCRASLPGGRRDILASW

SEQ ID NO: 36236 - protein, 181 aa, Sorghum bicolor
  Clone ID: SORBI-28MAY03-C85767_1.pep
MDAGDCSTSTSKPPQPSAAAATQPSSPSVWARLVPADSACPVVEVAEDDSVVCSLVAPAPACGGGDGEEVAWCEIRRNAGDASAATIRNLSSDAIIVDGRIVKQECVDIKPGSEIVSGPQKEGHLVYTFEITEEEDHEKKNVKIVLDIENAKCSICLNLWHDVVTVAPCLHNFCNGCFSEW

SEQ ID NO: 36237 - protein, 283 aa, Sorghum bicolor
  Clone ID: SORBI-28MAY03-C8578_1.pep
FIPLQSVRVKPIIEKLRTLGGSAQLVFDVIHFDRVLEKAVLYAVGNTLVCDKLDEAKALSWSGERYKVVTVDGILLTKSGTMTGGTSGGMEARSNKWDDSAIESLKKNKNKLETEMSELGSPRELQRKELAISEKITGLEKKLHYSNVEQNNLRGKLAKLASERSNIEAEIKRLKPGEEELETRIAEREAEVRKLEKKINDIVDKVYRDFSISVGVKNIREYEERQLKDVQALQERKLSLSNQMSKLKYQLEYEQKRDMQAPIVKLTETHESLEKELKGLQER

SEQ ID NO: 36238 - protein, 120 aa, Sorghum bicolor
  Clone ID: SORBI-28MAY03-C85786_1.pep
MAVVAERFPREVSSEALFRCVRLGPVDEPDAEVAYQTSVSIAGHVFKGILHDVGPDPSVAAGGGGGGGFRHATDGSSPSTAAAGEGSVAGPVSSSAVVMDPYPTPGPYGGAAHFFHGHPR

SEQ ID NO: 36239 - protein, 327 aa, Sorghum bicolor
  Clone ID: SORBI-28MAY03-C85790_1.pep
MALPLLRNSIPMVSLAVSVAALYTSAVSSHVRPGFPRVAMLLPVGVLFVAVPLAFSSAVLRCSAFLFLTWLGAFKVLLLAMDRGPLNPSLPVLHFLLAVALPVELITASDGSRRPDKDKPLLAAASIISCTFKVVTVAAMAHFYWFFDRLHLYVRLALYGVRFWFSIEVLFACAAAGCSAALDVEVKPQFVQPYLATSLRDFWGRRWNLPVSAVLRAAVYNPLRARAGKEAGLLATFLVSGLMHEALLCYSTLQRPTGKMAAFFLLHGACRVAEDWCARRWPPPPRPLATLLFVAFMTTSFCLVFAPLCCDGWEEMLHSYRSPNSRN

SEQ ID NO: 36240 - protein, 191 aa, Sorghum bicolor
  Clone ID: SORBI-28MAY03-C85809_1.pep
DGAEAKIPFFFLIKESQKAVMQILKAEDDEVTLELGVAAVLSPWYCSGRPVPFAVKMVLWMQNGNGKSQHAAVGGARAELSTRRAACGLPPGGSTAVVRCHRPPTDVEDTTEGQKAATAQSSFNVPWCSWRLEQTPHASHSLTQLTPATNAIDPGWPADALAMDGAATPNRAGRHRAPARFFVFTGGRETL

SEQ ID NO: 36241 - protein, 107 aa, Sorghum bicolor
  Clone ID: SORBI-28MAY03-C96441_1.pep
FRTVYTRRSINLSCSTIFFRFLGLLISINVRDRIRSSEHNNGLEIERVIVAEARHVRKGIAGAVELLQLQARRHVPLVRLRPCRRRRRRRGVPVPHRLRGRRAPRRG

SEQ ID NO: 36242 - protein, 310 aa, Sorghum bicolor
  Clone ID: SORBI-28MAY03-C85272_1.pep
MQAAGGCRAANLCSPSLSRFRCGFRLPGRARLFSEGVAAAPLRVGYLPQPRTHGSGRFAHLEAMDAEAPRLPHALRGMLIDHQKMACPNLLKAAVLSTMTLLAVPLEASAEMCQPPNSFANMPIFIAVALIGAAVGGLLARQRKAELKRLNNQLRQINAALRRQAQIESFAPGLTYAPVRRTNETDVIVDPRKQQLVTNLRNGKNYMRNQDLHKAIVEFRTALELAESIGDRFEEKKAARGLGASLQRLGKYREAMRQYTKVLELSKETGEDSGCTEAYGAIADCYTELGDLERAAKIYDKYISRLPPGE

SEQ ID NO: 36243 - protein, 92 aa, Sorghum bicolor
  Clone ID: SORBI-28MAY03-C85291_1.pep
DFAFCGNTFLESCQSIGDASGGGSFSSSELNGQPLNESILDMESSSFSFLNQMPQNFIFSDLADDFNQSAEITPFLTPETNFSDSTGGEHTG

SEQ ID NO: 36244 - protein, 166 aa, Sorghum bicolor
  Clone ID: SORBI-28MAY03-C8545_1.pep
TPYSPAINRDLMRRLRSAIEKIQTDTTAKVVLVASSVPGAFCAGADLKERRLMKSSDVGEYARSLRSTFSSFEALPIPTIAVIEGAALGGGLELALACDLRICGEYAELGLPETGLAIIPGAGGTQRLPRIVGRSRAKELIFTGRKCGAAEAVMMGLANYCVPAGE

SEQ ID NO: 36245 - protein, 86 aa, Sorghum bicolor
  Clone ID: SORBI-28MAY03-C85485_1.pep
DVAQLYAANELYNKGWFYHKDYRVWLTRAPNSASLVKTPLHERGSYICFDPSIWDTVHKDNFVLHYEAVEKRPVLPSAGQNIRREL

SEQ ID NO: 36246 - protein, 119 aa, Sorghum bicolor
  Clone ID: SORBI-28MAY03-C85517_1.pep
AAVENDSAEDKEVVVLAAAKDGNGESSVEALTSKTSDGTGREEKTEAGDSSKGVGFSVVAQPSVQEEDLSWEEIEDIGDEDEKNGPSQRSSSVSKVEDLRKRLNSVEDDDEDLSWDVDE

SEQ ID NO: 36247 - protein, 124 aa, Sorghum bicolor
  Clone ID: SORBI-28MAY03-C85580_1.pep
MSSPMHVRKAIHFASLRAKLAQQGKAGLALRLLLAAALAGFLLVFAARTLLVSSPAAATSSLAECAAKGTAAATAGLPLAVMEALVHYTTSNVTPQQTADEIGVSLRVLQRRAPCNFLVFGLGH

SEQ ID NO: 36248 - protein, 120 aa, Sorghum bicolor
  Clone ID: SORBI-28MAY03-C85505_1.pep
PGAYVLWYRPLYNAMRTESALKFGWFFLFYLLHILFCVWSAVAPPFPFKGKSLAGILPAIDIIGRSAIVGIFYFIGFGMFCLESLLSIVVIQQVYMYFRGSGKAAEMKREAARGAMRNAF

SEQ ID NO: 36249 - protein, 196 aa, Sorghum bicolor
  Clone ID: SORBI-28MAY03-C85862_1.pep
MAPLSWRHHTLLQALLTRGPLSDRDFRAVFAAVSGKKPATHQQLFNDTLLKLNKELAYLQFELRACMNQYDGVVYYGVVNNIVDDESKLGTKYSVPQVAYYKGLLEAVIQEAGNDGSITSIGALHVRLDNQVIILDGGSHDSQSRLPSCITDFKLSQKEKTIDELVRDRWLSYTSTGKIGLGIRSFLDLRGWFRAN

SEQ ID NO: 36250 - protein, 168 aa, Sorghum bicolor
  unsure (1)..(168): unsure at all Xaa locations
  Clone ID: SORBI-28MAY03-C85929_1.pep
MSVAAGVSDAAIAVRDKLRGKIGQTKVKRYWPGKAPEWADDADEDTDLRTTRVDKAFPKDDDGDVPAKDDRRLRRLAETRAENKEELRADHRRIRQAEIVSTAEEENERQEADIDEEDEEAQEERRRRIXERQLLREQEELLPXEEEEPVEDEESEEESEYETDSEDE

SEQ ID NO: 36251 - protein, 278 aa, Sorghum bicolor
  Clone ID: SORBI-28MAY03-C85944_1.pep
MALSLARSPSPGAALPAARVPHFALPLLPLRSPRHQCQARLRLRLRVAASSPPAAQAAAAPVVAEEEEEQGEKRRKLYVANLPWSFPAPEIEKLFAQHGTVKDVEVIKGKDGRNRGFAFVTMSTTEEAAAAAEKLNSHDVMGRTIKVEFSRSFRKPAPLPPIIERHKLYVSNLPWKARAPNVKEFFAKFNPLSANVIFDNGKAAGYCFVSFGTKEEAEAALTELDGKELMGRPVRLYWRESGDDKVEVAKADSEVEVVNIEGASVDDASTDGGEDKQE

SEQ ID NO: 36252 - protein, 84 aa, Sorghum bicolor
  Clone ID: SORBI-28MAY03-C85933_1.pep
SAATAVVSQQEALRPWRLRSPSCTARGSAPAPSESGSPSTSKVTGSNRWLWFPAPQMTANLAQNRGLVSGRWGIGDNVTFFLIY

SEQ ID NO: 36253 - protein, 82 aa, Sorghum bicolor
  Clone ID: SORBI-28MAY03-C86001_1.pep
LFLISELRGNRISIPKLKPKSHGSRYRGLWAGQARLIIVGSLVRGGLWIQLPYFTALHVTDGFRISSWLWISRISKLLVDGS

SEQ ID NO: 36254 - protein, 135 aa, Sorghum bicolor
  Clone ID: SORBI-28MAY03-C85954_1.pep
TITTGGGAANAGTSSRPSTAALPSKSVVSDLLDAIETNRAAPRRDAARRGSGGSAGLGWWNLNVEGVMLLLRVVQAVRGRRHLAAPAAGEKRPRDEGPGRDTMRGGVMGGGGAARRWCGGRSRKIGNTVGACGSS

SEQ ID NO: 36255 - protein, 252 aa, Sorghum bicolor
  unsure (1)..(252): unsure at all Xaa locations
  Clone ID: SORBI-28MAY03-C8566_1.pep
RPGRAYPKSGENLGRGIELLHNAQGYSFTFDKVFDHSASQEHVFIEISQLVQSALDGYKVCIFAYGQTGSGKTYTMMGNPESEDQKGMIPRSLEQIFQASQALNSQGWRYKMQASMLEIYNETIRDLLVTNRMAAQDGGPTKYSIKHDANGNTIVSDLTVVDVTTINEVSSLLRRAAQSRSVGRTQMNEESSRSHCVFTLRIFGVNEGTDQQVQGVLNLIDLAGSERLNKXSGATCDRLKETLAINKKLVMP

SEQ ID NO: 36256 - protein, 125 aa, Sorghum bicolor
  Clone ID: SORBI-28MAY03-C85659_1.pep
DTVHGGNPYEKDIPERCIQQSGKTLQAVISEWISKFDNMEIDRSRLQLNNVDAITSRTYICNHCYSKFIDFLLYWFRVSMPRNLLPPDAADRESCWYGFMCRTQHHRPDHAKKLNHVCRPTRGNP

SEQ ID NO: 36257 - protein, 147 aa, Sorghum bicolor
  Clone ID: SORBI-28MAY03-C85680_1.pep
IGYIAPEMVSRSFGAISSKSDVYSFGMLLLEMAGGRRNADQNAANSSQAYYPAWVYDRLAAQEVGEISVASDMHELERKLCIVGLRCIQMKPQDRPTMSEVIDMLECGTDGLQMPSRPFFCDNDHNIPAADSYHFSSELTEISEEDE

SEQ ID NO: 36258 - protein, 214 aa, Sorghum bicolor
  Clone ID: SORBI-28MAY03-C85706_1.pep
MANSCAAAAFLHPSASYWQALLVFISVTAVRAAGAGGRGTCPPFSCGDLHNISSPFRRPGDPPECGVQAYELSCSRSKATIRINTETYFVTSINYTDLSFGVVDANLDMHSSCPLPRPDQFRYNDDYTGSYLESGLHSHYDLGFDYSNNWACFINCSQSKTNSSWYKPVNCLSANNSFVYVMVDYSDCSVSSLEPSCGYLTMIPFGNWRTITDP

SEQ ID NO: 36259 - protein, 167 aa, Sorghum bicolor
  Clone ID: SORBI-28MAY03-C85725_1.pep
MGIFFSKEEPPPPPPMVLVPPLFDYPPIAARTRVAVPAYELMFGKLSLHNLFEDYFDHAGNMTSRIMLKPLEDPHVDLIATVSAAAADKNSGTEVKGDALFRWQRELYDPHTFVDLLVSTSSPLLQLRSCAYDPKYRIGAFGTLPLLMGNRVRSEDYGVVGVRYGSE

SEQ ID NO: 36260 - protein, 102 aa, Sorghum bicolor
  Clone ID: SORBI-28MAY03-C861_1.pep
MFIQKAWRTAAFGLYGFTQFTKSGFLEHAKKFREEDMQIRLDGKNCLVTGANSGIGFATAEGLASHGATVYMLCRNKERGEAALDQIRSKTGNANVHLEICD

SEQ ID NO: 36261 - protein, 200 aa, Sorghum bicolor
  Clone ID: SORBI-28MAY03-C86102_1.pep
MAPRPAAAAALMDELVEEILLRIPPDDPARLLRAALVCKRWCRIVSDPGFRRRFCEFHRKPPMLGFVCTAGPWCTSGPFTSFVSTTSFRSSPSRLDYRAVDARHGRVLLHGEIWNHKRKHWDDSLVVWDPITGVERARLTLPPRSRHQEANYSSGIWNVAVLCASAAVDDACDHLDCHSGPFLVVFLARGRSGMCTQVYS

SEQ ID NO: 36262 - protein, 216 aa, Sorghum bicolor
  Clone ID: SORBI-28MAY03-C86111_1.pep
TGEAREAFGWWCSRSLQLLTRRGRTRRAAAVYPKMARPPILSVALPSDTGRVLSIQSHTVQGYVGNKSAVFPLQLLGFDVDPINSVQFSNHTGYPTFRGQVLDGKQLWDLIEGLEENQLLHYTHLLTGYIGSVSFLETVLQVVDKLRSVNPDLLYVCDPVLGDERKLYVPQELISVYQQKVVPVASMLTPNQFEVELLTGLRITSEQDGLTACNTL

SEQ ID NO: 36263 - protein, 95 aa, Sorghum bicolor
  Clone ID: SORBI-28MAY03-C86129_1.pep
MERSTRETTPCSLIRNPEMISTPGSTTKSKTSNSMTSRRRMETSIRRFIPSSHEMEEFFSAAEKQEQQSFREKYNFCPVNDCPLPGRYEWARLDC

SEQ ID NO: 36264 - protein, 270 aa, Sorghum bicolor
  unsure (1)..(270): unsure at all Xaa locations
  Clone ID: SORBI-28MAY03-C86152_1.pep
MSKARLDGKVAIVTGGASGIGEAAARLFASSGATVVIADVQDELGQAVAASVGSGRCAYARCDVTDEAQVEATVARVVAAHGRLDVMMSNAGVLLPTGSVMDMDLAELDRVMAVNFRGAAACVKHAARAMVASGSGGGGGAIVCTASVASLQGGFGPASYTASKHALLGLVRAAAGELGRHGVRVNCVSPGGVATPLSCALMGVGPQELEAMTVPHNVLQGKVLRADDVAEAALFLASXQAAFXSGHNLVRQTAPYTAVNPARAAEPSGL

SEQ ID NO: 36265 - protein, 70 aa, Sorghum bicolor
  Clone ID: SORBI-28MAY03-C85813_1.pep
QAIKWLVICHLTCRYDLWSSQQLTDLWTPRVWIMLPGGKDEWLRSENIRNKMTNDFIFLLHIFKQLYQVN

SEQ ID NO: 36266 - protein, 83 aa, Sorghum bicolor
  Clone ID: SORBI-28MAY03-C85827_1.pep
LFPWICSAIEKLLEGCDSKYATGDEVQLADVFLAPQIHAGVTRFKIDMSNYPLLERFYKAYMEILAFQVAAPEKQPDAPASPY

SEQ ID NO: 36267 - protein, 175 aa, Sorghum bicolor
  Clone ID: 30967258.pep
GDWGSGYGISAQALTAVVRAYDGRGPETALTNNILDFLGLASPDELIGWTYEDQSWARIADLLPVVVESAESGDEVANKILHNSVGELASSVKAVVQRLDLGGEDGKHPFPLVMVGKVLEANKRWDIGNEVIDCVTKNYPGAYPIHPKVEPAVGAALLAWNAIASELDGDIRTVQ

SEQ ID NO: 36268 - protein, 136 aa, Sorghum bicolor
  Clone ID: LIB3476-051-P1-K1-C5.pep
MAAHLGTRCQQPVCVCIPAAMPFTTRSRSSPAPSPAAPTTTPSEVTPPGLAQPSQLLALLKFPVHCSDNRWTYEDQSWARIADLLPVVVESAESGDEVANKILHNSVGELASSVKAVVQRLDLGGEGDTRILSDFP

SEQ ID NO: 36269 - protein, 80 aa, Sorghum bicolor
  Clone ID: SORBI-28MAY03-C85829_1.pep
SGYVGLRDVNTGEKDNMMQSFFLAETLKYLYLLFSPPSVISFDEWVFNTEAHPLRIVPVNDNKGIGTPVRPFGRKQGKPE

SEQ ID NO: 36270 - protein, 138 aa, Sorghum bicolor
  Clone ID: SORBI-28MAY03-C85838_1.pep
SAFQCSNMVTNSKQVPAQDWFYQSRLICYCQMTENKLYEFVEAIHIRPQQLEVAAAFPHHTQKDHLLPPGATINRMYTTKESLQSHYLSSMSPHHSLLPSFGSSGRLGRPCRRHLLSGFDCFGFRSSQAPRPPRNRRR

SEQ ID NO: 36271 - protein, 175 aa, Sorghum bicolor
  Clone ID: SORBI-28MAY03-C86308_1.pep
GPDEYDNFADERDNYEQTEATTYNNAPLMGVLARLAAGHGGGRFGHHSVAADLPAEASSSTAINRTSLPSPTPAAPEHASPIEIEQNATASWTERGKTYHRYAVTVTNRSLIKTVHELHIGISKLYGQVWGVDKARYGYVLPSGLPSLPAGKSASFVYVQAAPPADVWVTGYKLL

SEQ ID NO: 36272 - protein, 73 aa, Sorghum bicolor
  Clone ID: SORBI-28MAY03-C86343_1.pep
ELDRKYRFVMRLVDLYGPFALFKGIFDDANMERLRIAMPVADRVEFNFDPKTVDWDDYFYKIHIPAVMKYVLN

SEQ ID NO: 36273 - protein, 153 aa, Sorghum bicolor
  Clone ID: SORBI-28MAY03-C86387_1.pep
MADALLLPRRFLAPSPAASGVSSSASSSPPCCWVLSAPGSPRRARLAAAHPQPRPRRLTRYKTYAAEPKSGEQPKWWEKNAGPNMIDIHSTVEFLDALRDAGDRLVIVEFYGTWCGSCRALFPRLCRTALENPDILFLKVNFDENKPMCKRLN

SEQ ID NO: 36274 - protein, 185 aa, Sorghum bicolor
  Clone ID: SORBI-28MAY03-C86412_1.pep
MARGGGRGGGGSRGAVVDSMAVVLIGLAMALAAATTQVASAAGHDYRQALSKSILYFEAQRSGRLPGSQRVSWRADSGLRDGKANGVDLVGGYYDAGDNVKFGLPMAFTVTMMSWSVLEYGKQMAAAGELGHAVEAIKWGTDYLVKAHPEPNVLYGEVGDGDSDHDCWMRPEDMTTSRQAYRLDP

SEQ ID NO: 36275 - protein, 49 aa, Sorghum bicolor
  Clone ID: SORBI-28MAY03-C86019_1.pep
IGTVKIKVCPLLMNSKSIYTHSQWSSSRWSGEFLLPRQCLVATTAISSY

SEQ ID NO: 36276 - protein, 178 aa, Sorghum bicolor
  Clone ID: SORBI-28MAY03-C86041_1.pep
MAAANAENTSSLLRLDGRVALITGGSRGIGREVSSHLAALGARVVVNYASNSARADELVAELASRGHQAVAVRADVSDPDAVRALFDRAEEAFGSPPHIVVCCAGVLSDKYPALADTAVEDFDAMFAVNVRGTFLVCREAANRVPANSGGRIVTFSSSIVGTLLPGYAAYTATNAAVE

SEQ ID NO: 36277 - protein, 177 aa, Sorghum bicolor
  unsure (1)..(177): unsure at all Xaa locations
  Clone ID: SORBI-28MAY03-C8606_1.pep
DFSMVDSVHDNIVLNKCIKDILALIKPVEDDRSRRLSTIQELENCIHSQASLSGAAVKPFGSFVSDLYSKSGDLDLSIQLWNGSNHPINKRKKQNTLREVRKTLLSQGVTGYMQFIPHARVPVLQYVSNRFGISCDISIDNFAGRIKSKIFYWINTLDERFGDMVLLIKEWAKAXNI

SEQ ID NO: 36278 - protein, 194 aa, Sorghum bicolor
  Clone ID: SORBI-28MAY03-C86074_1.pep
MLRCLVLAAVSLALLVLAPPARAGIPFTEKDLASEESLRALYEQWRSHYMVSRPAGLQEQDDKARQFNVFKENVRYIHEANKKGRPFRLALNKFADMTTDEFRRAYAAGSRTRHHRALSGGRRRHGDGSFMYADARNLPLAVDWRQWGAVTGIKDQGQCGSCWAFSTIAAVEGINKIRTGKLVSLSEQELVDCD

SEQ ID NO: 36279 - protein, 141 aa, Sorghum bicolor
  Clone ID: SORBI-28MAY03-C86061_1.pep
MPVRYSRVRPTRSAGRPAAAAPPLPPSRDAIRTRPVGNAARWKHRSELTPHVAVVPRRASDALAGMHACMERKKHARTTSTGRRFRTTCACCTSQDTSSIDYLAGVRLASGYLYTDIYFFSDILHDRSCMPWTLVHVNSID

SEQ ID NO: 36280 - protein, 121 aa, Sorghum bicolor
  Clone ID: SORBI-28MAY03-C86655_1.pep
SWKVTNPSCSTLPLEGRWERDCKIDASHISGSLPKLLGQAASLPPLQQLHTGHPTLSLDDDDVVYVVAKVDHRDDKAFVLAVNMWNGALQAADYFGAERMIGISFTYTQYRPSDYAEITTG

SEQ ID NO: 36281 - protein, 150 aa, Sorghum bicolor
  Clone ID: SORBI-28MAY03-C86666_1.pep
TNGGTQVYADQRRNSLEEAVKLCVAGGLQGIVSEVRAILRQPSAVAEIKDANKLSLMTYGQLNNVPEVVYVQHLMGVDGVIVDLVGEIAEAVSAFTVTPVQASGSQDGGGGVVGERMETAAALAVAAGTTPSFSPREMSFLLRLIPELVQ

SEQ ID NO: 36282 - protein, 314 aa, Sorghum bicolor
  Clone ID: SORBI-28MAY03-C86678_1.pep
MTRAHLPAAAAGAAQRRPTVALLLGLALAFCLAVLSIQSSFFAAPGAPSRRLDLDADDVRELAGFQSRVQQCVASRGLGLTADIIDHCKLVLKFPEGTNSTWYNTQFKIFEPLEYKYDVCEAILLWEQYRNMTTVLTREYLDVRPDGWLDYAANRAPRLGADKCYNRTLCDELLSILLPAKPPFHPRQFATCAVVGNSGDLLKTEFGQEIDAHDAVFRDNEAPVNKKYAKHVGWKRDFRLVVRGAARNMAPILKGSSNEALIIKSLTHKEINAVIKELPNPVYLFQGIVLRRGAKGTGMKSIELALSMCDIVDM

SEQ ID NO: 36283 - protein, 178 aa, Sorghum bicolor
  Clone ID: SORBI-28MAY03-C86742_1.pep
MASLAAVKKVLVLVPITAGSEPVEAFVPIAVLRRAGADVTVAAAGAGAGLRVHAMYGVTVVADANVADCADASYDLVALPGGVPGADNLGGCAALESIVRRQALGGGLYAAICAAPPLALARWGLLDGVKATAHPAFVDKFPAEVAAVDANVVVDGRVVTGRGPAPAMEFALALVEQL

SEQ ID NO: 36284 - protein, 206 aa, Sorghum bicolor
  Clone ID: SORBI-28MAY03-C8679_1.pep
TRGKRSKVSHLLPQERAVPCDLADPRVRSSSLEFASRTGFLDAHLSALVDGAATHSGAQTLIILVDTSCPGSSHRLLGLLLPMLRWMCRSRQRGKFQNLATFIMSAGVAAAFAFHGVHFVKLQRRSASALLHRPLAHCGWCALHGSKISEPLLSVDFSALPSYFWSLQYAVALESMYLPAMIRHSRLLDGGSEEIYPHTPLYLDSG

SEQ ID NO: 36285 - protein, 351 aa, Sorghum bicolor
  Clone ID: SORBI-28MAY03-C86788_1.pep
MAPPPRWLRREVFVGLALGQFVSLLITSTGFASSELARRGVNAPTSQSLLNYILLALVYGGTLLYKRQHMTIKWYYYLILGIVDVEANYIVVKAYQYTSLTSVMLLDCWSIPCVIVLTWIFLKTKYGLRKFIGVGVCVAGLILVVFSDVHSSDRAKGPNPLKGDLLVIGGSMLYAISNVTEEYFVKKSNRVEVMAMLGVFGAIISGIQISILEQKELRSTHWTAGAILPFIGFALAMFLFYSTVPIILKICGATMLNLSLLTSDMWAVLIRIFAYHEKVDWMYFVAFAGTATGLVIYSYRGSKQISEETAQVTQAMDEEAAAANSTAQVPGVGDGGPASNKDFSLAATASR

SEQ ID NO: 36286 - protein, 136 aa, Sorghum bicolor
  Clone ID: SORBI-28MAY03-C86158_1.pep
SQNYYSTEAPAAPYNYPNFQSYPSFQDSTAPSVPTHQSSFYPASDGPAATSYTPASNSSAPTHYLSTAESSPQLAPPAVPPASQYKYDSSYQPEVEKIAEAHKAARFAVGALAFDDVSVAVDHLKRALDLLNKPFR

SEQ ID NO: 36287 - protein, 135 aa, Sorghum bicolor
  Clone ID: SORBI-28MAY03-C86177_1.pep
FRSEERLMLEQALLQEKKQARRGLRAEMESREKAGREAAEVKMRMAMEHARAEAQAHSEMLNHGPIRASVVASQGDNGPSHEMVQEHGEDGWRNSQRDDEEPSEDFLNDENEPENGNSDGHEDWRRSGELDLNSR

SEQ ID NO: 36288 - protein, 102 aa, Sorghum bicolor
  Clone ID: SORBI-28MAY03-C86237_1.pep
MGKYMRKGKVSGEVAVMEVPGGALLGVRTRSRTLALQRAQRPLDKGDAEDAAAEYLELRSRRLEKPHKDPLPPPSAPATKRGAGRKVATAAAAAAAPHGLAE

SEQ ID NO: 36289 - protein, 84 aa, Sorghum bicolor
  Clone ID: SORBI-28MAY03-C86282_1.pep
NFDENKPMCKRLNVKVLPSFHFYRGADGLLVAFSCSLAKFQKLKDAIAMHNTARCSIGPPVGVGDVDLLDSTSPQEKPAEASPR

SEQ ID NO: 36290 - protein, 148 aa, Sorghum bicolor
  Clone ID: SORBI-28MAY03-C8626_1.pep
HSACDEIEWYVSPDFNSSSTEDHQRVARGKVLVDFFPKMMEDLEDKVTLWNLKEGKLTFSFDGVDVRQKVEAMKTSYARHIKTDMDAVPGGIDIQQLVVPRRPRTPMVPVQVNEPPPPQPSDVDDSMASSGSKSDSKDSDYHPSDSEE

SEQ ID NO: 36291 - protein, 170 aa, Sorghum bicolor
  Clone ID: SORBI-28MAY03-C86951_1.pep
VGARRPAEWDEDEDHVVVALDGEPVDVEPSKGARWASSAVPGLTVTRTDAAANAVVVELDGAFAISANAVPITDEDSRVHAYGKTGKDSLVHLDVSYQFHGGLTKDVDGVLGQTYRPDYVNKLDISAKMPVMGGADKYRSSGLFATDCAVSRFRRAGGGADAGGFTSFAS

SEQ ID NO: 36292 - protein, 223 aa, Sorghum bicolor
  unsure (1)..(223): unsure at all Xaa locations
  Clone ID: SORBI-28MAY03-C87044_1.pep
AYRIRQAAGHVRVRDPVALVENHPSCRXNREGQKVLPNGQSWRHQLLLLCYSSKILSEANSLLKLQDPNPGKLFGFRFRSPPLPFLLSSLLQSRAHPKLSAEQGGNEGDSDIELDDYSDVEQDDDEEEYDQLPPFKPLTKAQLARLTKEQKNAYFDEYDYRVKLLQKKQWKDEIRRLKEMKKRGKTDLDDYGYASIGGENDQDPPPENVSVPLPDMVLPPSFD

SEQ ID NO: 36293 - protein, 180 aa, Sorghum bicolor
  Clone ID: SORBI-28MAY03-C87063_1.pep
MAIRGGAIAALLLVALLALSSSASAQFVSRRPSKQPPRTSTPGDPKKPPRNGKFTTVVANRHHKRNYQITCTTDWGASCYVKCPARCPNKCLAYCAYCLTFCMCDLMPGTSCGDPRFTGADGNTFYFHGKKDESFCLVSDDRLHINARFMGNHNADSGRDFTWVQALGVTFGAGDGAHSH

SEQ ID NO: 36294 - protein, 117 aa, Sorghum bicolor
  Clone ID: SORBI-28MAY03-C8711_1.pep
MAMPTFHLAPDLPPVSRLCFGTMTMGEQSGAACSLRLLDAAYDAGVNFFDSAEMYPVPQRSETRGRSEELLGRWLRARRAPRDSVVVATKVAGPSGQMTWIRGGPTSLDSRNIAEAI

SEQ ID NO: 36295 - protein, 190 aa, Sorghum bicolor
  unsure (1)..(190): unsure at all Xaa locations
  Clone ID: SORBI-28MAY03-C87195_1.pep
MATARLRSAASLRGAILRHFSVGPASTAHAVSRVPDFHVRQSIMWRHFSTSRPNSLARHDNFGLVACLHTQIRWASQAAAVKETEASGSKISIGPKPKQIKEDDEDANLVYQGPISSTIKKVKLLSLSTCCLSVSLGPVITFMTSPDMNVILKGAVASTVIFLSATTTAALHWFVSXPYIHKLRWRPGSD

SEQ ID NO: 36296 - protein, 44 aa, Sorghum bicolor
  unsure (1)..(44): unsure at all Xaa locations
  Clone ID: SORBI-28MAY03-C872_1.pep
LAIYVPNSIITYNTAAIIFFQHYLFANITHLQLGGGVTINTPXY

SEQ ID NO: 36297 - protein, 118 aa, Sorghum bicolor
  Clone ID: SORBI-28MAY03-C8650_1.pep
MELPRSMAVLVLVFFVLCGVGEAATFTFVNRCTDTVWPGVLSNAGSPRLEPTGFELSPGEARAVPAPAGWSGRMWARTGCSHDGATGRLVCATGDCGSGSAECAGAGAAPPATLAEFT

SEQ ID NO: 36298 - protein, 154 aa, Sorghum bicolor
  unsure (1)..(154): unsure at all Xaa locations
  Clone ID: SORBI-28MAY03-C86485_1.pep
MLRAWWTSTSATMATGTSVRKSSFPYPAGAGRARAPHRSRRPVPPPPTPAPRHGGRRFPPRRALPPPAGAAARALPGLALLPGPAPLPPPPXSPPLPPTLAVPPPSPPPTEDKQQTPEAKCPPPPPPSSRPPPPQWAGTSLAGPPKPERAKQSR

SEQ ID NO: 36299 - protein, 184 aa, Sorghum bicolor
  unsure (1)..(184): unsure at all Xaa locations
  Clone ID: SORBI-28MAY03-C8655_1.pep
HASDNSGCGGGLMDYAYKFVVKNGGIDTEEDYPYREADGTCNKNKLKKRIVTIDGYSDVPSNKEDLLLQAVAQQPVSVGICGSARAFQLYSQGIFDGPCPTSLDHAVLIVGYGSEGGKDYWIVKNSWGESWGMKGYMHMHRNTGDFKGVXCINMMASFXTKSSPNPTTSSCPGATKCSLLTYCA

SEQ ID NO: 36300 - protein, 134 aa, Sorghum bicolor
  Clone ID: SORBI-28MAY03-C86571_1.pep
MSHQIQSFSRNNCVLLAVLCGKYAEKRAPAARSGLEAKRPRPSYPFPELSSAGRLEVHTLFNPTPEQFLEAQRVVQPNFLYIQGQQLEDEKEIGSLVWGDADVSDPQAFSTLISPPFPTIVYLEVPIGEKLAQA

SEQ ID NO: 36301 - protein, 181 aa, Sorghum bicolor
  Clone ID: SORBI-28MAY03-C8662_1.pep
MATADIRVSIGHQTRFALRLAAALSSPSPSASPAGNVAFSPLSLHVALSLLAAGAGGATRDQIAATLGGGGDAAEGLHALAEQVVQLVLADGSGAGGPRVAFADGVFVDASLKLKPAFQEVAVGKYRADTQPVDFQKKAAEAAGKVNSWVEKITSGLIKEILPPGSVDHTTRLVLGNALYF

SEQ ID NO: 36302 - protein, 357 aa, Sorghum bicolor
  Clone ID: SORBI-28MAY03-C86284_1.pep
TRAYISLPVARCNDNVGFQLKLTHVDAGTSYTKPQLLSRASQPTPYFDVKRSATYRALPCRSSRCAALSSPSCFKKMCVYQYYYGDTASTAGVLANETFTFGAASSTKVRAANISFGCGSLNAGELANSSGMVGFGRGPLSLVSQLGPSRFSYCLTSYLSPTPSRLYFGVFANLNSTNTSSGSPVQSTPFVINPALPNMYFLSVKGISLGTKRLPIDPLVFAINDDGTGGVIIDSGTSITWLQQDAYEAVRRGLASTIPLPAMNDTDIGLDTCFQWPPPPNVTVTVPDFVFHFDGANMTLPPENYMLIASTTGYLCLAMAPTSVGTIIGNYQQQNLHLLYDIANSFLSFVPAPCDII

SEQ ID NO: 36303 - protein, 191 aa, Sorghum bicolor
  Clone ID: SORBI-28MAY03-C89978_1.pep
MAQARVALALLCALLLVAGVAPRAEAVSYNVGNSAGWDPSADLPSWAGGKTFYVGDVLVFQYSSYHTLDEVDEAGYNNCSAADAVLSQNDGNTTVPLAAAGDRYFICGNQLHCLGGMKLHVLVNQPAAGGGAPAGAPPQSPPQTGSGATLGPPTTDDDAGIPYLVLGGSHRATVGPLLVTWLLVLAAALLV

SEQ ID NO: 36304 - protein, 226 aa, Sorghum bicolor
  Clone ID: SORBI-28MAY03-C8743_1.pep
RGTLSGQRQGQPVFICKLEGYRSGTASGTRAADWPETMHIVRLIAQEHMNNKQYVGKADFLVFRTLNQHGFLGQLQEKKLCAVIQLPSQTLLLSMSDKAGRLIGMLFPGDMVVFKPQVPTQQTPMQQQQLQQQQLQQQQLQQQQLQQQHMHMQQQGLPLQQSQMQLQQQQQPQMQPMQQQPTQMQHQQQQPSQMQPMQHQQPQPQQMQSMQHQQQMQHQQQQQQQM

SEQ ID NO: 36305 - protein, 160 aa, Sorghum bicolor
  Clone ID: SORBI-28MAY03-C8756_1.pep
MPTSVATHASLLLKAAAAKPFFSPRAAARIHAPAPSPHPPPPAGRRLPTTAPALAAAARRFRWPSAARGLCAAPHSGGEAMGSEAGVGARKRPVPAVNGLAKDVPAVNGMTKEEPATAPPRLLTLPTVLTIGRVAAVPLLISTFYMEGPWAATGTTGILL

SEQ ID NO: 36306 - protein, 145 aa, Sorghum bicolor
  Clone ID: SORBI-28MAY03-C87563_1.pep
AGKGLSAEDMVVLSGAHSIGRSHCTSFVQTRLSAPSDIAASLATLLRKQCPANPTTANDAVVSQDVVSPDVLDNQFYKNVLAHNVLFTSDAVLLSAPNTARMVRANARFAGSWEKKFAKAMVKMAAIGVKTGRDGEIRKNCRLVN

SEQ ID NO: 36307 - protein, 91 aa, Sorghum bicolor
  Clone ID: SORBI-28MAY03-C8763_1.pep
LIKEMVWIYTHSITIFPRKMKICQRCIVALHGRTPAALPYQQGTSTTVSARCSTRRRRCCREVFAVSGEAESGNAARATWQLRQANVGGRN

SEQ ID NO: 36308 - protein, 101 aa, Sorghum bicolor
  unsure (1)..(101): unsure at all Xaa locations
  Clone ID: SORBI-28MAY03-C877_1.pep
ASLSRAQPEIGDCEFTTLRPNIGSLTYEDYFSVKVADIPGLIKGAHENRGLGHAFLRHIEGGXVIAYVLDLAAXLNGRKGVPPWEQXQDLVSKLEHYQEGM

SEQ ID NO: 36309 - protein, 163 aa, Sorghum bicolor
  Clone ID: SORBI-28MAY03-C93307_1.pep
MGAYATTGMQMMATRPCIPACRQMLGPTSALSAFGRAICTRTGFASSSKATSAGPLVSLNRKRVVVRAMSQRGAQGLPIDLTGKRAFIAGVADDNGYGWAISKALAAAGAEILVGTWVPALNIFETSLRRGKSDESRKLPDGSLMEIAKVYPLDAVYDTPEDV

SEQ ID NO: 36310 - protein, 148 aa, Sorghum bicolor
  Clone ID: SORBI-28MAY03-C93329_1.pep
MAIPVIDFSKLDGPGRAETMAAIAAGFEHVGFFQLVNTGIPDELLERVKKVCSDCYKLRDEAFKDSNPTVKALAKLVDMESEQGLPAKKIEDMDWEDVFTLHDNLPWPSNPPAFKETMMEYRKELKKLAEKMLGVMEELLGLEEGHIR

SEQ ID NO: 36311 - protein, 188 aa, Sorghum bicolor
  Clone ID: SORBI-28MAY03-C93337_1.pep
HALRRGGRPPPPGAPHPRRPRRARPPRRGAPGPQPPRAPHPRRAQPPRPHRRAAPRPAVADDRLACVRTSPPCYLLLPTCSACLAAADGLAGGVPCLSLLRLLVHVIRWRVLRFAWGLPAPGVGLSPLVNLLCCVRCSVWVVPSGTHHHLSCRLLGGTLVFSCALPLCIIRPVFLLSVKLYFSYFSVV

SEQ ID NO: 36312 - protein, 130 aa, Sorghum bicolor
  Clone ID: SORBI-28MAY03-C93354_1.pep
GLYRLQFGSVVDVVLQNANMLAANKSETHPWHLHGHDFWVLGYGIGRFDPAVHPAAYNLKDPILKNTVAVHPYGWTALRFKADNPGVWAFHCHIESHFFMGMGIVFEEGVERVAQLPKEITGCGMTKGGH

SEQ ID NO: 36313 - protein, 182 aa, Sorghum bicolor
  Clone ID: SORBI-28MAY03-C88024_1.pep
MPEAPVTTMREAATAAAAAAVPETHRELLEYIERVTAGAAQVQRRVLAEILAQNAPAEYLRRLGVAGDAPGAVDAFRRAAPLVTYEDILPDVLRIANGDTSPILSGKPIREFLTSSGTSGGERKLMPAIADEMDRRSLLYSLLMPVMSQAVPGLDKGKCMYLYFVKAESRTPGGHPARPVLT

SEQ ID NO: 36314 - protein, 227 aa, Sorghum bicolor
  Clone ID: 30975198.pep
DTVTTPSLGYLEAPLPLKSSPRSPAYVRDPDPLPGGSNAVPNGPRLSLLHLLRRLDDAGAAAARAAPRPLEVPACTSAAAAATAGASRPSAEPPTAASPRASFHALVNIADGRINIHVLMALAAFASIFMGNALEGGLLLAMFNLAHIAEEYFTSKSMFDVRELKENHPEFALLLETSGEESVQFSNLSYTKVPVHDLEVGSHILVRAGEAVPVDGEVYQGSSTVTI

SEQ ID NO: 36315 - protein, 169 aa, Sorghum bicolor
  unsure (1)..(169): unsure at all Xaa locations
  Clone ID: LIB3476-054-P1-K1-A9.pep
ALEGGLLLAMFNLAHIAEEYFTSKSMFDVRELKENHPEFALLLETSGEESVQFSNLSYTKVPVHDLEVGSHILVRAGEFLYSLXVPVDGEVYQGSSTVTIEHLTGETKPLERTVGDAIPGGARNLEGMMIVKVTKSWEDSTLNRIVQLTEEGQLNKPKLQRWLDEFGEY

SEQ ID NO: 36316 - protein, 260 aa, Sorghum bicolor
  unsure (1)..(260): unsure at all Xaa locations
  Clone ID: SORBI-28MAY03-C8809_1.pep
AGHDPARHKKLFGARFWVSRLDCIFDNNHYANDQQVLRKRKTELGGMFSVATVILFLGLATVLLYQAIHRRNAQVHRVKPANAPDLLDFVNDLEFHITTISSMSCAQVVAPSTIAMGTPGFMDFRVLPLSTLLTYTCQNTSEGPSITLKCNGCRIPPRDHYVSWQFVDLPRQPAAAIGFQFNLTAKEHGDDKDMSFVSGTLSSDNYVDAKLKTFRGPDSNVLKIQLFPQIYNNHRGLKLLQPLVQDFTQXSTLSDLSSLN

SEQ ID NO: 36317 - protein, 302 aa, Sorghum bicolor
  Clone ID: SORBI-28MAY03-C88052_1.pep
YWHRHISKGGWTFSTADDGWQVSDCSANGLKVCLLLSTISPEIVGEPLEIERQFDAVNCLMSLMNNDGGFSAFEPTRSSPWLEHINPSEAFGRTMIDYPYVECTSSAIQCLALFRKLNPGHRKEEVENCINKGADFIENIQRTDGSWYGSWGVCFTYATWFGVSGLVCAGRTFENSTAIRKACDFLLSKELPCGGWGESWLSSHNEVYTNLRGNRHHGTHTAWALLALIEAGQAERDPMPLHRAAKTLLNLQLEDGEFPQQEIMGVFMQTAMASYSQYRNIFPIWALTEYRRRVLLAGKKSE

SEQ ID NO: 36318 - protein, 181 aa, Sorghum bicolor
  Clone ID: SORBI-28MAY03-C88068_1.pep
MAKARKQKGDGGGAGAGATVLHQKLCLSIDMENQLIYGYTEIKVLLAENDTFALHADNMTIRSILVDGETVEFDYSPHWKNESDQPNWSSISCLKTAADAACSTYTSSLNREATPNLIVSSERSVKSMTEQQLDENSEKHEEISGRLEEHGAKPVQSSYDQILNGCNGSAVEEGIENSAGK

SEQ ID NO: 36319 - protein, 91 aa, Sorghum bicolor
  Clone ID: SORBI-28MAY03-C8722_1.pep
EEGKGSSWGALFKKQQRKIQVNGISDDLLRKAARKIDGFSGREIAKLVASVQAAVYGRPDCILDPQLFSEVVDYKVTEHHQRIKLASEGMV

SEQ ID NO: 36320 - protein, 131 aa, Sorghum bicolor
  Clone ID: SORBI-28MAY03-C87289_1.pep
MRPAATAAADAHQSRLLYELCALLLTVLRASPDDGAVARPLLPRQVTPAGVASMLLGASMALMLCGSVTFMLGFFLMPWVVGLGFLFLFVGFVTNLSGIWRAILLWPSAADSPKEASSPWHIFSKPSFMSM

SEQ ID NO: 36321 - protein, 84 aa, Sorghum bicolor
  Clone ID: SORBI-28MAY03-C87373_1.pep
MVEPIRTMQIRPVLAQIITLGMILTSALIIWKGLIIVTGSESPVVVVLSESMEPGFPRVHSSFAQYNNQHSFVQLYILHLTESP

SEQ ID NO: 36322 - protein, 58 aa, Sorghum bicolor
  Clone ID: SORBI-28MAY03-C87392_1.pep
LQTHTPQQFLIFFSTCLIHGCYIFRKCWAVFDFSLWKVVLHITWWVYSNVGKPLLLVF

SEQ ID NO: 36323 - protein, 109 aa, Sorghum bicolor
  Clone ID: SORBI-28MAY03-C8739_1.pep
GAVAGSFRGRGRLSINEPIKDYAPPQNGINRNFDHVDIPNTESVVTEVERVLSNPNMPEIEKARKLLKDQEQSLLDAIARLDEASDSDSEDMAMEGRMGSAGERNGIAT

SEQ ID NO: 36324 - protein, 91 aa, Sorghum bicolor
  Clone ID: SORBI-28MAY03-C87425_1.pep
LFRRRARLLCRKCGGRIGNAYEEEDDARDYSSSSLFDGDGDGSSDDMRRSSGLGSGRSSIVSSSQKNYVIKISALQPSSDDSAAVVPFTHR

SEQ ID NO: 36325 - protein, 184 aa, Sorghum bicolor
  Clone ID: SORBI-28MAY03-C88313_1.pep
ARRTWFGFSRLLPPTLPVIRIPRGAGPGPARAARGAVALLCFLVSCAALVESRGGSSRRPSRHRQDLDVGLGSGGGGGGIGIGIGIGGGGGSPSPPSSSQPRPCDFENERLYRAYLVIQQFRSTVTCDPMDVTRSWSGTDLCGGYKGFFCERPPNVTDRTIASVDFNGYMLRADSLQGFINNLP

SEQ ID NO: 36326 - protein, 184 aa, Sorghum bicolor
  Clone ID: SORBI-28MAY03-C8841_1.pep
MENLHLAIAHRPPLPVPAAGHLRRRHLHLHHLPAPLSLPSTSHSLSSPHHHRLTPTLRRHLRPPLRVSQTPDANPEPEPEPEPKPEPTGAKLVPFVISIAVGLAVRFLAPRPVEVSPQAWQLLSIFLSTIAGLVLGPLPVGAWAFLGLTAGVATRTLPFAAGFSTFTNEVIWLIVISFFFARGF

SEQ ID NO: 36327 - protein, 194 aa, Sorghum bicolor
  Clone ID: SORBI-28MAY03-C88428_1.pep
MAARPVALLLLVLVSGGLAASSSAGATQFKVGGQNGWGVPAAGAESYNTWAGRLRFQIGDQLLFVYPKETDSVLLVDAAAYNACNTSSYITRFDDGSTVFTLDRSGPFFFVSGNDASCRANEKLIVVVLADRSGTRTPPAAPPTSPPTPLPSPPSSPPAPATSPSSSPPSGSAAPVPAPAATPTSPPSPAASAP

SEQ ID NO: 36328 - protein, 186 aa, Sorghum bicolor
  Clone ID: SORBI-28MAY03-C88449_1.pep
MVVNGRPLKRARARVEATDFARFPAAGDCGAAGTFREAVRGFLAKHARLLPLPSIFSPAAAAAPPRLLIWRVSLRVGEAGEEESGGRVELNVVEEDVLRSRSVYCDQRRVVGWSGHPVCVKRYHFIIENDSLSDRRRTCCLRCGTPMAAGESRCALCNFDMDGEEVEECAYLHLDDSSHLLHAVVH

SEQ ID NO: 36329 - protein, 208 aa, Sorghum bicolor
  Clone ID: SORBI-28MAY03-C88467_1.pep
MHRFFLLVSALVAIATTTLSADTTSTIAAAQSQRSWAELSGRDNWDGLLDPLDADLRRAVIRYGELAQATSDAFIGDPASPYAGASRYAPGAFPYRTQAPGGSDPDAYAVTRFLYATSSARVPVPDTFITRPAPPGAWSAESNWMGYVAVATDAGAARLGRRDIVVAWRGTKRAVEWADDLDITLVPATGVVGPGPGWSQPAVHRGFL

SEQ ID NO: 36330 - protein, 87 aa, Sorghum bicolor
  Clone ID: SORBI-28MAY03-C87776_1.pep
RFQLNKKKRFAGHIVAGYACQVNFSPDGRFVMSGDGEGSCWFWDWKSCRRFKTLKCHNGVCIGCEWHPLETSKVAPCGWDGVIKYWD

SEQ ID NO: 36331 - protein, 158 aa, Sorghum bicolor
  Clone ID: LIB3481-057-Q6-K1-E11.pep
MLKKLLPKTKSKRRGGAASSAIPTLDRLHETLEMLEKKERFLQKKCSAEIEKAKDYTKSKNKNAAIQCLKKKKLYETQIEQLSNFQLRVHDQIIMLESAKATTDTVDALRSGSSAVKAIQQSVSIDDIESAIEEANEQTENMREIQQALATPVGASAD

SEQ ID NO: 36332 - protein, 90 aa, Sorghum bicolor
  Clone ID: LIB3476-053-P1-K1-G1.pep
MLKKLLPKTKSKKKKEAASSAIPTLDRLHETLEMLEKKERFLQKKCSAEIEKAKDYTKSKNKNAAIQCLKKKKLYETQIEQLSNFQFRVH

SEQ ID NO: 36333 - protein, 136 aa, Sorghum bicolor
  Clone ID: SORBI-28MAY03-C8780_1.pep
AAEPKVASEFPLTLTKEAVDVPSVAIPAKQPGKDLVLLIEGIEYDPQINNKFDVIINVPKEDAGKVGPKDCEYAGSFTAVPSSNAAGGTLVGKVTLFIDGVLADLGLTNESAVDIVLVPHTDEEIKIYLPPTIENA

SEQ ID NO: 36334 - protein, 235 aa, Sorghum bicolor
  Clone ID: SORBI-28MAY03-C87932_1.pep
EPQRHGNQNQPTTVRTTQEGAQCRRGGGGPGRATAGSTRPSTTSPSWATRRATLRPSSLISSRCTGALMRGPYWRKVAPTRLCKRGSSRSRRRRRRRRTSSCCWSITNSRMASKWRMSFLSTKNQQQMRKRKTLCSLNHKIPYQFQMRHQQRLSQQIRKWKTLCSSNRLLVKLHWHLMLLGLAQGDPAMDGLVSQKMRKRNNLLVKNMRCMFQVQESKPSRWAADTNLSRSMMLH

SEQ ID NO: 36335 - protein, 133 aa, Sorghum bicolor
  unsure (1)..(133): unsure at all Xaa locations
  Clone ID: SORBI-28MAY03-C87971_1.pep
MARGIARAVSFGGRATTGWCSYRRVTVAVCLGNLVAALLVLRSLTAPASFAPTAPNRVEVVQYTEEQIRSVEESIRIRREAEPVELVLAVKKLRKKFAQEEKRRREELPLVLKQKVSYDIVRRLHDLXDNGSL

SEQ ID NO: 36336 - protein, 78 aa, Sorghum bicolor
  Clone ID: SORBI-28MAY03-C88651_1.pep
VRGLSLDEWHHQSWISIRSHVCLMSRQPRYICIELPNDVQELWTLTATSRWNNLMTLSHNSSFPLGHDDKHVCQVPCP

SEQ ID NO: 36337 - protein, 94 aa, Sorghum bicolor
  Clone ID: SORBI-28MAY03-C88674_1.pep
MELVEVGPSMDLVVRRHRLPVESLKKEAMKTAEHAKKMKNVTKDPVKGKLGKVYMPDQQVGKLTLSNDVKGLKRERREAKKNNEDSKKQKVNPE

SEQ ID NO: 36338 - protein, 227 aa, Sorghum bicolor
  Clone ID: SORBI-28MAY03-C88709_1.pep
LNDTQKCKKKKKKKNKTREQQELLPDLDSTAAAEAEGQVEAKGNEVEEHEATDATASAMEGTPKCNEEDSKMKVSLMPEKEANTIVVPVLESTPKHKKRKKKKNKMQGQLDSAKASPSVVAVDITMAARAENGCTDVVGASGHADVNMDPINGDDQSSAQSKANDSDVLLKNKDGNKVNKNCAEYSGLLQESSARRKRRKGKRKWASDNGGPGFSSGNKNCAEYSEL

SEQ ID NO: 36339 - protein, 205 aa, Sorghum bicolor
  Clone ID: SORBI-28MAY03-C8872_1.pep
RTRVCIGGVEGLQTCLVGLLSMSRWFKPAAGSFVKVPFFGAVSYLTLAVCPFCIVFAVLWGVYRRLSFAWIGQDILGITLIVTVIQIVRIPNLKVGSALLSCAFLYDIFWVFISKMIFHESVMIVVARGDKTDEDGVPMLLKIPRMFDPWGGYSIIGFGDILLPGLLVAFALRYDWAAKKTLQSGYFLWSMVAYGSGLLITYVAL

SEQ ID NO: 36340 - protein, 208 aa, Sorghum bicolor
  Clone ID: SORBI-28MAY03-C8876_1.pep
PTRPVGGNGEFAPDGNGEKQKGSPGGQVPRLNEATGAEHELPFEFHVLEVALEVVCSSLDLSVADLERHATPVLDELTKNVSTRNLERVRSLKSHLTRLLARVQKVRDEIEHLLDDNEDMEHLYLTRKQVQNQQVEALMSSAASNSIVLAGTGVPRLNSSFRRSMSIATSMHLDNDVEDLEMLLEAYFMQLDGIRNRILSVREYIDDT

SEQ ID NO: 36341 - protein, 318 aa, Sorghum bicolor
  Clone ID: SORBI-28MAY03-C88181_1.pep
MSMGRFVNSMDPRSGLEVIRDWNGVAQVVLRSPKGASARVSLHGGQVVSWRNDRGEELLFTSSKAIFKPPNAMRGGVQMCFPQFGYSGTLERHGFARNRIWALDDEHPPLTHNDNGSKVSVDLILKPSEDDLKCWPHCFEFRLRVSLSKDGDLSLISRIRNVNGKPFSFSFAYHTYLSVSDISEVRIEGLETLDYLDNLSHKERFTEQGDAITFESEVDRVYVSSPNVVAVLDHEKKHSFVIRKEGLPDVVVWNPWEEKSKTMIDLGDEEYRQMLCVDAAAVERAITLKPGEEWTGKLELSAVLSTNCSDHLDHPVSI

SEQ ID NO: 36342 - protein, 77 aa, Sorghum bicolor
  Clone ID: SORBI-28MAY03-C88185_1.pep
KWELYSTKHQTDNKRMSHLGLTTARCKPSLALRILPQRLKLHTLENKELHMNKGNIFTLGDEPNKIVSKLKCTNSMP

SEQ ID NO: 36343 - protein, 188 aa, Sorghum bicolor
  Clone ID: SORBI-28MAY03-C8819_1.pep
PTRPAAAALSNMGNFLTEMSSDSYQLLGMAERGMLPDFFAKRSHHGTPLIGILFSAFGVILLSWMSFQEIIAAENYLYCFGMILEFIAFIKLRVTHPNASRPYKIPLGTIGAVLMIIPPAVLIIVVMAIASYKVMAVSILAMVIGFVLQPCLGYVEKKRWLRFSISADLPDLPDAQETAEDDAVPLVF

SEQ ID NO: 36344 - protein, 116 aa, Sorghum bicolor
  Clone ID: SORBI-28MAY03-C882_1.pep
NGHTLTVKVVSATRVRGRARPGAPAAVPSRAPRIAECLVGDETGAIVFTARNDQVDLLKPNATVMGRNAKIDMFKGSMRLAVDKWGRIEATEPASFTVKEDNNLSLVEYELVNVAE

SEQ ID NO: 36345 - protein, 200 aa, Sorghum bicolor
  Clone ID: SORBI-28MAY03-C88277_1.pep
MAADDKTGRRHHHFLVVAYGLQGHVNPGRALARRLAQLDGSITATLSVPVVTYRRMFPSSLLDSAAAVAAEEEMTTDGVISYVPYSDGLDDGSLSWPTDAESRARRRRASADSLSAIVARLAGRGGGHPVTCIMCTMVLLPVLDVAREHGIPLAVYWLQPATVLAIGYHFFHGLGELVAAHAMEPAYEVLVPGLKLNRPL

SEQ ID NO: 36346 - protein, 204 aa, Sorghum bicolor
  unsure (1)..(204): unsure at all Xaa locations
  Clone ID: SORBI-28MAY03-C88284_1.pep
ARGQPARLPLPPPRRPPPPAPPPSPPGPARPPRPPARSSLAPPAPSRLPRPPLSPPAAPPPAPPPQXGPAPPPPPAAXPAPGRPPRPPRRARPRGPPAGSGLAAPDASPVPQPPRAPRAAPTSASSAAAPSGLRPGARTAGPCPSADDCSLLLTALPSCAPLFPVPDPGLPKAAGGPAPTAARSDSRLSNDLVKAALIRWPTCR

SEQ ID NO: 36347 - protein, 62 aa, Sorghum bicolor
  Clone ID: SORBI-28MAY03-C89062_1.pep
MFTGYLVGFSMFKALFNNSAVLSAAGGILGLVGGMLVETVLFIIRSSSKELPSSVPRSKKDQ

SEQ ID NO: 36348 - protein, 91 aa, Sorghum bicolor
  Clone ID: SORBI-28MAY03-C89076_1.pep
QVDRGDALPLGAPALMVSPQAVEPGRARGELVRARDERYRVDSSAGGLKAARVEMDEPEWINPNADYWRLHRKGFAVDVVPAEMKRHAPFP

SEQ ID NO: 36349 - protein, 160 aa, Sorghum bicolor
  Clone ID: SORBI-28MAY03-C89090_1.pep
ESSIDKSPYVNFMEDGMVAAVTNDSPNNGDSLHNEISGEIELNDSMVVQHVQHNQNTGAIQNESDSWADDKNSSEGNAMTVQAHGGSQEQREEPYANKICEAIGPVKKSINQLSRTQGRSVWLLAYIALVTSWPLLGALGFYFFRKRSSNSLLARKLKKL

SEQ ID NO: 36350 - protein, 98 aa, Sorghum bicolor
  Clone ID: SORBI-28MAY03-C89123_1.pep
TVRQAVRNRQLESKLDLTETIKDGARMFLIDAGIRRQLILAFTEDSKLHVEELVDVYRLVEDQIDMPSVALEVLQDLPSVARDFMLSWSDSILSDRQY

SEQ ID NO: 36351 - protein, 269 aa, Sorghum bicolor
  Clone ID: SORBI-28MAY03-C89136_1.pep
CKVCKDEQGCICSISYHERMCRVIVELAIPCVKSGPRVFKGFTVGFHPRSSEIVYNGFTQFGFEQPHHGFSFQTEQIHVSLYLSAKSSLSGLIGKPTFKVNPVKGLGVTLVGFNGAMPSTLSPTVLNVNWRCEIARTNPYEVNIFIPVEGYDPIEFTLTKKCGYIQEKESDPMKGWAIFGIVSCMFIVLSSLLCCGGFIYKTRAEHLYGLDALPGIAVLSAFLDAVGRPRGYLPADNPSENHASHTSWEHAAGTTQVAQRTNDMAYGTT

SEQ ID NO: 36352 - protein, 324 aa, Sorghum bicolor
  Clone ID: SORBI-28MAY03-C88480_1.pep
RDMLWAVLLHGPLQKMEPAEANKKQREILQMRRTILMETKMCPACSGSPLEPCPPRFRSLLAKKPRPDEEDKAGSKSSREEVNEFMAILRSECWKEIATDDEAMVADARSSEHKLKRSREDGKRSSSRPEEKKKAEGDDKEGSRSSKKKAKRSNEVEGSGLKEAEMERSRSIDEVLFEGIFESGCGDLKTKVHFRRVLKKTIESKPPVKIEWEPMKEDIELAGGEWKTKMVTQRLDKGCVDRLINRPCPEPVTYNKCFTSRDAFDALANLDKVHRLFHWYLRYQSIIKGYAEYQKEVTDGVGNDWGMYAGYHEEVTDGVGHDWK

SEQ ID NO: 36353 - protein, 66 aa, Sorghum bicolor
  Clone ID: SORBI-28MAY03-C88488_1.pep
GVDDVTGEPLIQRKDDTAEVLKSRLEAFHRQTEPVIDYYSKKGLVVNLPAEKPPKEVTVEVQKALS

SEQ ID NO: 36354 - protein, 57 aa, Sorghum bicolor
  Clone ID: SORBI-28MAY03-C88529_1.pep
LGHPSVVVFLIARLWSINFFLDSSVNLSLSLSGFWELVVAVAMLNKTHPLLIIHSIL

SEQ ID NO: 36355 - protein, 152 aa, Sorghum bicolor
  Clone ID: SORBI-28MAY03-C88553_1.pep
MEVEMEVEMGTDPNPNPNPNPNTSPSAADDAATASGEAKACADCHTTKTPLWRGGPEGPKSLCNACGIRYRKRRRQALGLDAAAADSQQDQQQPKKKATADPQQQDQHHLRKKAADPQQQDQHHLRKKAAAAATTDPQQQDRKKAAAASSTN

SEQ ID NO: 36356 - protein, 192 aa, Sorghum bicolor
  Clone ID: SORBI-28MAY03-C88514_1.pep
MSSSMAFRAAAGRLRAAVLRRYARPIIAPAAFSPSRSAATTTTAGAEHHRAGTGTGGGGNNNKQVPPRGDYVPVYVALGLIALSVTLGLHTARQQLAHAPNVWVDKKKREAVPEVAAPELALGDAERFVDRSLFRKVAHVQDDRSLAAGVADPVAEYPTKKAVTLKDVGVETPGIEQSREGVLDKIFKKNHA

SEQ ID NO: 36357 - protein, 163 aa, Sorghum bicolor
  unsure (1)..(163): unsure at all Xaa locations
  Clone ID: SORBI-28MAY03-C89261_1.pep
MELELGLAPPSARHPIPMTIDHLTAEDELSSTSSDHHHHPCAARAGKRAFAEAFQEAAATTTXTLPLFDDGSSCGGTNGSSSKRPLVGWPPVSSARSRACGVGGAKYVKVKKEGDAIGRKVDLSLHASYDELLATLSRMFPTTGCNKGRYHCSLLVHQISGDL

SEQ ID NO: 36358 - protein, 283 aa, Sorghum bicolor
  unsure (1)..(283): unsure at all Xaa locations
  Clone ID: SORBI-28MAY03-C8928_1.pep
QQVAELASXLAVEEAAYRDVQERKVELHDALIKMVQGGSVDGLLQVRADRIQYQLEEMEKALSERCKHFGLQFKSSASVELPSGWEPGPQEGLIEWDEDWDKFEDEGFSIVKDNGTIQENPVSAENGKVPSLWDDGDDMSPVASSNGHIKEERRYSGGDQVAESEIAYDFGDESVRSPGSAGRSASGSPFKSSRFGMHDSSPSKRESYSDHGGSESVFGDKFADETSWNFDDQDTDSVWGSTALNTEADQHGGTHSSFFGSEAGSSSGASVFGKKRSTFFDGS

SEQ ID NO: 36359 - protein, 159 aa, Sorghum bicolor
  Clone ID: SORBI-28MAY03-C8938_1.pep
MQRLARVLVVLVVAAATASAQGPTAAPATPTPATPAAPAPKAATTTTTSSNITGVLAKGGQFNTFIRLLKSTGVASQIDNQVSNGGNGITVFAPTDNAFTSLPAGTLNSLSDQDKNALVQYHVVSTAIPMSQFDTVSNPLRTQAGSASPGEYPLNVTSE

SEQ ID NO: 36360 - protein, 158 aa, Sorghum bicolor
  Clone ID: SORBI-28MAY03-C89439_1.pep
ASSRGSTGATSKMSSLNLKSNHGNRKGTKDTRTQAHRTRFDPIYALMINWLVDFLWWKVSTHIIDQTNTKRTNRCGLNNESRLKQEGKRQDRKQDKHNLKKTQIFCQIPKDTRRIRDLLSQTKSRFLHKFTICGPLPLKKTRGRKHRVDGGKKVEDIQ

SEQ ID NO: 36361 - protein, 130 aa, Sorghum bicolor
  Clone ID: SORBI-28MAY03-C8947_1.pep
QDSRTDGLVERVVVGQLWPSVLSRERLPPAAVLVDALLLLLVHHCSCLVHAIAGPCPLQVAQGIMGRSWLLLLLLLRQRVMWFLLRLLLRQRVMRLRCKRRHSQRVEGLRVHIKHVRLERRQLLADTGVF

SEQ ID NO: 36362 - protein, 88 aa, Sorghum bicolor
  Clone ID: SORBI-28MAY03-C89493_1.pep
MARAGGGGLLVFLLRGAALVTVAAVLLGGMVGAARAAQLRQNYYGSSCPSAESTVRSVISQRLQQSFAVGPGTLRLFFHDCFVRGCDA

SEQ ID NO: 36363 - protein, 213 aa, Sorghum bicolor
  Clone ID: SORBI-28MAY03-C88719_1.pep
MALSAARRLSTTTSTSSSAAAAAAPPKLSSLFRNPKPRPRPDPGVDAPRRGPRPKPRQPWEEEAGALLRRLHEGGYLPGPDLSSAPHAASPDSVKTAAERFGHDHQPVAKWLSGSDLKKVALFGCPTVERRTVFASERLRVFFNLQEDKICSSCKLRSSCKFVNQEVVRHNKVILSDTMRIISLFVLDACAQQLQVTAELKASVCKLLKDTIN

SEQ ID NO: 36364 - protein, 252 aa, Sorghum bicolor
  Clone ID: SORBI-28MAY03-C88831_1.pep
QLTPNNTIQLLPVPANSSVKDSLTAMARALVLVAVLLAASAAGSTTATTLTIHNLCPHPIWPLVTPNSGLPSISDNTARLDPNALLSLSFPPTFWAGRVAARTGCDAAASGCWTGAAPPATVVQVTVHDGGDLDQAAYSVSLVDGFNVPVVVSPQAIAGGGQCPALGCPVDLNCDCPPAQRAAEGVACRGPPEYFKNRCPLTRTMPTDVEPVPQSCRGPGELKVVFCQATIVTGAAGAGEAEMVIRSVVADS

SEQ ID NO: 36365 - protein, 107 aa, Sorghum bicolor
  Clone ID: SORBI-28MAY03-C88880_1.pep
MDSRSMATSGAGVDAAGGVAPFVAKTYRMVDDPATDAVVAWGRDNNSFVVADPFVFSQTLLPAHFKHSNFSSFVRQLNTYVRARACSCQGFRKVDPDRWEFAHVSFL

SEQ ID NO: 36366 - protein, 289 aa, Sorghum bicolor
  unsure (1)..(289): unsure at all Xaa locations
  Clone ID: SORBI-28MAY03-C88933_1.pep
SFPVHPLLWLCPVAAISFPISVPVPVPIPPRAAAPGRPPPAPPLRRHAPRLPDLPRLLPALHRSLAPCHPAPRPPALTDVIRALGEEGLPRHALAAFHRMRQLRCAPDAQCYNTLIAALCQNGRFRDARFLLDQMERPGARCXLCKTYRVDRAHEVFDEMLRKGCAPNRVTYNSFIRYYSVVNQVDKAVEWMREMIARGHGTASTSTYTPIIHSLCESRRVMEARQFLIDMAECGHVPREHTYKLVKSAIDDAREDALPAELCQSIEDGITARFRQVMQIKPIMRPVTR

SEQ ID NO: 36367 - protein, 137 aa, Sorghum bicolor
  Clone ID: SORBI-28MAY03-C89013_1.pep
GTHSIQLTEEHTLCSSLLYSGSTSGLCKLDHQLDSRRRPAVGVVHARRSIECAPLSGGGRRARLLTARRCLGTRSEAGGGRGGARGREARGRAYVVRGQLAGAVSRRRRCVAPPAAQRSLGARAQAGGGFGGPSAQL

SEQ ID NO: 36368 - protein, 166 aa, Sorghum bicolor
  Clone ID: SORBI-28MAY03-C89779_1.pep
MAASHSHGAGTLKSTAINGVKLYSLTGSRYVAPWVVAKKKRALRKDKEYQRRLDLIHDLRFETATTKIKLTPDDQYVIASGIYPPQVKVYELKELSMKFERHLISEIVTFQILGDDYSKLAFLCADRSVNLHAKYGSHYSLRIPRMGRDMAYDCWSCDLLCAASSP

SEQ ID NO: 36369 - protein, 152 aa, Sorghum bicolor
  Clone ID: SORBI-28MAY03-C89807_1.pep
MAPPPPRLAALILLAALLLLLLAAGAAATGVFQVRRKFPAGVGGGASANISALRVHDGRRHGRLLAAADLPLGGLGLPTDTGLYFTEIKLGTPPKRYYVQVDTGSDILWVNCISCEKCPRKSGLGLDLTFYDPKASSSGSTVSCDQGFCAGT

SEQ ID NO: 36370 - protein, 233 aa, Sorghum bicolor
  Clone ID: SORBI-28MAY03-C89817_1.pep
RKKTFVGRINIPAVSSEDYYQEVTSLQLDEDQGYLMAVGTSTGKISIYDLRMSSPLRVKDHMYGSPILNIKWHQTLNSTEPKLITADKHIVRVWDPNTGNNMTSIEPDGGAINDVCIFRNSGLMLLALDNSQIPAHFIPALGPAPKWCSHLDNLTEEMEEKPDTTLFDEYKFLTKEEMERLNLTQYIGSSAVRAYLHGFVVRYELYKKQRAEVAPVEYETIKEEIKKKKIEAQ

SEQ ID NO: 36371 - protein, 133 aa, Sorghum bicolor
  Clone ID: SORBI-28MAY03-C89812_1.pep
GTSNNSTQDESNGKKGADQAADGEKKDDAPAPLESKNSKKKKSKKDRSSKEPKEAQDQANGLEDAAVAEPDEDTASVDVKERIKKVASMKKKKSSKEMDAAAKIAASEAAARSARLAAAKKKEKSPYNQQPVR

SEQ ID NO: 36372 - protein, 168 aa, Sorghum bicolor
  Clone ID: SORBI-28MAY03-C8988_1.pep
HRHGDDDSNTILESLLSYSDLKQSGSESSGSLGSLFDSDNEAHASAHASGKVINQDIKPELDSFSEKWSFLLRTMNFSQQEVDLAFKQLGDEAPLEQLVDFIVNAQSRVSSGGPENGDATNEGKTELLYGVMEKTLSLLQMGFTEEEVSSVLENSDQRATIQELADSI

SEQ ID NO: 36373 - protein, 259 aa, Sorghum bicolor
  unsure (1)..(259): unsure at all Xaa locations
  Clone ID: SORBI-28MAY03-C8914_1.pep
NRNSWQRLILLQLVQCMIXEFIVCSLDLLSGLAEGLGAGIESLVAQSSLRDLLLQCCMDEAADVRQSALALLGDLSRVCPIHLHPRLQEFLTVAAKQLNPQSVKDAVSVANNACWAIGELAIKIGKEISPVVITVVSCLVPILKSPEGLNKSLIENSAITLGRLSWVCPDIVAPHMEHFMQAWCSALCMIRDDFEKEDAFHGLCAMVAANPTGAAGSLAYICQACASWTEIKSEGLHNEVCQILNGYKQLLGNGGWNNA

SEQ ID NO: 36374 - protein, 140 aa, Sorghum bicolor
  Clone ID: SORBI-28MAY03-C89171_1.pep
MGAEPDFSLPPPEPTHSPEPEVSGKDSRNWKAEMMSALGESVSFGRFLTEPLEWGKWSTFAHNRYLEEAAVQARSGSVAQKEAFFEAHYARKKRKSEDHAAASDDVAGGDGDLEAAEDGGTASWLLSAAESSCMTDEPPA

SEQ ID NO: 36375 - protein, 207 aa, Sorghum bicolor
  Clone ID: SORBI-28MAY03-C89224_1.pep
LEILRHPNPASRPLRRASQSPPQITPGARGPGPTRPPRGNNKQAPAHQRERHRRTKRGAEASRERKRAGSPPPRAPRRPTPPRQWRSPPPPPLLPRRRRDPRSRRSGSTPRRASSAACRPRPRPRRRPSPRQSPLRGPAARPTRSPPSSPPSSLSGASGGGDRRNSRPTPLPPPLRRGGRPSRRRRRRRDSWWGVRCRCSGRTWRSC

SEQ ID NO: 36376 - protein, 138 aa, Sorghum bicolor
  Clone ID: SORBI-28MAY03-C89199_1.pep
MEAAVSSAGGESAGELLLRAAALVPWTRYVLAALALAAALLYRFLELHFLGDLLRGLRGGRVSLTFHPDSQVYHRVASKCRSLHGRYLATPWLASPHLQTLFLSISGRPPSFTYGRQLYTVRDGGTIALDWLLASDLE

SEQ ID NO: 36377 - protein, 135 aa, Sorghum bicolor
  Clone ID: SORBI-28MAY03-C8926_1.pep
MCGGAIIADFVPAGGRRQATDDTISASSLLSGEDQHLEELGSRVPAPGRKTAYRGIRRRPWGRWAAEIRDPRKGARVWLGTYATPEDAARAYDAAAREIRGAKAKLNFPPAVGAGAREPAREPAPTSSSAAAEES

SEQ ID NO: 36378 - protein, 100 aa, Sorghum bicolor
  Clone ID: SORBI-28MAY03-C900_1.pep
ISRTPDLRTKEHLQRTLLELLGVVADRRSGLPIATCVSSRDELDAVCAAVANLSFVSMSPLYSDQAEAERASVLEKFRQETIQWNQTTKATNIAESSRLE

SEQ ID NO: 36379 - protein, 138 aa, Sorghum bicolor
  Clone ID: SORBI-28MAY03-C90017_1.pep
AILSVGLGWGVQIGGELTDFIIVLHDRKAVKAFSSRIHLSLGAGLSAAAGPIGRAFEADVRASDKGSGICYTYSCSKGAFVGVSLEGNVVTTRMETNLRFYGDAYLTATDILFGRVERPRAAQPLYSALDDLFSKMVR

SEQ ID NO: 36380 - protein, 65 aa, Sorghum bicolor
  Clone ID: SORBI-28MAY03-C90028_1.pep
TKCDKRKKKKNGGRRPEENVETFQSLIREYFEAAPPWIMTSSVTNQGRDEILLHMSQLRNYWLKH

SEQ ID NO: 36381 - protein, 255 aa, Sorghum bicolor
  Clone ID: SORBI-28MAY03-C90052_1.pep
MGGGRKRGRTQRRHFKQGRENVWKHNPQRPPAGEGGEGREGNPSWQPFATENPSFEEYYKEQQIVPEEEWDSFMSTLRKPLPATFRINASCQFYQDICSQLENDFRKSLETEVTDEHEEDAIRPLPWYPGNLAWHLNFSRMQLRRNQALESFHEFLKRENEVGNITRQEAVSMVPPLFLNVQPDHHILDMCAAPGSKTFQLLEMIHQSTKPGVLPNALVVANDVDVQRCNLLIHQTKRMCTANLIVTNHEAQNFP

SEQ ID NO: 36382 - protein, 172 aa, Sorghum bicolor
  unsure (1)..(172): unsure at all Xaa locations
  Clone ID: SORBI-28MAY03-C9018_1.pep
MTSHEQRNHQLLTNPLVNFKQPKRRAEMVFQKRSSSEMESCGGGQVAEMPRVPKSARGKRSVRKKEAQSPAQMSAFDLLATVAGKLLDEGVGSLGNMSAGASALAACAKDVRVKQEQCDEEMXQFKHEVTDQDSCNESAILPHIAXQRAVNNARTEXPKAKSEAQDKGISMI

SEQ ID NO: 36383 - protein, 126 aa, Sorghum bicolor
  unsure (1)..(126): unsure at all Xaa locations
  Clone ID: SORBI-28MAY03-C89565_1.pep
VFPSVRLQQEVPLRPXXRRPVLRKTSTAPNIGLNNKAPLPPTGLLEDLISFAGDAGDNEGSGNANSQEGKVSSYEGDLMGLLYTPPDSVKKIDHMIETNLSGFSSHVNRCRLTVSGCSVSRRVHGD

SEQ ID NO: 36384 - protein, 175 aa, Sorghum bicolor
  Clone ID: SORBI-28MAY03-C8964_1.pep
QHTATISILLTNEVHRLKHSITGSPSILHNSTLQPTGIYVGLGQICYMTESQSERQAQLASHHNASETPISLGEDGLSSFTANGPKNVHLDTFDISAVWVTSVPVTVFVLEDHEAARPRVLLRVRAVEIGGWVPVTVRGLELLLRLHLGERHTLAGLLCCMFLWVFQRFLLFRIL

SEQ ID NO: 36385 - protein, 57 aa, Sorghum bicolor
  Clone ID: SORBI-28MAY03-C89679_1.pep
FHYVLGSLICTSSSWQIGSMRILLQLVFFMLTICPSQVSFRCLLLEQVSTTVADTVA

SEQ ID NO: 36386 - protein, 92 aa, Sorghum bicolor
  Clone ID: SORBI-28MAY03-C8969_1.pep
TLPGLLVVLAWPILVALISQGNARTSSKKPHWSSGSTGGFVHTKMQENEQSRRLLLELSWKPKPKSKRKRRRRRRRRASLPSSSPRGNGMGA

SEQ ID NO: 36387 - protein, 176 aa, Sorghum bicolor
  Clone ID: SORBI-28MAY03-C8974_1.pep
VLRGLRLSERLSSTQRQRQSQPSSQRLHPSSWLLPCCQELSICRRVCHPDPVLIDPAASAAEAPQKWTVPRPQPAAAAVLLLLRRRQRCRGAGAAGSSPGRVGATNIGRLRHGKQQHGTRPGVGVGISISVTSWHLRVFAAVVGLMGCLLLAASLAMSALHQVQFRNAAISRNFRG

SEQ ID NO: 36388 - protein, 140 aa, Sorghum bicolor
  Clone ID: SORBI-28MAY03-C90310_1.pep
TAGLTPLMKMHTLGHGFVPDPIHAGGLRYHGMAPLISHVYELGFMDAIAIQQTECFQAALQFARTEGIIPAPEPTHAIAAAIREALECKRTGEEKVILMAMCGHGHFDLAAYEKYLRGDMVDLSHPAEKLEASLAAVPKV

SEQ ID NO: 36389 - protein, 108 aa, Sorghum bicolor
  Clone ID: SORBI-28MAY03-C90367_1.pep
LRVIPGHHHSRLKHVKIIKFVAAKTLAELTCQILKSATSLECLTLDTTNGHPGCSVSKTGKCVMMSKDALVKAHEGVLAAQTCIRPKVPSTVGFSLLEPCSRCHAVGI

SEQ ID NO: 36390 - protein, 168 aa, Sorghum bicolor
  Clone ID: SORBI-28MAY03-C90368_1.pep
EYMCIPIYVDPSEHTEHKTRTSSFHVQITHVIISIYIYTSCLVMLAHSLSGSQACSVHLSILSHHAPSTGSKYLSFQSSDPWVGTPHTSARNVPSPATRSTRWYSIALALPSAGLVDADSTFSSLGTGLMSFHRLYTNTANVATFRQNASLSAAAEPPCPSSPAAPCC

SEQ ID NO: 36391 - protein, 256 aa, Sorghum bicolor
  Clone ID: SORBI-28MAY03-C9037_1.pep
PRRPRVRPRVRENTLVPHEWVNHRHSYWSSGGKDNPDAPESLTYRLSSDLCVIDEIRVRPYKAAFQLGHPIYSSKAVRIRLGHSKLDPGTETFVSAENENLTAIADENYTWTYTSPEFPMLQENVLQTFKLPRPALCIGGIVKIELLGRLQKQSTDDKYYICVCHVQVMGRSLSPDLMIDISDPADYSNLKYLPGAGNLRPEDLLSSDAKEDSSDWRSLVSRYRQMRQLAMVYMLLGPVQFADEEDEAEADMLHLL

SEQ ID NO: 36392 - protein, 145 aa, Sorghum bicolor
  Clone ID: SORBI-28MAY03-C90470_1.pep
MASKAIKRRPCSAETDKTGEKQMETTLSDPITESLLGNTQEEKSKIYEPITRSGFLDGTRKECLRWAHLLATFVAQSAGNIVNLLSEFGSWLARLFGCSASKSSQNGQTVALNLSPLQEERLRLLRQRIDVPYDCSSVKHQDALK

SEQ ID NO: 36393 - protein, 115 aa, Sorghum bicolor
  Clone ID: SORBI-28MAY03-C96293_1.pep
GARLAPERMVRRVFVFSDMEFDQASANPWETDYEAIVRKFTEAGYGAAVPEVVFWNLRDSKAVPVEAGQKGVALVSGFSKNLLKLFLDGGGIVSPRAVMEKAIAGPEYGKLAVFD

SEQ ID NO: 36394 - protein, 137 aa, Sorghum bicolor
  Clone ID: SORBI-28MAY03-C9631_1.pep
MSIMAWYPLPQSGGTPSAPGDEFFDDQLSAAGWPLWSFGSSADDDHHDSHGAGGAARAEKHGNDDAAGSSVEHTEGLPVPRQQRTQPTDDIFMSQFSDEEMRRMDAPFEALDMFPGSMHQLLSYENMLSGVLTGGSS

SEQ ID NO: 36395 - protein, 192 aa, Sorghum bicolor
  Clone ID: SORBI-28MAY03-C96335_1.pep
ARGNPSPLHPWPLLSSWSPPPPPRPSLSDSAMATSSALLFPSPSSASSPPSSARVEAVVLFNVCDSYVRRPDQADRVIGTLLGSLLPDGTVHVRNSYVVPHSESADQVAIDIDYHHNMYASHQKVNPKEVIVGWFSTGFGVPGGSTLIHEFYSREVQNPIHLTVDTGFTRGEASIKAYISSNLSLGDRHLAA

SEQ ID NO: 36396 - protein, 149 aa, Sorghum bicolor
  Clone ID: SORBI-28MAY03-C96362_1.pep
MPFSSMIHEMKGEIGAISSRGLLRFRSGGHAAAAGRASAAAEPDEALRESCWARVPPELLRMVLARVEHEEARWPGRSAVVASAGVCRCWRAVVKEMVRVPEVSGKITFPISLKQPGPRDAPMKCFIRRNRATQSYSLCIGVTDALADD

SEQ ID NO: 36397 - protein, 209 aa, Sorghum bicolor
  unsure (1)..(209): unsure at all Xaa locations
  Clone ID: SORBI-28MAY03-C9634_1.pep
MPQGDHIELHQKRHGKRLDHEERKRKREAREVHRRSKDARNLLGAKGKRFAKKRYAEKAQMKKTLKMHDESNKRQKVDDDVQEGALPPYLLDRDQTQRAKVLSNTIKQKRKEKAGKWDVPLPNVRPVAEEEMFKVLRTGKRKTKLRKSMVTKATSXAAGSTRTPAKYERFIRTACHPLTKADDNHLELQCTFILDIIXVKKSSNGPMYT

SEQ ID NO: 36398 - protein, 151 aa, Sorghum bicolor
  unsure (1)..(151): unsure at all Xaa locations
  Clone ID: SORBI-28MAY03-C964_1.pep
GRSTEMFEECFQQRWYRTAACYILVIAKLEGPAVSQYCALRLLQATLDESLYELAGELVRFLLRSGRDFENATSDSEKLSPRFLGYFLFRSPYKRQSSDLRSNSMKELSPHIASVMNILERHACYLMSGKEXSKLVAFVKGTQFDLVEYLQ

SEQ ID NO: 36399 - protein, 161 aa, Sorghum bicolor
  Clone ID: SORBI-28MAY03-C9078_1.pep
MASSSDPDKLMSKADKLTKLSFTRWNADWKSATSLYEQAAIAYRFRKDNEKAKDAFEKASKGQEMISSPWDAAKHMESAAALAKDLGRWNEVSDFYHRASELYRECGRSQPASDALAKGASALEEKSPEEAIKMYDEACSVLEEDGKEQMAFDLYRAAAAL

SEQ ID NO: 36400 - protein, 168 aa, Sorghum bicolor
  Clone ID: SORBI-28MAY03-C90781_1.pep
LRRPPVTNLIRAFCRRPGMNCYDLLGSITGKNYCLNSSAVDVFLKYEPQPTSTKTMVHFAQTVRDGVLTKYDYVLPERNIASYGQAEPPVYEMSGIPAGFPLFLSYGGRDSLADPADVRLLLQDLRGHDRDKLTVQYLDQFAHLDFIIGVCAKDYVYKDMIAFLNRFN

SEQ ID NO: 36401 - protein, 48 aa, Sorghum bicolor
  Clone ID: SORBI-28MAY03-C90784_1.pep
IQDKEGIPPDQQRLIFAGKQLEDGRTLADYNIQKESTLHLVLRLRGGQ

SEQ ID NO: 36402 - protein, 133 aa, Sorghum bicolor
  Clone ID: SORBI-28MAY03-C90804_1.pep
CSAGQPSGGSSCMPPTAGCSVSLTCDQCPGASTAYPSVSNFMQAPTKVSTNDDQVAKAAMMTAEGAFNFMKSTISGLPGAQRNESDTGKEESTSMGMNPNLDSDLAALLNSWYAAGFYTCRYLMLQSAKNSRP

SEQ ID NO: 36403 - protein, 231 aa, Sorghum bicolor
  Clone ID: SORBI-28MAY03-C90848_1.pep
HEVESGCEPDVVTYNVKALYYMAHGKPEEVIEVMTEMEAAGLKPNTITYNYLMISYCKSGKLEDAKVLYHSLAEKGCSADAYTYKHMLAELCAHGDFDAGLGIFKDSLKKRKVPDFRTMKRLVEGLAKGGRVADAKEVIAEVKNMFPENLLSGWKKVEKELGLDSDSGGTPQSEVTSGETVAEVRPDAAETEALELEGSATEETAVSEESSDDEASVPEASSSEEVPEGRA

SEQ ID NO: 36404 - protein, 143 aa, Sorghum bicolor
  Clone ID: SORBI-28MAY03-C90068_1.pep
LSLAVAGRERSPPIRAGVGAVLTGGAGRLGLDMRWLLPSNGLAGVVTAGVVSGGAVAPRAPGLSFVVFLLLVVSVPSCAPRSPGFLEGTVGLREILANNARPAGSRWCGQHPVSCRPLLLAARVPVPRIETMNKHITEAYDEA

SEQ ID NO: 36405 - protein, 132 aa, Sorghum bicolor
  Clone ID: SORBI-28MAY03-C90188_1.pep
LGLPPHCDRNLITLLLQGSVAGLQVAYRGDWIRVQPVPGALVVNFGHQLEIATNGLLKSVEHRAAANAAVARTSVATFIMPTDDCLVAPAAELLAGDLGGGARYRAVTFREFMRVYKTVGARRESVEKAFKI

SEQ ID NO: 36406 - protein, 180 aa, Sorghum bicolor
  unsure (1)..(180): unsure at all Xaa locations
  Clone ID: SORBI-28MAY03-C90209_1.pep
MDGQGTKHRILMVSDFFFPNFGGVESHIYYLSQCLLKLGHKVVVMTHAYGNRSGVRYVTNGLKVYYVPWRPFLMQNTLPTLFLTFPIVRTIIIREKISVVHGHQAFSTLCHEALMHARTMGXTLADIDQAICVSHTSKENTVLRSGISPEKVFMVPNAVDTAMFTPSPKRLSCDEIVIVV

SEQ ID NO: 36407 - protein, 170 aa, Sorghum bicolor
  Clone ID: SORBI-28MAY03-C90359_1.pep
LAYPNRQLPPLKSDLWKEMGWQNSDPSTDFRAAGFMSLENLIYFARNYPDSFHRLLHKADGKRAEWEYPFAVGGVNISYMLVQMLDLQSGKMRTKAGVHFVQLLEDDDVAFDNLFCLAFKVLDSQWLARRASYMEFNEVLKSTRVQLEQELTIGGISRIQDMPSFRLLKK

SEQ ID NO: 36408 - protein, 166 aa, Sorghum bicolor
  Clone ID: SORBI-28MAY03-C90226_1.pep
MASQGEPSASASDPKEKKDYSTAILERKKSPNRLVVDEATNDDNSVVALHPDTMERLQLFRGDTVLLKGKKRKDTICIVLADETCEEPKVRMNKVVRQNLRVRLGDVVSVHQCQDVKYGKRVHILPIDDTVEGITGNLFDAFLKPYFLEAYRPLRKGDLFLVRGGM

SEQ ID NO: 36409 - protein, 212 aa, Sorghum bicolor
  Clone ID: SORBI-28MAY03-C91018_1.pep
NGGGTGEKTKTKATGGLTGREPSSSSHASKRRRGLRGESMADRFFPNDFPDFVAEAEASDGDGEGHRPAGLRGLLELPYTRLCDRLLRAARRLKDKVVEETWLKAGRKVTDYTLYTGSLGTALLLFKSFQVTGDRGDLALAADIVRACDEASRGLPFLTFICGRAGVCALGAVIAKHCDDQLRVTQYLSSFDEITVTEKVPNELLYGRVGYL

SEQ ID NO: 36410 - protein, 178 aa, Sorghum bicolor
  unsure (1)..(178): unsure at all Xaa locations
  Clone ID: SORBI-28MAY03-C91233_1.pep
MIVLAALQVFLRXLTRVNVTILFLPMLSRAISSRSSPAVIGNIVLVLVNSCGVLGSALSVKQLGREVTFAISAIVMVICQVAIPLILEVQIGVGGGTRMPMGYTTAMFVLTCVVSCGLSWSWGSFFWTFPGRKVHSAGQVLAMAVNLGVCFAQMQYFLLVLCRLKNATLAYYALWIWS

SEQ ID NO: 36411 - protein, 148 aa, Sorghum bicolor
  Clone ID: SORBI-28MAY03-C91243_1.pep
KKPRKKKPGSDLSATEGFYYYAGFGPFRSKRQCRSGGTNMKWPQDEEDDAKDDASPSEQQAEVDDGHDHTNQTVAAARGDASSCEDDTAGIAGVDEGSSDDDFDGLGISGHGMNGNGDSKASNGDGKRKIPWKRWRKPVKARSLKSLM

SEQ ID NO: 36412 - protein, 122 aa, Sorghum bicolor
  unsure (1)..(122): unsure at all Xaa locations
  Clone ID: SORBI-28MAY03-C9128_1.pep
MAAGTPEEQQQQQRSVVVRETVELTETEERIFNRLLEVVRHFGLGTQLRVAGGWVRDKLLGKDSADIDIALDNMTGQNFCEKVNEYSKLIGEQQKGNCVIQCFXSNPDQSKHXETARXAILD

SEQ ID NO: 36413 - protein, 219 aa, Sorghum bicolor
  Clone ID: SORBI-28MAY03-C9049_1.pep
LMTSFVVGFIIEWRVAIPTRPPTRPLVLANFAQQLSMKGFAGDTAKAHAKSSMVAGEGVSNIRTVAAFNAQSKILSLLSHELRVPEQQILRRSQTSGLLFGLSQLCLYSSEALILWYGSHLVRSHGSTFSKVIKVFVVLVVTANSVAETVSLAPEIIRGGESIRSIFGILNRATRIEPDDPESERVTTIRGDIELRHVDFSYPARPDIQIFKDFNLKIH

SEQ ID NO: 36414 - protein, 110 aa, Sorghum bicolor
  Clone ID: SORBI-28MAY03-C90571_1.pep
MEGRSGAWRLQQQQRGPGAPVAGLPIGFRFRPTDEELLLHYLRRKALACPLPAGVIPDADLARLHPWDLLPAAVQGAADADGERFFFHRPATRCWRKGGGAARAAGTGVW

SEQ ID NO: 36415 - protein, 100 aa, Sorghum bicolor
  Clone ID: SORBI-28MAY03-C90581_1.pep
MGRRSSRACSLLGSAQLLLLLLSLALGSAAAQKGSTWKTLSGKAPVIVAKGGFSGLFPESSLYAYQILGSLSSPDTVMWCDVRLTKDGGGICLPSIDMDN

SEQ ID NO: 36416 - protein, 199 aa, Sorghum bicolor
  Clone ID: SORBI-28MAY03-C9061_1.pep
EARVPFLDKSFINVAMDIDPEWKMIKRDLGRIEKWVIRNAFDDEERPYLPKHILYRQKEQFSDGVGYSWIDGLKDHANQHVTDSMMMNASFVYPENTPTTKEGYYYRTIFEKFFPKPAARSTVPGGPSVACSTAKAVEWDASWSKNPDPSGRAALGVHDAAYEDTPGEAPASADPVSDKGLRPAIGESLVTPVASATAV

SEQ ID NO: 36417 - protein, 169 aa, Sorghum bicolor
  Clone ID: SORBI-28MAY03-C90654_1.pep
MATTSARTHGHQQQYGLRQDPLRRMRGLDAKSSLQASPRATTVATAALLVPLGAALLGASGLALAATVTGLAVVTPLLVILSPVLIPFALAAVLIASRLLASGALSVAGVSALTWAIGYVWRWQGEGEGGVTGMVVQPLNHGLKRHGVEGTAAFVGHRPLPRDIDVASA

SEQ ID NO: 36418 - protein, 245 aa, Sorghum bicolor
  unsure (1)..(245): unsure at all Xaa locations
  Clone ID: SORBI-28MAY03-C9067_1.pep
TRQDAICKNTALQFKYVTWQLQAALANLPHSCFQISDEVQEEVDLVRAQLRREMEKKGGFDVTVFIKVHDILAQIDNTAPQSQQPHQQPEQSQMEKFSNDHLELQNVVSLVSEISGLSKSDMTKITSELIEGLQNVETPESPKPDNVDSQSSDETKSSSGEVKKPDSVAIPEDFRCPISLELMRDPVIVSTGQTYERAFIQRWIDCGNRTCPKTQQKLQNLALTPNYVXRSLILQWCEEKGIEPX

SEQ ID NO: 36419 - protein, 164 aa, Sorghum bicolor
  Clone ID: SORBI-28MAY03-C9150_1.pep
PVRKAFIKMSIQLYNYGEGLMGKVASDKCHKWVFKEPSECEPNISNYWQSSFDALPPEWTDQFASSIQTIAVIQAGHGLLQLGSCKIIPEDLHFVLRMRHMFESLGYQSGFFLSQLFSSSRGASPTPPFPLKQQPPPAAARAPQQLFNWAGHHQPQLPPSPGAG

SEQ ID NO: 36420 - protein, 171 aa, Sorghum bicolor
  Clone ID: SORBI-28MAY03-C9161_1.pep
QTYVVNSSEVDREVIEEALSLSDPPLLTPQTETDGESTDDDCASFPTTGQTEFFFNRPKGLSLSMVLSTPLFITVPNVKEEGPKLYSDVDPKYVQRMVKEYLDARPCMNLRATSYNILAVEDPTDARAAEMGTESRLPNVITEQTSVAAAHPRMVPTESRHEVSAEEIIPT

SEQ ID NO: 36421 - protein, 179 aa, Sorghum bicolor
  unsure (1)..(179): unsure at all Xaa locations
  Clone ID: SORBI-28MAY03-C9162_1.pep
TRKLRKGVKEANEEDLETVLDKVMMLFRYLQEKDLFEKYYKQHLAKRLLSGKNASDDSERSMLVKLKTECGYQFTSKLEGMFNDLKTSEDTTQGFYASTSSELLADAPTISVQILTTGSWPTLTXTTCNLPPEIVPISEKFRAYYLGTHNGRRLTWQTNMGHADIKATFGNGSKHELNV

SEQ ID NO: 36422 - protein, 183 aa, Sorghum bicolor
  Clone ID: SORBI-28MAY03-C9168_1.pep
MMKSLLFSVHPTPPLLPTPRLRRLLRFRASSSASASASAPPRADRRSPRPAPSRRPSSSSLYARPSLLEMERERAARRADVDAFLTSLGVDPGELAGLELPVTVDVMRERAEFLGSLGLTREDLAAYPLALGCSVRKNMVPVLDYLGKLGVRRDALPDLLRRYPQVLHASVVVDLAPVVKYLQ

SEQ ID NO: 36423 - protein, 169 aa, Sorghum bicolor
  Clone ID: SORBI-28MAY03-C91870_1.pep
LVIVQMCDMMIDGDGNSVPLSEAQRKNVLGTISSFASDALRTLCLAYKEGDDFSDDTDSPTGGFTLISIFGIKDPVRPAVKEAVDACMSAGIIVRMVTGDNINTAKAIAKECGILTDGGIAIEGPEFRNKSPEEMRDLIPKIQVMARSLPLDKHTLVTNLRGMFKEVVA

SEQ ID NO: 36424 - protein, 143 aa, Sorghum bicolor
  Clone ID: SORBI-28MAY03-C90899_1.pep
MESSPVSYWCYSCSRFVRVSPSTVVCPECDGGFLEQFTQPPPRGGGGSGRRGTMNPVIVLRGGSLSGFELYYDDGAGEGLRPLPGDVQHLLMGSGFHRLLDQFSRLEAAAPRPPASKAAVESMPSVTVAGGGAHCAVCQEAFE

SEQ ID NO: 36425 - protein, 148 aa, Sorghum bicolor
  Clone ID: SORBI-28MAY03-C90911_1.pep
MGSADLVLKLACEGCGNTSDLYGTGCKHTTLCSDCGKSMARSRARCLVCSAPITRLIREYNVRANSVTDKTYSIGRFVTGLPPFSKKKNAENKWSLHKEGLRGRQITDNMREKYSKKPWILEDETGQYQYQGQMEGSQSATAMYYLLM

SEQ ID NO: 36426 - protein, 169 aa, Sorghum bicolor
  Clone ID: SORBI-28MAY03-C90940_1.pep
ELKPDEQDDVKNTLRYMIENRFPSGNYPSSEGNESDRLVHWCHGAPGVALTLAKAYEVFHDDYFKQAAAEAAEVVWNRGLLKRVGICHGVSGNAYVFLSLYRLSGNVEYLYRAKAFACFLLEKADQLIAEGAMHGGDRSFSLFEGKAGMAYLLLDMVDPSESRFPAYEL

SEQ ID NO: 36427 - protein, 91 aa, Sorghum bicolor
  Clone ID: SORBI-28MAY03-C90989_1.pep
PSAFGKFSKHEAFTGEVNGASVLFLPCAVYNWTPPEGAGQFHGIPLDVKVVHFKGSRKRLMLEAWNFYNSTFKLSDMLCLILRSGRTKYDF

SEQ ID NO: 36428 - protein, 216 aa, Sorghum bicolor
  Clone ID: SORBI-28MAY03-C910_1.pep
MSLCCCSAATGRGVLLPSLLLGRRHRLRHPLVNLRTIATFASSSSAAATTSSLSPPQQRQVTIYVDTLLEWNQRMNLTAVTDEAEVMTRHVADSLAMLPPLERAYRGRSTSAGGSIDGVSLIDVGSGAGLPGLILAVARPSWKFTLLESMRKRCTFLEHAVEAMELSNVNVVCDRAEKVGQSFDFRGRYDIVAARAVAELKVLDFLFCSGVLHPIG

SEQ ID NO: 36429 - protein, 54 aa, Sorghum bicolor
  Clone ID: SORBI-28MAY03-C91138_1.pep
IPDGPSIRKEIPVQPWESSIDSSLTSEEREQKRNQAPDRATFVQGLVLSTLFGD

SEQ ID NO: 36430 - protein, 221 aa, Sorghum bicolor
  unsure (1)..(221): unsure at all Xaa locations
  Clone ID: SORBI-28MAY03-C92278_1.pep
APGPGAPRSRPARAPAGFHSAARSRSAGPPGAGAAPGARPGPTGRPGRPRGGGAPRRAGAARRAGLHRPRALLPPRPPRPPPPPRPPPPRPAAPALPAAPPRRGAPHAPGGRRPAAHAVPPAGPXPAAPPSSAAGARPGPCPGRRRGAAPPPPAPPARLVAADALGGCGRARALREAGAGAAPGPRGRAAPPLPHVASRRLPCFFLGLAVALVFFCATTML

SEQ ID NO: 36431 - protein, 186 aa, Sorghum bicolor
  Clone ID: SORBI-28MAY03-C92438_1.pep
SVADGLSIQEILENWLKLKPTLMDEWQEDRESLVDLFGRVRDDWIENDFSGWIGANRFYPGTADALKLSSSETYIVTTKQSRFAEALLKELAGIDFPSERIYGLGTGPKVKVLQQLQQMPQNQGLKLHFVEDRLATLKNVIKEPALDKWNLYLVTWGSNTQKEREEAEAIPRVQLIDLPDFSRQLK

SEQ ID NO: 36432 - protein, 72 aa, Sorghum bicolor
  Clone ID: SORBI-28MAY03-C9247_1.pep
VWLNHPQRTLGHLSVAQDHPLQAVGDLLVSLDGPQLTLSNPSREQRERQTCSGRYQNIEQARSTWHDLWIIL

SEQ ID NO: 36433 - protein, 113 aa, Sorghum bicolor
  Clone ID: SORBI-28MAY03-C9255_1.pep
QAVMKPMLDFLAQTGSYLMVNAYPFFAYSGNAGDISLDYALFRPNAGVLDAGNGLKYYSLLDAQLDAVFAAVSKLGNYNAVRVVVSETGWPSKGDANEAGASAANAAAYNGNL

SEQ ID NO: 36434 - protein, 170 aa, Sorghum bicolor
  Clone ID: SORBI-28MAY03-C92941_1.pep
PSSARRRRLLIPPPPASGTPPSRSPPTPSPAPRPRRPRRGPPAAPVPASPSSTPPPPRSGGSPQAWRPSAATACSSAPRGSRRSAAGRPASRAPGRCAAPPPAPRWSPTAAAPAAPPGARGPAPASSCAPPPLAAASPSLASLNAAGVLHVFGCACVELRDRGPRARPSS

SEQ ID NO: 36435 - protein, 107 aa, Sorghum bicolor
  Clone ID: SORBI-28MAY03-C91292_1.pep
PCRHRPAGSTPGSQPLHRASEPPPLAARSRWLPLAPAPRSAAPPPPAAAPATAPAAEAAHGPAALGSSPGQGPCWDRIRPRRSTWAARRIPTPPPPPPPPLRLSVDP

SEQ ID NO: 36436 - protein, 163 aa, Sorghum bicolor
  Clone ID: SORBI-28MAY03-C91315_1.pep
SATLLYPPPAPSPPRPPPPDPPRVLAPSSVPHRPRPHVLRCSQLERSARQARRKGADASFPSHTLLARLDHSPSLLFRLPRAGRSSLARRHFLQDLAAGVRGSRRRQSAARSIKAAAKGRASGRSGTVAVFSGTLSPSPSPSTKAAASSRCSQNAVICDGVLP

SEQ ID NO: 36437 - protein, 177 aa, Sorghum bicolor
  Clone ID: SORBI-28MAY03-C91338_1.pep
MRIRKSASRLLGSAYSASAAPPVGAAPPFDLLPPPPPPPPPHLAPCSAPESWGGAGFSGPSASSAEPCELSRSPWDLIAELSLSDPQVEDDIVDKYFVHVTTRSSWLFSATMPAASSAKKKKKLQAAAGGDSTKLRRDTVKKPAMSKEKEGEANKKAKVKKEEGQDQDGAARVWMCK

SEQ ID NO: 36438 - protein, 135 aa, Sorghum bicolor
  Clone ID: SORBI-28MAY03-C91393_1.pep
MASGGEGAGSGESPPAASVEAAAGEATLHIRCANGSKFTVQTDLGATVGAFKEVVAGSCDVPAPQQRLIYKGRILKDEQALESYGVETDHTIHLVRGVAPPAASSAPAAASPLASSTPSSGPAGGLGGLFPGLGA

SEQ ID NO: 36439 - protein, 142 aa, Sorghum bicolor
  Clone ID: SORBI-28MAY03-C91430_1.pep
RAPKASVPYRYFPDVHALAADSDALIVACALNDATRRIVGRRVLDALGPEGVLVNIARGGNVDEQELVLALQDGRIAGAGLDVFQNEPHVPPELGDMDNVVLTAHEAVFTEESAADLRELMIGNLEAFFSGKPLLTPVLSRP

SEQ ID NO: 36440 - protein, 76 aa, Sorghum bicolor
  Clone ID: SORBI-28MAY03-C91439_1.pep
GNLLYVKLPVGKLCGFVQYSSSHEEYLFFMYCAYQFIHQSMLINYVVLSVQFHVETFLRQYFSATVRAQFVIVIPR

SEQ ID NO: 36441 - protein, 182 aa, Sorghum bicolor
  Clone ID: SORBI-28MAY03-C92694_1.pep
KQVASDIGNGLQVPVFLYAAVHPTGKSVGAIRRELGYYRPNYKENQWLGSVLPDVLPVKPDVGPTHVSHKRGATTVGVTPWIEGYNIPVLSKDVPAVRRITRRVTGRSGGLPTVQALALFHGDDCTEIACLLDPDHVSAYQVHTVVEQIAGEQGLEVEQGYYTDITKDAALDKYLKIACTDD

SEQ ID NO: 36442 - protein, 71 aa, Sorghum bicolor
  Clone ID: SORBI-28MAY03-C9273_1.pep
VSEKKAKAWCASKGNIPYFETSAKEGFNVEAAFECIARNAVKNEPEEDMYLPDTIDVGGAGRQQRSSGCEC

SEQ ID NO: 36443 - protein, 184 aa, Sorghum bicolor
  unsure (1)..(184): unsure at all Xaa locations
  Clone ID: SORBI-28MAY03-C92764_1.pep
MASVLPDTASDGKALTDAWDYKGRPASRATTGGWACAAMILGAELFERMTTRGIAVNLVPYMTGTMHLGNASAANTVTNFIGASFMLCLLGGFVADTYLGRYLTIAVFTAVQATGVMILTISTAAPGLRPPPCGDARGASADCVPAXXTQLGVLYLGLYLTALGTGGLKSSXVXGFGSDQFDES

SEQ ID NO: 36444 - protein, 100 aa, Sorghum bicolor
  Clone ID: SORBI-28MAY03-C92815_1.pep
RCRCTGTNVSCMSLAAGKNFGRVSPGSFNFFQWKYDLSSLRIDGLVTRTRLGIIIKNTRKVIEVLRVGDQGQEILASKEDGMQQGCKRETLVMKEGKRRK

SEQ ID NO: 36445 - protein, 156 aa, Sorghum bicolor
  Clone ID: SORBI-28MAY03-C91898_1.pep
MEIVNSVYFGFIGVSTTRINKTVKVGSQPHQIGWKLRRTCCEYSPGTSRKKQEKYEGQPQNVDLPELHPKNKKKPFPVPIKKMLQASRRDKRLAQMHIEKPLEPPKNGLLVPELVPVAHEVLDNWKVLIRGLSQLLNVVTVYGCRKCPQVHVGPVG

SEQ ID NO: 36446 - protein, 223 aa, Sorghum bicolor
  unsure (1)..(223): unsure at all Xaa locations
  Clone ID: SORBI-28MAY03-C91886_1.pep
MARLLLSLSVPXPLALCCRRRRVLVLVPHGHXRRGRGRVAVPATSTATATQGQEAPAFDPAAAPPFGLADIRAAIPKHCWVKDPWRSMGYVLRDVVLVLGLAAAAARLDSWLVWPLYWAAQGTMFWALFVLGHDCGHGSFSNNSNLNSVVGHILHSSILVPYHGWRISHRTHHQNHGHVDKDESWHPLPERLYKSLDSVVLMLRFRLPFPMLAYPFYLANRSP

SEQ ID NO: 36447 - protein, 108 aa, Sorghum bicolor
  unsure (1)..(108): unsure at all Xaa locations
  Clone ID: SORBI-28MAY03-C9193_1.pep
MTGGSGGRRDHESDRDASTALPVPGPCASTHRALAECHRRAARGPLQPEVLCRHLNRALAECVVTACCPXETDAVRPFCGSAGQPLKRQQCPRLRIEFALCLDAHIEP

SEQ ID NO: 36448 - protein, 96 aa, Sorghum bicolor
  unsure (1)..(96): unsure at all Xaa locations
  Clone ID: SORBI-28MAY03-C92143_1.pep
MRALPVAHKLALTAPLLPCHRRPAAHGRRRRYGAVVAYMEPNPNSPGAIAGRLIGALPIVGLVARILSDEXGGVGGDIIDFAEFRRRVSKKCTVMD

SEQ ID NO: 36449 - protein, 198 aa, Sorghum bicolor
  Clone ID: SORBI-28MAY03-C92175_1.pep
MASSLPVHDRLAAAMHGRRLFTVVVLIFALVTPPADAVTAACNSTGGTYTSGSAYDINLSRVVGGLPTNASASPELFATATVGTGGGDNQTVYAIGLCRGDMAADSCLLCLQSSFSDAQGFCPSDMDVSMDYDSCHMRYSGADFLAASTNNSVQQAVFSSFPAVTPSSAAAAFNGLVARLLNATAEYAAANSSRRFAT

SEQ ID NO: 36450 - protein, 105 aa, Sorghum bicolor
  unsure (1)..(105): unsure at all Xaa locations
  Clone ID: SORBI-28MAY03-C92239_1.pep
MPELRSGVRQSRLRAKKVEDLVAQDPTDNLVVAAPTVAGRRGRGRGGGRGAARGRGGRRRGVPXIDLDPDQPCEVLPGAGVGGRAAGGAQPIGADKVVKMDGGSA

SEQ ID NO: 36451 - protein, 167 aa, Sorghum bicolor
  Clone ID: SORBI-28MAY03-C93045_1.pep
RAPRRRGGPDAPPSGRGAAGRPPSAAAGGLPTGRPPGPPPAARPRRALDGARGGRPSPLGAPSGRCHRTPPGPLSGCPSPRAPPRGAGSPPASPSPPLTSAAACSAVCAARHRVTAGWVGSGSPRRLAHTLGSSAGSRGALRSRAPLRRSVPACAPSSCWPAAALAR

SEQ ID NO: 36452 - protein, 85 aa, Sorghum bicolor
  Clone ID: SORBI-28MAY03-C93071_1.pep
NVGSNEQGIAQGCISGISSFGSILGPLIFTPLTAWFLSETGPFDFKGFSILCAGFCTLIAFIISLRMRGAQSSTCKKTAVQHEQA

SEQ ID NO: 36453 - protein, 201 aa, Sorghum bicolor
  Clone ID: SORBI-28MAY03-C93093_1.pep
PATQGERENPSSSAGPPPAVPFSLLAWPGTGLEQDVRANKQAKTGGAGAPPLGGAAAGSPGLLRAEPAGSPRPHASPRGRRRAGAHQGGGGPTPSLPPSKRASASAFRFTRRRRRRASEPAAYPQCWGAAAAACGSSMSWCVFLLALAGSPSLALALLALACLGSHFSPVLFSSLLGFGCLVCFGFLFLVALKCSPFCVFS

SEQ ID NO: 36454 - protein, 196 aa, Sorghum bicolor
  Clone ID: SORBI-28MAY03-C93163_1.pep
SRNIRRSLWCWCHPVGARTRQRRRRLKRLAAAAGRVGDVRHGGSIDGRRDGEVLGALEAELPEEVGDLGAPAADAEAGLRRELRAEVDRRQVLSAVVLGRVRRVLHRVDARELRPRTLRRRHGMVSGARWPLRGEQGKEGSSPGARRNASAVAGCEWGLTMREGAREGGLLPLLQKLSQRSAPPRPGRRRCRLPCA

SEQ ID NO: 36455 - protein, 162 aa, Sorghum bicolor
  Clone ID: SORBI-28MAY03-C93276_1.pep
MALLSPRVPRLPPSTFTFTFAAAAGAPCFGRAARCQATAAGGVAAAGPPSSEMEAVQWGSAQLQGVRDEMEDEILLRPGSLLDGFSFAAVLDGHAGFSAVQFLRDELYKECAAALDGGAVLSTKNLDAITASIQRAFAAVDAKLSTWLEQADKDDDSGATAT

SEQ ID NO: 36456 - protein, 149 aa, Sorghum bicolor
  Clone ID: SORBI-28MAY03-C93232_1.pep
ELGIIVHSVIIGMSVGASESPSTIRPLVAALTFHQFFEGLGLGGCIVQAKFRLKQVLMMTLFFSLTTPIGIVIGIGISSAYDENSPNALIIEGVLDAAAAGILNCMALVDLLAQDFMNPRVQNNGRLQVIINISLLVGTALMSMLAVWA

SEQ ID NO: 36457 - protein, 200 aa, Sorghum bicolor
  unsure (1)..(200): unsure at all Xaa locations
  Clone ID: SORBI-28MAY03-C92552_1.pep
ARGPATAAPPRRPPAPPPPPSARPLPSLWRAAGAAGPAAAPGGAPPGARCVHCRPALRAALLLDVLVCRVLRPGGPVCLTTAVDPPSGCAHSVRPASDIARVRVLSSSARLCLPRRSVGEDNRFWFPTVSCCLVLASFXRAGRVGCASPDARLLGSPRVHSWGCVRVGVLLRNLRPCGGEMQGEHSLLAVKMYRICQTNV

SEQ ID NO: 36458 - protein, 118 aa, Sorghum bicolor
  Clone ID: SORBI-28MAY03-C92576_1.pep
VNSIKPLFEEARIELGKSEIDTQVVEMVWEKIAPGLDSQFDAPYSLPLLAPRPLLLLNGAEDPRCPISGLEEAASKAAKAYEESGCAEKFMFIAEPGIGHQMTIDMVKAASQWFDRFL

SEQ ID NO: 36459 - protein, 75 aa, Sorghum bicolor
  Clone ID: SORBI-28MAY03-C92595_1.pep
QGLAMGILNLAIVVPQVIVSLGSGPWDQMFGGGNAPAFAVAAGSSFIGGLVAILGLPRARIASAPASRRRGGTHR

SEQ ID NO: 36460 - protein, 83 aa, Sorghum bicolor
  Clone ID: SORBI-28MAY03-C92614_1.pep
MGVHAKSMSWYMSPPGSPPAPGSAATEAQHALSSSPGGSSDASFDTNMVIILAALLFALLFALGLNSLARCLIRWARRASEGE

SEQ ID NO: 36461 - protein, 203 aa, Sorghum bicolor
  Clone ID: SORBI-28MAY03-C92658_1.pep
MVTAAAAASTSLRPLSSSPSPIASLPRRWCWGIPVQSAGRSAFHAERRRRTTLLCAADKPPEESLKKTVEVDRLIDMLRNANPRELDQIVVENVLSFDAGFWVRLAARIDLCKSDDDKKDYEELAENVMNIVDRLVHKTNQKIDQSTDVQWPPRGPDTLKLMEKELTRREQEGQLDEGFLSEVSAQLRQAKQDGDKPGLQAML

SEQ ID NO: 36462 - protein, 196 aa, Sorghum bicolor
  Clone ID: SORBI-28MAY03-C92662_1.pep
HEGDSSSSSIVAPKAERASARLIKEEERASGHVSFTVYKQYMTEAWGWWGPLVVVVVSVVWQGSLMASDYWLADQTSEENASSFQPSLFINVYAIIAAVSVVLVAARSFLVAFIGLQTADRFFKQILNSILHAPMSFFDTTPSGRILSRASSDQTNVDLFLPFFVWMSVSMYITVISVLIVTCQVAWPSVIAIIPL

SEQ ID NO: 36463 - protein, 98 aa, Sorghum bicolor
  unsure (1)..(98): unsure at all Xaa locations
  Clone ID: SORBI-28MAY03-C93368_1.pep
LQMIIEEQQKLGGSIXASEDQKLSDSPPSLDDYPESMQPSPKKPRIDALSPDSERDRTQPEFESHLMGPWDQEICAKNICGVAFPVEEFKADPGMSKS

SEQ ID NO: 36464 - protein, 120 aa, Sorghum bicolor
  Clone ID: SORBI-28MAY03-C93437_1.pep
MGRLPWLLCCPFLSLSLAAAARAATVHQEWEISYQFKSPDCVRKLAVTINGQTPGPTIRATQGDTGGVRVKNSLLTENVAIHWHGIRQIGTPWADGTEGVTQCPILPGDTFTYTFVVDRP

SEQ ID NO: 36465 - protein, 155 aa, Sorghum bicolor
  Clone ID: SORBI-28MAY03-C9354_1.pep
MASSSAAEPSSRLSDRAKRSSLGLRFMVLLMHLLFVGAVFILDPTLDWRIHEEPWYIGLYGVLVLLTLVQYFYTAGSSPGYVVDVMRAGSMMHATFVNTTALSKQSNSRNGNTSSPTSRAQLQKLSTMTPTSSWAQMVMDLYPPGSSSRDWTCTY

SEQ ID NO: 36466 - protein, 207 aa, Sorghum bicolor
  Clone ID: SORBI-28MAY03-C9361_1.pep
TRASPTIFSPITCMDHVNLRPSYHARQICAIDQSVFHADPHFTATAPMAYRTDVRQLPNSERTKIHYYTTPSNKYPCTKQQELSMECFCSECLGHHNPEQKLLGMRNSCLSQNFGQDTQHNAETTMRLMGKTVTLGTSSIHCRRLNIETPCSSKQSQAENQFFQGTRTKVFPQLFIGGLVYPPSTFSDGERQPSGNLSHFSFVPAAV

SEQ ID NO: 36467 - protein, 106 aa, Sorghum bicolor
  Clone ID: SORBI-28MAY03-C93640_1.pep
ACKSNHSACDASQMKFLQDFRDQMVASVNNGFAGSRSNGLFINSCFAHCQSELPMTWSDNAAGGGASPAIQSRGIAKSVGDWYFGRAQVKAIDCPYPCDRTCRNII

SEQ ID NO: 36468 - protein, 146 aa, Sorghum bicolor
  Clone ID: SORBI-28MAY03-C9284_1.pep
VGRNTKALVAGVSERASRHPDAMASVFHAVNSISEELSSIVELAAEDEIAITSKEDKLAELMEMNQGLLQCMGVSHSSIETVLRTTLKYSLVSKLTGAGGGGCVLTLIPTLSANIVLEKVTTELESHGYRCFKVEVGGRGLQVFRG

SEQ ID NO: 36469 - protein, 141 aa, Sorghum bicolor
  Clone ID: SORBI-28MAY03-C9290_1.pep
GEGGGGGDKLASGWTEGEQRYDHRLRSHPCRMAWPHGRWGKGRWPFTLARRPQEALPPRALVATSGWKRTHRHRPAASGALAPRRPRAAPPSPRRDALALMGREGRECAAAMAAPIRHAEDRLGREGDGGDEKYREEPTRP

SEQ ID NO: 36470 - protein, 126 aa, Sorghum bicolor
  Clone ID: SORBI-28MAY03-C92956_1.pep
AAPSCGGEGAGRGASGPINQQKQRRSWTDGACLAVPQMREPGKDEQEAAGLGYTKQVQARRRSSGALRRSGGSTARVRLREEIWDAKIQCVCCNGLESLSRTQRSNTRERTAPFECRECPDTRYMP

SEQ ID NO: 36471 - protein, 203 aa, Sorghum bicolor
  Clone ID: SORBI-28MAY03-C9302_1.pep
HEGFPDDGWSSLLSSDGAEDITISINSSPNKLIGSHVSPSPFFSAMGGGIMCAKASMLLQNVPPAILVRFLREHRSEWADPGVDAYSAASLRANPYAVPGLRAGGFMGNQVILPLARTLEHEECLEVIRLEGHGFSHEEVLMSRDMFLLQLCSGVDENAPGACAQLVFAPIDESFADDAPLLPSGFRVIPLDAKTDVPSATRT

SEQ ID NO: 36472 - protein, 151 aa, Sorghum bicolor
  Clone ID: SORBI-28MAY03-C93038_1.pep
AALCESLRLYPPVPQELKEAVAADVLPSGHEVRRGDKILVWLYAMGRMEDVWGSDCREFRPERWIAEDGGRVRYVPSYKFMSFNSGPRTCLGKDMAFVQLKAAAAAVLSNFDVEAVPGHVVEPKLSIILHMKNGFMATVKRRRQALSLASE

SEQ ID NO: 36473 - protein, 74 aa, Sorghum bicolor
  Clone ID: SORBI-28MAY03-C93997_1.pep
THVTASSGFHSLLPCFFIISVSPHCSHSVLITPSAVVHGFICHFSGYCFPFLVHRMAVWKWRKQMEPAVSCTRR

SEQ ID NO: 36474 - protein, 75 aa, Sorghum bicolor
  Clone ID: SORBI-28MAY03-C93950_1.pep
ATIDLIGFLGKQKNRFSECTSESNLSGSGSGSNSSTSRESQLYQQNDRKRTSPSHQLRQQAVFKDQTNFQEISLV

SEQ ID NO: 36475 - protein, 122 aa, Sorghum bicolor
  Clone ID: SORBI-28MAY03-C9401_1.pep
SNNSRIFLSLKDVKPNPSLGALEAVIGEDLSLGEALEPVQSDFEWPEVDALMEELRKIEGVRDVYKGRFFQSPRLAPTFQVYMAPVVGPKYKLLARYGNNVQEVMVETTLGKEELEEAILMC

SEQ ID NO: 36476 - protein, 142 aa, Sorghum bicolor
  Clone ID: SORBI-28MAY03-C94010_1.pep
PDVKCSVLDLDHVVAKAPSGTDVQYIAGDMFESVPPANAMFFKWVLHDWSHEECVKILKNCKKAIPPKEEGGKVIIIDIVIGEESSNLKHKETQALFDLYIMLVNGIERDEQEWKKIFFEAGFSDYKIFPVLGPRSIISVCP

SEQ ID NO: 36477 - protein, 118 aa, Sorghum bicolor
  Clone ID: SORBI-28MAY03-C94016_1.pep
LPSLFVCYLLPFLVVVVCLSPLFNCRQVAWHECWLLGVRRPGSPSSCFALLASASRSLVLWAQFCSFAPAGLFCLQSRLPFCPAPCCVTLSDSILLWLLTDYWAEANCTILHEANCHH

SEQ ID NO: 36478 - protein, 267 aa, Sorghum bicolor
  Clone ID: SORBI-28MAY03-C99337_1.pep
RTKQTARKSVGGKAPRKPLAAADLFPGHHTNPAFGATSLPTPCAVSDSDFPCCVEYAKSARSACRSCSRQIAKGVVRIGQQYDRDHSGYHWYHVSCFRGFPRDGSVTAEGFLFGFENLSPKDKASVRDTLEGRATPTHLQRRDSFSSEAEDPSCGEEDEEGTEEDEDVFAAKPIAGFQQQYGFGSAHASSARVGTAMAFGGAPTMLGAEAVAGLTKAASAAGMTDRFFAQPPTTAHRALRAAIEAFEISADVEELSDTLTLIHRLFA

SEQ ID NO: 36479 - protein, 114 aa, Sorghum bicolor
  Clone ID: SORBI-28MAY03-C99309_1.pep
GPGDRIDYRNMSLINRFISEQGKILSRRINRLTLKQQRLITVAIKQARILSFLPFRNYENEKQFQAQAISIITGPRHRKNRHIPQLTQKFNSNRNLRNSNQNLRNNNRNLSSDC

SEQ ID NO: 36480 - protein, 98 aa, Sorghum bicolor
  Clone ID: SORBI-28MAY03-C99345_1.pep
VTCDERYGHVREVSLRVEDADGAGVSGRDGLAAVAAAMAAPRRRGCGEDAARERYEDFVRGKRARKEWKARREGILDLCCSSVGAAAFLGFLAVLTFR

SEQ ID NO: 36481 - protein, 152 aa, Sorghum bicolor
  Clone ID: SORBI-28MAY03-C9937_1.pep
PTRPIPCVVMWPPLDENFQEIHEDQAGGSTSRVNDRTSTELTQKLSAASEELQFLRSKLTLMERYANILHISIFRKPLDERALPRSLQESSVFDIRKEFENILDAADTDELNRLEIFYRSMLSGVKDKLLKRRVQEMVQQCIISLSAGRQNP

SEQ ID NO: 36482 - protein, 54 aa, Sorghum bicolor
  Clone ID: SORBI-28MAY03-C99511_1.pep
ISNILPKLFKWILKSNGAHVLVTNSLPVQPLLSPVESNNYTIYLHKKNKFNIAG

SEQ ID NO: 36483 - protein, 128 aa, Sorghum bicolor
  Clone ID: SORBI-28MAY03-C9421_1.pep
MADAVNKEAEGRLTLLGLHVSPFALRVRMALDLKGLSYEYVEQDLFHKSDLLLTSNPVHKKVPVLIHNGKPICESLVVLEYLEEVWPGPPGTGTGAAILPADPYGRAVARFWAAYIDGKLFPAWVDVM

SEQ ID NO: 36484 - protein, 152 aa, Sorghum bicolor
  Clone ID: SORBI-28MAY03-C94243_1.pep
MSCSSPPPPPPLEHHAHDDGRTRAPALDLLDEYWFFSNTLVTNNSAKKKPPHLPRSPSTSTSATSTGEKASGSAGPPSRIGGRRLLRTPSLPTSRVGMTMEQVHQDGAGAAAAAGANQQPHRRQLQVVAADEVDDDDLNWSSIYEGVLRTRM

SEQ ID NO: 36485 - protein, 110 aa, Sorghum bicolor
  Clone ID: SORBI-28MAY03-C94292_1.pep
TILIYHYGIALQFTSHNSFFDHAFKEGYDVRDVAACSLQPSHSAVFFSHNQSANSTFCHGLSAKRLPAKVSKARLLPKVLCHEAITWDNPIYHHGPIQHQKMGWHQTILY

SEQ ID NO: 36486 - protein, 137 aa, Sorghum bicolor
  Clone ID: SORBI-28MAY03-C9434_1.pep
ISSPHLPDGDSPRARPPPPPPRLDAVACSSAADCPDSIGFAGFTLLTMDDKNKVKKEIDAPLGPAPRKGGLKFAPKVPQKKPAKVVPKKEPVEESKEETVDKELLMKLKMSQNKYPSARIKSGDKRKNAGFCSPHAL

SEQ ID NO: 36487 - protein, 215 aa, Sorghum bicolor
  Clone ID: SORBI-28MAY03-C94363_1.pep
MVAGGGRCLLAVALAAAWISGAVAAASSSAEQAAGSQKSVKCMPCSRPYIGDAYLDDTLTGHLAQRRGLVEMSDSGELCKGLAEDVDVPVLSKLRRQLVGEGSHRRLVYSMDFGACDGAVVNFLDGYDAHLVIFEKLPDGVFADPFELQHFVERKVFVDVAVFGDTNLELPTALSNRSSVEIHFDLRLIISTDCNLEIDLPLHARYPVRSYKLPV

SEQ ID NO: 36488 - protein, 173 aa, Sorghum bicolor
  Clone ID: SORBI-28MAY03-C93651_1.pep
QENTQKTTCYLIITHLLPAQVAVLAVPIPNSTYPPSNLLTIASQSLSFSRVSLPRFLGPPVVGVGASPVMAVGRCAVSCVAVVPRPRGSVGQARSAAFSASSSPPAAPAPPPLPQICPTPGRHESGHPVAACGDPKAFRCPGRHPAAAIGAEDPSRTALRGGRQDPGAALQGR

SEQ ID NO: 36489 - protein, 164 aa, Sorghum bicolor
  Clone ID: SORBI-28MAY03-C93695_1.pep
MTSHSAAVLAAGLVCLISAVLVVPWLAAGESSSSSSSVADDCQRSCGRVDIPFPFGMGPDHCMLTRDFRITCEDVGNGVRKAPFLANFTNVEVLNISLEQGQAQVLNPISSYCYNATVQQWDEWTWDLSSTSYTFSNTANKFTVVGCRALAYIGNTKGNTSAMY

SEQ ID NO: 36490 - protein, 243 aa, Sorghum bicolor
  unsure (1)..(243): unsure at all Xaa locations
  Clone ID: SORBI-28MAY03-C9370_1.pep
RSRPAGPDGLFTLTGQTYNISSIVDSHFQFDTEAYEKNGPLYLSTFFAVTYGVGFASLTATIVHVFLFHGSEILQLSKSAFQEKKVDIHTKLMRRYKQVPEWWFICILIANIAVTIFACEYYIEQLQLPWWGVLLACAIAFTFTLPIGIITATTNQTPGLNIITEYIMGYLYPGRPVANMCFKVYGYISMSQALTFLQDFKLGHYMKIPPRXMFMAQVVGTLIAAFVYLGTAWWLMDTVPNIC

SEQ ID NO: 36491 - protein, 150 aa, Sorghum bicolor
  Clone ID: SORBI-28MAY03-C93736_1.pep
LPNRDDVKTGVISYKISAHAADLAKGHPYAQAWDDALSKARFEFRWLAQFALSLDPVTAMAFHDETLPSEGAKVAHFCSMCGPKFCSMKITEDIRKYADENGYGTVEEALIQGMNAMSAEFLAARKTISGEQHGEAGGEIYVPESYAAQK

SEQ ID NO: 36492 - protein, 244 aa, Sorghum bicolor
  unsure (1)..(244): unsure at all Xaa locations
  Clone ID: SORBI-28MAY03-C9374_1.pep
GHAAKACPXVVAAAATQPAALAGAGATAAGLTVNQHQQPAKSYATGAADPCSLQXRELVNKQNESENMQDSDNLSMLTSMTTGNTGSVFPFSKQNNPFEVTSSRPEFGLVSSDSLMSSPHSSLENVNLLSSQSLNEHQSSATLQHFVDWPRTPAQGGLSWPEAEDMQAQRSQLSISAPMASSELSSASTSPIHEKLMLSPLKLSREYSPTGLSIAANRDEVSQLEATRATMFPRSXMGGPLREV

SEQ ID NO: 36493 - protein, 148 aa, Sorghum bicolor
  unsure (1)..(148): unsure at all Xaa locations
  Clone ID: SORBI-28MAY03-C93942_1.pep
MERTGGGGGGRGDEMMMTSGATGRIVPVFRSVLSRRALLRVAVALHSLFLWLLLLARGLRLRRAGSETSASALEAGAGGGSWNARRRRRLQAAEEEDVRRRRALAEEVPMEEVDRGTRWATFLVXPGARRNALFWRLWAPAADEMRGI

SEQ ID NO: 36494 - protein, 86 aa, Sorghum bicolor
  Clone ID: SORBI-28MAY03-C94768_1.pep
MRRTAALLWTHGGRSIPPALADVLVCPLSKQPLRYCEATGSLVSDAAGVSFPVLDGIPSLVPKDGKLLDDQEVKSEQESSTRDSSG

SEQ ID NO: 36495 - protein, 105 aa, Sorghum bicolor
  Clone ID: SORBI-28MAY03-C9484_1.pep
HNLRCSVRFLTGHSRNGGTDPLHVAGSAADPDTTLVVYMGLSTLPSLAPKLMKHGLPPDTPAVAVERGTTPQQRTVATLWPAKTKLVISLLLHPESLSLRRCSPC

SEQ ID NO: 36496 - protein, 131 aa, Sorghum bicolor
  Clone ID: SORBI-28MAY03-C94916_1.pep
YHVRHYDVLKLMHLKEPLDIFLSHDWPLGITEYGNWQKLIRVKKHFEEEVNNRTLGSKPAAELLNKLKPPYWFSGHLHCLLPAPTHRGLSAPSATPLAPGLCFPGRSFSQVIDLPAVPGPCVILSARERPA

SEQ ID NO: 36497 - protein, 52 aa, Sorghum bicolor
  unsure (1)..(52): unsure at all Xaa locations
  Clone ID: SORBI-28MAY03-C9493_1.pep
EIKSYIFESLHGRHDSPRGLCSRHLVISVSFSYXFGTCADKAKSSEFRNVIM

SEQ ID NO: 36498 - protein, 88 aa, Sorghum bicolor
  Clone ID: LIB3478-002-P1-K1-F11.pep
FSKSSLGKKQYPFLLRRSMDINSNSMFASSRATRHGQTTRQEPPSAAEHPTCKQCLSKLLVPCYRICEISMQYIVMLPFIIFRINPYM

SEQ ID NO: 36499 - protein, 82 aa, Sorghum bicolor
  Clone ID: LIB3478-033-P1-K1-H2.pep
QILFSFCSNRISIVPKVKSIFASSRATRHGQTTRQEPPSAAEHPTCKQCLSKLLVPCYRICEISMQYIVMLPFIIFRINPYM

SEQ ID NO: 36500 - protein, 128 aa, Sorghum bicolor
  Clone ID: SORBI-28MAY03-C94942_1.pep
SLGVLVLEIVSGRRNSSFVDDEWSMTLLGYAWTLWKEGSVSELIDPLMGTTYTYDEVCRCIQVGLLCVQELPAERPTMSTVLRMLSGDVTIPSPKQAAFFVGRAPRLPADDNSTESGNQLTYTDLQGR

SEQ ID NO: 36501 - protein, 205 aa, Sorghum bicolor
  unsure (1)..(205): unsure at all Xaa locations
  Clone ID: SORBI-28MAY03-C9403_1.pep
WKHCAWDVIISRRGQLPVRQRKTDRAHVLDKAKHLSRLNVKESGKVMLKRGEGKLEKQFRMSCVGCDLYVCSRSEEDLEVAPFIYVVDGALSSVAAETNPHDAPVPXCITQLEGGLVQVAIEVEDRAQRSAITRVNADDVRVTVAAPAARGEANSELLEFMGKVLGLRLTQMTLQRGWNNKSKLLIVEDLSARQVYEKLLEAVQP

SEQ ID NO: 36502 - protein, 147 aa, Sorghum bicolor
  unsure (1)..(147): unsure at all Xaa locations
  Clone ID: SORBI-28MAY03-C94150_1.pep
SPYQMPRFXLAHRVVLAPMTARGAPDAIPGPALAEYYAQRSTEGGLLISEGTIISPSGPGFPRVPGIYNQEQTDAWRKVVDAVHAKGAIFFCQLWHVGRASHQVYQPGGAAPISSTDKPISSRWRILMPDGSYGKYPTPTRLATSGI

SEQ ID NO: 36503 - protein, 142 aa, Sorghum bicolor
  Clone ID: SORBI-28MAY03-C94160_1.pep
MPRLLRHSHSTLGRHTPPKAEHSAVARCSSKKQTSGGFHQLQLQDKKWKSSSDLESIEVQGFRDLGFVFEHEELRESLADVLPGLKQQTKSTSTSPRPRPYLSEAWQQVRRPALARVQSAAEMKDQLRMWAQAVACNVRQEC

SEQ ID NO: 36504 - protein, 167 aa, Sorghum bicolor
  Clone ID: SORBI-28MAY03-C9412_1.pep
VLTLSFLPHAVSQSSTTPAPFLWRRRQVRDEAPAARICDSKGAPSGGMTLHSTTASQRARRGTAQAPATLDRTSAWLSSLPLSGCSSAGRRQAAHSSSQRRTQGAGAEQIHAAPRCRCRAHRPRCSLTHARPPSRLAVAGRSHKADGLQWPYTCSPHNNLGSFVATN

SEQ ID NO: 36505 - protein, 53 aa, Sorghum bicolor
  Clone ID: SORBI-28MAY03-C9417_1.pep
RPGCDRAAGLRRLRSSRGPRERTTARSGLAGEGRGGESHGAARHALLDAWVYA

SEQ ID NO: 36506 - protein, 116 aa, Sorghum bicolor
  Clone ID: SORBI-28MAY03-C95019_1.pep
MAPPISASQSTITILKIFPKPPAPDISSNNFTVGAKFDNRRALLCGLVAAAAGTVLSPDIAGAASKRRPPPPGPAEEKKDPNVSGVQAKVLASRKRKEAMKEAVAKLRERGKPVDK

SEQ ID NO: 36507 - protein, 160 aa, Sorghum bicolor
  Clone ID: SORBI-28MAY03-C9505_1.pep
TIFQSAGFSGASDATRVSILLGVLKLIMTGVAVLVVDRLGRRPLLIGGVSGITVALFLLSSYYTLLKDASYVAVIALLLYVGCYQLSFGPIGWLMISEVFPLRLRGRGLGVAVLVNFASNALVTFAFSPLEDLIGTGALFSGFGVIAVASLAFIFWIVPE

SEQ ID NO: 36508 - protein, 170 aa, Sorghum bicolor
  Clone ID: SORBI-28MAY03-C9508_1.pep
HEGRLSPSFPPTRPPTRPERGKKGRGAQHAALQLLRLHVRPRRQAPAVRRLLQAPLHGGGLCDYNCADAQCDDGDGNDGRAHSEPNAVADLPELPSQVKDKILSLELMGVDYRRALELNPALRDAAPESIHAVVSFLQSRGLQFKDLGRVFGMCPSVLTASVRADLRPVF

SEQ ID NO: 36509 - protein, 184 aa, Sorghum bicolor
  unsure (1)..(184): unsure at all Xaa locations
  Clone ID: SORBI-28MAY03-C95095_1.pep
HRYKIYIEGRGWSXVSEKYILACDSVALMVRPRFHDFFSRGLSPLRHYWPVRGDRGMCRSIKYAVDWGNAHTDRAQEMAGNASRFIQEELTMDRVYDYMFHLLTEYARLLRYRPEVPRGAAEVTVESMTRGKRGLERQFMADTAVAAANGEGPCRLQPAYSAEELEALRRAREDVVRQVEAWEK

SEQ ID NO: 36510 - protein, 371 aa, Sorghum bicolor
  Clone ID: SORBI-28MAY03-C95097_1.pep
KKKKKDFTIIIEGKFLTSALNFPGEFLDICLDASSVICCRVTPQQKAQVVKLVKEDGHVTLSIGDGGNDVVMIQEANVGVGIAGREGLQAARAADYAIGKFKFLKRLLLIHGRYSYVRTAFVSQYCFYKSLFICFIQILYCFLSGFAGTSFFNTFSLTTYNIVFTSLPIVLYVLDKDVPEEYAWNHPSIYGDTQRGDNMTIPTVVGWGLRAFYQALAVFIITVISARHFSYDGSLDYASISIVAYTALVVINCLTVFLESKRLTWVNHIALWGTLVTYSITMTIVNLIPGVMYGVVSRLRSDPLYWLTVLLSVAFAIVPVYAIRFYYLIFTDKRESTRVSRLRVEDPSIRLDHYSITNVNDKTPLLKEQNV

SEQ ID NO: 36511 - protein, 87 aa, Sorghum bicolor
  Clone ID: SORBI-28MAY03-C944_1.pep
KELLALKEICPTGHFFHVSDEHLKLPNSLLHKTQHRARGITAHQLAAQIRRPVHRSRAKSRPASKNRERERPASLRRDRAHRKARGA

SEQ ID NO: 36512 - protein, 136 aa, Sorghum bicolor
  Clone ID: SORBI-28MAY03-C94401_1.pep
PTRPRRSRRGEDERQCRAARRCSVPPPPPPPPAARHHGSIGCTPKGDSPSPPTSTSTTSSTGADRPKLPLPSPCRLLPPITTTTSSLLSGSRLRRPPPSPSSRRRRRSARPATLCDQTLALAIPRRRRNNRFSSLL

SEQ ID NO: 36513 - protein, 136 aa, Sorghum bicolor
  Clone ID: SORBI-28MAY03-C94428_1.pep
MPQYQELPCGGQVLDIDTALKDGILGGALEPVDAAAGDAGKQPLELRKMMDELDAAGDGGGDEAVPAVFICPISLEPMVDPVTLCTGQTYERANISRWLALGHRTCPTTMQELWDDALTPNATLRQLIAAWFSRRY

SEQ ID NO: 36514 - protein, 185 aa, Sorghum bicolor
  Clone ID: SORBI-28MAY03-C94431_1.pep
MGNSSSRGRSKLSQRPQTTMKWSVDGFSSLLDKGEGWTYSRVFEIMGHNWYLRLNPRDKKSGDDKEYVSLILELDISSVKPDTVVEASFKLLIYDQSYGNHSEYQGRHNFQTASTSSGASCMISLEKLKERPSKFIVNKSCTFGVEFIKVTTSKVSTTSETLFVQKPSIFNEAKTYTWDIEDFFA

SEQ ID NO: 36515 - protein, 126 aa, Sorghum bicolor
  Clone ID: SORBI-28MAY03-C94639_1.pep
LHTGDIGYVDDDDEIFIVDRLKEIIKYKGFQVPPAELEALLITHPEIKDAAVVSMKDDLAGEIPVAFIVRTEGSEVTEGEIKQFVAKEVVFYKKIHKVFFSESIPKNPSGKILRKDLRARLAAGVH

SEQ ID NO: 36516 - protein, 168 aa, Sorghum bicolor
  Clone ID: SORBI-28MAY03-C94661_1.pep
MGSVDTAVAVPVPVPEPEAEEKAAVVFRSKLPDIEINNSQSLQTYCFGKMSEVADRACLIDGQTGASYTYAEVESLSRRAASGLRAMGVGKGDVVMNLLRNCPEFAFTFLGAARLGAATTTANPFYTPHEIHRQAEAAGAKVIVTEACAVEKVREFAAGRGVPVVTVD

SEQ ID NO: 36517 - protein, 123 aa, Sorghum bicolor
  Clone ID: SORBI-28MAY03-C95345_1.pep
EKLEIVDFTSFVEKSSDPGRYVIFWELSSDASEDVLRSCANCLALPFVDAGYMGSRKIKAIGPLELRILKKGPFKEILDHFLTLGGPVSQFKTPRFVSPLNVKVLQILNRNPPGSYFSPPYGL

SEQ ID NO: 36518 - protein, 111 aa, Sorghum bicolor
  Clone ID: SORBI-28MAY03-C9537_1.pep
ASSPNDARYAGARSSLPSLDWPKRLKIIKGVARGLAHLYEELPMLMVPHGHLKSSNVLLDATCEPMLSDYALAPLVTPQHAAQVMVAYKSPECAAAHGGRAGRKSDVWSLG

SEQ ID NO: 36519 - protein, 117 aa, Sorghum bicolor
  Clone ID: SORBI-28MAY03-C95394_1.pep
LSEALDELRLTLKSSTIVFVDMFAIKYDLVANHTKYGIEKPLMTCCGHGGPPYNYDPKESCMTSDKYLCKLGEKFISWDGVHFTDAANGIVASKVLSGEYNHSQGQADQPPPQTKIR

SEQ ID NO: 36520 - protein, 180 aa, Sorghum bicolor
  Clone ID: SORBI-28MAY03-C9542_1.pep
MRVAPKVLFLVRDAAGYGAALADSLRPRTGLTRESSPFELALDKYGLHGEKASGELLSFSDSNGSPQVSIFVLPDYKPPLAACVVNEVLELISSEATSTERILIVPFITRSSSYHRGMEHATKASPVLHGAEIGATTDYTHLFVGGTTKPPTFLPIRSEPTLCSLEKVRALRMPTVLLAL

SEQ ID NO: 36521 - protein, 237 aa, Sorghum bicolor
  Clone ID: SORBI-28MAY03-C9547_1.pep
EREVPLSENLLQTEPGENQIPNEQDEKDKQDEFQTPKERNEEDVQDTEFGEAKKEVEQELPVSHFLMNLILGKESSDANEDSESKAARKQGEATEDGSCAFISKQEENLGSLPTENKVDDNLTFVGQEKHEVKCPEETQEMVKEQSDDLKMDTERSIKTVEDIKKNTHDLEIPAYQDNSQDDISGELLTGEAAGVSTKMETRDIDISSVELDDIAVGTVCQENMEESTKTENGSLRS

SEQ ID NO: 36522 - protein, 168 aa, Sorghum bicolor
  Clone ID: SORBI-28MAY03-C94946_1.pep
ISEDSLSRMTYLKAVIKETLRLHPPAPLLIPHLSLEDCDVVDNFKVPAGTTVLVNVWAIGRDPRTWDNAEEFMPERFIHDGEIGGVDFKGKDFQYLPFGSGRRMCPGMNFALATIEIMLANLVYHFDWELPKGAEKIGMSEVFGLPARRKEKLLLVPIARGTVCPSNG

SEQ ID NO: 36523 - protein, 173 aa, Sorghum bicolor
  Clone ID: SORBI-28MAY03-C9495_1.pep
AVETDTLRDWETVPARCEKYVGNYMLGGQYRSDSQAVVDEAVAYAEGLKLSGDGKEVWVFDVDETTLSNLPYYAEHGFGSEPYNSTAFGAYTKLANAPALPETQRLYKRLQELGIKPVILTGRREDKRESTAKNLADVGYTGYEKLLLKPRDARVTAVEFKSGERKKLVDAGF

SEQ ID NO: 36524 - protein, 210 aa, Sorghum bicolor
  Clone ID: SORBI-28MAY03-C94966_1.pep
MAQVVFDQLACDSPTAEVFLLVLLPLLLLFVLLRCFFTTGAARSSRGRKSLPPSPPALPLIGHVHLVGALPHVSLRALVERHGVDGLLMLRLGVVPTLVASSARAAQAVLRTHDQVFSSRPRSVCGDVLLYGPSDIAMAPYGEQWRLAKKLSTTHLLSAKKVQSYRTARKEEVELVINKIIHGAAATRTVVDMSELLSKFTNDIVCRAVA

SEQ ID NO: 36525 - protein, 129 aa, Sorghum bicolor
  Clone ID: SORBI-28MAY03-C9501_1.pep
QCQLKVAFLDHCRCCVLVEADDLLLRSCCRLLYASDVKLGSWLDVDDRRRSTARRTSRLCLLHQLLLDMVQPVQLVYLLSEDLFLVQDGHPHLLPVHVLVKVHADPLFPNRVLSLFRISRSVRKNNLPN

SEQ ID NO: 36526 - protein, 151 aa, Sorghum bicolor
  Clone ID: SORBI-28MAY03-C957_1.pep
MLAAAWRLSQRAVTSPLLGIGRSQIRNPFSTMASLSPAAASPKRLRVYSSPAADGAGAGSGKRVGTHNGSFHCDEALGCFLIRLTSQFAGADVVRTRDSQILDTLDAVLDVGGVYDPSRHRYDHHQKGFSEVFGHGFNTKLSSAGLVTKHF

SEQ ID NO: 36527 - protein, 172 aa, Sorghum bicolor
  Clone ID: SORBI-28MAY03-C95701_1.pep
PTFENGVTGWELALVTAPSSNETAVAPSKKLAGGLDLLTLDSLYDEANRRASQPAASYNPWDATPATAAPVPMLTMAPAMHDPFYASNGYAAPHGVQMAAMAQQQQAFMLQQQMMTMAPAPAPVVHHPMQMQQNPANPFGNPFAAAGAHPYGAAAAGMPLHAGPGNVYTGLI

SEQ ID NO: 36528 - protein, 88 aa, Sorghum bicolor
  Clone ID: SORBI-28MAY03-C95770_1.pep
MVGSVHVNGSVHGGNGTATEERLDELRRLLGKSEGDLLKIVSVGAGAWGSVFAALLQDAYGHFRDKVQIRIWRRPRRTVDRSTAEHLF

SEQ ID NO: 36529 - protein, 103 aa, Sorghum bicolor
  Clone ID: SORBI-28MAY03-C9582_1.pep
SFTACRVSWFGRSLIRNKRSCRRRLTHHNARRRKPQADAISFNSSRLSSMFYDTSHRTNLFFSQPLYGQVRSNAVSPWDNSGGFKFMETKHLCSAANKNSTPG

SEQ ID NO: 36530 - protein, 190 aa, Sorghum bicolor
  Clone ID: SORBI-28MAY03-C95810_1.pep
PYEAPTPGSGWANTPGVSFNDAPTPRDNYANAPSPYVPSTPVGQPMTPNSAAYLPGTPGGQPMTPGTVGLDAMSPILGGEGDGTWLLPDVMVNVLRGGDDGPGVVREVLGDGSCRVALGSSGNGDMVTVLPNEVEVIRPKKSDKIKILNGNFRGYTGKLIGIDGSDGIVRLADTYEVKILDMVILAKLAT

SEQ ID NO: 36531 - protein, 117 aa, Sorghum bicolor
  Clone ID: SORBI-28MAY03-C95107_1.pep
RGMAVLTVPFTMNFAKAIFCYWITSNIFTLLYGIVIRRPAVRKWFNLPALEAQPSLTAKPIFNMFGGSKAIPAAESPVAIAGAQQSGLGQPDAAALGYKVKNLEKKVKSRGKSRKQR

SEQ ID NO: 36532 - protein, 150 aa, Sorghum bicolor
  unsure (1)..(150): unsure at all Xaa locations
  Clone ID: SORBI-28MAY03-C95102_1.pep
EHLGAXCSTDVDSSVTHVVTVDLGTEKARWGVANKKFLLPPRWVVAADSRRPSQPVGQVPVAAPKEKSRDIDNAVAGKKETSKDKEKETMKGKEENAAAGQKETMKDKEENTVADQKETGNDETNVAGQEKDGAKENAVATSTTGYPTDS

SEQ ID NO: 36533 - protein, 194 aa, Sorghum bicolor
  Clone ID: SORBI-28MAY03-C95155_1.pep
MSQKDGASLSEAPILTDEQLIITTPPTKFVTAAAGDSIDVKALKGKMSSITKKKATPKEDCKVKFCGKQESKGDAKPRKQAIKPSKDELREAVFLILDTADFATMTFGDVVKEVDKYFGKDLFERKPLIRCLIEEELFKLADEAEKKELEELEAAEAKARAEQAAKEMAQVQTVESGINKQNVLQAGRDSNTKD

SEQ ID NO: 36534 - protein, 225 aa, Sorghum bicolor
  Clone ID: SORBI-28MAY03-C95194_1.pep
MVKRWLPLEANPDVMNQFKWGLGVPEDVGFCDVYGLDDELLAMVPQPVLAVILLYPQDRIKESQASATSSVETKEPSKNVYFTKQTVGNACGTVGIIHALGNATSRIKLAEGSYFDRFYKRTADMDPSQRATFLEEDEEMENAHSIAATAGDTEAKDGVIEHYICFSCVDGELYELDGGTSQPIPHGPSTPDTLLQDAAKVIKARLSMYSQSNNFNVMALSGKVI

SEQ ID NO: 36535 - protein, 172 aa, Sorghum bicolor
  Clone ID: SORBI-28MAY03-C9520_1.pep
MASSLVSRPHLTQRPVRAATLASPTRARLAAGAGALGGRGVRCQAHAAGDLDAQYMRRCVELARKAAGHTSPNPMVGCVIVRDGRVVGEGFHPKAGQPHAEVFALRDAGNLAENATAYVSLEPCNHYGRTPPCTEALINAKVKEVVVGMTDPNPIVASKGIEKLQGAGINVR

SEQ ID NO: 36536 - protein, 92 aa, Sorghum bicolor
  Clone ID: SORBI-28MAY03-C95213_1.pep
LLKQQGYLKQQSSSMSYHMGARKALLNMETKGLNIWKYFNKVLFFYDNKFYMFSCWSVCHGSMQVVKMQLHWNNGPVSKSTCLFFFFVGGIV

SEQ ID NO: 36537 - protein, 251 aa, Sorghum bicolor
  Clone ID: SORBI-28MAY03-C96137_1.pep
GTFTPHREKDQLSAALGNPEHRGRVRGMSSRMSWKDAWAIDAVSCRTQQGYKEKLIQETSEETMREIVMEEIRNVLTSGDPKMVQLRSQFLGKASSMELMQQTQPDQGLSVPSSSASTVNQPADDIISCTPCSLHIPVGRKKRMMEVATGMAIPGRTFQCQPIPIDYAKVLVVDVHPNHQRPEIDLPTKEGIWYLGDAKNNLILWNRYDIGLATASPPLPPMQLESDNDPSPGQASASGNVTDEGEAATPS

SEQ ID NO: 36538 - protein, 94 aa, Sorghum bicolor
  Clone ID: SORBI-28MAY03-C96181_1.pep
MAIGGFVDAPAAAAGADYGGRVTSFVVLSCILAGSGGILFGYDLGISGGVTSMESFLRKFFPDVYHQMKGDKDVSNYCRFDSELLTVFTSSLYV

SEQ ID NO: 36539 - protein, 75 aa, Sorghum bicolor
  Clone ID: SORBI-28MAY03-C9619_1.pep
GGLYQVLCIVSLLITKLDARFGYDHNRFLCSQKHVYVPFFVAVRFSRALHVSMPFFCCCQVSAPAKTCFFSFIVI

SEQ ID NO: 36540 - protein, 166 aa, Sorghum bicolor
  unsure (1)..(166): unsure at all Xaa locations
  Clone ID: SORBI-28MAY03-C9621_1.pep
MAQQAAAPARPAGPTRLVYFDDMGALRYSATVLSVHQEDGGRVAVVLDATVFHPQGGGQPADTGVISAGGARFLVEDVRAKDGVVFHYGRFEGTEQGCGIGFKEGETVSLEVDAERRSFNSRLHSAGHLLDICVHNVGLFHLQPXRGYHFPDGAFVEYKGVIPPDQ

SEQ ID NO: 36541 - protein, 72 aa, Sorghum bicolor
  Clone ID: SORBI-28MAY03-C96290_1.pep
IATVAVRYILNQTSVAGSMVGVRLGLSEHIKDTNAIFSLELDEEDMNSITEVSKKGRNLMDIIGDCGDEYRA

SEQ ID NO: 36542 - protein, 254 aa, Sorghum bicolor
  Clone ID: SORBI-28MAY03-C95544_1.pep
MTDGRRPDGSYGPEYGPVPHELEYALYHQLPSRSRRRSPWPLHHGDYPWRLSEQRFGRRPFERSSSSVWPTDVVLRHPLQPYTPFQIHHVHDSSGSGATLNPRRSQEDTGLTDEEFRKAMDQLRKQEYRPPDPQKKQGDSGGGRGILRTRSAAPPATTGEKACTVCLETFLPGEQVAITPCNHMFHQGCIAPWVKGHGNCPVCRFVLCERRNPATADAANEDGGMDLELLAMVRTMEEAFSRFRLFSDSTPHYH

SEQ ID NO: 36543 - protein, 188 aa, Sorghum bicolor
  unsure (1)..(188): unsure at all Xaa locations
  Clone ID: SORBI-28MAY03-C95592_1.pep
MPAWAEAALVLGSPSPATATASSTTSSCGVRPRAAVESGRLLCKGFPCTIRSKAGFQIHNYRTRTFKIKAKAEPGDGYTRLAPLRFESPSGQLLVQILQSHPHLIPATVDQQLENLQSEKTAQSEEASKVPQDLLYKRIAEVKEKERQNALEEIIYCWIIYRFMDNDISMTSALSPXGGPVRDISALP

SEQ ID NO: 36544 - protein, 145 aa, Sorghum bicolor
  unsure (1)..(145): unsure at all Xaa locations
  Clone ID: SORBI-28MAY03-C956_1.pep
APPHPPAMAFALKAAATGSASFSAAGPRRGAASATGRVSFRGAAPAVAVRAXAAAFFYVAEDKRSISGTFAELMEQGKTAFVPFITAGDPDLSTTAKALKILDACGSDVIELGVPYSDPLADGPVIHASVTLALAKGTTFDDVIS

SEQ ID NO: 36545 - protein, 199 aa, Sorghum bicolor
  Clone ID: SORBI-28MAY03-C95632_1.pep
MARSGNNVVVHVLVAMVVLWGGAAAGAAALPLPDLETTTMNDTVTGSLSADFHLESCPDLHSMVRSAVQAARNQDVQITAGLLRIFFHDCFPQGCDASLLLDKTHPGSEQHVHPQNAGLNHKALQLIESIRDMVHRRCGERSVSCADILAVATSHAVNLAGGPFINMQLGHRDSVDPAQPWQVQTLPAPTADVTTLFNS

SEQ ID NO: 36546 - protein, 66 aa, Sorghum bicolor
  Clone ID: SORBI-28MAY03-C9569_1.pep
FVLLPLNFCKAEHPNQYFSVKQVGNTRISVQGIIFLEVAFSSHSPCLNLVHIRVKFCILQNPTTIP

SEQ ID NO: 36547 - protein, 187 aa, Sorghum bicolor
  unsure (1)..(187): unsure at all Xaa locations
  Clone ID: SORBI-28MAY03-C95688_1.pep
MEASRCRCFLLPIDHGSPGRRPSRSRGPTRASRPRPGPRAARRLGPAARPGPRPARTTASAPLRPRGVRGQSQRPPSDRGHRGRGARRPRGPPRAPGPPAAAGAPGRPGRPAGTGRPAGGAPVGGRGAWAAGGAPSGGRPEGGRGRRPGXGGRAGRAARPGGRHRETRPGGGTGKGRGGRRRKERHV

SEQ ID NO: 36548 - protein, 285 aa, Sorghum bicolor
  unsure (1)..(285): unsure at all Xaa locations
  Clone ID: SORBI-28MAY03-C9640_1.pep
MKDFGLEDGESDEENNVTKVSNHETKMKEDFAVLSGDDKMDVVYSSAPELVSLLSELKDAHEELRAIGQLTSEVTSCLGKDKMQPFEVKKACLLAHCQAITFYLLMKSEGLSVQDHPVISRLIETKNMVEKIKQVTMNSARQKGSTDDHIMHSGTIQTDKNVALDKQEGKFSNVLALDKVIQGAEVSESRKSEPSKNDFHEVNEQKNKDEHMGLHSLEMLKVRADLEERLKKKGLYNLKKSKPEKLSKTRTTSNKGLQTLDDFDDEVXKNNQIMKPSKLVAAAAK

SEQ ID NO: 36549 - protein, 210 aa, Sorghum bicolor
  Clone ID: SORBI-28MAY03-C96409_1.pep
PIYTHKLPALQAVPRSTQETPEHLELSPRKYVSSSRAEGSLHGWLHAAAIAFRHSKLSVLILALATGGAAARAQLSPTFYASSGPAALVTIKTAVRAALGLDRRMGASLLRLHFHDCFVQGCDASVLLDDTGNFTGEKSAGPNAGSLRGFGVIDTIKALLEALCPRTVSCADILAVAARDSVVALGGPSWTVQLGRRDSTTASLSTANTD

SEQ ID NO: 36550 - protein, 81 aa, Sorghum bicolor
  Clone ID: SORBI-28MAY03-C96424_1.pep
HRSPMEMLISAEIFREDKTRVFMQRLITKRRPRLPRTCNMVLPIYRYSVVGTIDDDDVRMKKLAIPATSSSREGSSSRRVA

SEQ ID NO: 36551 - protein, 61 aa, Sorghum bicolor
  Clone ID: SORBI-28MAY03-C9644_1.pep
VSREDIMDAIEREKYGVNGRQETDDSERQGLTKLFPWLPKSGNKPSSPDDFRGLMGYHTLS

SEQ ID NO: 36552 - protein, 228 aa, Sorghum bicolor
  Clone ID: SORBI-28MAY03-C95906_1.pep
HDLVLLDNLSFGVIIRVEAEAFQVLKGVPDRPEVVLVKLREIKSKIDRRSSAKDRSNNIISASAGVRVIEGACKGKQGPVEHIHKGILFIYDRHHLEHAGFICAKAQSCLLVGGSAGGRRGNGMDTADARLGALRSSASILQSPGRLPPRGPNMNYGGRFGGGRGGRGHDALVGKCIKIKSGPYKGYRGRVKEVTGALVRVELDSLMKIVTVKRDDIADTPTVATPFR

SEQ ID NO: 36553 - protein, 264 aa, Sorghum bicolor
  Clone ID: SORBI-28MAY03-C96004_1.pep
MAAAAAAHHLPVVPHRLAPMRQISSSPPPPLHPASRCSATGKLPVQLRAAPVRAERATGFAARVAFNPSGNYDLSLSMGQDETPQDQPPPPPTEGRFEIIINNNTIRTLDLSPVQEALGDLSSLTAADSKTLLDQTVGFTINYEREDEYDTRELSEFPDIRLWFVRLDAAYPWFPVVLDWRAGELARYTAMLVPHQMSMRLGVVFNPEALELFVMKKVFAVETWLKQQNHPKPRLKTADMARMLGFGVGDELFELIEKYPVHRS

SEQ ID NO: 36554 - protein, 88 aa, Sorghum bicolor
  Clone ID: SORBI-28MAY03-C96079_1.pep
MLRGAGHGGGDARRRALRSSRRRLPGWIWWLLGIFLLVGLMLFVLHHNQKEQFRPPVVDNGSEIEEVPHERVNFSEELLSSTSFARQL

SEQ ID NO: 36555 - protein, 128 aa, Sorghum bicolor
  Clone ID: SORBI-28MAY03-C9613_1.pep
TRIVGEAMKTPVTSSQLATITVAYPAYKRRFPTTVLLRASGPVGAAPSHRHSSRPHPSGTAPIPPAPLPTPSAPHQGVAPPLAVAPWVVVTGVGQGRPVTTCHLPHAERLGDGHAGGQRLLLQQRHHP

SEQ ID NO: 36556 - protein, 81 aa, Sorghum bicolor
  Clone ID: SORBI-28MAY03-C960_1.pep
NPSVARQLWRRNPLASSSSAATATVMLNGWIYRYLTLFFSPVVSWLLPQDPLSMASVRAALDCGSPPVLFLSNPGGQRNGV

SEQ ID NO: 36557 - protein, 109 aa, Sorghum bicolor
  Clone ID: SORBI-28MAY03-C96845_1.pep
THTLTRLQFRTIHTPTKKKKQGQGNTTSSNPGKRTIIFFFKKKLGAALRVLDRVAAATTTQTRSRFLVGRGGGAVLRPPRPQHELKRDDGDEDDGQVKPIPNLPRVVGA

SEQ ID NO: 36558 - protein, 215 aa, Sorghum bicolor
  Clone ID: SORBI-28MAY03-C96889_1.pep
SNNIHRTENDSCDQNTEYTPYLYTTTNSANSGLDELSYSGTGAPASFTAVSGKVKNCLQTESDKFLCKSVSFSSNPCASKVQENRLSPYHALMHEQSLIPDDPGESVRLLSHEESFNVQGDSMQFEDATRFTCQDNSTFPELPNRSPEEATAETLEKDSTGNNSLLETMMLDLSTNSFVQDWWDDSVLLAENLPNSSEKHSEPAIELANRHSLPT

SEQ ID NO: 36559 - protein, 185 aa, Sorghum bicolor
  Clone ID: SORBI-28MAY03-C96969_1.pep
MAASATDPLATALVMAAVALMLTATTTHAARHLADTTPAAAPAAVVPGIPAVPKPPVVPTVPAVVALPPMPAVPTTVPAVGAVPPIPAVPAVPAATTLPPMPSVPAVPAATLPPMPKVPAVPTAASLPPMPAIPSVPKVALPPVVPSSVPKVTLPPMPSVPKVTLPPMPSIPGVPMPFLAPPPSA

SEQ ID NO: 36560 - protein, 228 aa, Sorghum bicolor
  Clone ID: SORBI-28MAY03-C97059_1.pep
YWPRPLRLPSSQFRTKSAPVLSLLLSFLSSAPPPRGPHLPLLCLGTAHHLQLPRRPLLPCPVPHRPLRAFSSFLPMPQRPARLAPPATCGRPEATLRHLRRSFPHPHVLSLSLSRQPRPCLLRANPKCHSSSLPPLSGPTWAVRRHGLPLALPSARDSQMASGTRPVAAPCHDGAPTWPRPWPAPTVGSDLSPAIPRVRCHDAYEDYLVVNASMCSAMPSQLQAPWLN

SEQ ID NO: 36561 - protein, 206 aa, Sorghum bicolor
  unsure (1)..(206): unsure at all Xaa locations
  Clone ID: SORBI-28MAY03-C97087_1.pep
ECCKVASPTSHQPTSSTAWAPRLAEPRCSTMSSPALSTTSSHVPRGAPXSSSSQAPAWATWSRSPASPSRFPPATAATSPSSRRCPQFRPRSPATSRRSALPSPPSGSWTWTSALPRSTRRPSSRAPIRSTSATRRCAAPRPCSSARSSPAQARRLSSRTSRWPPSPYPWQGSSTSRASSSSPRRPRCCRSKPTSPPTSMPSAPDM

SEQ ID NO: 36562 - protein, 69 aa, Sorghum bicolor
  Clone ID: SORBI-28MAY03-C9733_1.pep
VPIYTLTIYLTKSWPANSQNICRMSNILLYEQTRKIASNAYGPYAADQLAPWHNCPPNITTLSCDGLIM

SEQ ID NO: 36563 - protein, 104 aa, Sorghum bicolor
  Clone ID: SORBI-28MAY03-C102833_1.pep
TNTLRNSPASIPRITHLITVDGTHYVSLQGRLEVVREPLFDGALCGSWWKHWQKKELVACQDSRVDFGMCLRNPSQEALLPRLGCKFSPRASLLREKSIAVLLL

SEQ ID NO: 36564 - protein, 145 aa, Sorghum bicolor
  Clone ID: SORBI-28MAY03-C103049_1.pep
MAPTTYFLLVSFLALVTSQAIASDPSPLQDFCVADIHSPVKVNGFVCKDPMAVNVDDFFKAANLDKPRDTMKSKVGSNVTLINVMQLPGLNTLGISLARIDYAPLGQNPLHTHPRATEILTVLEGTLYVGFVTSNTDNGNKLFTK

SEQ ID NO: 36565 - protein, 97 aa, Sorghum bicolor
  Clone ID: SORBI-28MAY03-C103065_1.pep
LHNYTPLFRYIMRTAPAMFDRSTCMCSGSCKEAGSINCKEKYIQIHLKEYQDSMPKIPRHNSHLYTQIKAKIHPLCLVHAATHGQQATEPPARLDSQ

SEQ ID NO: 36566 - protein, 246 aa, Sorghum bicolor
  Clone ID: SORBI-28MAY03-C103166_1.pep
TRKVDDAKRAVEETVAHFGKLNHLVANAGIWSSCFFEEITNITAFHNVIDLNFWGAVYPTYFALPYLKASRGNIVVTASVAGRVPTARMSFYNASKGAVIRFYETLRAELGSHVRVTILMPGYVVSNLTKGKGLQKDGHVGIDEEARDINVGPMPVGKTESLAEVVVASVRRGDYYVTWPGWYWPFHMVMCAAPELLDWFSRAFYVSKSGEQDGGPALSKKILEPVGGKKFLYPSTIRSQTAIAAN

SEQ ID NO: 36567 - protein, 113 aa, Sorghum bicolor
  Clone ID: SORBI-28MAY03-C97422_1.pep
EIAKFCDVYLMERVLDDESEGKVLLALSEAGLFAGGGLIKDKVLFCSTENGRTSFVRQLEPDWHIDTSPEIVHQLARFIKYQLHISPQRTERIATNVFSAPSLEQYFGGLDQR

SEQ ID NO: 36568 - protein, 120 aa, Sorghum bicolor
  Clone ID: SORBI-28MAY03-C97451_1.pep
SAVGIRGTLAKLSQLVATYDGELQHHLEVTTEVNPQFYAFRWITLLLTQEFNFADIIHIWDTLLSDPDGPQETLLRICCAMLILVRKRLLAGDFTSNLKLLQNYPPTNISHLLYVANKLQ

SEQ ID NO: 36569 - protein, 194 aa, Sorghum bicolor
  Clone ID: SORBI-28MAY03-C97497_1.pep
GKTKAPQPPTNRSRIARTREESIRQHHSPSPTSTCSPSSRRSPSPPRIRIESRQLFLYIPLRSLRFSFPFSLFPVDKTDASTRLANPSGGGTRGTRLQARRVKGQSCPAQSRPGTPRDAVARDVAASRGRRGGGGGGAVPRRRRRGGARRAPRGHARMLPVVRAPAPAPPGRAAAGVPVADDVGEGGQGVRAGP

SEQ ID NO: 36570 - protein, 173 aa, Sorghum bicolor
  unsure (1)..(173): unsure at all Xaa locations
  Clone ID: SORBI-28MAY03-C97510_1.pep
APACTAHTCPCPSRPSRTRRRHRCSRSASLRLLPLLPAAEHHRKKKLQHAAVLSASDHHFPSHLQFHPLTAIKTCSAFRARNRNREMHGHRRQLLTGVTAYPRANRPPRWCPESRPSAGKHARTRPATPPRTSSARSRAGLPDPVETXRRRQTRNHPAAGSGGGEREERRQEP

SEQ ID NO: 36571 - protein, 139 aa, Sorghum bicolor
  Clone ID: SORBI-28MAY03-C97522_1.pep
MASASASAPVTGAGAGAGGGKDDELADLVRRLVDALARYADRLPFDLDRQKLRSLTTLAAISITLLFAWKMLRAPQEQARRPRRRAAPSSSNTSTRSQPGALTTTDACSSADSRAHEAVNQLFQPVNLTLEQLVRHKLS

SEQ ID NO: 36572 - protein, 64 aa, Sorghum bicolor
  Clone ID: SORBI-28MAY03-C9802_1.pep
LVHNWTIFGTNKRKCYSSEIQNLFASKQGLRFLNRLLTRLHCLNIGRHCFSSIHPSILTFLDSN

SEQ ID NO: 36573 - protein, 127 aa, Sorghum bicolor
  Clone ID: SORBI-28MAY03-C96489_1.pep
MGRTPCCDRAAVKRGPWSPEEDVPPRRCGLRRRRGAAWPAGPSHAGLKRCGKSCRLRWLNYLRPDIRHGGFTAEEDAVILSLYTQLGSKWALVPPLFVRSSVPGRQALPNPRLDCPPPALAGTYAQV

SEQ ID NO: 36574 - protein, 178 aa, Sorghum bicolor
  Clone ID: SORBI-28MAY03-C96528_1.pep
PGFLPTPPPAASRRERSVALLYTARRASAPGSSASAVSAGRLVGRGAISHRRLPFLGARGLSSTRMESASTTVPSIVVYVTVPSKEAGKKLSQSIISEKLAACVNIVPGIESVYWWEGKVHSDAEQLLIIKTRESLLDALTAHVKAHHEYDVPEVIALPITGGNTKYLEWLKNSTRDN

SEQ ID NO: 36575 - protein, 66 aa, Sorghum bicolor
  Clone ID: SORBI-28MAY03-C96537_1.pep
MGSLTTPPCTEGVIWTVVKRVRTVSKHQMELLREAVHDGMEKNARPVQDVNDRDISIFRPKPHKHY

SEQ ID NO: 36576 - protein, 139 aa, Sorghum bicolor
  Clone ID: SORBI-28MAY03-C966_1.pep
GACRTGLFCPHGGSSGCRSSSSTLASPPSTKFLCSFRLPAADAGGISIRKIHRSSNLTAHSLATQASRLSAVLPRRSCSSTAHNQKCPVLNALQELSVSDPLLVLCDVLVAVGRRRACSSCWCCIGRGSSAADSTRRWC

SEQ ID NO: 36577 - protein, 141 aa, Sorghum bicolor
  Clone ID: SORBI-28MAY03-C96633_1.pep
MGPAGRHLRGVLTALLAAALVLSAAVPAARGQEETEHEEEFNYVVGDEHGPAHWGSIKAEWANCSAGRMQSPIDLSHERVSLVRSLGYLHHSYRPADASIVNRGHDIMVRFNGDAGSLVINGTAYYLRQMHWHSPTEHTVD

SEQ ID NO: 36578 - protein, 117 aa, Sorghum bicolor
  Clone ID: SORBI-28MAY03-C97858_1.pep
SNLTTRDLSIYTDIDLYTDYSTGPSHWNSLNFRVLVYLFLSIHVIVFLLFFLFEFVFIIARNIVATRANYFELAKCKSSTVSLGILWLRRNLTISHRPGRRDVYRSSSSLSLLECYF

SEQ ID NO: 36579 - protein, 217 aa, Sorghum bicolor
  Clone ID: SORBI-28MAY03-C97881_1.pep
MSRYHLKQYEKEHMKMAMLKQEETFRQQVQELHRLYRVQQLLMAKDAANEATMAMPPAAARRCKLEDDDERRRAAENDAGSSRSWLDDAYSRQQQGQGNNNKAPPPLVLQESELELTLALGCFGAGAAAGTKKAAVAAKKEASSSVDSRTSFSSSSTESGSPDDCGGVRRLPPPSLIGSVLPGQQPTSAGSVGQRRLEQEGLPQPPPWIHKCLNLAR

SEQ ID NO: 36580 - protein, 229 aa, Sorghum bicolor
  Clone ID: SORBI-28MAY03-C9793_1.pep
MAPGLQLFTDIADDGTPRLNAASGEELVRVDRAVAVALGPRSPESPGTLFITTRRMIWLSEAEKGKGYAVGFLDITLHAVSRDLEAYPSPCIYTQIEAAEGTDEEAGESNPEANELELSKVSEMRLILADHSQLDALFDVFCHCAELNPDPNAERDEENGWFHGEDMSDGGWVHDDEDMVDENAPQFFSANPIGQNGGYDLTRSVLELQIDDQRFEDAEEEQESHENGH

SEQ ID NO: 36581 - protein, 101 aa, Sorghum bicolor
  Clone ID: SORBI-28MAY03-C98007_1.pep
KPPPISDGTPNESVADVFVRVTQLMSILETQYSGETVVIVSPDFDNLSIFQAGLIGLDLRRHSSLFFQPGEVRPVDPSSIFEYKQPPFTVFKCANPPSCKD

SEQ ID NO: 36582 - protein, 242 aa, Sorghum bicolor
  Clone ID: SORBI-28MAY03-C980_1.pep
KCAIKFKMDDNAELYDFDDEKDENKVDFKKLVSDNWIEPPRRERQEDYSESEYFKQALRQGAPAKPREPRIPRMPHLHDFQFFNNQRLNELYKKEVLILMQANQKKDTIDGEDEDQLEPLTAEEQEEKEQLLEEGFASWTRRDFNTFIRACEKYGRNDIKSISSEMEGKTEEEVQRYAKVFKERYKELSDYDRIIKNIERGEARISRKDEIMKAIGKKLDRYKNPWLELKIQYGQNKGKFYN

SEQ ID NO: 36583 - protein, 110 aa, Sorghum bicolor
  Clone ID: SORBI-28MAY03-C97360_1.pep
MRDEAMGSAAELLAPRMLVSPSSRVQELERFSHYVARQIGFDDVKECPHLCTLAYDYLRKNKGYEENIFAFFQNNVDPEPLIVYWIEELDKCIVGYFSFHWKYATYIITQ

SEQ ID NO: 36584 - protein, 142 aa, Sorghum bicolor
  Clone ID: SORBI-28MAY03-C9737_1.pep
MEAAAERGTVVTACVTGAGGFLASWLVKLLLSTGRYAVRGTVRDLGDGKNAHLMTLEDAGERLQLVKADMLDYGSVASAVAGCEGVFHVASPVPSGQLSNPEADVIAPAVTGTLNVLKACHEAKVKRVVVVSSVAAVFIILT

SEQ ID NO: 36585 - protein, 279 aa, Sorghum bicolor
  Clone ID: SORBI-28MAY03-C9738_1.pep
FLRNVSLTSNWSNEFLQELSSQLNLRVNQFEIVNFYVVGASGLNITMDIAPHTGISFAADQVKAMNYSLTLHTVQIDPVLVGDYNLLNLTWFRPLAPAPAPEFTIAPRASPSTVSNLPRPSEGPSNNGHPSLITVVIICVGSLIGVLLIVLIICFCTFRKGKKRVPRVETPKQRTPDAVSAVESLPRPTSTRFLSYEELKVATNNFEPSSVLGEGGFGRVYKGILSDGTAVAIKKLTSGGHQGDKEFLVEVEMLSRLHHRNLVKLIGYYSSRESSQNLL

SEQ ID NO: 36586 - protein, 77 aa, Sorghum bicolor
  Clone ID: SORBI-28MAY03-C97401_1.pep
ERLKLEYIVRGEQGRRLLLMQVKANRLNAFATCLKIVDQGGVPALYAGLIPSLLQVLPSASISYFVYELMKIVLKVE

SEQ ID NO: 36587 - protein, 64 aa, Sorghum bicolor
  Clone ID: SORBI-28MAY03-C97413_1.pep
SMLIIGSAAGVAFMGMEKVDFFWYFRKVSGFALAGYAAGIISYLAAQNLHLSLPTSLAEIPFIS

SEQ ID NO: 36588 - protein, 157 aa, Sorghum bicolor
  Clone ID: SORBI-28MAY03-C98356_1.pep
MAGSSSRNGGLLTLRIILLCAFAAAAITLLPLVMDPCAHSLSRSILAASGLDAYLLPRAADASKAPSSHGKDANRTSGGGNTGARRPIITDQLCVKGVLPPHALPPFQCCPPPPSTSSASGPINFTFPDPADPLRTRRPVHVVGAEYMAKYARAVAL

SEQ ID NO: 36589 - protein, 168 aa, Sorghum bicolor
  unsure (1)..(168): unsure at all Xaa locations
  Clone ID: SORBI-28MAY03-C9837_1.pep
EWLIGEEKYKQQTQEKHILLAVADKFLVDRQANKTGASILCFDEIQTIDVFAVVALSGILSRLLSTGTVLVATSNKAPEDLNQDGMQRDIFLELLSKLDENCNKILVGTEKDYRRLIPTEGSTEVHYFWPATSDARSMYEAMWYDITNKSXGNINSVTIPVMFGRMSD

SEQ ID NO: 36590 - protein, 204 aa, Sorghum bicolor
  Clone ID: SORBI-28MAY03-C984_1.pep
MAAAIPNGHTAGGDDAPPPASSSLVFLGTGCSSAVPNARCLIQPPDPPCSVCSQSLSVPPELNPNYRCNTSLLIDYCQDEGAHKYIIIDVGKTFREQVLRWFVRHKIPCVDSILLTHEHADAILGLDDVRVVQPFSPTNDIDPTPIYLSRFAMDSISQKFPYLVKKKLKEGEEIRRVAQLDWKIIESDIQKPFITSGLEFVPLP

SEQ ID NO: 36591 - protein, 77 aa, Sorghum bicolor
  Clone ID: SORBI-28MAY03-C98423_1.pep
LLKIHLMDRNKTIDTIFLILYPTTMSPKQHFCKSSKRTIGSVHDFYYEMIPVLYNSSSNKEGSKPGDKANPATPYIP

SEQ ID NO: 36592 - protein, 117 aa, Sorghum bicolor
  unsure (1)..(117): unsure at all Xaa locations
  Clone ID: SORBI-28MAY03-C98515_1.pep
MMHMTFYWGKSATILFDGWRTSTWFDYLLSLAALLLAAAFYQYLEALRVRVKLAAEGGGGXXXXXKGKXXSSIPPPASDDPRAPLLVDVAGRRWPARVAVAAMVGVNSGLGYLLMLA

SEQ ID NO: 36593 - protein, 106 aa, Sorghum bicolor
  Clone ID: SORBI-28MAY03-C98748_1.pep
NCGISNQLLSVFSYFQFVFFVMVTLPICFFIPLETIKITGQEGKENASSIRFFYPYSIRVVISCTPSYIVEPADLVVGAYRVLGTNVQESRLLIDYVWSKFKMVPD

SEQ ID NO: 36594 - protein, 139 aa, Sorghum bicolor
  Clone ID: SORBI-28MAY03-C9756_1.pep
VAFDDIPEDGLNSPLRLEKLANEVTYRRMKDALIELSKAVQTGPCANLVPVLFGEKAPMRSKDTMKFSPFNKNLDDSQKEAISKALGSRDVFLLHGPPGTGKTTTIIEIILQEVKRGSKILACAASNIAVDNICERLAR

SEQ ID NO: 36595 - protein, 94 aa, Sorghum bicolor
  Clone ID: SORBI-28MAY03-C9763_1.pep
FDPRHMRISIQGSGIYLNRERGHSIDPIHIDDPLCPANNVGRNCFRIHQCIKAFADAFAVLENELLQFSSECSMPASAFNILKKIIPSIDSDEL

SEQ ID NO: 36596 - protein, 63 aa, Sorghum bicolor
  Clone ID: SORBI-28MAY03-C9766_1.pep
QCTEIKKNLDCSTIGTAAQALAVDLAHTLHMFHPLHMFHHLQTLGATTTYATKYLSNETSLPC

SEQ ID NO: 36597 - protein, 150 aa, Sorghum bicolor
  Clone ID: SORBI-28MAY03-C97725_1.pep
FGIKTMIAKMYKAPSNFKMGSTMLTDLKNLLSLSMINARMPFVAATFAPAATRGVMLPMTLRGGRFCSIWWLSWESYDSSTTVAAMVVRATSGVVFPKPLRAICGHQQLPPHWSWSYTSWGGSVAGAGCRGSDNNAARLGTGPPVAFVLM

SEQ ID NO: 36598 - protein, 74 aa, Sorghum bicolor
  Clone ID: SORBI-28MAY03-C97780_1.pep
CLICGCMNLKIINWSTDGSATAVLSTHSSSSPMVSSSVKSSFAVLLKGGAQSPRCKPPHCMHISLSCDNHDKQL

SEQ ID NO: 36599 - protein, 157 aa, Sorghum bicolor
  Clone ID: SORBI-28MAY03-C98712_1.pep
PFLIPDWIGTCGSVLFATRWEGVCPSTPLYQPTCGYAISGSRKYWESTENKEYDSYASHLWQQWVSVMQYCECGVFPHVFQRSRNISRKSITANPFLSSTHITFLSSLSSSRLRVHHPLASRGTDVRVVRKRNPDCPVQALACPQAAHFCRAYPEVR

SEQ ID NO: 36600 - protein, 101 aa, Sorghum bicolor
  Clone ID: SORBI-28MAY03-C98742_1.pep
EYKSLQDIIAILGMDELSEADKLTVERARKIQRFLSQPFTVAQVFTGIEGKLVDLKDTIRSFKAILSGEGDDLPEGAFYMVGDLESARAKGEKILAELEKS

SEQ ID NO: 36601 - protein, 130 aa, Sorghum bicolor
  Clone ID: SORBI-28MAY03-C98743_1.pep
LGYPVRLERWLMEGSYDRVWKAMKSSEVPCDEYSVFSEILKNQIRSEIASSSERAYPSLPISSTKSLLFLNSEGDVIQFAKHRGWLVKEGHIYFPNNAAEGSEDGVYVKDMSQMIMENTLGYARELETIV

SEQ ID NO: 36602 - protein, 159 aa, Sorghum bicolor
  Clone ID: SORBI-28MAY03-C9878_1.pep
LLCFTGTEALFADLGYFSIKSIQLSFGFGLVPSVLLAYIGQAAYLRVHPEDVANTFYRSTPISLFWPTFILALAASIIGSQAMISCAFATISHSQTLGCFPRVKILHTSRQYSGQLYIPEVNYLLCLGACLVTIGFRTTVIIGEAHGICVVLVMIVTTL

SEQ ID NO: 36603 - protein, 91 aa, Sorghum bicolor
  Clone ID: SORBI-28MAY03-C98765_1.pep
LMAAYASSLTCNAVCSVCPLLISNGNKVQTGLCSRSAITLFVYNFSMEKVFFIITQGKKCCTHHAVKCLVIFASCTSSNVYITTKQAAKCR

SEQ ID NO: 36604 - protein, 60 aa, Sorghum bicolor
  Clone ID: SORBI-28MAY03-C98120_1.pep
FDPQPSIIYHRHMSSRRICHIISRSYKSKKFQTKSHNRNVIWRQSSASPSAESRATANAT

SEQ ID NO: 36605 - protein, 112 aa, Sorghum bicolor
  Clone ID: SORBI-28MAY03-C9821_1.pep
DWHWKRRAGLQKATFELKEEEGWKRCRCMLLRLSAGAGVQLLVSSHSESDQRPSESLVVAAHLEVGGIVSPLGTAHAKAKVYLYCDGPQPLSSLRSALGPRATCFDFRRGHC

SEQ ID NO: 36606 - protein, 193 aa, Sorghum bicolor
  Clone ID: SORBI-28MAY03-C9832_1.pep
KYYVPYASDSNAIRRVITHDVAYAAVQAYPDEYRPDWGRMSFLVDILRPTPGEGPSWYHLLKKASGGCNDLMYSGHMLVAVLTAMAWTEAYGGWISVAIWLLVLHSAQREVRERHHYSVDCVAAIYVGILLWRMTGFIWSARDLTRARRLAKLEEIQSRLVHAAKDSDIDEIRGLLKEVELAGQEKQGFSQRA

SEQ ID NO: 36607 - protein, 91 aa, Sorghum bicolor
  Clone ID: SORBI-28MAY03-C98331_1.pep
ADAGDFVRFHVYVNARAYHRVPSGGREMAGSFVTLKHPGKEGTALRTSMTVALNELLEALGAEGDDSVTVTLVPVTGQVTIGGLRIVYMDE

SEQ ID NO: 36608 - protein, 178 aa, Sorghum bicolor
  Clone ID: SORBI-28MAY03-C9834_1.pep
EYEEENFQILGFLSKLLYLKSLIPQFNLQDARGNDVELSRYKGKVLLIVNVASQCGLTNSNYTELGSLHKKYGEKGFEILAFPCNQFVGQEPGTNEQIAEFACTRFKADFPVFGKVDVNGGKAAPLYKFLKSERGGLFGERIKWNFTKFLVDKDGHVVSRYAPTKLPVSIENDIQKLL

SEQ ID NO: 36609 - protein, 273 aa, Sorghum bicolor
  Clone ID: SORBI-28MAY03-C9890_1.pep
MGMEWPPTPAQQRKAVVGAGSALKLVLFVILAGPALRLLVGPAAYLLPPTAAPEGGARLIAAPGRERTGGGGIPSVETDDAIFTLTSAEPLTAIDKKEGSPKPEESCDLFHGEWVPNSSGPAYTNASCRFIESPQNCMTNGRPDTDYLNWRWKPYGCEVPPFDGKKFLDGMKGKHWALIGDSILRNHVQSLLCLLSKVEDATEVYHDDTFRSRRWHFPSHNFTVSLIWAPFLVKAKIFEDSDGVSTADLQLHLDVLKKNWTSQWESFDYVVIS

SEQ ID NO: 36610 - protein, 111 aa, Sorghum bicolor
  Clone ID: SORBI-28MAY03-C98902_1.pep
GQIHAGYAPVLDCHTAHIACKFKELIEKVDRRSGKKMEDNPKAVKSGDAAMVLLVPSKPLCVETFTDYPPLGRFAVRDMRQTVAVGVIKAVTRKDPKAGKVTAAAKKAGKK

SEQ ID NO: 36611 - protein, 86 aa, Sorghum bicolor
  Clone ID: SORBI-28MAY03-C98906_1.pep
KSGYASKDSTCTEGALNLLMLPPEKLSLFVPSQYANSDQDLLLEIPLNARHPEAELLCQPSQLSSITHSSTSVDGVADGEGHLKQP

SEQ ID NO: 36612 - protein, 169 aa, Sorghum bicolor
  Clone ID: SORBI-28MAY03-C99056_1.pep
KNRILIFVLYKREAPKIEGLLKRQGYKVAAIHGDMSQSQRIAALQSFKDGTNPLLVATDVAARGLDIPDVEYVLNYSFPLTIEDYVHRIGRTGRAGKTGVSFTMFTSQDKLRAAELVAILKEANADIPPALIKLSSYGSKKQEHALYGAHAKDFGNKPMPKSSHVKFDD

SEQ ID NO: 36613 - protein, 161 aa, Sorghum bicolor
  Clone ID: SORBI-28MAY03-C99020_1.pep
MDQIKQRMNALRIEADESAAKAEEYKAKLKTLETENTQKEQEITSLAHKNQVLEAEVEKLESSVKTFKDEATGGAAASSQVEAMQRKIQVLEEEAEESDRTIRELNEKLRQTDVKSGHFERKVQALEQTRDQWETKYEEMAKKYADTKKELDEFAAEIGNL

SEQ ID NO: 36614 - protein, 78 aa, Sorghum bicolor
  Clone ID: SORBI-28MAY03-C98560_1.pep
LILRHTFPCLHFSNASHSCSILSGSPCNARGSAAWSGMLQSGLIISATEPKSLDVSLSPSCQANFACILSINLKSILG

SEQ ID NO: 36615 - protein, 100 aa, Sorghum bicolor
  Clone ID: SORBI-28MAY03-C98574_1.pep
DCFIIFASDGLWEHLSNQEAVEIVHNHQHAGSARRLIKAALQEAARKREMRYSALTKIDKKVRRHFHDDITVIVLFINHALLLKGAPQGQPLSIRCALDY

SEQ ID NO: 36616 - protein, 213 aa, Sorghum bicolor
  Clone ID: SORBI-28MAY03-C98618_1.pep
MSDNGEVEVENPSGYYPALPKDVQTDSVKLFGKWSYDDVEIRDISLTDYIQIRSPVYLPHSAGRYAAKRFRKAQCPIIERLTNSIMMNGRNNGKKIMAVRIVAHTFEIIHIMTDQNPLQVAVDAIVNCGPREDSTRIGSQGTVRRQAVDVSPLRRVNQAIALLTIGAREAAFRNVKSIAEVLAEELINAAKGSSNSYAIKKKDELERVAKSNR

SEQ ID NO: 36617 - protein, 75 aa, Sorghum bicolor
  Clone ID: SORBI-28MAY03-C98622_1.pep
LAAVSSLLMENTPPPVTAKSGGTSKGNPNAGNVGDGKIDRTYKPLTTADRAGAGIITFLVLSFACGIFGWMSMGK

SEQ ID NO: 36618 - protein, 115 aa, Sorghum bicolor
  Clone ID: SORBI-28MAY03-C98655_1.pep
HEARILGEVNENSLRKFAETAERCLADYGQERPSMADVLWNLEYCLQLQETHVRRDAFEDSGAVGAQFPEDVVVPRWVPSSTSFMTTGDPDDTAVTDVGVVNSKVFSQLSSGEGR

SEQ ID NO: 36619 - protein, 92 aa, Sorghum bicolor
  Clone ID: SORBI-28MAY03-C99176_1.pep
QSKMCILIKGPNNEFHMTKVYTCKSDEYGQYDSKKYYLCQCWCHFLFGKVCCHRPYRSAHHFADRLGHHHACTSDTRCPVIDHSSDPRRKQA

SEQ ID NO: 36620 - protein, 125 aa, Sorghum bicolor
  Clone ID: SORBI-28MAY03-C992_1.pep
MSAAARVLPKAVTFVTGNAKKLEEVRAILGSSIPFQSLKLDLPELQGEPEDISKEKARMAASQVNGPVLVEDTCLCFNALKGLPGPYIKWFLEKIGHEGLNNLLKAYEDKSAFAMCIFSLALGPW

SEQ ID NO: 36621 - protein, 111 aa, Sorghum bicolor
  Clone ID: SORBI-28MAY03-C99231_1.pep
YQVVIGGSTYTVSGTSASSPVFAGFITLVNNQRAALGKAPVGFLNPALYQLAAQKSAVFNDITVGQNNCCAGSPGSQVCCQYGFNATVGWDPLTGLGSVKFPLLLQALAQL

SEQ ID NO: 36622 - protein, 117 aa, Sorghum bicolor
  Clone ID: SORBI-28MAY03-C99261_1.pep
FNALEFFVYDCDVMSYLAFEDGAMPSLQKLGLLLDPHKWDKVTPLGLQCLSNLKKITVWTVATSYSNDAGAGDKESEEMSAAALVRKVFQEAANAHPSHLAYTFHEGLDRPAEEAQE

SEQ ID NO: 36623 - protein, 57 aa, Sorghum bicolor
  Clone ID: SORBI-28MAY03-C99275_1.pep
KFFFYAQKDGATAFFLVECIVNTASAKAQLKIKADDGAAVEAFSTLFQSALSKFGLS

SEQ ID NO: 36624 - protein, 181 aa, Sorghum bicolor
  unsure (1)..(181): unsure at all Xaa locations
  Clone ID: SORBI-28MAY03-C99686_1.pep
HEGKKKTRVVNLRRTKSEVTTPETGSEASDTASVDVPLSEPMIDESIPEETESSIIAEASTPNKVRFRSAGEAGRPSVMATLEEARRMGSPLKNAVEPSESQNYPSIAAITSELKSEKGKSPGLENQSISSETSSVILEQAWIMKMAGEIAKRVYDEKNRQRSPXDEREDAPPPAYEAATQ

SEQ ID NO: 36625 - protein, 115 aa, Sorghum bicolor
  Clone ID: SORBI-28MAY03-C98783_1.pep
LANIFITFALPLWNLFAGFLIVRPAIPIWWRWYYWANPVSWTIYGVVASQFGENEGELSVPGGSGKPVVVKQFLKDNLGIQHDFLGYVVLVHFAYIIAFFFVFGYSIKFFNFQKR

SEQ ID NO: 36626 - protein, 76 aa, Sorghum bicolor
  Clone ID: SORBI-28MAY03-C98798_1.pep
TLPTFRHLLIAFGGLAGLEESIEEDTNLKGKHADDVFTSYLNTCPNQGSRTIRTEEALLISLQYFQDPIRRAEQKM

SEQ ID NO: 36627 - protein, 196 aa, Sorghum bicolor
  Clone ID: SORBI-28MAY03-C98848_1.pep
MECGWSIIILLILYIIWDVNYFIRVVFTVVFGRLFQKKVKLTETTSILGFCTSQDVDIFIRHMNNARYVRELDFARFHFYALTGLYEEIKKSKGGAVQGASSVRYRRTIPIFSSYRIETKLIWWDEKAIYLEQKFITSSDNFVRAVATSKQCITNVNVVELMKKFPECANRPAAPEELEIWLNAIEISSQKLRKDK

SEQ ID NO: 36628 - protein, 35 aa, Sorghum bicolor
  Clone ID: SORBI-28MAY03-C98867_1.pep
HVLLPKSSFRLMVMLCSDNSVHHLFNVVGLMPVRF

SEQ ID NO: 36629 - protein, 55 aa, Sorghum bicolor
  Clone ID: SORBI-28MAY03-C98881_1.pep
RANFHIAVQMITQGIHSKVQTERGDFPHKFLARSICSDLFGTREKKKKKNLDPHT

SEQ ID NO: 36630 - protein, 96 aa, Sorghum bicolor
  Clone ID: SORBI-28MAY03-C99499_1.pep
TRILHDSVQELADTVIAVVRRLRLCGEDGKDIFPLVLVGGVLEGNKKWDISGEVIKCISKVFPGTDPIWPEVEPAIGAPLLAWSHHCKGLKLENGS

SEQ ID NO: 36631 - protein, 120 aa, Sorghum bicolor
  Clone ID: SORBI-28MAY03-C99650_1.pep
SVVDSGTVITQLPPTAYQALRTAFKKEMKAYPSAAPVGSLDTCFDFSGFNTITVPTVTLTFSRGAAMDLDISGILYAGCLAFTATAHDGDTGILGNVQQRTFEMLFDVGGRTIGFRSGAC

SEQ ID NO: 36632 - protein, 69 aa, Sorghum bicolor
  Clone ID: SORBI-28MAY03-C99653_1.pep
LIIIWSANCINKLNWTTTEARERDGSKNQPIITQSIQEAGKKLLVVVEIIDLKEKINRNLQIKKKKTVV

SEQ ID NO: 36633 - protein, 54 aa, Sorghum bicolor
  Clone ID: SORBI-28MAY03-C99655_1.pep
TWRMNPSLQGLIPKVHLASKLSLQSFFVARAAACLVLLQLREITNHDHTLLGLD

SEQ ID NO: 36634 - protein, 59 aa, Sorghum bicolor
  Clone ID: SORBI-28MAY03-C99679_1.pep
HEENERLVTKESVDEKIYEIARRKLVLDAAILHSGAELDNSTDVPEKTMGEILASLLLV

SEQ ID NO: 36635 - protein, 67 aa, Sorghum bicolor
  Clone ID: SORBI-28MAY03-C99079_1.pep
LPPPDSLPSGLGARVGGSRSPQAARQTRTAMVVVFEAGRATVEASRPNASSSSVWLIVASHTLCPVD

SEQ ID NO: 36636 - protein, 185 aa, Sorghum bicolor
  Clone ID: SORBI-28MAY03-C9910_1.pep
MVLLRGARAAWAASTAVAAGASGGRSISIRLIPVAALSSGGRKRKGQRRGEAKPPSPPPPQPLPRQSETLSSKKKSGAKPSGEAKKSRRPVELGEARGPRRLEGSEARKGNVQQQQQQEKAKAKRLVRWKCASGCGACCKLDKGPDFPTPDEIFADHPDDLQLYRSMIGSDGWCVNYDKATRTCN

SEQ ID NO: 36637 - protein, 135 aa, Sorghum bicolor
  Clone ID: SORBI-28MAY03-C99165_1.pep
AVDEWVVETRKEKKQKEIEDAEKRRKEEQEARKAEAKKKRKEERAKAKKAKAKAKRKSNGESSGSDSSDSDTESETENRTSEKKDEKKDEKDTEKKSEDTPKEAEENKKLEVPDEESSKSKGTSDSGYDTPNTAL

SEQ ID NO: 36638 - protein, 119 aa, Sorghum bicolor
  Clone ID: SORBI-28MAY03-C99172_1.pep
ATPDRNTRLPMSTEHNNGERNPVVRDSRTTPGGRGNLPEKWPVMAECLTPPGGRGSPQRIGEVGTAGGRYSKVPREKREVEAASYERSGPGEQVPRGNRPHHLEERMEMGPRGARCQRK

SEQ ID NO: 36639 - protein, 114 aa, Sorghum bicolor
  Clone ID: SORBI-28MAY03-C99167_1.pep
TGRKRFTLAHSFLCIILGRPIYLSSFYFLVHGVGLSAIAGAGLPSVFGTGVAFYFGALFGLPKSWLDGLLLQYFVSPRQASGVFRGPGIHVMIRFKEICFGIWEALEPGFAMQR

SEQ ID NO: 36640 - protein, 163 aa, Sorghum bicolor
  Clone ID: SORBI-28MAY03-C99783_1.pep
VCREAILRTNLNDSSSYLHRVPKSHKVIPLLSLTHTHRLLTLLLFHLLDLLRHFLPFGHLRPRFINSLVVQVSSSRKLNILQVRRSTECHKRTQKPVFVTELQHVLDKSSCWSRRAQQCFSNHLRSLQGCCSWLRALLSIACKYGLDSLARELLTRRACPSSC

SEQ ID NO: 36641 - protein, 160 aa, Sorghum bicolor
  Clone ID: SORBI-28MAY03-C99821_1.pep
ARGVTSLASSTDGLLLVSGFEDGNVRVWDTRCQQVTRKFKHSQGPVTNVLIVTPQRVNLPPLQPLRKVCSANGEAEWRAVVLPRPENDVPIPGNKTSIFMERYLDELQKHGGSSRLFDFELNAQNGTPNQQGTEWRDRYLELQDLFVHEVLHQMPSSRNP

SEQ ID NO: 36642 - protein, 56 aa, Sorghum bicolor
  Clone ID: SORBI-28MAY03-C99827_1.pep
SSDLKGNTNSSIFDAKAGISLNDNFVKLVSWYDNEWGYSRRVLDLLAHVAKVDASK

SEQ ID NO: 36643 - protein, 142 aa, Sorghum bicolor
  Clone ID: SORBI-28MAY03-C99848_1.pep
LAKLCLNKESAISIAGARGTIGYIAPEVYSKQFGLVSSKSDVYSYGMMVLEMVGARDKNNTSASVESSSQYFPQWLYEHLDEYCISASEINGETTELVRKMIVVGLWCIQVIPTDRPTMTRVVEMLEGGTSNLELPPKVLLS

SEQ ID NO: 36644 - protein, 107 aa, Sorghum bicolor
  Clone ID: SORBI-28MAY03-C99859_1.pep
GMPSSHSATVTALAVSVGIQEGFRSATFATALVFACVVMHDAFGVRLHAGKQAEVLNQIVYELPEEHPLSETKPLREILGHTVPQVVAGCILGILMAVVMHLALGSS

SEQ ID NO: 36645 - protein, 63 aa, Sorghum bicolor
  Clone ID: SORBI-28MAY03-C110019_1.pep
GFQHPPPLTPNFPALSPARGTGILGPGPMPPPPSPGLWFPQSPSGLLSPSGFLPILSPRWRDI

SEQ ID NO: 36646 - protein, 181 aa, Sorghum bicolor
  unsure (1)..(181): unsure at all Xaa locations
  Clone ID: SORBI-28MAY03-C11047_1.pep
AASSLVEQIASLAATMLCHAGXVILICLLYEQIMPTLLLSGGKAKLGSAGQVCSIIEGFTLAHVLLVSGASIWGVGETSPAYTSIYTSKRQRVVDRHLEFMTRVMEGNIVLGCGDTTWRSYVVCFVNLLVNFVPTWIPEVKLKTLQKLASGLQRWHEGDLALSLLERGGAKTVTSVVESLL

SEQ ID NO: 36647 - protein, 187 aa, Sorghum bicolor
  Clone ID: SORBI-28MAY03-C110570_1.pep
TREELTIPRSIQSVICLNLPSFSGGLNPWGTPGTRKVQDRDLTAPYVDDGLIEVVGFRDAWHGLILLAPNGHGTRLAQAHRIRFEFHKGAAEHTFMRIDGEPWKQPLPKEDDTVVVEISNLRQVAMLAIDPCRSKSVNEPSSPLCHSHEDDDSNSLEDEDEWEDGRKKFGAAATFKIPDEVDIAHLS

SEQ ID NO: 36648 - protein, 65 aa, Sorghum bicolor
  Clone ID: SORBI-28MAY03-C11022_1.pep
TCCYSTEQNKKMSGVIKHFPHYRSKCDEKVTPLVTHVLTVHSRSDSVAVSCRVLLDMFLGGKKLS

SEQ ID NO: 36649 - protein, 166 aa, Sorghum bicolor
  Clone ID: SORBI-28MAY03-C21056_1.pep
MDALTRLHRSLVGGDDDEDPPEDSILADTEGLCSLSPLQRIYAFAACLVAGLALMILSFIVFVRPIKFAVMFTFGNILAVGSTAFVMGPQKQIRMMFDPVRLYATAIYVGCVVLALIFALWIHDKLLTLIAIICEICALFWYSLSYIPFARRMVSDLMVKLCDTEL

SEQ ID NO: 36650 - protein, 82 aa, Sorghum bicolor
  Clone ID: SORBI-28MAY03-C9993_1.pep
RRGLVSLSDTEMLYVKCRDTYSVCFKNIFTLRFMEFKESDTLDQHHMSLAHLDQYVISFCVCDQVVCHSVARQPFCVLLLIE

SEQ ID NO: 36651 - protein, 81 aa, Sorghum bicolor
  unsure (1)..(81): unsure at all Xaa locations
  Clone ID: SORBI-28MAY03-C99949_1.pep
LNKYLYSFFFLNDPSAGSPTDTLLRLLLPLNNKIQXVSFLSSGSCISPDYXIGRSDGRCVQKAGTXSTQFDELRLLGIPRS

SEQ ID NO: 36652 - protein, 126 aa, Sorghum bicolor
  Clone ID: SORBI-28MAY03-C99950_1.pep
TRAVAVARELGAHGRVFATDVSEVAIDVARLNVQRYGVQDKVEIRHGSWFEPLQDLKGKLMGVISNPPYIPTDDLPGLQPEVGWHEPKLALDGGKDGLEHLLHLCEGLSSVLEPGGFFVFETSSVL

SEQ ID NO: 36653 - protein, 77 aa, Sorghum bicolor
  Clone ID: SORBI-28MAY03-C9999_1.pep
DVKYRKFIPGISKSQEFDTKERHNKQSRLSKSNSHSPSSGNRKEVLSIRRLLPVIDFEIDRTKALDMIDRVDNLRVQ

SEQ ID NO: 36654 - protein, 132 aa, Sorghum bicolor
  Clone ID: SORBI-28MAY03-C99981_1.pep
LNSADIQATRRTPSTLHDTFWHTPLRGPSGLDSGPLYQPRSSYPVSPPCEDQYNITELQAMPQTIHLDSLGSRSPYQRRGMSSFPQYFNATCQENALTSSFSGNEIESLSPPVLQTQLLGPPRLPPRGSPEG

SEQ ID NO: 36655 - protein, 210 aa, Sorghum bicolor
  Clone ID: SORBI-28MAY03-C10001_1.pep
MANIRALLVGLSRARGSLAEVGRCASTRPSLLASLGAHYKIPMPAHWFSSAGLPPHLVVGMPALSPTMNQGNIAKWRKQEGDSTGVGDVICEIETDKATLEFESLEEGYLAKILAPEGSKDVQVGQPIAVTVEDLEDIKSIPADTSFGGEQKEEHSTESVPQNKVVNVPEQTSTVSRISPAAKLLIKEHGLDTSSLRATGPRGTLLKGDV

SEQ ID NO: 36656 - protein, 251 aa, Sorghum bicolor
  Clone ID: SORBI-28MAY03-C99735_1.pep
HEADELEENEEVEDGDDFDADEEEEGDIMDDDEEFEDDYNFEDDFESDDEQDLYAGDGGAGGGISLAGTWWDKEALALAEQVSASFDDDLKIYAFKTAANLTIRVRIEKMSTRYGSPTIDDIEAYTIAYRAKLDDAESTGKIPKNISLEVSSPGLERVIRIPEELERFKERAMYVRYTTTSDEAATPQEGDGVLRLISYDMDLRECIWGIADVKINRQQSGKGRPLSKKQREWRLQTPFESLKLVRLYSEC

SEQ ID NO: 36657 - protein, 163 aa, Sorghum bicolor
  unsure (1)..(163): unsure at all Xaa locations
  Clone ID: SORBI-28MAY03-C9974_1.pep
PTRPKWDPTGSFLASCSDDWTAKIWSMKQDKCLFDFKEHTKEIYTIRWSPTGPGTNNPNQQLLLASASFDSTIKLWEVEHGRLLYSLSGHRQPVYSVAFSPDGEYLASGSLDQCLHIWSVKEGRILKXYRGSGGIFEVCWNKEGSKIAACFSNNTVCVMDFRM

SEQ ID NO: 36658 - protein, 85 aa, Sorghum bicolor
  Clone ID: SORBI-28MAY03-C99754_1.pep
ASRKHFILCISEIKNLRRNRSRDFSVQNSKFIFNVFEFNISEFMHLDVYITQCVSLLSSQLYICNCSLIGSSTTSLSFEILFNFI

SEQ ID NO: 36659 - protein, 163 aa, Sorghum bicolor
  Clone ID: SORBI-28MAY03-C99766_1.pep
AEVMPAQWEYQVGPCTGIEMGDQLWISRFFLHRVAEEFGAKVSLHPKPIAGDWNGAGLHSNFSTRAMREEGGMKVIEEALKKLEPHHVECIAEYGEDNELRLTGRHETGSIDSFSWGVANRGTSIRVPRETAAKGYGYFEDRRPASNADPYRVTKVLLQFSMA

SEQ ID NO: 36660 - protein, 127 aa, Sorghum bicolor
  Clone ID: SORBI-28MAY03-C99773_1.pep
PPESQPKPAHANGISASDSKKPTSAFELFCLETRPGLESKEKANEIPVNIEDELTRIWKGLSDGEKDEYEAKFELAMAKSDESKKSPASDKKDDKPAESKQLVQDEDIEMGDDTEDQDTQAGEKVEE

SEQ ID NO: 36661 - protein, 98 aa, Sorghum bicolor
  Clone ID: SORBI-28MAY03-C100373_1.pep
HEGLDQLSERCVSCLYNIVEKHKGERVILVSHGGTIRELYRHASPTKPLHCKIHNTSVSVILVSDSTGRCIVKMCGDISHLQETGVLENAFGGDKNSA

SEQ ID NO: 36662 - protein, 95 aa, Sorghum bicolor
  Clone ID: SORBI-28MAY03-C100400_1.pep
ESLRLKMKRCTLNSGTNIHAGRQVNVRHRRRGRITRFRSAARPVAGLSGRRVPGGRRRAATAARWCSAAAPSPAAAPGGRTPRRRAALAAPFGRR

SEQ ID NO: 36663 - protein, 214 aa, Sorghum bicolor
  Clone ID: SORBI-28MAY03-C100430_1.pep
HEGKTDACSNSAGICPPVAKRSDPTVCPPGTGFFQSCSNGFRGCCKGDACGQKEPICPTTVNKRSDPTVCAPGTGFFQSCSNGFRGCCKTDACSQKQPICPPAVAKRSDPTVCPPGTGFFQSCSNGFRGCCKGDACGNTWCPDYKTGTYQPAQSLEVKTRSSGTCAPGTGFFQVCANGFKGCCKKDACCSEAALSAPSKRRSLSHFSSNGFTLA

SEQ ID NO: 36664 - protein, 82 aa, Sorghum bicolor
  Clone ID: SORBI-28MAY03-C100437_1.pep
RALYPLPKWLQQNHNQNITNQLVIIYNTSTPQRVFSPFNSLHCTGPTARGAYRTKVILKHMQDQRGHNVAMVTVKPSHLIIQ

SEQ ID NO: 36665 - protein, 166 aa, Sorghum bicolor
  Clone ID: SORBI-28MAY03-C1005_1.pep
SRLTRAPLFAPLRLSSLPLSPCSPRAPGALRPPLSISLCLSLCPQLPAPSGSAPLHRLLFPLATRYSLGSSPWSGPPAVPVRSQRKRTGASSKGPLDRGGRWLLCRAAARLQSWRLLSTGRRHKQWRFPSPFSQLWIPSVDRGSTAEAARPPAIAPVEGHSLSYIL

SEQ ID NO: 36666 - protein, 56 aa, Sorghum bicolor
  Clone ID: SORBI-28MAY03-C99860_1.pep
KPVYLLDFTYLSQLRKDAHPTKYDGGIFGGDCTHWCVAGLPDTWNVLFYAALTGQD

SEQ ID NO: 36667 - protein, 104 aa, Sorghum bicolor
  Clone ID: SORBI-28MAY03-C99876_1.pep
ISMFNICEDSLLASPLIIDLVIIAEMMSRIQWKAASTDGAATTEYKSFHSVLSVLSYMLKAPLTPPGTPVVNALAKQRAALTNIFRACVGLEPESDMTLEHKLF

SEQ ID NO: 36668 - protein, 80 aa, Sorghum bicolor
  Clone ID: SORBI-28MAY03-C99877_1.pep
PSISNQAHPPVQDLGQTTIQYIPRYILLQAVNISHLSCLSYVYDHQLLYAINHQHHCCMPQTLCFPQDCIYIYGSRHFFV

SEQ ID NO: 36669 - protein, 190 aa, Sorghum bicolor
  Clone ID: SORBI-28MAY03-C99893_1.pep
MPAYHSVFLDEPNQQLIGNFALLPLRTRTRGPAIQLPALPADVTELTIDASHESYDPLDEILALFRANTFFRNFEIKGPADRVLIYGILYVSDVLGKIKPGMTRREAEKAVMNSALDTNFAIPGDAGFPLNQAFEAPPDRNSAEVLRQYIMQMRQELATRLLNRVYADETNTPSKWWLSYTKRKFMGKAL

SEQ ID NO: 36670 - protein, 250 aa, Sorghum bicolor
  Clone ID: SORBI-28MAY03-C9988_1.pep
IENLGRRLVQVLRRNGPFVVLHLRYEMDMLAFSGCTHGCSNMEAEELTKMRYAYPWWKEKVIDSDAKRKDGLCPLTPEETALVLQALGIDRSYQIYIAAGEIYGGQRRMAALTSAYPSVVRKETLLPSELSLFQNHSSQMAALDYMVSLESDIFIPTYDGNMAKVVEGHRRYLGFKKTVLLDRRHIVELVDEYRNGTLSWTDFSSAVMASHISRMGEPSRRQMIPDKPKEEDYFYANPHECLPVEDFSAL

SEQ ID NO: 36671 - protein, 182 aa, Sorghum bicolor
  Clone ID: SORBI-28MAY03-C100725_1.pep
ARGKHLRIFECPSLSKPWEPSANGESQGLDFPLHLEKLEIDNTSFFKICICKKLPFLQHVVFFMANNVRAFTEEQEKALCHLTSLQVLDFCYCPDLQSLPNELYCFQSLKKLSIKACPGLQSLPEKGLPASLQELYVSNCSVELKEQCRKMKNVRRVYVDRHRSKFITVCKMLRLYFRNRRR

SEQ ID NO: 36672 - protein, 99 aa, Sorghum bicolor
  Clone ID: SORBI-28MAY03-C100800_1.pep
MRILFYPQWINLGCGHFTSMFGCSLGRSGPLGTWASAVPARSARPYRLSHRASCIFWTGAQTSALQSCCFSASSLSTSRRCLGGLPGGVAHPCTQPKKS

SEQ ID NO: 36673 - protein, 186 aa, Sorghum bicolor
  Clone ID: SORBI-28MAY03-C100832_1.pep
HSTITCYTHASISPDGPNTQPRFAGIGIVFVNMQGDPGNKLFIKAIIKDASSVIMAEAGALALAARIAVSMGYTNVSFFSGSSQLVQFLSTHDHSHSPDWRMKNFTQEYDNSTASIQSNLYKINRAENLVADSLARNALPLASTVHQPFSLDCSFRAHESQCPMFQALKSVTTTMHSVWLLAASCC

SEQ ID NO: 36674 - protein, 122 aa, Sorghum bicolor
  Clone ID: SORBI-28MAY03-C10091_1.pep
VKRKPVNAVDGKHADGEGRRRQKIETRISCAKIAAVTSTAIKHTDLQNKHASHLPTSATPSTEANGVFRERGTNSEEHQHSVENTETSRQAGSDCIKDVGSMSPEKAVNTTNTSDSEPYSVR

SEQ ID NO: 36675 - protein, 112 aa, Sorghum bicolor
  Clone ID: SORBI-28MAY03-C100837_1.pep
WPQHCDSGLWCLVLQRRLPRFCLKFSKKMVCLDSLHMMPGGSTWSAHAGGLGHSGGLGWPTLVWSVKRFLWSGLTSIHVYSQMYSTINADDCKPLMRTLAIHKIQFVIIIVF

SEQ ID NO: 36676 - protein, 153 aa, Sorghum bicolor
  unsure (1)..(153): unsure at all Xaa locations
  Clone ID: SORBI-28MAY03-C100967_1.pep
MWESVALTLAGTAGNNIGKVLQKKGTLILPPLSLKLKVVKAYASNQLWISGFLMDMCGAALMLTALSQAPVSVVQPIAGCGLAILCVFSHFYLKEVMNGLDWIAITLAGLGTIGVGVGGEEQKVDQIPLLNIPWLVLSIVILFVXAQHMASYV

SEQ ID NO: 36677 - protein, 71 aa, Sorghum bicolor
  Clone ID: SORBI-28MAY03-C10005_1.pep
MADSGVLGDPFPSSLGCLDRKRNTKLTTIQPCASDEMSRMPLVCVSSNFFTGLSANETMKPFFLLQQTSCQ

SEQ ID NO: 36678 - protein, 85 aa, Sorghum bicolor
  Clone ID: SORBI-28MAY03-C1001_1.pep
MSGQGSSVQQSPLAAPTAGFPSQATANPQGISGIQGAASSTDSKFSGRKELPADIFTALYPPSTPMMPGWQRAPQFGMGYAMQYP

SEQ ID NO: 36679 - protein, 121 aa, Sorghum bicolor
  Clone ID: SORBI-28MAY03-C10007_1.pep
MGSRYEVEVTVGSARDLKNVNWRNGDLKPYAVVWIDSGAKTSTRVDLDNGENPAWDENLLVSLPPTSRLDDAVLYIDVVHANAAEGVKPLVGSARLPLRDVLDDAGVGGKASRNLRLKRPS

SEQ ID NO: 36680 - protein, 121 aa, Sorghum bicolor
  Clone ID: SORBI-28MAY03-C100160_1.pep
MHSLQRWEWDELCTFAPGLRELVVKNCPQLRELPRCIQNLRDLEDMEIVGCWELALLPHLNGLTSLQRLEISDCNSICSLPCTGLPRSLQVLSINNCHQLSHSCKNLRSIISSVWIDGHRI

SEQ ID NO: 36681 - protein, 141 aa, Sorghum bicolor
  Clone ID: SORBI-28MAY03-C100356_1.pep
PSLYTLSIAVGDVFGARHLLYGEKSLDTITRVNDLVLVGLGHVIGYPIASASVGALRGLLTNNLVALKGSCPNCGEQVFAFVKTDKSVRAPHRAECHVCECPLEYRTKIEKSLSGPRRSWVYGRVYLVKQGHPRKRKWIND

SEQ ID NO: 36682 - protein, 97 aa, Sorghum bicolor
  unsure (1)..(97): unsure at all Xaa locations
  Clone ID: SORBI-28MAY03-C101260_1.pep
YAAQYAQYYGGADPYAAYGGYANYVAMYQQYYGAQAQAHAPGAPGATPGQSASPPPPPGEAAPPPPPPPSGXPPPPPSGSPPGTGGSYGSVPPPPGL

SEQ ID NO: 36683 - protein, 131 aa, Sorghum bicolor
  Clone ID: SORBI-28MAY03-C101320_1.pep
TDPSQRQWEVKTWSDAQDLKIPGTDGIPGRREITVRSMMGDFGGNAGLLSLWFDQESWEWKYEYATCPLGSQHFWWFVHIFDFIVLVWMQSYAVLSVMEAYGVDVDGPFWRGVSRMKDFVLRRKQSVSDKK

SEQ ID NO: 36684 - protein, 114 aa, Sorghum bicolor
  Clone ID: SORBI-28MAY03-C101391_1.pep
PANEVHLVEWLKMMVGSRRAEEVVDPDMELKPTTRALKRALLVALRCVDPDSEKRPTMGQVVRMLEAEDVPSREDRRSRRAHSSNADSESKASSSEFEISSDRRELGPSARFQS

SEQ ID NO: 36685 - protein, 124 aa, Sorghum bicolor
  Clone ID: SORBI-28MAY03-C101427_1.pep
STIPNQYQTGRASPDVAYRNHRGNSSPATLPVSTQHGCYVLGPLLTRSRRPPCHGNPLPCLGPSQVAERSTQARPTQPQPPPLNVVASSREHALANLCQGHGPPELRHYHTSVECARSVTTREV

SEQ ID NO: 36686 - protein, 168 aa, Sorghum bicolor
  unsure (1)..(168): unsure at all Xaa locations
  Clone ID: SORBI-28MAY03-C10145_1.pep
MGNIFVKKPKITDVDRAILTLKTQRRKLAQFQQQLEKVIEAEKEAARQLVQQKKRDRALIALKKKKAHEELLKQVDTWQMNVEQQLADIELASKQKAVFESLKSGNAALKSIQNEINIDDVQKLMDDTAEAKAYQDEINAVLGEQXSAEDEEAVMAEFENXEAQLAVE

SEQ ID NO: 36687 - protein, 193 aa, Sorghum bicolor
  unsure (1)..(193): unsure at all Xaa locations
  Clone ID: SORBI-28MAY03-C10059_1.pep
RAHERDGREQGDAGEPGAAHVLEPGRGGQRRRPPQHGAAVRVAVHARGQRAHPDGRRXPVAGTPYDFLAPTPVGARIRQVSGGKAGIYGYVTNYAVDGDDAGAGAALRKVAVVRDGKSGRAMELWANQPGVQFYTGNFLQDVEGKGGKVYGQYGALCLETQGFPDAVNHPSFPSQIVSPGQVYKHDMVFKFSF

SEQ ID NO: 36688 - protein, 218 aa, Sorghum bicolor
  Clone ID: SORBI-28MAY03-C10051_1.pep
MWTHTRKIPEGGSPEKLNLDRSSGDESMEEHVAEIKQVESNMKSDVLEGKNELNSEDVKEVILPDSVVEPSKEVIAEEKSAASAEKRKLEAEEGVANTEPIKRQRRWTADVAKVPERQTLSQTGPETPKDIFQPAFKRSFGRSDSTASIDSPKERIVPPSEKPATTSLRIDRFVRPFTLKAVQELLGKTGTVQDFWMEDIKTHCYVTFSSVDEAVATR

SEQ ID NO: 36689 - protein, 119 aa, Sorghum bicolor
  Clone ID: SORBI-28MAY03-C100652_1.pep
GIPPDQQRLIFAGKQLEDGRTLSDYNIQKESTLHLVLRLRGGMQIFVKTLTGKTITLEVESSDTIDNVKSKIQDKEGIPPYQQRLIFAGKQLEDGRPLSDYNIQKESTFPLVFRLRGGQ

SEQ ID NO: 36690 - protein, 136 aa, Sorghum bicolor
  Clone ID: SORBI-28MAY03-C100641_1.pep
KPEIALMWRGGCIIRSVFLKDITKAYRANPELENLLFDDFFNKAIHNAQAGWRDVVSKGALWGIPTPAFSTALSFYDGYRTKDLPANLLQAQRDYFGAHTFRVKPEFASEDYPEGKDIHVNWTGRGGNVSASTYNA

SEQ ID NO: 36691 - protein, 134 aa, Sorghum bicolor
  Clone ID: SORBI-28MAY03-C102140_1.pep
AQEIATSLVTAFNTALKNKDLTALARLFSEDGFWRDHLALSWNFRTVQGPSNILSFLKSCSESKDGLRLTKIEVDSSAPVRKPQFLPIDGAGEVQGVQFFFEIETVRGKGLGLARLIEENGEWKIFTFYTRIQE

SEQ ID NO: 36692 - protein, 247 aa, Sorghum bicolor
  Clone ID: SORBI-28MAY03-C10215_1.pep
ENTQELKLFVELYKHESTDSRQLMESRERELAEWARVHVLKYSLNESKLEQRVIAANEAEAISQQRLATAEAEIAELGQKLETSGRDLVKQSDILKSKHEECEAYVVEIESIGHAYEDIMSQNQQLLQQIIERDDHNTKLFMEGVKAKQSHDALHLEMCSLQRNLQHASTLMDLCNQKIIRLEDQLRGWSERLRRLSEDGMQQSMSLGNSQRKLAGMHGEAPKLRQSMDVLQAKVGSNRLGVAELLI

SEQ ID NO: 36693 - protein, 89 aa, Sorghum bicolor
  Clone ID: SORBI-28MAY03-C102165_1.pep
SVSPRVFRRAGAETRGCRSSPPHAKVLLRLILRRCGPVFVFVFFSLVSGGQPWFSLVSDFQVASLGFAELILWPSAVVSNGGRSNLKLG

SEQ ID NO: 36694 - protein, 162 aa, Sorghum bicolor
  Clone ID: SORBI-28MAY03-C102261_1.pep
MSMLSAEVTEWGQSPKSVKVVPPQTPVNDSETEIRVIAAGLHQLVRSRAAGKHYTATELPHRPGVDGVGVNVSTGKKVYFSLLGTTQGSYAEIVNAPSHNIVELPEGVDPVVAAALINPVMASWMALRKRAGLKEGAAFKVFINGVTTASGKIAIRVARSLG

SEQ ID NO: 36695 - protein, 113 aa, Sorghum bicolor
  Clone ID: SORBI-28MAY03-C102294_1.pep
WRRRRWRWPAAARRGSTRCWAGARRRRCTPCAGRGTRCSSSIYPGPARSWIFVFKLSISFAFFQFASSSACSCLDIYKLLITTEYITIEANDHRPAGRPCAARTPQAVGNGGV

SEQ ID NO: 36696 - protein, 461 aa, Sorghum bicolor
  Clone ID: SORBI-28MAY03-C101_1.pep
MDERRTILMDRYEIGRQLGQGNFAKVYFARNLTDGQSVAIKMIDKDKITRVGLIVQIKREISIMRLVKHPNVLQLFEVMASKSKIYFVLEYAKGGELFNKISKGKFSEDVARRYFHQLISAVDYCHSRGVYHRDLKPENLLLDENENLKVSDFGLSALAESKRHDGLLHTTCGTPAYVAPEVLSRRGYDGTKADIWSCGVILFVLVAGYLPFHDPNLIEMYRKISKAEYRCPRSFSGELKDLLFRMLDPDPSTRISISRIKRSTWYRKPIEVNSAKIKHDTTRDKVCNGEATTSNSIECSNSEETRGSSSLPNLNAFDIISLSTGFDLSNLFEEKYGRREERFTTRQPAGTVFAKLNELAERLKLKIKKKENGVLKLASPKEGIKGFLELDAEIFELAPSFLLVELKKTNGDTIEYQRLVKEEIRPALKDMVWAWQSDRHQQRNESVQGEQQLSSPLPPQQ

SEQ ID NO: 36697 - protein, 80 aa, Sorghum bicolor
  Clone ID: SORBI-28MAY03-C101086_1.pep
LKAIRDGADVKGYSVWSLLDLYEMFGGYKAHFGLISVDFNDLRRQRQPRLSAYWYSDFLKNNVAIQVDNGEATATSHEQI

SEQ ID NO: 36698 - protein, 150 aa, Sorghum bicolor
  Clone ID: SORBI-28MAY03-C1011_1.pep
MAMRSAVARLIRSSSASPSRLSSSSILLKSGNAFFSNATPSDQKHIEESFNATPSDRKHIEEPFEVKEAEPVNASKSSPEKLLVLGGSGFVGSHVCKEALDKGLVVSSLSRSGKPSLNEPWADKVIWNQGDLLEPASLKDAMDNVSAVVS

SEQ ID NO: 36699 - protein, 129 aa, Sorghum bicolor
  Clone ID: SORBI-28MAY03-C101094_1.pep
FLQAASYAGFIVFYSWISSSFPRPPAKRAVAIAMINAFSQLGNVAGSYVWDLKENGYRKSYGIVLSMFGVTVVGCYIFRLVLIDLNKKLERGEAAWETRQDVAAHTAAVEVMDSPDEALRMKRDFRYLI

SEQ ID NO: 36700 - protein, 192 aa, Sorghum bicolor
  unsure (1)..(192): unsure at all Xaa locations
  Clone ID: SORBI-28MAY03-C10115_1.pep
GTKLSDGGTKKEPKKQSGGSKSKTAEADITVAKLDIRVGLIRKAEKHPDADSLYVEEIDVGEGAPRTVVSGLVKFIPLEEMQNRKVCVLCNLKPVAMRGIKSHAMXLAASNEDHTKVELVEPPESAAVGERVTFAGYSGEPEASLSGKSKTWEKLAAELHSNGELVACYKDVPFTTSAGVCKVKTIANGEIR

SEQ ID NO: 36701 - protein, 103 aa, Sorghum bicolor
  Clone ID: SORBI-28MAY03-C102516_1.pep
MGVPAFYRWLADRYPLTVSDAEEEEPVELEPGAFVPVDLRRPNPNGLEFDNLYLDMNGIIHPCFHPEGRPAPTTYDEVFKSIFYYIDHLFGLVRPRKLLYMAI

SEQ ID NO: 36702 - protein, 152 aa, Sorghum bicolor
  Clone ID: SORBI-28MAY03-C102583_1.pep
ARGDKELDAGISTTGRLLHTDQLKFFDKAAIVTDGDVLPSGQPNLWRLSTVHRVEELKSIIRMLPICAAGIILVTSASHNHSFAIQQARTMDRDITPHFKIPPASMLIFTNVGMLLTLAFYDRVLVRVLRRFTGRPNGITHLQRTGVGLTIA

SEQ ID NO: 36703 - protein, 63 aa, Sorghum bicolor
  Clone ID: SORBI-28MAY03-C1026_1.pep
PRHAAFRWFPFAGSWCWWPVEPTSQRAIAVSASAETSCARQCICSFKFWAWLIINYFGFVGFR

SEQ ID NO: 36704 - protein, 105 aa, Sorghum bicolor
  Clone ID: SORBI-28MAY03-C102663_1.pep
STMSRSSVYSDDSRSSAWTTTYTRIPKKQPKALRFLSWVAGAPPGATAVKKRTRDYRDDRSVSSSGSTFSNWDQSDTQLYWVVHPNSYYYSGSSRGSTSSGHSKR

SEQ ID NO: 36705 - protein, 239 aa, Sorghum bicolor
  Clone ID: SORBI-28MAY03-C10271_1.pep
HEAGPFRAVHLVCGYYADAARQRQLARWVQTFVAKGVQELILVNRPMPLHVPLPAAHASAQSYTRLYLGLWKFPDTSALRQCQSDAGVVFPHLRELVLCWVMVESRDMDFLLAGSPVLETFGIMGIREKAMRLRHAGQHLRCTQILMSTVDSVTVVDALSLERLILWEAMPCNSSCIRVKIGKVPKLQVLGYLSPGSHMLEIRNTVINAVIKATPSTMVPGIRILGLYMRFGDTNDSKM

SEQ ID NO: 36706 - protein, 81 aa, Sorghum bicolor
  Clone ID: SORBI-28MAY03-C101521_1.pep
DNFHAILCTVDVVIDQTYALEPAEYKLATFLENINVSQDSCYSFVSNRSIWRLDKRIGASGTLGNRSNPTAKNPVSYLLPM

SEQ ID NO: 36707 - protein, 108 aa, Sorghum bicolor
  Clone ID: SORBI-28MAY03-C101790_1.pep
GSGSASRFCLPRMYGDRLWLPRMYGSGEAERTPFFLVQGSADRASKLDSMGAADRTSDCGTGAARVEMANVARMNVERMLSVLNYCCWKDVFVFNCLICDTCTARWIN

SEQ ID NO: 36708 - protein, 98 aa, Sorghum bicolor
  Clone ID: SORBI-28MAY03-C101800_1.pep
GRNLFGSSSLSLRSTHILSITLLPFLSTLLISFIFTPPSQSISLFPRISYRFTTVIRLRLPTSTDLIIADLMSRSQSRRTFNPERFCRPILTFAWLNL

SEQ ID NO: 36709 - protein, 105 aa, Sorghum bicolor
  unsure (1)..(105): unsure at all Xaa locations
  Clone ID: SORBI-28MAY03-C101845_1.pep
TRAGRSPRQQATLVRLHSPASATPANPPPDPPLLLLLLFVPDPSAIGWSCSGAPLISAAALRWFRSARGATXGPSRSTGSMERARLTPFPPREQATTRICKVSRY

SEQ ID NO: 36710 - protein, 176 aa, Sorghum bicolor
  Clone ID: SORBI-28MAY03-C10186_1.pep
ASTSTAAAVVPTETETVLPPPLLGSRLLDAEEFRRQGHQVVDFIADYYASMEDYPVHPNVTPGFLRRQLPSDAPSRPKPDAFAAALRDVHDLILPGVTHWQSPRHFAHFPASSSTVGALGEALAAGINVVPFTWAASPAATELEMVVVDWLGKALHLPRGLLFCGGGGGTLLGTSC

SEQ ID NO: 36711 - protein, 140 aa, Sorghum bicolor
  Clone ID: SORBI-28MAY03-C103127_1.pep
HFAHIDKNLFKSERATIVRPFHSMSERRRPRLACSERPRDVSVLLLRSSVVPSNQAFRTLAETAWHGCAWFVRLVFTPSKFLLSCFCFDMVVASSKAHLASRVSRVLGIRFLPPPRPSQDLYFKDSPCKPRQTLSGHMPT

SEQ ID NO: 36712 - protein, 86 aa, Sorghum bicolor
  Clone ID: SORBI-28MAY03-C103198_1.pep
MLPFFWIELIAFQWHSVTFGIWNFEDFPVRPPPMFHAAFFLLRRILRKKSTSKYQQERCVVNVSSFPHLARDFCPLFECTVDLTSS

SEQ ID NO: 36713 - protein, 192 aa, Sorghum bicolor
  Clone ID: SORBI-28MAY03-C103200_1.pep
HEGSPDLGNMLGGSPDVSLFNQMLQNPAMMQMMQSIMSDPQTMNQLLNFNPNTRNLMESNTQMREMLQNPEFLRQLTSPDTLQQLLSFQQSLLGQLGQLQPSQGGNNAGSATGTQGNPSLDTLMSMLSGLGSGGGLGVPNTSNVPPEELYATQLTQLQEMGFIDTAENIQALVATAGNVHAAVERLLGNLGQ

SEQ ID NO: 36714 - protein, 269 aa, Sorghum bicolor
  Clone ID: SORBI-28MAY03-C10333_1.pep
SPLFPPHPSSASSSYNHRGTLDIYLSIESARGEGGVEMTGLNGKRKAVETPLAKRPAQHKPQASRRTKRTKEPALPRKRESSTARAPLADGRDEYASVSYSLRNRIVYVPIPKNTSKHIVPSTSEPAPPESDFRKEPKYRQSNQTSTCAQMGLEHYNSMNQGDEHELVKAVDSNSVIFNGVWIHANFLAKRKGATTCPDLVPKYFFTEVKCDYNGLSCLSCVKLDPGVPRKFGGCGVCPPQIMHPVDGGYLSAQPFNPSAPPGNCVMGL

SEQ ID NO: 36715 - protein, 167 aa, Sorghum bicolor
  Clone ID: SORBI-28MAY03-C103357_1.pep
GVRHSNSRAVGSRVGGSPWRWVRLYAGSDEVERFYTNWDVSSLDPLRGSGCWAGNREQMVGGGGWAWRVEEMGKCIRRRGRVGMGRRGTQPERLACIRRRVGDVAVAGVGVGTAATAWSTPKSSARRELADPSAWRASAGERAGGGSPIRAGGPRARSCGGERCCGG

SEQ ID NO: 36716 - protein, 141 aa, Sorghum bicolor
  Clone ID: SORBI-28MAY03-C103364_1.pep
TRLLLSPSSHRPTPAILASPSATTSFLASLDRFLSDPHPAASAAAPGELDAAIRVQEEARLYGDEYPAWPAPAAGPLRVYVYEMPGKFTYDLLRLFRDSYRDTDNLTSNGSPVHRLIEQHSIDYWLWADLIAPESQRLLKS

SEQ ID NO: 36717 - protein, 254 aa, Sorghum bicolor
  Clone ID: SORBI-28MAY03-C102370_1.pep
HEGQNEKTRREDFHRTWSRYIPDNVMCSMGLFDSPSQCDVKVAPFDRDLLPIDVDDVEKLAPQSILGSFLKSERSQLAKPLLSNSSTSGNLNKSEQNPLSADDKMDFQDFLGGYDSIDIAGTSKLEVENARLKAELASAIAILCNVGAEYGYESIDEGQIDAVLKKAREKTAEALAAKDEFAYQLQSLLTAKQEKCLAYEKRIQDLEERLANQYMQGHMVSGSKGTSDSLLSAFSNDCNLDVSGVRQTQIRDES

SEQ ID NO: 36718 - protein, 208 aa, Sorghum bicolor
  Clone ID: SORBI-28MAY03-C102392_1.pep
ARGTPFMQVGPSIARIHGGTGIGLSISKCLVGLMKGEIGFASKPQVGSTFTFTAVLTRAPPGGNENKSSEFKEINALVVDHRPVRAKVTKYHLQRLGVHTELTTDLDQYISKINCGSQIAKLVLIDKETWLEESHSMPHLVTKLRNKDQPDSTKLFLLENPKSSVKSSLHIFREYNLNVIMKPLRASMLQVSLQRALGGIDKLHCRNG

SEQ ID NO: 36719 - protein, 146 aa, Sorghum bicolor
  Clone ID: SORBI-28MAY03-C1024_1.pep
FMYDGVPLLAMLDEYVMLRQEREEEKKRMREQKRYIEQQLNTDHEGPFGSRVSPNRPASSKKAIGPKLNGSVSNGTPPNRRLSISGQQNGGGHGVRSGGKDSKKDTVKTASPGNNAAAAAPVGVAATAKEDAASQISVSDPVPSTP

SEQ ID NO: 36720 - protein, 73 aa, Sorghum bicolor
  Clone ID: SORBI-28MAY03-C102432_1.pep
AGSRGRCPGHGRRLGLPPARLHERDASPPDKLSHSPKVEEPVAAVVDLTVLMPGHRYPTFLAQPAPLAPCPRE

SEQ ID NO: 36721 - protein, 101 aa, Sorghum bicolor
  Clone ID: SORBI-28MAY03-C102440_1.pep
HEERIQEAGYAPNTGSVLHDLDVEERESMLRIHSEKLAVAFALMNSVQGSVIHVIKNLRVCTDCHAAIKIITKLTGREIIVRDIKRFHHFKDGLCSCGDYW

SEQ ID NO: 36722 - protein, 153 aa, Sorghum bicolor
  unsure (1)..(153): unsure at all Xaa locations
  Clone ID: SORBI-28MAY03-C10380_1.pep
SINLTLSIQRFSISPSFVWFPPYLHHNPPARAFSQENPLPIHLIIASRSLNLDMEQHPTCAPPPAPVPVAGAVVPVDFKVVKKGPEMAMHDAIGRLAFRAAGRDSWATALHDDRWSVLVTVRSSGQGEWQAFSGNSLEQRHIIFTAXVISASS

SEQ ID NO: 36723 - protein, 71 aa, Sorghum bicolor
  unsure (1)..(71): unsure at all Xaa locations
  Clone ID: LIB5050-004-R1-XP1-H2.pep
GSCMPISGPFFTTLKSTGSTPPATGTGAGGGAQVGCCSISRFKDLHPASPSVDRREICFIRTRGPXXSSAA

SEQ ID NO: 36724 - protein, 178 aa, Sorghum bicolor
  Clone ID: SORBI-28MAY03-C1039_1.pep
MQAHGIAVRARAPVAPAHARRRRQCRVSATAAVAAPAARARVTHSMPPEKAEVFRSLEGWAARSLLPLLKPVEECWQPTDFLPDSSSEMFEHEVRELRARAAGLPDEYFVVLVGDMITEEALPTYQTMINTLDGVRDETGASACPWAVWTRAWTAEENRHGDILGKYMYLSGRVDMRM

SEQ ID NO: 36725 - protein, 245 aa, Sorghum bicolor
  Clone ID: SORBI-28MAY03-C103900_1.pep
DNMLEPSDKMPWNKAGTLLEALDSIKPPKRPVDKPLRIPLQDVYKISGIGTVPVGRVETGILKPGMVVTFAPTGVTTEVKSVEMHHEQKLEAVPGDNVGFNVKNVSVKDIRRGHVAGDSKNDPPLGCLSFTAQVIILNHPGEIKAGYAPVLDCHTCHIACKFEQLIKKIDRRSGAELEDNPTKLKKGEACIAKLVPSKPMCVETFTDYPPLGRFAVRDMRQTVAVGVIQGVEKKAPAAAAGGKKK

SEQ ID NO: 36726 - protein, 203 aa, Sorghum bicolor
  unsure (1)..(203): unsure at all Xaa locations
  Clone ID: SORBI-28MAY03-C10401_1.pep
ARWRRPPSRRWTGRGRRSRTAPAPAPPARTPTAPGPRTPAPRAXTTPAPAGTPRAPAAPAPAPAAPRPRPRAATLPRSPRAPPPSPPAAAAAGHYCTLPKLLPPLLHQQPQHARRRRGAGPMTPAAAAASLSLPMGLIMAMVTTGRRRWLVAEKVLLLLLLRWLPAACTGGCMGTAEVYVRGAHMPTFSSSRGRRERDKVPIG

SEQ ID NO: 36727 - protein, 132 aa, Sorghum bicolor
  Clone ID: SORBI-28MAY03-C104029_1.pep
MAESYHKEVISGLKDKSLFIQDAFIDGKWVAKENKFDVFEPSTATVLGQVANCTLEDFQTAIKSADAAQTKYFDSTTGASRGALLRKWYDLVLSHQEDLAKILSLENGKTYAEALGEVIYSASFISWFAEEA

SEQ ID NO: 36728 - protein, 200 aa, Sorghum bicolor
  Clone ID: SORBI-28MAY03-C38925_1.pep
MAAADRQLVVAVQGTAALGPYWSTIVAEYVEKIVRSFCASELPGQKLAGPPPELALVVFHTHGPYSAFDVHRSGWTKDTDAFLSWLSGISFSGGGFSEASTCEGLAEALKILQGSPNATQSHQNHEAQKHCILVAASNPYPLPTPVYCLPTQSTDHKENIETSKEPSIADAETVAKSFAQCSVSLSVISPKQLPTLKAIY

SEQ ID NO: 36729 - protein, 220 aa, Sorghum bicolor
  Clone ID: SORBI-28MAY03-C117943_1.pep
RERGSKRQQEWQPKEAAAEEEEEESGAVPTESSPKTDGAGVKPSGAAETTTSSKAVCNTDGPVSETCELDGDVRTNGSARSVTFVPASPSSSERREWKVRPYSRRTMSGVDRVTVTQLESPAAASPPPAACAVTHDVPGVLFALGGLTGNYWHDFSDVLVPLFAASRRYKGEVLFLVSNIQPWWLGKYEAVVRALSRYDAVDLDRDARVRCFRHLTVGLR

SEQ ID NO: 36730 - protein, 133 aa, Sorghum bicolor
  Clone ID: SORBI-28MAY03-C118010_1.pep
TARTVNSHDVLLGVHGAGLTNAVFLPAGGVVIQVVPYGRLERMARTDFGEPVADMGLRYLEYGVAAEESTLLEMLGPEHPVIKDPEAIHRSGWDKVAEYYLGKQDVRIDVNRFAPTLAQAMDHLRHRHRHRQQ

SEQ ID NO: 36731 - protein, 192 aa, Sorghum bicolor
  Clone ID: SORBI-28MAY03-C118039_1.pep
ARGYYLVPTTVKQSASIQSIICIPLMGGVLELGTTDTVLEDPDLVSRATAAFWEPQCPTYLEEQEPSPSSNTPSANETSEAAADADDIVVFEDLDHNAMEMETITAVVEGHGQELREAESLSNASLEHITKEIDEFYSLCEEMDVQPLEDGWIMDGSNFEVPSSPQPTPPGNLADGSRATSFMAWTRSSQSC

SEQ ID NO: 36732 - protein, 208 aa, Sorghum bicolor
  Clone ID: SORBI-28MAY03-C1181_1.pep
GGPGPDFPGWPHPSAISELLQEIDRPIILSISPGTEVTPALAENISDHVNMYRITGDDWDNWKDVSSHFGVSSSFAAAKKIGATGLRGRSWPDLDMLPFGWLTDPSVNQGPHRKCNLTLDEQKSQMALWSMAKSPLMYGGDLRNLDDSTLNIITNPALLRINHYSRNNMEFHYVYSERTSNEEHPGHRSYPVHLTKNDGMFCQSHYLQ

SEQ ID NO: 36733 - protein, 198 aa, Sorghum bicolor
  Clone ID: SORBI-28MAY03-C10428_1.pep
MERTLITSNLSMSAHASRSSGRVHYISPAASAAAQNSSYRKKKKSAPSPPPSAAATATVVTSPPATDNVQSSAVKQTGRQELEELVATKANTSRIASAPSQAQARAQPRRRPAPAATSLPMAFCSALEEAINTFVDPPALRPSVDPRNVLSTNFAPVDELPPTPCPVVRGAIPRCLAGGAYIRNGPNPQHLPRGPHHL

SEQ ID NO: 36734 - protein, 184 aa, Sorghum bicolor
  Clone ID: SORBI-28MAY03-C104273_1.pep
MKVQELCDQDMLVDLEKGNCLLSKEDNSEMKVNSIAGHARTKPHSSWDDLVALKDDKSHHISRYSSHCRDSTVKSGEPTASEGEIKVGLLDKSAADMEKKKWYKKPPRPPRPPTTPPLDPADQKLISELSELAVLKRARIERMKALKKMKNSKPASSIGNLVALTITVIFCFFILWQGITTGNP

SEQ ID NO: 36735 - protein, 206 aa, Sorghum bicolor
  Clone ID: SORBI-28MAY03-C104375_1.pep
PPDVLQAIALAEAEAKKAAKKETLKGPKGAVAAAAAAAASNASVKARKAAPTAPPKFSKAARRFYNENIKEREPQRLAKVLAAAGVASRRTSEELIFQGKVTVNGSVCTSPQTKVDISKDSIYVNGNRISKKLPPKLYFAGNKPKGYICSCGEDSKSVVSLFNDYLKGWNKIQPGLPKPRLFTVGRLDVATSGLIIVTNDGEFAQK

SEQ ID NO: 36736 - protein, 158 aa, Sorghum bicolor
  unsure (1)..(158): unsure at all Xaa locations
  Clone ID: SORBI-28MAY03-C104377_1.pep
ARGEIDEYFLKAAASGKDVVILLDSAGGRPDALEIEAKKGAGKNSKSAKVFSTLSWSWSFKSQQANSESSVLNSSDSSGYGYHGKTLEKLYDEEQKLYKLIXEFARLQYKKHVSVLQKLESGEHDRLHAERVRDAIEELQTRIISLEEAVSLACFSIS

SEQ ID NO: 36737 - protein, 236 aa, Sorghum bicolor
  Clone ID: SORBI-28MAY03-C10455_1.pep
GFVPVDERMQVMDATGNVVPNLYCIGDANGKLMLAHAASAQGISVVEQISGRDNILNHLSIPAACFTHPEISMVGLTEPQAREKADKEGFEISVVKTSFKANTKALAENEGDGLAKMIYRPDTGEILGVHILGLHAADLIHEASNAIALGTHVQDIKFAVHAHPTLSEVLDELFKAAKGTSGAPRAMLQPVAVSWGTGLMSPLLPPPHSAVTSPLVATCLPLTGSCVSSLSPACSF

SEQ ID NO: 36738 - protein, 122 aa, Sorghum bicolor
  Clone ID: SORBI-28MAY03-C104727_1.pep
RGGRPSTAAWAWGPPSVQGSARRGRSAAPHRRELGRQRGGGSGQAGTSLPPPAAPAAALRKDGETTERGLLLPPKAKDPIRGKVPRLSLSPFLLVLASAAFHWQRFLSQLLQQPCSLSLPRA

SEQ ID NO: 36739 - protein, 189 aa, Sorghum bicolor
  unsure (1)..(189): unsure at all Xaa locations
  Clone ID: SORBI-28MAY03-C10339_1.pep
MLLSLVRAGSAPLRRVVSTFSSTRAVSPRFRCAISSGGNLNLPLYAHPSPSRDGSSGPAGGARRGMSFCARAVDVGDEAASSSAAVGSDLSAPYLSVRIRCRRHDVEALSEALLCFGASSVTVDDIADAENLDEISITSLYADGEDVDSSVSSAACSAGLNYSPVYETXVGKQCDWVANVQETYEPTEV

SEQ ID NO: 36740 - protein, 252 aa, Sorghum bicolor
  Clone ID: SORBI-28MAY03-C10340_1.pep
PTRPVPSLSDLHLTHLQSSLLYPGLRRPDHVGPTIPIPARISTDLTIGGAPARDDDVPCALSIGATNKQKPDAVKPAGLVLFGRTILTEQQMSLSSSGGATSPAATTGNSSQLYWNAEKGPNVSEGSGSGVIQNSPTKNHASSERLPWCVGDGGSQQQVSELGLEPGQCKVFVESDTVGRNLDLSALSSFDELYRRLSEMFGIEGAELRSRVLYRCATGEVKHAGDEPFSDFVRSARRLTILTDAGSDNLGS

SEQ ID NO: 36741 - protein, 164 aa, Sorghum bicolor
  unsure (1)..(164): unsure at all Xaa locations
  Clone ID: SORBI-28MAY03-C10359_1.pep
MFGDGHTVTVINVQSKLSSPHIYSKDPGDEERLSTPGQNNKESSCYHNCERHCYQPILPWINGDGSTNSTLYEGXSRRVIGYVMHYPGLMEEDVIRRMDVLNPQTCRTLLEKLTLDGYLHVRVFEEPVPMAPTILQGLLKQHSSKEPSKCVKRYFANPMSTLQL

SEQ ID NO: 36742 - protein, 130 aa, Sorghum bicolor
  unsure (1)..(130): unsure at all Xaa locations
  Clone ID: SORBI-28MAY03-C103638_1.pep
HEGRAEATSSPISIRAREPDRDRDRDRKRSVGGHTRDTQGGRGNRGTFQSTADAAGREKLAALTRCLRPCSRRPRVRAPRGATCHISCCPVLLVSDGFARSIGCVFRRAHAGTKETVKNALSRWGRKVXE

SEQ ID NO: 36743 - protein, 163 aa, Sorghum bicolor
  Clone ID: SORBI-28MAY03-C103647_1.pep
ARGPGGRLPHLTPQLTPPSFLSLSLSLSPPLHVGGLELCLDHSCARWLGDPLIRPLPPLSALLSFSPRAPGQGDLRCRRARLAFLARARVGWAAVSFPRLPQPRFPSSCWIWLARSDVSCPVCSKILAWVVVPGDFWEDAARPEEEGTFRDGFFHGVWRGKQV

SEQ ID NO: 36744 - protein, 237 aa, Sorghum bicolor
  Clone ID: SORBI-28MAY03-C10525_1.pep
ARGKNGVDVGICLTCASQSALNKVDTRWTTGRDVWWQDVVPDFPTKCDVEWVDAEDPLFLLYTSGSTGKPKGVLHTTGGYMVYSATTFKHAFDYKPTDIYWCTADCGWITGHSYVTYGPLLNGATVLVFEGAPNYPDPGRCWDIVDKYGVTIFYTAPTLIRSLMRDGTEYVARYSRKSLRVLGSVGEPINPTAWEGFYDVIGDSRCPISDTWWQTETAGFMITPLPGAWPQKPGSAT

SEQ ID NO: 36745 - protein, 89 aa, Sorghum bicolor
  Clone ID: SORBI-28MAY03-C10528_1.pep
MGVQEDSRPSGALGGLYGVQFAGRALYSDDVAVKTSIVDSSTCEPQVDNGRSRRLLIWRLWKQRPPCLKPVHCSLSCDKHVGETIANVV

SEQ ID NO: 36746 - protein, 80 aa, Sorghum bicolor
  Clone ID: SORBI-28MAY03-C1053_1.pep
MLCSNEPAETFVRADGAFIPFAHDFDISTVSTTVRGVGDIGDVKFIDLQCPLNSLIGRQVCKIGRSSGHTTGTVMAYALE

SEQ ID NO: 36747 - protein, 90 aa, Sorghum bicolor
  Clone ID: SORBI-28MAY03-C105374_1.pep
PSDLERDVPNSKVSFSNIKFGPIGSTYKSDGTTPNPPASSSTTGSSTPTNPPAGSVDQWGQCGGQNYSGPTTCKSPFTCKKINDFYSQCQ

SEQ ID NO: 36748 - protein, 181 aa, Sorghum bicolor
  Clone ID: SORBI-28MAY03-C105467_1.pep
SLKWIIPSQMYPLEVRSAGKGMSEAISLALTFVQTQSFLNALLGSGDEGRKEIDARLCSAVVDEQGDGGGVDLIGGELGGVVDLVKHDTKHFVELDLGAQIFTKQIPYHVCKHTNKQQGEHPIRPITQVQAQCSIRGVVDAAADETGERSHQQTSPQPRPRLPPPRRATASRRLPSGRAGP

SEQ ID NO: 36749 - protein, 68 aa, Sorghum bicolor
  Clone ID: SORBI-28MAY03-C105618_1.pep
HEAPPPPPLPFGVYPPPPPLAMAGHLQQLPVYYLLKLWLTLHLDIYLLGIFGDFFFCTKVRCFFYLNF

SEQ ID NO: 36750 - protein, 276 aa, Sorghum bicolor
  Clone ID: SORBI-28MAY03-C104128_1.pep
LPPIVTHNMLNDHGAPVLNQIRRVQLFNHPTDRVKVVFHPEFLNSANPVLPLDYDDFVRGCHLGVFSSYYEPWGYTPAECTVMGVPSITTNLSGFGCYMEELIENSSDYGIYIVDRRTKGVDDSVNQLTSFMYDFCGKSRRQRINQRNRTERLSDLLDWKRMGMEYVKARQLALRRAYPNSFSGDDEEEDFIPGVEQKISRPFSVPGSPRDRTGMMTPGDFASLQEGREGLSTEDYVAWKLPEEEDPDEYPFPLTLRTKQPAPHSPSDNVPVNGTQ

SEQ ID NO: 36751 - protein, 163 aa, Sorghum bicolor
  Clone ID: SORBI-28MAY03-C104171_1.pep
HEEKIYPSDGLLPIYINPHSGTASYSTITFGAMGDSFYEYLLKVWVQGNKTEHVKHYRQMWETSMEGLLSLTKKTTPSNYYYICEKNGGSLSDKMDELACFAPGMLALGASGYGPEKSEQIMNLAKELARTCYNFYQTTPTKLAGENYFFHTGQDMSVGTSWN

SEQ ID NO: 36752 - protein, 99 aa, Sorghum bicolor
  Clone ID: SORBI-28MAY03-C104181_1.pep
MPSRSEITYFGAGPALLPTDVLEKAAQALIDYEHTGLGIAEHSHRSELATNIINEAKADLASYIDIPEDYEVLFMQGGGSGEFSATLYNLVGAWVTKKK

SEQ ID NO: 36753 - protein, 109 aa, Sorghum bicolor
  Clone ID: SORBI-28MAY03-C10421_1.pep
VFFQWADSTNKIYPHIVYEELSKSEVPNQCADTDNCKIEERLLQGLKRVSWEKVDVSFHNSKVRSAAHSVIQVLPLPSGGILIFRSKNLPRYQVHEPGVHVQRNPRWHF

SEQ ID NO: 36754 - protein, 168 aa, Sorghum bicolor
  unsure (1)..(168): unsure at all Xaa locations
  Clone ID: SORBI-28MAY03-C10571_1.pep
MAALPLATAEACDANAALIMNGDLRALQPIFKIYGRRQIFAGPVVTLKIFEDNVLLREFLEEKGHGRVLVVDAGGSMRCAVLGGNLAQLAQNNGWAGVVVNGCIRDVDEINGCDVGVRALNSLPIKSNKKGVGEKHAPVTFAXTRICDGEWLYADSDGNSIXRSELTV

SEQ ID NO: 36755 - protein, 217 aa, Sorghum bicolor
  unsure (1)..(217): unsure at all Xaa locations
  Clone ID: SORBI-28MAY03-C106108_1.pep
MEISFEAWEGVQRPGQDLADRLAQGFTGLLQAPPQFPWPPAPHKRMPMPLDIDLPVGPAGASCRRRRRXAPTTQAPLPPAASVGEGAVGLSVERAAVDRCPLEAAAAAAAAATGSAAASSVSGHVNGDDLDEDDEGFGCDIGTLGNFKKANGTVNMSATYNTRTQDIESSVVARGDLWRLEASRGGSTSGNDTSPLYLVQLGPLLFVRDSTLLLPVH

SEQ ID NO: 36756 - protein, 140 aa, Sorghum bicolor
  Clone ID: SORBI-28MAY03-C10620_1.pep
MAARAPLVMARAAASAGPLPAAATVAPRQPAQCLRARGAVSGLFFDQRTAHPVRRLLPDAKFGAIGSTAEAAPAEGLVQKLQGVEVFDLNGKAVSIVDLWKERKAVVAFARHFGCVLCRKRADLLAAKQVPWLISRAVLL

SEQ ID NO: 36757 - protein, 223 aa, Sorghum bicolor
  Clone ID: SORBI-28MAY03-C10625_1.pep
HEEDAKAIVVQILSVVAFCHLQGVVHRDLKPENFLFTTRDESAPMKLIDFGLSDFIRPDERLNDIVGSAYYVAPEVLHRSYSMEADIWSIGVITYILLCGSRPFWARTESGIFRSVLRADPNFDDSPWPSVSAEAKDFVKRFLNKDYRKRMTAVQALTHPWLRDEQRQIPLDILIFRLVKQYLRATPLKRLALKALSKALREDELLFLDAVSCEPKGDTRTSQ

SEQ ID NO: 36758 - protein, 166 aa, Sorghum bicolor
  Clone ID: SORBI-28MAY03-C106315_1.pep
MYRVVATASALIAAARAQQVCSLTTETKPALTWSKCTSSGCSDVKGSVGIDANWRWTHQTSGSTNCYTGNKWDTSICTDGKTCAEKCCLDGADYAGTYGITSSGNQLSLGFVTQGPYSKNIGSRTYLMENENTYQMFQLLGNEFTFDVDVSGIGCGLNGALYFVSM

SEQ ID NO: 36759 - protein, 200 aa, Sorghum bicolor
  unsure (1)..(200): unsure at all Xaa locations
  Clone ID: SORBI-28MAY03-C106696_1.pep
HEARLPLPPLRSTPLPPPRPRSTQLAPLPSTQPALLPSTLLPLPRPLPTPPPRSSLLPPMSPPGRPPSPTAPAPTLLARAAPXASLSTLPPTSTTPWLPLLLLPPSPPPLSPWPPPASPLTLPRPTLPSPLLLTTLPPTAPPPLSLLLRVPPPAPSPLLPSPPPLSSLVPLARPPLASSPLLVPLLLSCKQFALEWFVGA

SEQ ID NO: 36760 - protein, 144 aa, Sorghum bicolor
  Clone ID: SORBI-28MAY03-C104919_1.pep
IIKGEGHGSAVDWWTFGIFLYELLFGKTPFKGSGNRATLFNVVGQPLRFPESPIVSFSARDMIRGLLVKDPQHRLGYKRGATEIKQHPFFEGVNWALIRCASPPDIPKPVELECRPKQVPSANGKVAPVANQKGPDNYLEFEFF

SEQ ID NO: 36761 - protein, 133 aa, Sorghum bicolor
  Clone ID: SORBI-28MAY03-C10503_1.pep
NNDDHCSPVQVHFPEDQKISQVACGWRHTLALSEKKNVFSWGRGTSGQLGNGEIVDRNTPVLIDALSTDGSGCKKLESSTAAPFAAKVWVSPSERYAIVPDENVPKAGEGTARGNGADANVPENDVKRMRVQS

SEQ ID NO: 36762 - protein, 116 aa, Sorghum bicolor
  Clone ID: SORBI-28MAY03-C105037_1.pep
QFKAFWDKTGKQWQQGSFWGKHAGLFVSTGTQGGGQESTCLAAMSTLAHHGFIYVPLGYKTAFADLANLSEIHGGSAWGAGTFAGADGSRQPTELEIRVATAQGKAFYEAVAKAHQ

SEQ ID NO: 36763 - protein, 147 aa, Sorghum bicolor
  Clone ID: SORBI-28MAY03-C105157_1.pep
IKKAKLDTSTFFETLGGTESPGRTWMLIFTAKGRLVKGQYFPVTAVQRFDAAGKRIENGIYLGPIGCLTFEGRLSWKKKILAFIFERVRIKVGPLGPLEIGFGSSNDDREPSTKDPFFVWFYVDEEIAVAQGRAGGVAYWCRCQRVP

SEQ ID NO: 36764 - protein, 227 aa, Sorghum bicolor
  Clone ID: SORBI-28MAY03-C107519_1.pep
MSPPVKIIGHYASPFSHRVEAALQLKGVPYELIQEDLSNKSELLLANNPVHKKVPVLLHGDRAVCESLVIVQYVDEAFDGPPLLPADPYDRAMARFWADFIDTKLVQPFWLAHWTEGDGQKAQVEEAKQNLALLEAQLNGKRFFGGDTVGYVDLAACVLGPWLSAVEEVTGVVVLDEDEYPALRRWSKEYSSYEALKQCGPGRDQLVAFYTEKKEMYRMFANALLQQ

SEQ ID NO: 36765 - protein, 100 aa, Sorghum bicolor
  Clone ID: SORBI-28MAY03-C10750_1.pep
DAARAQEYCERAHKCTQGDAEALSLYAGLVWETSRDAARADDYYSRAVQAAPDDCYVLGSYAGFLWDAEEDDEENDNSETLPPPSLFQGAVQHPSITAAS

SEQ ID NO: 36766 - protein, 214 aa, Sorghum bicolor
  unsure (1)..(214): unsure at all Xaa locations
  Clone ID: SORBI-28MAY03-C107393_1.pep
ARGFGPYGDIEDLRVVTXDRNTGKCKGYGFILFRHRSGARAALREPQKKIGNRSTACQLASVGPVPGGAPNSAGAVPAPAQLHLPPVSEYTQRKIFVSNVGADIDPKKLLQFFARYGEIEEGPLGLDKVTGKPKGFALFVYKTIESAKKALEEPHKHFDGVVLHCQKAIDGPKPNKLGGAGGFFGAGASSGGKGFPGYGATSHSLPGTVGIVQP

SEQ ID NO: 36767 - protein, 70 aa, Sorghum bicolor
  Clone ID: SORBI-28MAY03-C107532_1.pep
MASAAAEANGGEGEELLLLSAAEAGRGGGATAEAEESWRLNFEGFRPPEAHQERPPTGPLHHCLGVLAQG

SEQ ID NO: 36768 - protein, 135 aa, Sorghum bicolor
  Clone ID: SORBI-28MAY03-C107295_1.pep
TRDMSGTAIRTLDLSATQAWGLKQLFLLGCEKLCLILWPKEKNREIYLEILCIDTTTTTYAAWDRKEGKSNKQEATASDGSSISIGSSSGMVCGMDRTIIDLDSYISIRDPMLFRSLESLRHEKWLHVEISSTGP

SEQ ID NO: 36769 - protein, 265 aa, Sorghum bicolor
  Clone ID: SORBI-28MAY03-C105648_1.pep
LLARLLLPRPRIRSRAAAGSAGAPLAAAASGSAPSDRPLVAAPVVPPPRQDVRELAFPGWAAGLGVARGAAEDLRAVLGLSCGTPVRSEHWGLERVRLGGRALGDWAEAGSSAAFGVSLRDFCPLFSAGSREGIRQLTDRAGALLTEVIQAWYVMGRLGAYNSSNLQLANSMMDYDPSYDSEEASPVMPSSFHDISDVEFQDCCALVASGRLGKRMCANSEIPLTFFSCRVDLGTSNYLGLDVLLNCLTQFSSEFGNINAPALLP

SEQ ID NO: 36770 - protein, 129 aa, Sorghum bicolor
  Clone ID: SORBI-28MAY03-C10566_1.pep
MAARCYAAASVVRAGAHDLSLSPSSFSVTAAARPRPVGGVWACGGAGGGYSWLRAVRAMGSAPSSSSSQSPSPQTPSGQTQGKADYTSLSEEEWKKRLTKEQYYVTRQKGTERAFTGEYWNTKTPGIYH

SEQ ID NO: 36771 - protein, 209 aa, Sorghum bicolor
  unsure (1)..(209): unsure at all Xaa locations
  Clone ID: SORBI-28MAY03-C10553_1.pep
CLLLKICYEFDFVREARAMERIREFLRVTNKKPPVMVPRVIPGMVSREVLVMEFIKGTPIMNLGNEMAKRGIDPGGKIAAMAKQXSPFISKEKILSDLTLAYGQMILKDGFFHADPHPGNILICKDTEVALLDYGQVKEMPEDLRLAYANLVVAMADDDFLRAEESFRYPELHTMHYLSKRPLRAFRHYTVAHRFHLITHLSHLNGSFA

SEQ ID NO: 36772 - protein, 146 aa, Sorghum bicolor
  Clone ID: LIB3478-015-P1-K1-F4.pep
VEKQFGKNFDDIFEFFDVEPVGSASIAQVHRARLKLSKADVAVKVQHPGAEHLMMVDIRNMQAMALFLQKYDINFDLFSATKEMEKQICYEFDFVREARAMERIREFLRVTNKKPPVMVPRVIPGMVSKKGLVMEFNKGTPIMNLG

SEQ ID NO: 36773 - protein, 236 aa, Sorghum bicolor
  Clone ID: SORBI-28MAY03-C10570_1.pep
SAVPQASVLPPVPGATIVPFTTMQAAVSKNMVESLAVPAFRVGYPIVTDKLDALYEKVKPKGVTMTVLLAKATAMALVQHPVVNASCRDGKSFTYNSNINIAVAVAIDGGLITPVLQDADKLDIYLLSQNWKDLVKKARAKQLQPNEYSSGTFTLSNLGMFGVDRFDAILPPGQGAIMAVGASKPTVVADKDGFFSVKSKMLVNVTADHRIVYGADLAAFLQTFAKIIEDPESLTL

SEQ ID NO: 36774 - protein, 313 aa, Sorghum bicolor
  Clone ID: SORBI-28MAY03-C10839_1.pep
SRHDEELMTNSAGSDSSSSCMSEGDRESSSSSTTSSSTQNPESSSESEESPKRINSKVGTPSSRAASRSLVEACAGNGFREYQPKATRPAHNDMFGYNVSPVQDQLLHYQGMHAPQRPPITMGFHDRPWAAPTNGNFQYARPSHLYSSPLVFGIPGNHFIDYPYMAPAFSHIPPEPIHKASASFRAMPLSPPFQNGHRQVAGHTQRDMNLERHHSKLTIPTGMDPPEDKTKSGLKDLSEDKNKPWNADASFSLFQFNLPIASPVTPSSKDKSEELAARTPLVQVQAQHCSREQADVKEYNLFSSKDNGIFSFM

SEQ ID NO: 36775 - protein, 251 aa, Sorghum bicolor
  unsure (1)..(251): unsure at all Xaa locations
  Clone ID: SORBI-28MAY03-C10868_1.pep
HEARELLSSGHSDIPEEATLTTVEQLLEPLELCYRSLCACGDRVIADGSLLDFLRQVSTFGLSLVRLDIRQESDRHTDVLDAITTYLGIGSYRGSPEERRQEWLLSELNGKRPLFGPDLPKTEEIADVLDTFHVIAELPADNFGAYIISMATAPSDVLAVELLQRECHXKTPLRVVPLFEKLADLEAAPAALARLFSIDWYRQRINGKQEVMIGYSDSGKDAGRLSAAWQLYKAQEELIKVAKELRGELNM

SEQ ID NO: 36776 - protein, 157 aa, Sorghum bicolor
  Clone ID: SORBI-28MAY03-C108480_1.pep
HEGGAAPTIGGGGGERQDLGRPRFVFAGAGCHGGGGGMGEAAIAALPRKEVGAGDTPADCAVCIAEVGPGEAARVLPRCGHAFHVECVDMWLRSHSTCPLCRCAVADEEDAKPVPPRAAPEADPESPNFPTNVLFFGGGHLHHLRHLLLLSSLSHLI

SEQ ID NO: 36777 - protein, 104 aa, Sorghum bicolor
  Clone ID: SORBI-28MAY03-C10821_1.pep
SPCRQKTSQNILQLAKDAKDKLQKAAEADRSTDTSADKRIADMKLAKDFAATMEEFRKLQSLAIQRETAYKPVVPQNAQSNYTTDDRSSESGNMPEQRALLAAK

SEQ ID NO: 36778 - protein, 196 aa, Sorghum bicolor
  unsure (1)..(196): unsure at all Xaa locations
  Clone ID: SORBI-28MAY03-C108574_1.pep
HEGRLAALLRTVSHSPLHEAASSPSXAMRRGASGRPSGTDGSDFSYRMVVESRYQRVADGRSRLARLILVQALHLVVGGALLLLSLSKGAAGNKFAVLSVAAGFVAIVVGELGRRRTMAVLLRLYTSLSSIAVAFSVTCIIRSELFLKVMKQNTEAITSYEMLDAVRVALGILLQMVVIATTTRLLQNMSPPKRAS

SEQ ID NO: 36779 - protein, 145 aa, Sorghum bicolor
  Clone ID: SORBI-28MAY03-C106874_1.pep
NSWIYERRTTAKAFAKDVFINQERKLGARRRSDTVLVSTINDADQGPADLASRTPPAPLETSWAWGSAATLLARLKLKGIARRAPLVLRPTLNWYLGHFRMGRGDRVSGGPRSRIHAIMARRGTASEGYDSVAMCESYKYRPAFC

SEQ ID NO: 36780 - protein, 254 aa, Sorghum bicolor
  Clone ID: SORBI-28MAY03-C10691_1.pep
TRLVVARKLKELKGTKSCIVFPDQPEKRRASQLFRTAIDTIEGVTVSSLDDVPTDPVNSFFKSIRNTLDFDFSDDNEDRWKSDEPPSLYIFINSSTRDLASIEKYVEKFATSVPALLFNLELDTLRSDLGLLGFPPKDLHYRFLSQFTPVFYIRQRDYSKTIAVAPYIVNYSGAVFRRYPGPWQVMLKQLDGSYACVAESEARFTLGQAKEELLRVIGLQEEEGSSLEFLRRGYKNATWWEENVDQETSAAWRT

SEQ ID NO: 36781 - protein, 122 aa, Sorghum bicolor
  Clone ID: SORBI-28MAY03-C107079_1.pep
MAGEELTLLGLWASPFVIRVRIAFNLKGLTAYVYSEESIYHKSELLLKSNPVLKKVPVLLHDGKTICESQIILQYVDEAFPTAAGAPVLPSDPYDRAIARFWASYVDDKLFSAWLPVFIGKT

SEQ ID NO: 36782 - protein, 57 aa, Sorghum bicolor
  Clone ID: SORBI-28MAY03-C107243_1.pep
FNSNLLQHMSIEMDTCASKQGLNLVHLNYCFHSQVISQLVNKCNIYILQFCRTRFST

SEQ ID NO: 36783 - protein, 159 aa, Sorghum bicolor
  Clone ID: SORBI-28MAY03-C107261_1.pep
MGQGAAKAKQGGEDAAQKTPEKEDAKKAQKSSDANALIEFMKKNYDAKVKNVTEFDEFYHAIYDLIEKFCEQRGQLQYRIPSKDDLKKKYQDFHRARGNVTAEEFEKIAREILKIDSFTFGKAASAWLPTLFGAPVCALLAKRVVPGLKAISDDIVIPA

SEQ ID NO: 36784 - protein, 111 aa, Sorghum bicolor
  Clone ID: SORBI-28MAY03-C10887_1.pep
AVNVALQLRPGINRGFATLREIGHGRDLKKFLIVIAGLWLLSVLGSCCNFLTLFYIVFVALYTIPVLYEKYEDKVDAFGEKAMIELKKYYAIFDEKCLSKIPKGPLKDKKY

SEQ ID NO: 36785 - protein, 265 aa, Sorghum bicolor
  Clone ID: SORBI-28MAY03-C1089_1.pep
MGSGEEDTGGGGGAVRGAVLKALVVVGGVLLLRRLRRSTTRWDHARAVADALSGEKFSREQARKDPDNFFNLRMLTCPATEMVDGSRVLYFEQAFWRSPEKPFRQRFYMVKPCPKEMKCDVELSSYAIRDAEEYKNFCDRQKDQRPQPEEVIADIAEHLTTIHLSRCGRGKRCLYEGSTPPEGFPNNWSGASYCTSDLSIHKNGEVHIWDKGFDDEGNQVWGTKVGPYEFKPAPKSKYDDMFSPLNFSAPLSLEKLDKAYVIDDQ

SEQ ID NO: 36786 - protein, 121 aa, Sorghum bicolor
  Clone ID: SORBI-28MAY03-C10895_1.pep
MSKSQRKWRNENQTNRGPATPPAVYHRLLLMFTEPGSRVMSTEKNELLTNYILVLTLFADDFRSSPNDICEDLKMTYQKLKPYYDQLGCKSVSLGPFKGSAVTLPAPLKFPTDVTRKRRRR

SEQ ID NO: 36787 - protein, 219 aa, Sorghum bicolor
  Clone ID: SORBI-28MAY03-C109116_1.pep
HEAGFDVLVDNDGDGAAYLHDEEEHEGEMYPVEDYEYAPADFDIRAHHESEQFNNGMGENGRIGQYDGYERKRRRSSSERSLDRPYHPDRRFLHRELDRDKIDGSDLRHQLRRRRINGPSTAISPEQANGDRHWRDERYRERPHGGHHTHRDRYQGPRGSTLSSRLQARIKLPRRSPDRVDIRFEDERDRRRLRDRFSPVRRMDFHGGRHRESGQNQER

SEQ ID NO: 36788 - protein, 53 aa, Sorghum bicolor
  Clone ID: SORBI-28MAY03-C109760_1.pep
KCGEPGAYACPDPSNHWSWHGIHLTEAAYGHIAKGWLYGPFADPPILDTKHLG

SEQ ID NO: 36789 - protein, 202 aa, Sorghum bicolor
  Clone ID: SORBI-28MAY03-C109809_1.pep
PVKAEAEAKESCSNVAHVQEGAKTIDRQIRVFVSVPGSSVAQNDVPDSFYKLSGEEIRNEAKMRRERLEQSRLLIPKSYKEKQALAARQKYKQAVIRVQFPDRMILQGVFLPGEATSSLYEFVTSALKQPGLEFELISPAIPKPRVVPHFPNPGERARTLQDEELVPSALLKFIPQETDSVVFTGLLDELLMASEPLPPASQ

SEQ ID NO: 36790 - protein, 140 aa, Sorghum bicolor
  unsure (1)..(140): unsure at all Xaa locations
  Clone ID: SORBI-28MAY03-C119405_1.pep
MAVKFLVLLSVVLASLIXSSRQVAYARELTEANETEGKNVKQGGAPELKDEKWGGGYNGGYGHGGGYGGGYGQPSYGGGYGQPGYGGGYGSGYGGGYHHGHGGGYGPGYGGGYGPGYGGGYGYGHGGPGYGYGGGHGGRN

SEQ ID NO: 36791 - protein, 217 aa, Sorghum bicolor
  unsure (1)..(217): unsure at all Xaa locations
  Clone ID: SORBI-28MAY03-C10768_1.pep
DWVREESGKKIXFHTFSNTGWLCYGVILENLQQQDPSAVDRIKACVVDSAPVAAPDPQVWALGFSAALMKKRSVTTKGLGSDDSRSDVLVVESNKEPKLGATEAVLLSALESFFDVVLNYPKINRRLSDVMELLSSKQPKCPQLYIYSSADRVIPAKSVEAFIEGQRKAGHEVRACDFVSSPHVDHYRSNPGLYTSQLGNFLEECVLANDSEGACAS

SEQ ID NO: 36792 - protein, 141 aa, Sorghum bicolor
  Clone ID: SORBI-28MAY03-C107731_1.pep
LTRRSRAGASMDASQDVWDWEVLPDHRSLSMMSHGSKNLDDQETEEHGLLPPSGDVDVHEPADECKDIGVVPDETKQVAGVADRMASEGEEEEKKAFQSADAKESTTADDGKFAQEEEEEDIKKEDKFAQEEEEEDIKKED

SEQ ID NO: 36793 - protein, 173 aa, Sorghum bicolor
  Clone ID: SORBI-28MAY03-C1082_1.pep
MLLSCGSLSSWVRRFVACVGGCFGCAQPTPIIAVDEPAKGLRIQGRSVKRHNLSDDFWSSSPHEMENSALQSRHSMSSISTAAQPNDQHASGSSSSPNDFVNQGLLLWHQTRQHWIGKRRRNSQGQQSQEPKISGNATYESLLGSSKPFPQPIPLGEMVDFLVVSWEQEGLYD

SEQ ID NO: 36794 - protein, 147 aa, Sorghum bicolor
  Clone ID: SORBI-28MAY03-C108169_1.pep
FQSKATASGGGGRRRRHMQHMLPLLNNMEAPPGQSSKQQQLMRTVSISVLVMSLPVLYVSFLHVPPAALFRDTTFWFLMSNSIIIVIAADSGMLFFRSSSSSSSSSSSSTDDDDDGGLSFAAVSVSEPAVTVSVVVKDGHHALGGSD

SEQ ID NO: 36795 - protein, 150 aa, Sorghum bicolor
  Clone ID: SORBI-28MAY03-C1081_1.pep
MEPGATTALYPLHRCKTIYLVRHAQGIHNVAGEKDFGAYMSHDLFDAQLTPLGWSQVDGLREHVKKSGLAEKIELVISSPLLRTMQTAVGVFGGEKYTDGVNAPPLMVENAGHRGRPAVSSLNCPPFIAVETCREHLGVHPWDKRRSITE

SEQ ID NO: 36796 - protein, 137 aa, Sorghum bicolor
  unsure (1)..(137): unsure at all Xaa locations
  Clone ID: LIB3476-029-P1-K1-E6.pep
VPVVCPSSSSISSSRISSPVVFLLLCQGQGPGRASSRPPRPIPSRSSASLRIPQQVREWPRAIHNVAGEKAFGAQHVKWTSSMLSSTPLGMGQVDGLREXVKKSGLAEKIELVISSPLLRNMQTAXGVFGGEKILMV

SEQ ID NO: 36797 - protein, 299 aa, Sorghum bicolor
  unsure (1)..(299): unsure at all Xaa locations
  Clone ID: SORBI-28MAY03-C11115_1.pep
MAILAVASPLKTLNPSQADHSRIRLSSSLLRLPLPVPRWRRLRCSAQYSEAAAAPPTSTTTPRPAEIPWSKELCNSVRLIGTVGTEVELRQLPSGSAVARGRLAVWKSATETTWVTLQFWDDLAIVASEHVKKGDRIFVSGWLVSDTVDEGPEXAACLLQVQQLNFIESQPVRLYEPEASQDAPGGRRADYFNSTSNSTEDKNRDNMSSSRSTEELWQAFFANPLDWWDNRTNKKNPRYPDFKHKHTGEALWVDGRNNPNWVISQLAVLDSRMSSLQDNGRKPVSYMYADEFITLDGNR

SEQ ID NO: 36798 - protein, 68 aa, Sorghum bicolor
  Clone ID: SORBI-28MAY03-C111209_1.pep
MSHCQLCVRNLKTAYHLFYECPVAREIREQVGRWIQMSFLMPQSWSQTEHLHDWFVALIVETPQTLPR

SEQ ID NO: 36799 - protein, 152 aa, Sorghum bicolor
  Clone ID: SORBI-28MAY03-C110650_1.pep
MAMSDTGSSFAQWAALYHHHHDATGPAVLPDDDAAADVLGIGIGTTAAAAAVASPTSGGSSGGGGSPTKAAGVQHQQQLHGVEGPRIGKPAAAARRRSRASRRAPVTLLNTDTANFRAMVQQFTGIPAPPAGAFGVGAGGAPLINFAADYAF

SEQ ID NO: 36800 - protein, 168 aa, Sorghum bicolor
  unsure (1)..(168): unsure at all Xaa locations
  Clone ID: SORBI-28MAY03-C11128_1.pep
FAFQLHHLPDESVSIMNERDQLLRMVKGLHPKLVTLVEQDANTNTAPFLPRFREVYDYYSALFDSLDATLPRESPDRMNVERQCLAREIVNILACEGPDRVERYEVAGKWRARMTMAGFIPCAFNSNVISGIKSTLKSYCDRYKFHEDHGGLXFGWGGQTLIVSSAWQ

SEQ ID NO: 36801 - protein, 83 aa, Sorghum bicolor
  Clone ID: SORBI-28MAY03-C11122_1.pep
MGPRPCFGGSAQAAEQERQRAEAERRESQDARAKAAEAAQRRQQEYEKSAAGRAAKAQMKAMKESKTSNHGGGEPVLKWQMGS

SEQ ID NO: 36802 - protein, 132 aa, Sorghum bicolor
  Clone ID: LIB3478-023-P1-K1-D6.pep
IHPHPKQASSSRRESSEEEETNHPPRRNQTPATSEPREGGREADGQCPCFGGSAQAAEQERQRAEAERRESQDARAKAAEAAQRRQQEYEKSAAGRAAKAQMKAMKESKTSNHGGGEPVLKTFDGKQEIDCD

SEQ ID NO: 36803 - protein, 183 aa, Sorghum bicolor
  Clone ID: SORBI-28MAY03-C10878_1.pep
MLHGDMVKHISCNPLGANGAGRGVGLVGGGPPRGVPRGTRRHGPRSSRGRQPPATSRPRAPAPSPSPSPSPCRRRPPSPSPSPPPPSPSRAHRRRGRAAPRSSAWRRPGARSSAPSPPTRPVPPYPRSGSFTCQVPSHKQAAASPSHSFLSCLQARCLVLPFLLGSDSSTQRHGSGTNNRRRF

SEQ ID NO: 36804 - protein, 46 aa, Sorghum bicolor
  Clone ID: SORBI-28MAY03-C108811_1.pep
KAAFRASALKWHPDKHQGPSQAEAEEKFRQCVEAYNKLTFAFKSSG

SEQ ID NO: 36805 - protein, 124 aa, Sorghum bicolor
  Clone ID: SORBI-28MAY03-C108820_1.pep
RERIRRQSARTGVDLPQPMKDFEPRADHTDKGRRGKLILPRWRHTSPLVGGEEPLPPPPPLGFPDWNRRAATRGRCASVRGARAIFPARDPRTAVRAAMYDRVPPPTRIIQLPCFNSWPRHKST

SEQ ID NO: 36806 - protein, 99 aa, Sorghum bicolor
  Clone ID: SORBI-28MAY03-C108842_1.pep
APIIVYVRTTERKNRSEGLKTYHINSRKYHHSHVHSIYLNYTFNLDYHSILSCMQNVQLASTNGSVPPCHPKGAEEDTLAERAVLAWMVGKGVAIPRQE

SEQ ID NO: 36807 - protein, 139 aa, Sorghum bicolor
  Clone ID: SORBI-28MAY03-C108866_1.pep
HEAGIGGPELEMKNTPAFQAQLQSASSDPRFQLHVQPNVQSHQNLRFSDPMQDGLNHMNDNYLASRFLAQNHGPVSPYAQIPQQPRNSQVTNGHWDGWSDSRQGNNTAMSDMSRMLYPSDVNKLHMLGSNDIYNRAFGM

SEQ ID NO: 36808 - protein, 166 aa, Sorghum bicolor
  Clone ID: SORBI-28MAY03-C112210_1.pep
QPTTQTKHRGAGSQLLLPSSIRFLFCCRDEDPHQGPDGSPCRRLRSALRHGGRPRGLRIGAGVHGACVCAGAGTGRWSRLRSGLRCRRGVVRTAVPACGHPDAVEAYLCISSTAYVCYYIHGHGHAWHGVVVGFVSRFEREFDRSIECLLFLILFVSYMSPTCLYI

SEQ ID NO: 36809 - protein, 103 aa, Sorghum bicolor
  Clone ID: SORBI-28MAY03-C112285_1.pep
MGNCVASGGTTTVTAAGAAGEDGRRRGRRWKAPREEQLGSVPGRIFSNDGRSRTAAVFTQQGRKGINQDAMLVWDGFGGEDDVVLCGVFDGHGPHGHLVARRS

SEQ ID NO: 36810 - protein, 151 aa, Sorghum bicolor
  Clone ID: SORBI-28MAY03-C11222_1.pep
RPRVRKAALRKYRKALRYLDVCWEKEEIGEDKSTALRKTKSIILTNSSACKLRLGDSKGALLDADFALRETEGNAKAFFRQGQAHIALNDIDAAVESFKHALELEPNDAGIKRELAGAKKKIADRRDQERKAFARMFHPSGKSDKSNEENN

SEQ ID NO: 36811 - protein, 172 aa, Sorghum bicolor
  Clone ID: SORBI-28MAY03-C11233_1.pep
SLFLLKLCCFSMDKNLKLLCFSIPRKLFNFSRVPCRVLDCLSMSKIKLDGIVPNPKIARLCSCLIQEGCTSANPAPVYGKKKSANKSVFAESNKPFSCILTNCCSFSFAPQEHYFGCLRHRLGFVPKFVHTNREKKSRRFLESRYHLKHEKKEDKSRRQEHGGSKGRLKRRD

SEQ ID NO: 36812 - protein, 116 aa, Sorghum bicolor
  Clone ID: SORBI-28MAY03-C112960_1.pep
IAGKVYDVTPFMEEHPGGDEVLLACVGKDATADFEDIGHTDSAKELMPQYCVGEVDAATIPAKLTHAVVTKDAASRSEKTTTASAGTWATLLQLALPVLLLALAFALQNYSRAKAA

SEQ ID NO: 36813 - protein, 113 aa, Sorghum bicolor
  Clone ID: SORBI-28MAY03-C112964_1.pep
MGVASDAAAGGKRGTGTGTRCELCGGAAAVHCAADSAFLCLRCDAKVHGANFLASRHLRRRLPRPPSAADSGARRRPRPAAPACPRPTPRSQPPLRRWRGGLRRDCGRARPRR

SEQ ID NO: 36814 - protein, 143 aa, Sorghum bicolor
  Clone ID: SORBI-28MAY03-C13031_1.pep
GNRLDLHDPRILAMAAAQHRLLEDEYDEYTTTNNNAAAFCRSIFLILMALLLLRHTLTITNSDDEDDASAIFSLFLLRAAGFLLPCYIMAWAISIMQRQRQRQEEAMLLPTEVAIILHRNGRTMQFAVAPPESPTSPQPEPIQ

SEQ ID NO: 36815 - protein, 381 aa, Sorghum bicolor
  unsure (1)..(381): unsure at all Xaa locations
  Clone ID: SORBI-28MAY03-C13014_1.pep
ARGDCKKKVEPDDWEDAADMSTPKLPSDSGNQAGITQVLDSDTTEANGRKKYSRDFLLTLQQHWTGLPVGFKMNEAVNAIMNNLAGKSYVVDREPHPSPGRGLDRPTSRGDRRGAAMADDRWTKAGIPLSPGRDVHMDLAARPSIINYRGSSGGNHGVLRNPRGQPSNQYGGGLLAGPMHSVXTSSISQWXDADRWQQKGLMPSPVTPMQAMHKAERKYVVGKVSDEEEAKQRQLKAILNKLTPQNFEKLFEQVKEVNIDSVETLTGVISQIFDKALMEPTFCEMYANFCSHLAGALPDFSEDNEKITFKRLLLNKCQEEFERGEREEAEADKTEEEGEIKQTKEEREEKRIRARRRMLGNIXLXIGELYKKXMLTERIMH

SEQ ID NO: 36816 - protein, 172 aa, Sorghum bicolor
  Clone ID: SORBI-28MAY03-C130325_1.pep
TRAASAGSPAARAGAMLTCKRFRELGQTKVVLARASPRCLAVRAKAWSDDAHRFLQRCADAGYLEACYRPGMIRFYCLGGSRGSGAALMAAAAVGGHREALYSLAVIQFNGSGGGKDDRDLRAGAALCARAASLGHVDALRELGHCLQDGYGVRRSVLDGRRLLIQANAREL

SEQ ID NO: 36817 - protein, 77 aa, Sorghum bicolor
  Clone ID: SORBI-28MAY03-C13050_1.pep
LLLLFLPFFVEKGQGHLNVISAIVGVDGDLIGFVNLASRSCTANSVGYCKCYVDNGTSVAVQVGLVSCWHYLTKCSL

SEQ ID NO: 36818 - protein, 91 aa, Sorghum bicolor
  Clone ID: SORBI-28MAY03-C113324_1.pep
MVRATRITVVILELIRATNPDFLNPERIQDVICRGADLFDMLPEEYTFQEIIAKLGPIPSTYSGVHLPSYLLKNVERFRYLLPGNCRRESG

SEQ ID NO: 36819 - protein, 207 aa, Sorghum bicolor
  Clone ID: SORBI-28MAY03-C11335_1.pep
EIEKAHPDIFNILLQVFEDGHLTDSQGRRVSFKNTLIVMTSNVGSTSISSGRRSIGFSTQKDTEETTYAVMKSLVMEELKAFFRPELLNRLDEVVVFRPLEKTQMMAILNLILQEVKSRLLALGIGLEISDSMKNLISQQGYDRSYGARPLRRAVTQLVEDVISEAILFGQFKPGDTILMDTDATGKPCLSRLNDQTVQLSDPAPTM

SEQ ID NO: 36820 - protein, 122 aa, Sorghum bicolor
  Clone ID: SORBI-28MAY03-C113371_1.pep
PFFIAARVQDGEMEKEKKRKKRNKASELTAEAQGLLKRRVDPVNGARKGQDVREARRGSRLLAVRLGDDGLAEEPRRRRVQRRRRLMLLLPVLVYTGLLGVGARRRVAAVAVVGTPMHVVHG

SEQ ID NO: 36821 - protein, 153 aa, Sorghum bicolor
  Clone ID: SORBI-28MAY03-C11343_1.pep
FDFAQYYAFDITIFALTMIYSLFAPLVVPVGATYFGYRYLVDKYNFLFVYRVRGFPAGNDGKLMDRVLCIMQFCVIFFLAAMLLFFAVQGDSMKLQAICTLGMLVFYKLLPSRSDRFQPSLLEGMQTVNSFVDGPTDYEVFSQPDLDWNLYQS

SEQ ID NO: 36822 - protein, 154 aa, Sorghum bicolor
  Clone ID: SORBI-28MAY03-C11338_1.pep
SQSPSPQTPSGQTQGKADYTSLSEEEWKKRLTKEQYYVTRQKGTERAFTGEYWNTKTPGIYHCVCCDTPLFESSTKFDSGTGWPSYYKPIGENVKSKLDMSIIFMPRTEVLCAACDAHLGHVFDDGPPPTGQRYCINSASLKLKPQSLDPLGRS

SEQ ID NO: 36823 - protein, 145 aa, Sorghum bicolor
  Clone ID: SORBI-28MAY03-C114093_1.pep
GDPRCRWPDSLSLGAGAGLGKTPERRSRETSRDETLGLALGQTKRRRGVVGGCPLGAGVRDAPKVVGARRGGGCGSSGRFVGGALGAGIGDAPKVAASEVDLRASDGRQLGQWPDLDGFMFLQPGWARVLLLLAGRWSERAMLGG

SEQ ID NO: 36824 - protein, 101 aa, Sorghum bicolor
  Clone ID: SORBI-28MAY03-C113741_1.pep
GTNNQCTAANGVHDTSYSAHWHTDTTSLAFVNLSTLNRCRYHSPMLIKHRNTISGKPVSFYINNVFSSPDASTSKDVPSCTWCSSSQRKHQCINWPAVFLV

SEQ ID NO: 36825 - protein, 178 aa, Sorghum bicolor
  Clone ID: SORBI-28MAY03-C11135_1.pep
MSALNSDSNMQQLVPIAPPGEASCGGDSGKELVVVDPAGKSSTGSKLREDEEDLEVKLRRIMENVPVRVSNTSGSSAGSGSGDFHQYRQMRRREQDRLARMDADYQKRKEMAEFELRREERIKAAEERTAKKRLKRQKKKQRKKEKRAKTGNNGGEDPNRVDSSDDDEGSDDDDKSKQ

SEQ ID NO: 36826 - protein, 86 aa, Sorghum bicolor
  Clone ID: SORBI-28MAY03-C111762_1.pep
MSGAQGAHPVGQTTPTTYESVGGGENRTRTDLRSREDQGAIQIEKVQDKVDDAAGRGVDHRTFGAKKERPDDSADAGATGTGGTAA

SEQ ID NO: 36827 - protein, 139 aa, Sorghum bicolor
  Clone ID: SORBI-28MAY03-C111974_1.pep
MRGLYGDDDYNASHYGQQQSAGTAVAKALASATAAFTLLVLSGLAVTGTVLALIVATPLLVIFSPVLVPAAITVALLTTGFVSSGGFGAAAVAVLAWMYRYLQTTTSSSDQQQHQHQLSGKAHDVKDWAQHRLEQARAH

SEQ ID NO: 36828 - protein, 115 aa, Sorghum bicolor
  Clone ID: SORBI-28MAY03-C11217_1.pep
FMLRLNSHSHSCSLELCTIARVTIARCLVVEENRLTHDQYGRCHARYPSRVPTSSNTIWSIQNRESSHLLPRHAQVDCRRPGTVHGRWIHPCAASDHKLLLPSIKSCVGKEVYVV

SEQ ID NO: 36829 - protein, 278 aa, Sorghum bicolor
  unsure (1)..(278): unsure at all Xaa locations
  Clone ID: SORBI-28MAY03-C1120_1.pep
TRQSSVATSGAIKKDYQEGSINTSKGKGKAVLKSSLDEPKGPHTRNAERRKAASEKDVELKPSHDHSTSEDEDLDASPVEIDDALMLDDDDEDVSEDEDDDHEAVLRGSLPRPASEGVHDVKLGDADDSSVASLANDNQAQPSSGSSTKNASGRGLDAAEFRSPSTFGSRGAMSFAAAAMAGLTSVGSRGIRGSRDRSGLPLGARTTEHYNKLIFTAGGKQLNKHLTVYQAVQRQVVHDEDDXDQLGGSDLPDDGNHFWGDVFTITYQKADNTAEKGS

SEQ ID NO: 36830 - protein, 267 aa, Sorghum bicolor
  Clone ID: SORBI-28MAY03-C114288_1.pep
ARGPLLPVALAMASAYSAGSGADRRLLFRQLFEKESSTYTYLLADVADPDKPAVLIDPVDRTVDRDLNLIKELGLKLVYAMNTHVHADHVTGTGLIKTKLPGVKSVISKASGAKADHFVDHGDKIHFGNLFLEVRATPGHTSGCVTYVTGDADGQPSPRMAFTGDALIIRACGRTDFQGGSSDLLYQSVHSQIFTLPKDTLVYPAHDYKGFTVSTVEEEVAYNARLTKDKETFKTIMSNLNLSYPKMMDVAVPANLVCGIQDPPPKI

SEQ ID NO: 36831 - protein, 144 aa, Sorghum bicolor
  Clone ID: SORBI-28MAY03-C114361_1.pep
FHSGSELFTILYAGFIASGVAFAVQIWCIDRGGPVFVAVYQPVQTLVVAIMASLTLGEKFYLGGIIGAVLIIAGLYLVLWGKSEERARIARDAAAALVVSGAGDREGLLAAGGGGGGGIRSKAAASAAVTQPLLLPSSTSTDNV

SEQ ID NO: 36832 - protein, 169 aa, Sorghum bicolor
  Clone ID: SORBI-28MAY03-C114380_1.pep
VSLSEQQVLDCDTDGNNGCNGGYIDNAFQYIISNGGLATEDAYPYAAAQGTCQSSVQPAVTISSYQDVPSGDEAALAAAVANQPVAVAIDAHNNFQFYSSGVLTADTCGTPSLNHAVTAVGYSTAEDGTPYWLLKNQWGQNWGEGGYLRVERGTNACGVAQQASYPVAR

SEQ ID NO: 36833 - protein, 130 aa, Sorghum bicolor
  Clone ID: SORBI-28MAY03-C114457_1.pep
SYVDDKLFSAWLPVFIGKTAQERVEAATQVLATLDTLEQAFEECSKGKAFFAGDTVGLVDVVLGSFLGWLYATEAICGVKVVDATRTPLLAAWAERFCALDAAKGLIPDVERLVEYNKARRVFLGLPLLP

SEQ ID NO: 36834 - protein, 177 aa, Sorghum bicolor
  Clone ID: SORBI-28MAY03-C114503_1.pep
MAAVARGPAMAPVAVQGARAAAAAAAAAAAAAEEMRWRQLDSGVSAVSFGFVATAILVSMFLAMAILEHFLRPPAHAPGHGNGHAPPRGILRRLRLFLGRGGERGAGPGADLEASRKLQGHAPLEIPVYPKGVSVLMPGQDMPTFIAHPAPAPCPPERIQWPSHQSPPFAGSLSNPS

SEQ ID NO: 36835 - protein, 211 aa, Sorghum bicolor
  Clone ID: SORBI-28MAY03-C11300_1.pep
VVDFIDDGSKVTAILEDGRKFEGDLLVGADGIWSKVRKTLFGHSDATYSGYTCYTGIADFVPPDIDTVGYRVFLGHKQYFVSSDVGAGKMQWYAFHNEEAGGTDPENGKKKRLLEIFDGWCDNVVDLINATDEEAVLRRDIYDRPPTINWGKGRVTLLGDSVHAMQPNLGQGGCMAIEDGYQLAVELENAWQESVKTETPMDIVASLRRYY

SEQ ID NO: 36836 - protein, 328 aa, Sorghum bicolor
  Clone ID: SORBI-28MAY03-C113154_1.pep
LRPPIPPPPLGGPAAAVALVVPVSPPPLHLSSMSPSRILPWRPFLALFRMPARSTKAARAAPAPFAHPMPIAPSSWDFPAPRLAAAPPLAAGGTFPAAEMSRVALMGAASLAVAAWIPLRFETLRLPDPFCIPCLVMGVRVGVYLAWVRVSAVCGPRTYVVFLSCRSTPCRAIGLDVGMNMAWICDSADFDPHTHKDFMSILITAARAYVLVHKGRHDPGLGSHLCFKSLCSFPKQRPGSLHCGYYVCAFISNTKGYRRHPELWKEEKALKRDVYRDDDLLEIVGDLCNFIMDHVVYYKGDYHNPHSDLGSNPLYQHLRQWDRLCLGR

SEQ ID NO: 36837 - protein, 118 aa, Sorghum bicolor
  unsure (1)..(118): unsure at all Xaa locations
  Clone ID: SORBI-28MAY03-C11323_1.pep
PPPAPRRARLLLQVALTNAVTSESDDVAAEEAAAAPKIGRRVRVTAPLRVYHVIKAPDLDIQGMEAVXKQYVSVGKGKRDTANLPFSLEFQLAVYGQPKPVRFFTHLREDEFEFVDEE

SEQ ID NO: 36838 - protein, 243 aa, Sorghum bicolor
  Clone ID: SORBI-28MAY03-C11499_1.pep
LLIINSTISFIEENNAGNAAAALMARLAPKAKVLRNGRWTDEESAILVPGDIISVKLGDIIPADARLLEGDPLKIDQSALTGESLPVTKGPGDGACSGSTCKQGEIEAGVIATGVHTFFGKAAHLVDSTNQVGHFQNVLTDIGNFCICSIPTRPVVELIVMYPIQHRGYRPGIDNLLVLLIGGIPIAMPTVLSVTMAIGAHRLAQQGAITKRMTAIEEMAGMDVLCSDKTGTLTLNKLTVDKS

SEQ ID NO: 36839 - protein, 177 aa, Sorghum bicolor
  Clone ID: SORBI-28MAY03-C114990_1.pep
LKAILGRRSRRVYNLPPGPKPWPIIGNLNLMGALPHRSIHELSRKYGPLMQLQFGSFPVVVGSSVDMAKFFLKTHDVVFTDRPKTAAGKYTTYNYRDITWSPYGAYWRQARKMCLTELFSAKRLESYEYIRAAEVRALLRDLHSASGSGRAVMLKDYLSTVSLNVITRMVLGKKYLD

SEQ ID NO: 36840 - protein, 143 aa, Sorghum bicolor
  unsure (1)..(143): unsure at all Xaa locations
  Clone ID: SORBI-28MAY03-C115025_1.pep
SLASMHVPWMAVGQLLTYSSKEAVSAGVSGGHRRHLRRLDALQEHPVLRRRREPAAVGGEDVSAAASALQETVAVAEWRRRACVLLLPPELLLERRRNVLAPVELLLVVVEGHDGRGRREGVVGGEVDERCPTGPDPERAGXG

SEQ ID NO: 36841 - protein, 164 aa, Sorghum bicolor
  Clone ID: SORBI-28MAY03-C115039_1.pep
ARGDYCQPRPEWPCAPGKKYFGRGPIQISFNYNYGPAGRAIGVDLLNNPDLVATDPVVSFKTALWFWMTARDNKPSCHAVITGQWTPTAADRAAGRGAPGYGVITNIINGGIECGHGADPRVTDRIGFYKRYCDVFRIGYGSNLDCDGQRPFNSAVAVEQLAAQ

SEQ ID NO: 36842 - protein, 117 aa, Sorghum bicolor
  Clone ID: SORBI-28MAY03-C115097_1.pep
RIHYNRTVTRSSEKRSLCSDPRCSSLAVDGLLVAVGVLILGRLALGPAASAVQRTDHHPVVDGGAPRRAGGVAAVGHPAFPAQLLPALSLGRRRCSIKDGNIQRHNNISRRCFVSSC

SEQ ID NO: 36843 - protein, 167 aa, Sorghum bicolor
  unsure (1)..(167): unsure at all Xaa locations
  Clone ID: SORBI-28MAY03-C11350_1.pep
TRLNTMWMVYTIPSGLSSAISIRVSNELGAGNPHAARLSVYVSGIMCLAEGLFVAIITVLVRDVWGYLYSNEEDVVKHVSIMMPILATSDFMDGTQCTLSGAARGCGWQKVCSVINLFAYAYYAIGLPSAVTFSFTLKIGGVGLWLGIICAXAVQIFALVMMMLRTS

SEQ ID NO: 36844 - protein, 226 aa, Sorghum bicolor
  unsure (1)..(226): unsure at all Xaa locations
  Clone ID: SORBI-28MAY03-C1142_1.pep
RSTHVRDCWRQYCDPNTGCNSSYLYCSNNHPGSYTSWLNSNSTQVFSMCNGNQSYAFNFGIYEQALVSGILGPGNFISKLCYCFWWGLQNLSTLGQGLMTSTYTGEVLFSIAICVLGLILFALLIGNMQSYLQSVAIRLEEMRVKKRDAEQWMHHRSLPPEIRHRVRKYERYRWLETRGVDEESLVQTLPKDLRRDIKRHLCLGLVKRVPLFXNMDERLLDAICER

SEQ ID NO: 36845 - protein, 204 aa, Sorghum bicolor
  Clone ID: SORBI-28MAY03-C11420_1.pep
MASAASEMEGEGAGAGTGTGEGAPIAPRRPALPLKVRFQLLCLDVVGGLSMRRDGTINRSLFSLFDRRARASARPDGLGVRSADVHVDASRGLWARVFSPSEAAGSPLPVVVYFHGGAFALLSAASVPYDAMCRRFCRELGAVVVSVDYRLAPEHRCPAAYDDGVDVLRHLASTGLPDGVAVPVDLSRCFLAGDSAGGNIAHHV

SEQ ID NO: 36846 - protein, 176 aa, Sorghum bicolor
  Clone ID: SORBI-28MAY03-C114253_1.pep
MEDDDIQLLGTTTTARRNDNDGQYGGFWLADIMQNAVAAARTRIKSNPPDILLASLPKSGTTWLKALAFATLNRATHSPSDAHHPLRHHNPHDCVAFLEMMMVTQDDDNDDGDGDEALLRPPPSRRPLLVQTHIPYSLLPDAITAEGSGCRIVYVCRDPKDMLVSFWNFHLKEGPT

SEQ ID NO: 36847 - protein, 194 aa, Sorghum bicolor
  Clone ID: SORBI-28MAY03-C115539_1.pep
ARGLSPLPHNCEKIVILFQLPRTELLQNFTNTILAPLQLSWIISHHHGKLPGDSRQEGDQDHERRGRRRRSPQDAIPGGHAHAQLEGPGRSPLRAPTGGGGCCCRRRRPCCWRRRQGEAGDQQAGAEEDARQGGHVAGRHGVSHAQGGEWPRTGGGVLLWRVATGAGEHTGRQRSLARTLYCLASFFDHRSRFL

SEQ ID NO: 36848 - protein, 105 aa, Sorghum bicolor
  Clone ID: SORBI-28MAY03-C115542_1.pep
VVDSKHSSSRPDSPNSHDSKSQISREHRHGGEGVRVGDLPVRVAGAAVPGGGRRPPPAPPPAPRPPPPPPPAPPPPAPGSRWGRGPGPDDAPPSLRAPSFHLFRC

SEQ ID NO: 36849 - protein, 103 aa, Sorghum bicolor
  Clone ID: SORBI-28MAY03-C115657_1.pep
MDRVTKLASQRAVVIFSTSSCCMCHTVTRLFRELGVNPTVVELDQDPRGKEMDKALARLLGRNPAVPAVFIGGRLVGSTDRVMSLHLSGNLVPLLRNAGALWV

SEQ ID NO: 36850 - protein, 102 aa, Sorghum bicolor
  Clone ID: SORBI-28MAY03-C115784_1.pep
YGSINDTAMFYGLKYFNDHLMQAGPYGNVQSEVLMRKDASTFTFRQGWAFPRKVYFNGDECQMPPPDEYPYLPNSALPAAAASSSLGAAVAAVVVLLVMIVA

SEQ ID NO: 36851 - protein, 55 aa, Sorghum bicolor
  Clone ID: SORBI-28MAY03-C115792_1.pep
AGVAVLAWVLFFTFLPETRGRTLEAMHKLFGATDDDLKPQDGATKDKKLEMAATN

SEQ ID NO: 36852 - protein, 193 aa, Sorghum bicolor
  Clone ID: SORBI-28MAY03-C114613_1.pep
HEGHRSGYLIQAEYWSRIWIVQEFLLAKDLTLLMGSRRLSARRFEIIMRHWTENPPDGINLSNASFLVSFRRGHLSREFEQMFTLFADMLCSLPQDAVFALLGLVGERTKDTELIGMIDYSLTVWQLLQCILARDIIEYPLQFAYHYWVEILRNQEDKDTHMHDVLNVQLRHQAHLSLRDLDDSRYTNLDGLS

SEQ ID NO: 36853 - protein, 126 aa, Sorghum bicolor
  Clone ID: SORBI-28MAY03-C114619_1.pep
MEAYAAMASPPPPTTTKAVVDKLSYEIFSLLESKFLFGAGAGCLSSSVPGTPARALLDGGRVRVLAIDGCGAGAEDALLAAAALARLEAGLRDRTGDPDARAADFFDLAAGAGAGGVLAAMLFLRG

SEQ ID NO: 36854 - protein, 98 aa, Sorghum bicolor
  Clone ID: SORBI-28MAY03-C114853_1.pep
LHSPLRAAPDNNPRAAAGRSPPRHLHAFLFSSINQGAARAPPRRRPRKSIARASRPPPPPNDAPLPALVIHGLTPRSSHAPAGLANGGGRREGEEGEG

SEQ ID NO: 36855 - protein, 109 aa, Sorghum bicolor
  Clone ID: SORBI-28MAY03-C11497_1.pep
MGEAHSDEFCHCQGCAGKYTLLRDEENPRLAIFERRLPCCGCGIGWSSFLLGFLCPLIWYFAATLYCCKYYNKDPRERPGLAASAVAALIFTVLATIALSVALIICVYK

SEQ ID NO: 36856 - protein, 171 aa, Sorghum bicolor
  Clone ID: SORBI-28MAY03-C114834_1.pep
ASSASVRRSSRRRHRRRIRRSSCRCHRRVRNRRRWCRRQEEEQDGDGDGTGGGRGGGCARRAGAGRRGQLPGGQVRGARVGAGGGEPGEGGLVRRRLWGTRRRLRRRRRLLIGLPDGSSNHLASCCALSIIYPSSPSSWCSKYIFFMMNCKLDHVLFYFYLPPSVAVEIET

SEQ ID NO: 36857 - protein, 157 aa, Sorghum bicolor
  Clone ID: SORBI-28MAY03-C116383_1.pep
NMAYLRAVIKESLRLRAVAPLLAPHLSMARCTIDGLAAVPAGVRVLINAWAIARDARFWGQDAEEFVPERFLDGGSAADVGFRGTDFQFLPFSAGRRQCPGINFAMAAVEVMLANLVRRFDWEMPAGKAARDIDMSEVFGLVLHRKEKLLLVPKLCA

SEQ ID NO: 36858 - protein, 104 aa, Sorghum bicolor
  Clone ID: SORBI-28MAY03-C116386_1.pep
MAQEDVHHLDDAGLALGLSLGGGGASDAVRHGTSSSRLSMEAVARLPSPRPQLEPSLTLSMPDEATATATGSGGGGGGAAHSVSSLSVAGVKRERVDDAEGERA

SEQ ID NO: 36859 - protein, 273 aa, Sorghum bicolor
  Clone ID: SORBI-28MAY03-C11648_1.pep
MAATAVAASRKKRGTAAAFLDDPFSFPAADLPLLQTKRGRCSSSIVAADLGLSFPLEFDPVEALHLIFPGEDPQVLQNYLQASGNVLDAAIRAYKDYLAERSTESASAINHVPSDNEEGDSILSESDADLTVETIPTNCSGWAELIVKEMSSASDLTDAKNRAFKILNLLEKSAARSSPDEKSKVNKEHKIVKQMLGSLLHQNGVLKRAFLIQHNRLKEYQEMVQERSQFNQILEKYQKQIKALEEKNNALSFHLQNANQCRNTYWHRNPDVF

SEQ ID NO: 36860 - protein, 161 aa, Sorghum bicolor
  Clone ID: SORBI-28MAY03-C116500_1.pep
HEVEKMLLDRLLIFVRLESMMDGYSDSEDFTIMEQKAERSSRSLQLIEKAGGNTLSSIGDLSYSSQDSIVPAKSPLTGNSLTRYSSQTFGDELEFLNRCKDAGVVHILGNTVVQARRDSGFVKKVAVNYVYAFLRKLCRENSVIFNVPHESLLNVGQIYYI

SEQ ID NO: 36861 - protein, 69 aa, Sorghum bicolor
  Clone ID: SORBI-28MAY03-C116533_1.pep
LWELRHCGGTPHLSGCWARNEHYGDGDYDNWTVRNQAVLVLKTISHARKRRCNQNLNGSSKTKKYRVFL

SEQ ID NO: 36862 - protein, 220 aa, Sorghum bicolor
  Clone ID: SORBI-28MAY03-C115222_1.pep
MRQLWRWYQQCLATHPVRTQVVSSGILWGLGDIGAQAVTHYSARPDRRSSPPEDKDNKDNKEFKVDWKRVGVTSSFGFAFVGPVGHYWYEYLDRFIRRRFQPNTFKFVASKVAADGFLFGPLDLLLFFSYVGLGQGRSVEQVKEDVKRDFIPALVLGGTIWPAVQIANFRFIPVRYQLLYVNLFCLLDSCFLSWIEQQGDASWKQWFTSFQKIEDQKSKV

SEQ ID NO: 36863 - protein, 140 aa, Sorghum bicolor
  Clone ID: SORBI-28MAY03-C115279_1.pep
MAAAKSIDRLPARLVVPAEPTPAGPLHLSWLDRYPTQMALIESLHVFKAAPATATGGIDGGAAASPARTIERALARALVHYYPLAGRLVLSESGAQQAVDCSNAGVWFTEAEAACTLEDVDYLEAPLMIPKDDLLPPTPA

SEQ ID NO: 36864 - protein, 213 aa, Sorghum bicolor
  unsure (1)..(213): unsure at all Xaa locations
  Clone ID: SORBI-28MAY03-C1152_1.pep
TIEMAKKLPKEVVIDLLAKLEVGSACSLCDDTPEDAIVTICGHVFCYQCIHERITTDETMCPAPNCSRTLGFELLFSSGALKISISGESSSAGASSSADNESSSISQISFVSFKIQAAIDILNSIINLNALTESDTMEXNRSGVAPVKAIVFFQWTGMLDLLENSLNTNLIQYRRLDGTMSLNLRDKAVKDFNTDPEVRVMIMSLKAGNLGLN

SEQ ID NO: 36865 - protein, 149 aa, Sorghum bicolor
  Clone ID: SORBI-28MAY03-C115395_1.pep
MDQLVTMAMAAQPASPTSPHVAHKIPAGDGPYARAKHFQLVEKDLDASIAWFWKAISTGDKVDSALKDMAVVMKQRGYLTEAIDAIRSLRHLCPKQSQESLDNILLDLYKASGRTKEEIELLKQKLRKIYLGEAFHGKTTKRARSHGRK

SEQ ID NO: 36866 - protein, 70 aa, Sorghum bicolor
  Clone ID: SORBI-28MAY03-C115448_1.pep
CGHQHQRHLPAGMRRRRRRWPGAGGAGDGSLPTVGTCWSPPYVDPSSVNAFLSCCVNKSNHVADEKINSI

SEQ ID NO: 36867 - protein, 102 aa, Sorghum bicolor
  Clone ID: SORBI-28MAY03-C117397_1.pep
ALAALVGGRHRGDRSDRTAVRRIIPVFSCVLLSSSCGDDWATADGRCLLETSTQQIVKENQKLHKVNIEIEDEISEQKGEILQVEEGFRGTLLTSSVSPQLC

SEQ ID NO: 36868 - protein, 197 aa, Sorghum bicolor
  Clone ID: SORBI-28MAY03-C117414_1.pep
ARGFVSLFASYHQDSSVFNDMKYLQSPGTTDDAKPITHLLAIDLSSKVGTKLLSEAIRYLMDGSDRARVGLLLYVHTGGSSPILLLKDIFDRTIYSFSYKEKVLVFLHGLLKFYEAQPLPASSVADDWTRNMMEKVYTLPAETALPVDDYKAWFKSFSADTGLKGIDKLSDFLFGQLGLVFGRNAVITNGRVFIMNE

SEQ ID NO: 36869 - protein, 183 aa, Sorghum bicolor
  Clone ID: SORBI-28MAY03-C117406_1.pep
TRVLGSILERRLQKDRESGKPGRSVVRIRGVTDDAAAAFVRLLYAGRCGDGGEEEEEDDAMEKHAVQVLVLAHAYQVPWLKRACEGAIGARLTADSVVDVLQLADLCDAPRLHLRCTRLLAKEFAAVERTEAWRFLQENDPWQELHVLQRLHEADMRRRKWRRKRAEQRVYVELSEAMDCLDH

SEQ ID NO: 36870 - protein, 82 aa, Sorghum bicolor
  Clone ID: SORBI-28MAY03-C117605_1.pep
QDESPILVFFQGPPHAGSLGEGYPPTLQGSEVPRVKGILRRHQGEGCGHSTTITKNFKSKIASKGLNHKMFCLCKIVEIKIL

SEQ ID NO: 36871 - protein, 182 aa, Sorghum bicolor
  Clone ID: SORBI-28MAY03-C11775_1.pep
ARGQHNAGYKHKANVRTYYQQFEEQQTQSLIDQRIKEHLGQAAAFQAGAPFNQHMLTFPGAVARPRLPILPTPGMPHGFPQAPGAPLMPGVRPPILPAPGVPGYPGGPPTMLQPGAPPGSMPQPGAPPGSMPQPGAPPGSMPFLMAPLPRPPTLPPPTSGVPGAPIPNSAAPPAIYQANPPA

SEQ ID NO: 36872 - protein, 153 aa, Sorghum bicolor
  Clone ID: SORBI-28MAY03-C115982_1.pep
TRPVSGSARLRHLPSLRRTFSLYDQINLIDSVPEDELRFQSYDDTGFKINNVKYEGSLLIVENKIMTWAPKTFSEMPAESLSIFKVVHPIPEILILGCGRHIQLVSPELRKFIRSTGMKLEAVDSRNAASTYNILNEEGRPVAAAVLPFGVTC

SEQ ID NO: 36873 - protein, 268 aa, Sorghum bicolor
  unsure (1)..(268): unsure at all Xaa locations
  Clone ID: SORBI-28MAY03-C1161_1.pep
LLDSSGHYYCFVRTSSGMWHNLDDNKVRQVREADVLKQKAYMLFYVRNSIGKSVAHKENITANLPMKKTPEKISSLNGITQSSVKAQRTRGVSRFGDKAHNTIIGYSTIFSKTTTGHCSKNEVKAEDAPASQNNALPSRQAPGTQNDGGTLRTKPMQFDVNSQETASSHQPAPFTNTCGEQTVVGKPSQEMEPKAGAGKDTSVVSAIANGAATLSKADKLTSQPQTTPFSEVAPHVNGTAAEFAARLYXKKDSVVSNGVGLALMSTSV

SEQ ID NO: 36874 - protein, 216 aa, Sorghum bicolor
  Clone ID: SORBI-28MAY03-C1162_1.pep
AHSPHRVRPRVRARPGSSAAAPLLLLLAAAAASILAAAAASPAPSDFVRKSCRATQYPSVCEQSLASYGGSPAPRSPRELARAALSVSADRARAASAYVGRLALLRGKGGAPGSAAGPVRDCLESLADSVGHLRDAAQEMGGAGMSRSGTPAFKWHLSNVQTWCSAALTDENTCLDGLSSRGVDAGTRAAIRGKVVDVAQVTSNALALVNKVGPGY

SEQ ID NO: 36875 - protein, 120 aa, Sorghum bicolor
  Clone ID: SORBI-28MAY03-C116284_1.pep
LGFSDDGVILPAVPCARVGRVQDETHLEKLYVRRFASHRRLPVPSQLGALDDRIASVTAVDALGPGGGYNPTRAMRARRGGQRGLPGGSGAVSMALARKVQWPERVAGGERETDLGAWTA

SEQ ID NO: 36876 - protein, 67 aa, Sorghum bicolor
  unsure (1)..(67): unsure at all Xaa locations
  Clone ID: SORBI-28MAY03-C116313_1.pep
AXGQPSLTDMPLARKVSLKRFLVKRKNRLSAADPYPAAASESSTKQPPPVKEEGAPWLGVSSALSLS

SEQ ID NO: 36877 - protein, 137 aa, Sorghum bicolor
  unsure (1)..(137): unsure at all Xaa locations
  Clone ID: SORBI-28MAY03-C118313_1.pep
MGTRVRMFWTPTACEWRLTRTVASWRSSVSWRECGARSRAGWGARVGSAHAASARSYSLAVSRSAAVTLASRLLAVARSRVAARACEVRSRLVGAVCSAAATRSQREEWRRGAECVCVLXVASMAMTEGDGSAWRRA

SEQ ID NO: 36878 - protein, 93 aa, Sorghum bicolor
  Clone ID: SORBI-28MAY03-C118364_1.pep
GQPRVGWGRGWPPPFPVQAHLFISLLQEEPAPSLCAQVVIPFMEWLGMVHHEQEKIEICYAWIALLPSSLQQLCSICLCVCVCGLRLLVRQLA

SEQ ID NO: 36879 - protein, 115 aa, Sorghum bicolor
  Clone ID: SORBI-28MAY03-C118686_1.pep
AVLKVLEKEKLQENAFVVGSYLKDRLRGLQEKHDIIGDVRGTGFMLGVELVTDRQLKTPAKDEICHAMEHMKDMGVLVGKGGFYGNVFRITPPLCFTKEDADFFVEVMDIALSKL

SEQ ID NO: 36880 - protein, 124 aa, Sorghum bicolor
  Clone ID: SORBI-28MAY03-C118761_1.pep
MESEVVRTEMVLAPTLPFKKMQTADKYPKGQSRGRQWKHLRHLLQSADASSMPPDRPNYMNIQSPPSIYPPKRYCDLTGFEAPYVDPRTKLRYADPEVFKQIRMLPDEYVQRYLALRNAAVILR

SEQ ID NO: 36881 - protein, 188 aa, Sorghum bicolor
  Clone ID: SORBI-28MAY03-C118774_1.pep
RCTRHWGPRSSAAAAAGGSTAAGRRRRRRSTTPGCRTRGRRSSRRARPACRTGSSRCTRRSRSRSRSRTRQRQRCSRSLGCSRSRRRTRRARARWTARPRPARRPAPSSAAARSARRAAARTRPWPPSSSPAAGRGRPWSCRAASPSPCRASRPTPAREHRHRGRTSPSSPPPSRPCPPPSSRPCLAS

SEQ ID NO: 36882 - protein, 385 aa, Sorghum bicolor
  Clone ID: SORBI-28MAY03-C11905_1.pep
HEAPAAYFSETDDDKLRAGASLLCSDDQEWSLVKESYMEMTERIDSAVMLAKVPEEIKAMHRGFYEWDSSEVTSLNHQPIVQVLIDGKDRSVVDNGGSMLPTLVYMAREKRPHYHHNFKAGAMNALIRVSSVISNSPIILNVDCDVYSNNSPSGRDALCFFLDEEMGHKVAFVQYPQNYTNLTKNDIYGNSLNVINEVELSGLDTWGGPLYIENTGFHRRETLCGRRFTKDYKEDWDRGIKTEHSCIEKTEEKAKSLATCTYEHNTQWGDEMGLKYGCPVEDVITGLAIHCRGWESVYSNLPRSGFIGVGPTTLAQTILQHKRWSEGNFSIFLSKFCPFLYGHGKTKLPHQMGYSIYGLWAPNSLPTLYYVVIPSLSLLKGIPLS

SEQ ID NO: 36883 - protein, 141 aa, Sorghum bicolor
  Clone ID: SORBI-28MAY03-C117264_1.pep
MASYIGNKTMITFTAAALMILAVMTMVVEARDLSTSTGGYGEEAMKVRHQQWMAEHGRTYKDEAEKARRFQVFKANADFVDRSNAAGGKSYELAINEFADMTNDEFVAMYTGLKPVPAGPKKMAGFKYENLTLSDVDQQAV

SEQ ID NO: 36884 - protein, 207 aa, Sorghum bicolor
  Clone ID: SORBI-28MAY03-C117201_1.pep
TRVVSFLWLRRAVLGRRGGGPRLLPSPWALPVIGHLHHLAGALPHRAMRDLAARHGPVMLLRLGGLPVVVASSAGAAREVMKARDIEFATRPVTRMARLVIPEGAEGIVFAPYGDGWRQTRKICTVELLSARRVQSFRPVREDEARRLLHTVASAPRPRAVNLSELLAVYAADSSVRAIIGSRIKDRDTFLALLERGLKLFGSMSLP

SEQ ID NO: 36885 - protein, 76 aa, Sorghum bicolor
  Clone ID: SORBI-28MAY03-C117301_1.pep
NFLLQLSAVSPSAVGFAGLVWSGFSGRVYAAASLVFSSLLLLLLLLAWFGSVRTSLLFLWMDEYNWASCYSGRLPL

SEQ ID NO: 36886 - protein, 136 aa, Sorghum bicolor
  Clone ID: SORBI-28MAY03-C117307_1.pep
MQFTISAAALMAFAAKALAQVADFDPVLTPTNWEEVSAGKTLEITWQAKPKYSGEKISISLIGGATQNTQVPIKTIATGIDNDAASYSWAIDSTLGTENVYGLVLKLESNPEVFQYSFPFKIEGAKKPEDKPSQTK

SEQ ID NO: 36887 - protein, 144 aa, Sorghum bicolor
  Clone ID: SORBI-28MAY03-C11693_1.pep
TRLLSAVTYRDRKMEELRGIARPTDAEVSARWRSVTRGPSARAAGGPAASESSVPRTRTVSRCARRRRSSPTTTLRRRHAAPPHHFPQRRRPRQHRDYRSPPQPHETPRDLLLLLLCCTAATCVTRSDLFRSVCPCRALASWAC

SEQ ID NO: 36888 - protein, 105 aa, Sorghum bicolor
  Clone ID: LIB3478-032-P1-K1-F11.pep
SLLSAVTYRDRKMEELRGIARPTDAEVSARWRSVTRGPSARAAGGPAASESSVPRTRTVSRCARRRRSSPTTTLRRRHAAPPHHFPQRRRPRQHRDYRALASWAC

SEQ ID NO: 36889 - protein, 184 aa, Sorghum bicolor
  Clone ID: SORBI-28MAY03-C12009_1.pep
ARGVSLIFFLSGGPRWLMARVAPGGFWLAWGIGGARALAGRSDAAPLPCAASQLGSSSAPPVALTRALSGNSPKSTSTQPICLLFQALQLPPLCSPRRAAVLAAAWFFSGRTPCRPQHRRCWRARRTSKRRRPSGTARASTTLTRSCSSRSEAAPAQLIAPARSCSGCWISVQIFGACHGAVQT

SEQ ID NO: 36890 - protein, 269 aa, Sorghum bicolor
  Clone ID: SORBI-28MAY03-C120253_1.pep
HEAVVEAIAEKDDDTTTEDDLMVVSAELEKVLGGRNSGAAGDLIASARVSFAMGVDCPLQGFLFGSPVSDAAESRLEQPRDSNGGRRTSLGELFMRTRFADEKVALVAVEEGEDGGDGGAAGGERDDGKAGKGGGCHKTTKKRRVKDDKVAGGDGTPASAAVTKSKFQKTLQIFHRKVYPESAALARNLTKKSRKRGSGGADEPAEPASSNKLRCRKEQRAPGFGCCANRASFGGAASPIHDDDDDDELNGSKSGHWIKTDAEYLVLEL

SEQ ID NO: 36891 - protein, 297 aa, Sorghum bicolor
  Clone ID: SORBI-28MAY03-C120388_1.pep
MAAAAPTHAPVCSSSACRAGICSSGTPFPSFRSAEASAPGWRRTEPYPAVSVVPGSAPGAVAVDTDVDTLLDSVKWDSKGLAVAIAQNVDTGAILMQGFANKEALAKTISTRKATFFSRSRSSLWTKGETSMNFINVHDIFLDCDHDSIIYLGKPDGPTCHTGAETCYYTSVYDALQSSKPNEGRQVMTTLYSLEDTISRRQEEIVTEGGGKPSWTKKLLLDNQLLCSKIREEAGELIQTLLENEDQSRAASEMADLLYHAMVLLRVKDVKMEEVLEILRKRFSQSGIEEKASRNKS

SEQ ID NO: 36892 - protein, 153 aa, Sorghum bicolor
  Clone ID: SORBI-28MAY03-C120398_1.pep
MLMALSLFRKSLSDGVLAQVWMPIEHNGRVVLSTSEQPYLLDQDLAGYREVSRSFYFSVKEEPGLHLGLPGRVFISGVPEWTSSVMYYSKPEYLRMEHALLHEIRGSLAMPVYDPSKGSCCAVLELVTNKEKPDFDAEMDIVCDALQAVNLQT

SEQ ID NO: 36893 - protein, 205 aa, Sorghum bicolor
  unsure (1)..(205): unsure at all Xaa locations
  Clone ID: SORBI-28MAY03-C12053_1.pep
MAPARDEHLDAIRALMAVHSPPLHALVVPSEDAHQSEYVSEQDKRREFISGFTGSAGLALITMKEAFLWTDGRYFLQATQQLSNRWKLMRMGEDPPGEAWIADNLAAEAVIGINPWCISVDSAQRYEHAFSKKHQTLLQLSSDLVDEVWKDRPLVEPRPVIVHSVEFAGRSVPXKLKELRGKLVHEKATAIIITALDEVAWLYNI

SEQ ID NO: 36894 - protein, 145 aa, Sorghum bicolor
  Clone ID: SORBI-28MAY03-C14548_1.pep
LPPPPPPASRHEAEPAKSKASVFSRISFPGDGANPSDAKRSRRASDKPPAHSSSSSKKSAAAEGGGDARGHRHHQQNHREGAAAEEEKRRPGGEYYGGTDEEEESEEEEQHFKRRPSSSSRREREQEAQEEQPRHSRRSRDHKRR

SEQ ID NO: 36895 - protein, 147 aa, Sorghum bicolor
  Clone ID: SORBI-28MAY03-C14622_1.pep
TIDLVEMVFAKGDPGIAALYDKLLVSEDLWSFGKRLRANYEETKQLLLQVAGHKDLLEGDPYLKQRLRIRDSYITALNVCQAYTLKRIRDPGFQVNPGPHLSKDVMDIGKPASELVKLNTTSEYAPGLEDTLILTMKGIAAGMQNTG

SEQ ID NO: 36896 - protein, 122 aa, Sorghum bicolor
  Clone ID: SORBI-28MAY03-C14603_1.pep
TRLLSVAAYRKLWFPDRLHRDFLEVMFTNRKERAELLEGLVVSNKDATVPVLSQKILLLWGENDNIFNIELAKTMKEQLGEKTMLQSISKAGHLVHLERPCVYNRLLKEFLASVTAAETTKN

SEQ ID NO: 36897 - protein, 63 aa, Sorghum bicolor
  Clone ID: SORBI-28MAY03-C14636_1.pep
VREEMNLLAEVDQPGSLIDNYVTQLSFLLSRKAAGLVSLQARLARFQHRLKEQEILSRKKPSR

SEQ ID NO: 36898 - protein, 237 aa, Sorghum bicolor
  unsure (1)..(237): unsure at all Xaa locations
  Clone ID: SORBI-28MAY03-C120919_1.pep
MAPAASARFPPVSSYDASARTRRTAAADLDGTLLASSSAFPYYFLVALEAGSCLRAAALLLVAPLLLALYTLVSEAAAIALLAFVTFAGLRVRDVEAVARGVLPRHYAAGVRADTWTVFRGCGEGRRVVVTASPAVMXVGEFVREFLGAEVAGTELGFQCTTLTRKDKYMKLAGNDGSVAARAKKDAADDNACHESPPPRSLYEEIDYIYWQPSSNISEQHCTDVKKKKTCMHKRYS

SEQ ID NO: 36899 - protein, 291 aa, Sorghum bicolor
  unsure (1)..(291): unsure at all Xaa locations
  Clone ID: SORBI-28MAY03-C12119_1.pep
DYECTLCFKLLYEPVTTPCGHSFCRWCIXQSMDHGNKCPMCRTVLFIGPRTYPLSVTLSNIIQRNFPQEYAERRSEHETMTYAGVDLMPLFVMDVVLPSQKMALNIFEPRYRLMVRRIMEGNHRMGMVTIDSATGTVADCGCEVEILECEPLPDGRFYLEVEGTRRFRILRSWDQDGYRVAEVEWLRDRPLPEGSQERRELMEMANEASEMARAYIRRARETIRTARRTRHLDLEGMPGPQDPEKFSFWLVNLISLRPSDRLDMLRLRDTRERISSSIRLLSDAEQGCRVQ

SEQ ID NO: 36900 - protein, 152 aa, Sorghum bicolor
  Clone ID: SORBI-28MAY03-C121279_1.pep
MAKPQEVRSVDSFSQLPFIRPAPAPAQPRDATIRLFGCDFSNDQQRQAKQQQDAASDSPDNANGSTVTSESNGGAKSGGAAAAAAAAAAAERKFECHYCCRNFPTSQALGGHQNAHKRERQHAKRAHLQASLAMHRYVPGHMYGLFNYHHHH

SEQ ID NO: 36901 - protein, 87 aa, Sorghum bicolor
  Clone ID: SORBI-28MAY03-C12102_1.pep
QTTDRQLQTSGINFTQQDPTDWLITRLNFSLIQMLLLILLVLLVAKALILITEALRFTKDCSSSEPSTRPERPRITRATRIGGRETS

SEQ ID NO: 36902 - protein, 92 aa, Sorghum bicolor
  Clone ID: LIB3478-038-P1-K1-F4.pep
QTADRQLQTSGINFSLQDPTDWLITSVNFSLIQMLLLILLVLLVAKALILITEALLITTNCRPTARWLLVAVRRRAEDNDAEACLPHLHDTS

SEQ ID NO: 36903 - protein, 233 aa, Sorghum bicolor
  Clone ID: SORBI-28MAY03-C12139_1.pep
ENFCKSNDVPVYRRDPDDGIDNIGKTGGNHAVSGLKFRILREFLQLGYSVLLSDIDIIFFQNPFDHLYRDSDVESMSDGHNNMTAYGFNDVFDEPSMGWARYAHTMRIWVYNSGFFFIRPTIPSIELLDRVAYRLSHEPKSWDQAVFNEELFFPSHPGYEGLHASKRTMDMYLFMNSKVLFKTVRKDAHLRKLKPVIVHLNYHPDKYDRMKAVIEFYVNGKQNALERFPDGSE

SEQ ID NO: 36904 - protein, 241 aa, Sorghum bicolor
  Clone ID: SORBI-28MAY03-C12177_1.pep
MPPAYVPSHIGNQPMMENMRPPVSEFEEPKFEEDRTVIPVMDASLRDIDFEHLQIIKNGDLEELRELGSGTFGTVYHGKWRGSDVAIKRIKKSCFTGRSSEQERLAHEFWREAEILSKLHHPNVVAFYGVVKDGPGGTLATVTEFMVNGSLRHVLQRKDKYLDRRKRLIIAMDAAFGMEYLHSKNIVHFDLKCDNLLVNLKDQTRPICKVGDFGLSKIKRNTLVSGGVRGTLPWMAPELLN

SEQ ID NO: 36905 - protein, 127 aa, Sorghum bicolor
  Clone ID: SORBI-28MAY03-C119415_1.pep
MAGGTGAPPDQRKRKAPAPAAGAEDEEEVEAEVEELESEVADLDRRTLEHLRRTATRLSDAAFSRLAALRPPARLEVPAVSETSVAEDDQELEKVKILKSKIKANIDDLPKVLEKINETIARCEKFC

SEQ ID NO: 36906 - protein, 235 aa, Sorghum bicolor
  Clone ID: SORBI-28MAY03-C119596_1.pep
VNTCRALEGDFLDALQGIPSSDGQRLFAVGPLSPVLLPLPGAGASSGTSRRHECLDWLDAQPASSVLYVSFGTTSSLRPEQVRELAAALRDSGARFVWVLRDADRADLRSGGEGDAAAETLRAAAASELGPGASRAGVVVTGWAPQLEILAHGATAAFMSHCGWNSTVESLSHGKPILAWPMHSDQPWDAELVCKYLRAGVLVRPWERRHDVIPAAAIRDAIDRVMASDEGAEIR

SEQ ID NO: 36907 - protein, 135 aa, Sorghum bicolor
  Clone ID: SORBI-28MAY03-C119765_1.pep
LAVTGLPVWITELDVSPADESVRADDLEIVLREAYAHPAVEGIMLWGFMQGHMWRSHGQLVNADGKYTQAGNMFAGLRREWTSHARGKVDGNGNFKFRGFHGTYQVLLTTAAGEVKKRTFDVNKGDAPLVLDMDF

SEQ ID NO: 36908 - protein, 120 aa, Sorghum bicolor
  Clone ID: SORBI-28MAY03-C11993_1.pep
RERTKGMHRGCNAASTSNNRTRERHSYNSCSCGHPEDSGVMDSCFLPIARSGREMKIARKSGVEKPRLQYHRCYTLDNFIVSKGNRAGCTQKNAIPKQVWEPMDARRKTNLHNTVHDSGQ

SEQ ID NO: 36909 - protein, 211 aa, Sorghum bicolor
  Clone ID: SORBI-28MAY03-C122303_1.pep
VVISPSYLHLLLVRENLREGLEVASQNVYDKPNGAFTGEVSVSQLKDSGINWTILGHSERRTILRESDEVVALKTKYATENGVSVIWCCGESLEEREAGKTIDVVSKQLAALKAQISDWSKIVIAYEPIWAIGTGKVATTEQAQEVHKAIREWLKTNVSDKVADETRILYGGSVNEKNCGELSKQADIDGFLVGGASLKPAFVDIINCLKQ

SEQ ID NO: 36910 - protein, 168 aa, Sorghum bicolor
  Clone ID: SORBI-28MAY03-C1224_1.pep
MEGAGAARKRSRPESANGYAAGGKRSKDTESFQTGQSSKSKPCTKFFSTIGCPFGEGCHFLHFVPGGYPAVAKMLNLGSPAVSAPSRTHVDHAALTGASHQASMGKTRMCTKYNTTEGCKFGDKCHFAHSERELGKPAYMSHEGPPMGGRYGGRPEPLQQASMGPPAG

SEQ ID NO: 36911 - protein, 196 aa, Sorghum bicolor
  unsure (1)..(196): unsure at all Xaa locations
  Clone ID: SORBI-28MAY03-C122438_1.pep
MALRLAVQALSATLLSRAETTSPSPKPPSKSNNSKQQSQRPAGAAAAATTTSGRRLATASVAAVLASQLLPPVASSGAGTFDLRLTLPEKSSEEAEAVVRTHARNLLGVKRFIDAGAWRELQAALRASASILXQDLYAIIQAKPTGQRPELRRLYSDLFNSVTSLDYAARDKDQVQVQEHYGNIVSALDEIFAKIM

SEQ ID NO: 36912 - protein, 215 aa, Sorghum bicolor
  Clone ID: SORBI-28MAY03-C122747_1.pep
ARGPSRVGIATDAARGLSYMHDLAIIHRDVKSSNILLDRDFEAKIGDFGLARVLAKPGESEPASVIMGTPGHIAPEYLRDAEVSEKVDVYSFGVVLLELVTGKQPHDAGTKPGVGLAKWASQQHRNRIRWDHIIDKDIQNPAYEDDMKAVFMLGLRCTSEDPLNRPAMNKVLEQLEQLLSCDPSRVKHRGSFLAKVYRKIQDKIFRQGQSAVSIQ

SEQ ID NO: 36913 - protein, 222 aa, Sorghum bicolor
  Clone ID: SORBI-28MAY03-C123169_1.pep
EQTVLHTGPQPPFNNPYLILSPLLEISSTSISTNTKAISTRQIQQQKTKMYSKNLVLAVMASAATTAVAEFAIITTPVPTNLAVLTDLSGYKSSILAQVSSGLSSLTGDPANIRSASSAHKGLASFVATATYSIPPKVTEVNALETFSTTPVWYSALPTDVKAYYDKFNKGVQDLVDQAILGETKNATSDSGAKATGASSKCATEGDGRCHAKYGGAHGRGY

SEQ ID NO: 36914 - protein, 258 aa, Sorghum bicolor
  unsure (1)..(258): unsure at all Xaa locations
  Clone ID: SORBI-28MAY03-C123182_1.pep
MAQQQLLLLPAPPRTFLKPLSSPFLSSLPRRHLVPVSAVRVAPAVRRGLLQYATKRSGLVEELEIARDKQPRSRRANGIFWILLLNFGIYVADHLLQIRQIKSLYLYHAFPTWFQFVTSTFCHANWNHLSSNLFFVYIFGKLVEEEEGNFALWMSYILTGAGANLISWLVLPTSSVSLGASGAVFGLFTISVLVKMSWDWRKILEVLILGQFVVDKVMEAARATTITGQSFQXVNNIAHVSGALIGAALVFLVSRIPF

SEQ ID NO: 36915 - protein, 239 aa, Sorghum bicolor
  Clone ID: SORBI-28MAY03-C123187_1.pep
MADSANAPKPSSSVKLVLLGEAAVGKSSLVLRFVNNDFQENKEPTIGAAFLTQKCNLPTRTIKFEIWDTAGQERFASLAPMYYRNAQAALVVYDLTKPTSLIKAKHWVAELQRQASPGIVIALVGNKLDLTGDSSGAADGEEGDEGDDSGDARKVPTEEAQAYAEEESLLFFETSAKSGHNVTEVFTAIANAIPETSLKSARGAGASNAASRGGEEQRVNLGGPKDVGAKGTAVLARQT

SEQ ID NO: 36916 - protein, 171 aa, Sorghum bicolor
  Clone ID: SORBI-28MAY03-C12046_1.pep
DAWAEEYSHTAVNKFDRGPESIPDWLFDFMPTRGGYFVGNVSPARMDFRWFALGNCVAILASLATPDQAAAIMDLIEERWEDLVGEMPVKICYPAIEGHEWQIVTGCDPKNTRWSYHNGGSWPVLLWLLTAACIKTGRLKIARRAIDLAEARLARDGWPEYYDGKLGRYIG

SEQ ID NO: 36917 - protein, 179 aa, Sorghum bicolor
  Clone ID: SORBI-28MAY03-C120564_1.pep
VLPNPNAGPSYTISIQPEVMLYEQWKDLKTDSKSGLSAWIKGAFTGSKSDMQDSVLQNLHFILSSSPMWDRLELRGDKNVLGEFIEFKGRHEDIQLLKNLKRSKVSRFVIQKSTLFGGFGRSRVQILYSPRDYRAEGTSSSEWKEISVKQYTEIVFQPLHSKKARKFKLSSVVSVTLSA

SEQ ID NO: 36918 - protein, 193 aa, Sorghum bicolor
  Clone ID: SORBI-28MAY03-C12059_1.pep
ILRPLPCWLLHLFLSLVPPSNSKPHRAHRRSKQNTETSIPNRTPSPDSGGFVSNARGAYCRRTPPMTLDATEAGGGGDLFAANLKGSLLAIASSAFIGVSFIVKKKGLRRAGAAGARAGVGGYGYLLEPLWWVGMVTMLVGEIANFIAYMFAPAVLVTPLGALSIIVSAVLAHFTLNEKLHRVGVLGCGLCIV

SEQ ID NO: 36919 - protein, 166 aa, Sorghum bicolor
  Clone ID: SORBI-28MAY03-C120624_1.pep
MSESRLRVPDKVKEVAKEDFDQYKQLASDAVRSAAYLYPFKGIVYFFTHRALWKPLAAKLLPTASLGVGTTVFMFMVTYVPQAAILSIFNGPLAVFTTILLVLSESSTIFSVLSKNFLIDDALIDTFDGTLVCRNQTTLVSNERQVRSGSDPIGKLGKLVSKPFAR

SEQ ID NO: 36920 - protein, 134 aa, Sorghum bicolor
  Clone ID: SORBI-28MAY03-C123446_1.pep
TPTPLDVSDQKLLNELSELAVLKRARIERMKALKKMKNAKQGASGGNLCPLIITIIFCIVILWQGFFSGHGSAVSFHGSPESAIRAHSSLISIRFYKNHSNVRPPSENTAAPDNVETDSVLRLGNRNQARRLAR

SEQ ID NO: 36921 - protein, 78 aa, Sorghum bicolor
  Clone ID: SORBI-28MAY03-C12355_1.pep
MTAGYIVGSLVGSFAIAYLCDTFVSDMKAFGGSTPKTVSEKEWWQATDTKFQAWPRTAGPPVVMNPISRQNFIVKSTE

SEQ ID NO: 36922 - protein, 109 aa, Sorghum bicolor
  Clone ID: SORBI-28MAY03-C12348_1.pep
AFRPCRCAPQATRPLAVNRSMEGGGSNAPFYRGSTTALATNPSAANGAQKGDREAAIDAEIARVNNLPARSSYAIHRMKVLNKLRHLMSIKRTTSQDEELELLFASLSI

SEQ ID NO: 36923 - protein, 341 aa, Sorghum bicolor
  Clone ID: SORBI-28MAY03-C12358_1.pep
TYNTTSTVEHMVRNQPDVVLLLGDVCYANLYLTNGTGTDCYSCSFANSTPIHETYQPRWDYWGRYMEPVTSSIPMMVVEGNHEIEEQIHNKTFASYSSRFAFPSEESGSFSPFYYSFDAGGIHFVMLASYVDYNRSGAQYRWLEEDLVKVDRSVTPWLIAGWHAPWYTTYQAHYREAECMRVEMEELLYAYAVDVVFTGHVHAYERSNRVFNYTLDACGPVYISVGDGGNREKMATAHADDPGHCPDPASTPDPFMGGRLCAANFTTGPAAGRFCWDQQPDYSASRESSFGHGVLEVKNDTHALWQWHRNQALNADVAADEVYIVREPYKCLAKSTRLLAY

SEQ ID NO: 36924 - protein, 160 aa, Sorghum bicolor
  Clone ID: SORBI-28MAY03-C123878_1.pep
ARGSCGVTLYVMLVGGYPFEDPEDPKNFKKTIQKILGVQYAIPDYVCVSPECRDLISRIFVANPADRITMPEIKSHPWFVKNLPADLVGDGTVSYEEPDQPMQNMNEIMQILAEATVPADGARGTTQLLCDDLDDFDDDMDLDSDLDLDIESSGEIVYAM

SEQ ID NO: 36925 - protein, 360 aa, Sorghum bicolor
  Clone ID: SORBI-28MAY03-C124_1.pep
LEATCKRNGYKQAMKLLDEMRDKGCAPDIITYNVVLNGICQEGRVVDAMEFLENLPSYGGEPNTVSYNIVLKGLFTAERWEDAEKLMEEMAHKGCPPNVVTFNMLISFLCRRGLVEPAMEVLEQIPKYGCTPNSLSYNPLLHAFCKQKKMDKAMAFVELMVSRGCYPDIVSYNTLLTALCRNGEVDVAIDLLHQLKGKGCSPVLISYNTVIDGLTKAGKTKEALELLDEMISKGLQPDIITYTTIASGLCREDKIEEAIRTFCKVQDMGIRPTVVLYNAILLGLCKRRETHNAIDLFSYMISNGCMPNESTYTILVEGLAYEGLVKEARDLLGQLCSRGVVNKKFMKKGAVKMLDGPTQT

SEQ ID NO: 36926 - protein, 165 aa, Sorghum bicolor
  Clone ID: SORBI-28MAY03-C121785_1.pep
MHQQQQQQQFQRRSSFSVVRRERAAREAWLDRAWEMKRSWHQRNGGAPDADTPVVVVVGDVAEGHPPMASGGGGVAMDVEEVRACRDLGLELPSDCTVEIQCYGLSGGSSPTHTATPGSGADSPSALSSLPGGAAGGGADPMDVKARLKVWAQPVALASTTHLSS

SEQ ID NO: 36927 - protein, 207 aa, Sorghum bicolor
  Clone ID: SORBI-28MAY03-C12195_1.pep
LSALQGGLQVLSSILQKYLEFPFVVPKYFFRVRPCLGAELYMFGSNPVNEKGMSIEPGSLLSLTLCMKWKRMLERSAIRAVKLYCILATSLETCLDAAGTRSKQFDPRRTTEMVELNSKLLQYIKSDLRKAKNETKNSHCGMDMVTAFACFEPTDSGQGFSGCLLDVSSFPEGSYQIKWHACCLDENGSYFSLLPLNDGSIFSIRKS

SEQ ID NO: 36928 - protein, 72 aa, Sorghum bicolor
  Clone ID: SORBI-28MAY03-C12224_1.pep
GNLAKNVTTEVLKNFFSEKGKILSATVSHIPGTSKSKGYGFVTFSSEEEVEAAVATFNNAELEGQPIRVNRA

SEQ ID NO: 36929 - protein, 140 aa, Sorghum bicolor
  Clone ID: SORBI-28MAY03-C122093_1.pep
TPSCSLPSATATPTLRATAPARSSSSRSSTASGPTARATRSSPSPSSTSRVSALLTSLRTRPSPPVTPLASSPLLPTLPCPPPALPPSRPTLPSPAALALPAPPPPLSSATVPAVLALASASSLPLLASLLPYKQTYLLW

SEQ ID NO: 36930 - protein, 93 aa, Sorghum bicolor
  Clone ID: SORBI-28MAY03-C12007_1.pep
VYIIFIQWGLRSFKAALREWRMKREIRPQQGYTYNVKEYFRNNWYNRTTQLYQFLSLLPHTNCCFRRFSYRMQLPGKGKCIMVKKKHVCILQG

SEQ ID NO: 36931 - protein, 172 aa, Sorghum bicolor
  Clone ID: SORBI-28MAY03-C125416_1.pep
VPKEINDKRREENERAAELHSSFLMKMARRLYKMHQEKLLTHHNDETDWNRWKYAESLRRNFFFVNMINILGAKARLLNEQYFEPLGDDIVLQLPLPATEHMWRCCDEEEWAIAREHAMRRPANSPPVARTLRELLEQDKAGTLDASTLLPVTRLIFACAKVAPKGDSLGDL

SEQ ID NO: 36932 - protein, 71 aa, Sorghum bicolor
  unsure (1)..(71): unsure at all Xaa locations
  Clone ID: SORBI-28MAY03-C12544_1.pep
GGMKEETXFDQLQKRIPERIVEHAVRGMLPKGRLGRRLFTHLKVYKGAEHPHEAQKPVPLPIRDKRIQKTG

SEQ ID NO: 36933 - protein, 179 aa, Sorghum bicolor
  unsure (1)..(179): unsure at all Xaa locations
  Clone ID: SORBI-28MAY03-C12550_1.pep
MACCFLRVAAAPRLLLYRAAASRQLPSPLTVFRKGFSEQSALPVTDSSECFQGPSVQNTPRIPLYDDSISSSILDTLSNPTEVVPHADPSKSRIMLVDGTSVMYRSYYKILAQLQHGQLEHADGNGDWVLTIFKALSLLLDMLEFIPSHAAXVFDHDGVPYGHYTGMPXKECHMAKGMT

SEQ ID NO: 36934 - protein, 209 aa, Sorghum bicolor
  unsure (1)..(209): unsure at all Xaa locations
  Clone ID: SORBI-28MAY03-C1258_1.pep
RHEDIIYDGLGLEPPMLHALANDIDVIVNIAATTNFYERYDVSLDVNVMGVKHLCTFAKQCARLKMLMHVSTAFVSGFREGLILERRIKPVQSLREGTYLDVDTELRLVKEVKKSLAMANAGDGDGDAHTDVKMTERKAMKELGLQRARHFGWSNTYVFTKAMGEXVLGQQLRGVCAGDGGDIPRGVMRPSIITSVRDDPVPGWMQGTR

SEQ ID NO: 36935 - protein, 165 aa, Sorghum bicolor
  Clone ID: SORBI-28MAY03-C12600_1.pep
KRRILVHEAGHLLTAYLMGCPIRGVIVDPFVALRMGIQGQAGTQFWDEKMEKELAEGHLSSTAFDRYCMILFAGTAAEALVYGEAEGGENDENLFRSLCILLNPPLSVAQMANRARWSVMQSYNLLKWHKKAHRAAVKALEDGHSLSIVIRRIEEAFASERKYDN

SEQ ID NO: 36936 - protein, 103 aa, Sorghum bicolor
  Clone ID: SORBI-28MAY03-C125617_1.pep
LDAAVTCDERYGHVREVSLCMEDAEGGGGVSGRDGLAVVAAAMAGARRGRGAEEDTRVRYQEFVKGRADRKERKARREGIIDLCCSGVGAAAFVGFLVMLTFR

SEQ ID NO: 36937 - protein, 86 aa, Sorghum bicolor
  Clone ID: SORBI-28MAY03-C123217_1.pep
PPCDVCPSGRSIYPGGQVFFSCRRRRPATGDGNGEANFFCPLRLLDFCCVVAAVEKKVLVAAGLEAPFACGRDESAGGHPHPSNYF

SEQ ID NO: 36938 - protein, 171 aa, Sorghum bicolor
  unsure (1)..(171): unsure at all Xaa locations
  Clone ID: SORBI-28MAY03-C12322_1.pep
MLTTPSVIVSTGSSNMPADSGQSLKYGGPLAADWTQLELEILRDGMDEYVHEQGIMKYIKIAASLPNKTVRDVAMRCQWVXKKVNTRRRKPQEHHTGRNTKERKDKFVEPAPWGANHPLQTGMRASSFVPHNVQISGACEIDRPVQYLIEVVASIYLLLFLVSAGNLLVQL

SEQ ID NO: 36939 - protein, 157 aa, Sorghum bicolor
  Clone ID: SORBI-28MAY03-C12344_1.pep
MLSLPRTAAAVTVYALLALIASAGAAAAGGGVQPLSRIAIHRATAAPQPGAFVDASPALLGLEGEDREWVTVTYSNPRPSKDDWIGVFSPANFNDSICPQENEWVESPLLCTAPIKFQFANYTNRDYGNTGKGSLKLQLINQREGFSFALFSGGLSN

SEQ ID NO: 36940 - protein, 228 aa, Sorghum bicolor
  Clone ID: SORBI-28MAY03-C127183_1.pep
MPAGGFSVSAPSGVEFEAKITPIVIISCIMAATGGLMFGYDVGISGGVTSMDDFLGKFFPAVLRKKQEDKESNYCKYDNQGLQLFTSSLYLAGLTATFFASYTTRRLGRRLTMLVAGVFFIVGVIFNGAAQNLAMLIVGRILLGCGVGFANQAVPLFLSEIAPTRIRGGLNILFQLNVTIGILFANLVNYGTSKIHPWGWRLSLSLAGIPAVLLTLSALFVTDTPNSL

SEQ ID NO: 36941 - protein, 134 aa, Sorghum bicolor
  Clone ID: SORBI-28MAY03-C127258_1.pep
EELELEFKREATQLARARDQEEDEENHRHRESLRVIRENYMERVITMRNLHSRKWEEFLEQTFKRQQAQPSYTQTGYPGFEQRTTHISATHQPMDSKRTYPYASDSYSAPKAHAAYGEFQHERHDDLGRTYGRY

SEQ ID NO: 36942 - protein, 129 aa, Sorghum bicolor
  Clone ID: SORBI-28MAY03-C127272_1.pep
KARDDFVKQKNKIRTYKTAAWTSRRATKPLPRGRTRGHRRHPPKIVLHLKPGAALAHVSGQATLTGAVRIVTGVWAAGAAAAAAGVVAAAVHVAGGGGGASLLELEALLELRHDVGHGGGGAPRPARCT

SEQ ID NO: 36943 - protein, 162 aa, Sorghum bicolor
  Clone ID: SORBI-28MAY03-C127697_1.pep
MEVKDAAKPRLPPGFRFRPTDEELIVHYLRRRALASPLPPAVDIPDVRILAHDPSDLLPPGFSEQERYFFTCKEAKYVKGRRANRATGAGYWKATGKEKPVAVAVPATRGGQGQAVLVGMKRSLVFYRGKPPTGSKTDWVMHEYRLAGAGLAPCRRATAQQD

SEQ ID NO: 36944 - protein, 241 aa, Sorghum bicolor
  Clone ID: SORBI-28MAY03-C127690_1.pep
ARGWKEVADVYETFLVGSCGRVLSSDVPSADYITADDTLDMSVLTVFGDDILKLQNDAPLEVLQRLVNCLDHCASRTGSLPVQTVGLLPLHCSRFSLSCLQMMFSLCSSIAKTTLCAAASETSKVSISILMKRCEIILGQFLADENDLGEHPLPSVRVEETICVLQELARLIIDIDTASALNIPPYLKQALGENKSHGRAHLLSLLPTFSELVISREARVRELVQVLLRLISSELGLHRLT

SEQ ID NO: 36945 - protein, 251 aa, Sorghum bicolor
  unsure (1)..(251): unsure at all Xaa locations
  Clone ID: SORBI-28MAY03-C12737_1.pep
ALLREQWESLFSANGKLRDGGKARRKKVRSGGIEPSIRAEVWPFLLGVYDLNSSEEERNSVKIKKRKEYEKLRRQCQQILNGCKGNGLKAITEVNNECSSLEGTAEGSESPCFEDGNAIPAPVSLEELKPEQNEADQPESIPCAVVECMEEDADELAYAYPCIAESESSDSESSDEDDPGRISVSGEENCDPDPKYTRSTSFKADFFRSSRTSEDXATWQRIIRLDAIRSNSEWILFSRNQPEVPKERALQ

SEQ ID NO: 36946 - protein, 360 aa, Sorghum bicolor
  Clone ID: SORBI-28MAY03-C12434_1.pep
LYNSLIVARPSIASEIKHLGLLAEPMPSVDDLVARQNIHVEGLPATPSKKRDAGPDDNADPRSPKRSCNESRNTVVEHNLLTPPPKHHMVSTSLKAKCHPLESTFASPTVSNPVGGNEKCADVAIQIFFSKILDQQTTLFFNRHIDQLILCCLYGVAKACKVELSFKELLNYYRKEAQCKPEVFQNIYIGSRNSNDVLVSPRVSIISFYNAVFVPAAKPFLVSLISSGTCPEDKKNASGPIPGSPKPSPLPNNLPDMSPKKVSASHNVYVSPLRQTKMDALLSPSSRSFYACIGEGTHAYQSPSKDLAAINSRLNYSGRRINSRLNFDMVSDSVVAGSLGQPNGGSTSFNPAAAFSPLSK

SEQ ID NO: 36947 - protein, 245 aa, Sorghum bicolor
  Clone ID: SORBI-28MAY03-C12443_1.pep
GDRGLAALSACPNLEVLFLVKTPECTDSGIISVAEKCHKLRKLHVDGWRTNRIGDFGLMAVARGCPDLQELVLIGVNPTVLSLRMFGEHCRSLERLALCGCETVGDAEIICLAERWAALKKLCIKGCPVSDRGMVALNGGCPSLVKVKLKRCRGVSYECIENLKVTRGESFSISLDIVLEHEAGSASENGVQENGQAQVAELTDQMAGMDLPANAAGAQSSTHTINRMRSVMSAIRRRFGNPPPP

SEQ ID NO: 36948 - protein, 54 aa, Sorghum bicolor
  Clone ID: SORBI-28MAY03-C12513_1.pep
QVLSTNKNSCFHSFLLRILCHGSTTRPVRTMGANRHSALSKTEQLLALILIGMG

SEQ ID NO: 36949 - protein, 181 aa, Sorghum bicolor
  Clone ID: SORBI-28MAY03-C125245_1.pep
MAAQREKSAVAAAAHGAAVSGSPSPSSSSGGPAAASSGERWSAAIGNLGELGANVDALQKLLGRKAVFVDDDIFSKASLAADQARTIKVLDQRVQSLERELDAAISAAARARTEKRQAEAAQRAAELRTQEVTKELENTARVFELHMEELRLKQEEIAKKDSDIKVLEAIIRTLSSKDDTL

SEQ ID NO: 36950 - protein, 282 aa, Sorghum bicolor
  Clone ID: SORBI-28MAY03-C128596_1.pep
MESQQQPTIGHMASKSPEEQHELQEGQAVQNPSALQVQADLLWKLRKYLMLLAILAAAITYQAGLAPPGGFWQDSLARRIPGDIVLRVSYPKRYYVFFYCSTTAFGASLIVLILLLVRELSRNVVWLGALQFAMVLGLLGLMGAYAAGSCREVRTSVYIWVLLVGIFAYITVHVIFFRHLAPKCLRDIFMNIRKYWKDILATIFRKTQSNEPQTPMNDREAHDEGEELERNRSFLLVLATLAATVTYVAGLTPPGGFWPDDDKPNHLAGDPVLRDHYPRRFK

SEQ ID NO: 36951 - protein, 90 aa, Sorghum bicolor
  Clone ID: SORBI-28MAY03-C128674_1.pep
LLIHPPPIHPPAMSYQAGYPPPAATAYPPPGQQQAYVAPPPAYPPTQDGGAYAYGQQQQQTTTTSRGGDDGFWKGCCAAICCCCVLDMCF

SEQ ID NO: 36952 - protein, 239 aa, Sorghum bicolor
  Clone ID: SORBI-28MAY03-C12888_1.pep
MIFLGPNLPPQKSKGSPSRSPSPTPHRCLLMMRRFCCVRQVIRSMACLPIKPLDGAGGYLRWKESLLLRVHTLGVAYVLSEAPPAGAGGHDAAAKKWARDDAVCRGHILRTLSDRLLPDYARFATAAEFCFDTSTGDVFLEQLAHAEALGAAAELSDGAVAILLRRKIPSGMSLTTFTGDGKKALESIWEVARRAAAAGMDPWYKEKEMEDDSDDGDGPPIPEQTRKRAMSEHVGRRRA

SEQ ID NO: 36953 - protein, 115 aa, Sorghum bicolor
  Clone ID: SORBI-28MAY03-C129776_1.pep
MCKQIASQICRRTETPREISGRVVYFVSSSTRTMWIQSETQERQQATSARNGSVATVDEIKDSPCQGHGDGNSQDGQTFGYSIPCLPEDILRHIHSLMPMDAAARAACVSRTFLS

SEQ ID NO: 36954 - protein, 154 aa, Sorghum bicolor
  Clone ID: SORBI-28MAY03-C128959_1.pep
MKLSLLISLLPVALALPAPVIVPRAGTPIPGRYIVKMKNQNLENLINTALKLLRKDPAHVYNFGGFGGFSADMADDIVELLRNLPGVDYIEQDAVVRANLGEIEKKAYVTQSSATWGIARISSQSPGGSTYTYDSTAGAGTCAYVIDTGIYTAH

SEQ ID NO: 36955 - protein, 112 aa, Sorghum bicolor
  Clone ID: SORBI-28MAY03-C1263_1.pep
EEQAASRGSRRQWRRPGRAGRSGRGSAAAAGTRRRRHGRGIVVAAAWPWLPLSPPYPAVKAPLFLAVRSERRVILVRENGDGGGRREGDQLSSAQLSSAGNTLIDLLCLALV

SEQ ID NO: 36956 - protein, 83 aa, Sorghum bicolor
  Clone ID: SORBI-28MAY03-C126780_1.pep
VRDQIEICSQLYLKVVWRIINMTIAFQLAVFALIATSLVLVISVPLVFASPDGWSNNKNVVFSGTSLWIGLVFLVAILNSLIS

SEQ ID NO: 36957 - protein, 174 aa, Sorghum bicolor
  unsure (1)..(174): unsure at all Xaa locations
  Clone ID: SORBI-28MAY03-C126977_1.pep
HEGHSLLRGSVSRKFHDDPVQNSASRAELHRXSIAQMKINTQAVQDMQIYADPSRVPVVLIEQHVMVVPQHTSSKDLASNTSEQKDTIVLPKLQGESLVPKSSAGKKSGRILRAVIFVHGFQGHHLDLRLARNQWLLLDPGADCLMSEANEDKTSGDFKEMGSRLAGEVAAFLK

SEQ ID NO: 36958 - protein, 214 aa, Sorghum bicolor
  Clone ID: SORBI-28MAY03-C1271_1.pep
MEQGDEASSVNKESPEQQQQLTRDEDGATWLNLTLGASESPSPDAAAAAAAASCSAESGSGSGSEPGANKPSAAGAAPHKVFSCNFCLRKFFSSQALGGHQNAHKRERSAAKRSYHAQRMIVGLPLHAHAALMHSLRVNPASSAIHKQAAPIRTAPARFLEDGGGVAAAAWGTIACEEVAPSSAWPGSFRLRAQHSSEHEQASEQSKIDLNLRL

SEQ ID NO: 36959 - protein, 337 aa, Sorghum bicolor
  Clone ID: SORBI-28MAY03-C13093_1.pep
TRVPHNNGAGLLSPRASSSIDMTAAAALGLLPGSPTRHFVPPPLSPSAANNGGGAAAAHWLQGSRLRSSFNARDAQVDDLGALLEWESQYLGALSLPQSSRSQPRLSTGLSIRPTGIAPSNLEEMYASDMAMSPRFTNDQGHSVYSPAHKSALLNKFHHQQKGLLSPVNTNRMYSPKGLDPSILHYPYGGMSPRSPRTMEPTSPLSVCVGATVTQRDMLDQFSSLNKHQVPSVGSPRNLNASWGNIGTPKSKVDWGVDDDELVRLRHPVQPGNTAEEPDVSWVQSLVNHAELNGKRGEMAGMASRSINRPDLSSQGDSLDQSVIASWLEQQMHLEPK

SEQ ID NO: 36960 - protein, 192 aa, Sorghum bicolor
  unsure (1)..(192): unsure at all Xaa locations
  Clone ID: SORBI-28MAY03-C131383_1.pep
ARGDLSAAGPIVRVPLPELKDHCVLDSPDGLLLLQHDGDNAIRLLHPFTRDVAEFPDLKCLAHQLSGPCQLYQMDYEFIVNPWYNLNSWLQSTARCLYQARKLCAAVDVTPTGAITVMLALHSIRRVAFASAGDAGWTVSSWXDEPTGQALSFQGKLYVVNWEDGLIHVLQIDPPQLVAQCEGEDSSPVLAF

SEQ ID NO: 36961 - protein, 237 aa, Sorghum bicolor
  Clone ID: SORBI-28MAY03-C131091_1.pep
HEALLAVLAAAAALLVAPPVAAYPWPVCGQSNYFKPNGTYQAHLDFVAATLPKNASASRSLFATTVVGTIPEQLWAMALCRGDVNATDCFTCLTQAFRDLPNDCSYDMDGTIYYDRSSLHYSDVLTFPGAGTGPTTDTYAVNFNTNVTSDPAQFTSLLAALINATVAYAADNSTRLFATGEADFNHEFPKVYSLAHCTPDQTPAHCRNCLAKAVAKYQGSFYDYIGGRVLGMNCRYR

SEQ ID NO: 36962 - protein, 151 aa, Sorghum bicolor
  Clone ID: SORBI-28MAY03-C13157_1.pep
MGRPPSTTGAPAFRFLPSEVAEMEARLQQLNNGIPSRGVLQTLADKFSASPERAGKVAIQPKQVWNWFQNRRYSHRAKSTRAVPSPPAKMTPSGADHHQHAANASAFRAAQPSSVAAAHHGASPTGKNPVEGVSVEFEAKSARDGAWYDVA

SEQ ID NO: 36963 - protein, 159 aa, Sorghum bicolor
  Clone ID: SORBI-28MAY03-C13170_1.pep
MDDAAGNILASLGRVHLVDLMASEGLPSDSYKMCVSTMMQSLAQYSAVIIQLSPADGALLRSGLDSARFFFHQRGYNSNEAVHSDDSREWCKTSGYYVDHQMCLEMYDYRPGITATDPNGEMELPPSGLPDIFSVLGKVSRDILDAISFSLNLRSCAFS

SEQ ID NO: 36964 - protein, 152 aa, Sorghum bicolor
  Clone ID: SORBI-28MAY03-C13182_1.pep
GIKAMGIATGVCFVVLVLICTFLREGRAATFTFVNRCTGTVWPGIQSNAGSSRLDPTGFVLPPGTSRAVQAPSGWSGRAWARTGCAQDASGKVVCATGDCGSGSLECNGQNAATPATLAEFTLAGGGGDDFYDVSLVDGYNLPILVEPAGGA

SEQ ID NO: 36965 - protein, 137 aa, Sorghum bicolor
  unsure (1)..(137): unsure at all Xaa locations
  Clone ID: SORBI-28MAY03-C127702_1.pep
MLADATLGELGFNRCATEHALXTQRRGKEELVVCMYVDDLIVTGARAEDIDRFKREMVARFKMSDLGMLSYYLGIEVRQGKEHISLFQRAYAEKLLEHGGMTDCKPCTTLMEERLKLSKHSTAAKVDATRYRSIAAH

SEQ ID NO: 36966 - protein, 123 aa, Sorghum bicolor
  Clone ID: SORBI-28MAY03-C128101_1.pep
QLEELQDDSSPNFVEEVVALFFKDSSRLLTNIEQALEKYPQDFYRLDSLVHQFKGSGSSIGALRMKNECSMFKAHCNDRNLEGCRRSLQKMKREHATLKQKLETYFHLLRQVGPPERAVNSWK

SEQ ID NO: 36967 - protein, 199 aa, Sorghum bicolor
  Clone ID: SORBI-28MAY03-C12836_1.pep
TRVISHSQDFLNGVCTNIIHMQNKKLKLYTGNYDQYVQTRSELEENQMKQFKWEQEQIASMKEYIARFGHGSAKLARQAQSKEKTLAKMERGGLTEKVVRDKILVFRFTNVGKLPPPVLQFVEVTFGYTPDNLLYKKLDFGVDLDSRIALVGPNGAGKSTLLKLMTGELAPLDGMVRRHNHLRIAQFHQHLAEKLDLDI

SEQ ID NO: 36968 - protein, 416 aa, Sorghum bicolor
  unsure (1)..(416): unsure at all Xaa locations
  Clone ID: SORBI-28MAY03-C12843_1.pep
ARGLFLPWLLQLLLPSHDVTAFRFTVDDFPDGFAFGAGTAAFQYEGAVDEDGKSPSIWNTYAHSARNPNEHSGDFAADGYHKYKEDVKLMKDIGLKAYRFTISWSRLIPNGRGAVNPKGLQFYNDMINELVKEGIQVHAALYHLDLPQILEDEYNGWLSPRIVDDFTAYADVCFREFGDRVAHWTTMMEPNIIAQGSYDTGMRAPGRXSYPSGHDCTAGNSSREPYLFLHYTLLAHSSGDRLYREKYQAVRKGCAGINLYCLCIYSLTDLAEDIQATERANDFLFGSILNPFLFGDYPESMKKAAGARLPSFSSYESELVTGAFDFIGLNHYSSIYASNNPDASKMPVRDQAADVGALFRGTMVDPQGLEHVLKYIREKYGNISIYIQENGRPDDSLMDVDRNDFLKVYIASTLKA

SEQ ID NO: 36969 - protein, 171 aa, Sorghum bicolor
  Clone ID: SORBI-28MAY03-C12852_1.pep
QMASDCDDKKYILALAAFKNRVLYANVSYDHMVGWRTSSLRREKDLIKPLHRSLDGYKHIVNVEYCSPVSSEGPHFPSKAARAKEAAQRTPNRENTEGYHQMMEEEMIHGLQKVGWKKVDVNFHSSFWPYSAHNNIHVKNEWLHNAGAGVIAHVADSIKQQESRACLPANL

SEQ ID NO: 36970 - protein, 236 aa, Sorghum bicolor
  Clone ID: SORBI-28MAY03-C13303_1.pep
MSSPPPPPVKLIGFFGSPYAFRAEAALCLKGVPYELILEDLFGTKSDLLLHHNPVHKKVPVLLHGDDRAISESLVIAEYVDEVFDGPPLLPADPYDRATARFWADFIENKLTKPFFMAIWVEEGEARLRFEKEAKELVALLEAQLDGKKFFAGDRPGYLDVAASSLGPWRSVIEELNGVTLLSEDEHPNLCRWSRDYCACEDLKPCMPDREKLLAYFTKNFDRYKAAVNATLSQSQ

SEQ ID NO: 36971 - protein, 135 aa, Sorghum bicolor
  Clone ID: SORBI-28MAY03-C133192_1.pep
ARGAPRRAEARAAPPEGEGPRPRPRARAEQALRGGFAAAYGGRGPHPRRRQPVAARTLAPDQGVTGWPCRWRSAARDGMAALPTASPRRRPTIRGTVAFEHSRRKFSVVVGRETAGTTTTAAASFCCVGSHFLSR

SEQ ID NO: 36972 - protein, 62 aa, Sorghum bicolor
  Clone ID: SORBI-28MAY03-C13384_1.pep
RSHFCNSPEFRDTWTFVNRRIKDALDLQKTFQEAAYLAEAVGAGMGGTVQGVLNRVFQKRSG

SEQ ID NO: 36973 - protein, 37 aa, Sorghum bicolor
  Clone ID: SORBI-28MAY03-C134391_1.pep
MIEVFLFGIVLGLIPITLAGLFVTAYLQYRRGDQLDL

SEQ ID NO: 36974 - protein, 163 aa, Sorghum bicolor
  Clone ID: SORBI-28MAY03-C13472_1.pep
EELRKGLRLIGHNVHDTDVDMLMEAADMDGNGTLDCKEFVTVSIHLKKIRSEDHLPKVFSYFDKNGSGYIEIEELKEALSPRGDEKAIDDIILDVDKDKDGKISYEEFELMMKAGVDWRNTSRQYSRAVYNTLSRKMFKDVSLKLDINNGPLAAAVKEQQAVD

SEQ ID NO: 36975 - protein, 114 aa, Sorghum bicolor
  Clone ID: SORBI-28MAY03-C17177_1.pep
GRRHLTLPHVHVLSVLAECFQCMTSEMGTLPCPWRSGHLFAFITFALLFSTSFAGRHYSFLTDQGALRQQGEAARKEALVPLVQVRRLNVKTNDYSSYDPSPSMDKPHFKLIPN

SEQ ID NO: 36976 - protein, 114 aa, Sorghum bicolor
  Clone ID: LIB5052-002-A1-XP1-G5.pep
GLLHLTLPHVHVLSVLAECFQCMTSEMGTLPCPWRSGHLFAFITFALLFSTSFAGRHYSFLTDQGALRQQGEAARKEALVPLVQVRRLNVKTNDYSSYDPSPSMDKPHFKLIPN

SEQ ID NO: 36977 - protein, 265 aa, Sorghum bicolor
  unsure (1)..(265): unsure at all Xaa locations
  Clone ID: SORBI-28MAY03-C1724_1.pep
VTALRPTFGTVALTDVMSIFDSAXRLGPFCRSAVDCAIVLDAIRGKDACDPSSCEVALGDPFHVDITKLTVGYLDDAEMEVVHVLFFKGVKLXPFKLNYTVESVQSILNITMDTDMLAHFDNWQREGHDDDYEAQDQWPVELRRARLIPAVDYIQAQRARGKLIREIKDSFTVDAFVGNVTDWERVCLGNLVGMPVVVVPTGLKSIEDPPKGGTKRRTTVTTGIYAPPDHDHIALALAMAYQSVTNHNKQRPPIDDLGPNDGIHR

SEQ ID NO: 36978 - protein, 140 aa, Sorghum bicolor
  Clone ID: SORBI-28MAY03-C17272_1.pep
AVHPTTPPTRRKSHRTPPASRTRRPRKLLAITSLGVRRAITSSKPPLSTAHQASWPNAVRASPAVELRNRSRTASCSPAMNSAQEGWSKFGMSSTNQIKCILIATSCALEAPLVCFVRNLDILMFDLIQKITEKKKKKRP

SEQ ID NO: 36979 - protein, 285 aa, Sorghum bicolor
  Clone ID: SORBI-28MAY03-C17362_1.pep
MAMGDAKPSVLIPMPSRDRDRDRDLLVPTAAVATHASPSARAVADSDDDESKPSSASAAAAAAQTGREAFHKVVHSWASKKFMTGCVILFPIAVTFYVTWWFFRFVDGFFSPIYAHLGIKIFGLGFVTSISFIFVVGVFMSSWLGASILGLGEWFIKRMPFVRHIYDASKQISAAISPDQNKHAFKEVVIIRHPRIGEYAFGFITSEVLLQGYSSEEKMYCVYVPTNHLYIGDIFLVSSSDVIRPNMSVREGIEIVVSVGTTMPQVLSILETEPNQLNRIRSTRS

SEQ ID NO: 36980 - protein, 140 aa, Sorghum bicolor
  Clone ID: SORBI-28MAY03-C13608_1.pep
ARGELKQTMDMYSTACKEALTAKQKAMELQRWKMEEEQKTQDSRITEDSAMAMIEREKAKAKAAMEAAEASQRIAEMEVQKRISAEKKLLKEAEERKNRGGSGMSHEVRYRRYVIEEIEQATNNFDDTPKVCEGRYRPVY

SEQ ID NO: 36981 - protein, 104 aa, Sorghum bicolor
  Clone ID: SORBI-28MAY03-C13617_1.pep
DKRRCDEEQQKIAMVNGMIERFQYEWFSKLDEWGLSVNSLWSRMEGLYKEIELLKENRRARFATPVTEESTLATEESIPATEESIPATEESIPATEESIPATEE

SEQ ID NO: 36982 - protein, 195 aa, Sorghum bicolor
  Clone ID: SORBI-28MAY03-C13621_1.pep
PGVTEDPACGPLIDSVAIKTLNPPRRTNMNLVKNGDFEEGPYIIPGTKWGVLIPSRVVDDHSPLPGWMVESLKAIKYIDSDSFAVPRGRRAVELLAGRESAIAQVIRTVPGRQYALSFTVGDASNACRGSLMVEAYAGRESTKVAYESAGKGGVKRAVLPFRAASARTRLVFFSSLCGPVLDDVAVVSVRTTKRG

SEQ ID NO: 36983 - protein, 210 aa, Sorghum bicolor
  unsure (1)..(210): unsure at all Xaa locations
  Clone ID: SORBI-28MAY03-C13666_1.pep
RISAYDVLNHPWIKEDGEAPDTPLDNAVLGRLKQFRAMNQFKKAALRVIAGCLSEEEIKGLKEMFKSMDSDNSGTITVDELRRGLAKKGTKLSEAEVQQLMEAADADGNGTIDYEEFITATMHMNRMDRDEHLYTAFQYFDKDNSGYITMEELEQALREKGLLDGRDIKDIVAEVDADNDGRINYTEFAAMMRKGDPEPSNIKKRRDVXL

SEQ ID NO: 36984 - protein, 221 aa, Sorghum bicolor
  Clone ID: SORBI-28MAY03-C13639_1.pep
MFLYLQHSNEKVTSASHSVMASFSSSGSDTDQDARAALKEQLTFYYIKRSLEAYPGVTPFDGLASGVAALVRHLPAGSAAILFCIHSLVVKAKDLCEVAKAQNKSLWRSWEESTDPCKKMLDLLLRLIFLVDIQSFPYLLKELAEFVTLLPKEGQDALLDDMHAHVAESDDVTRKPVLVSWLQSLSYLSSQSSRESHSKAMSAAASVASDELTLNRAMARL

SEQ ID NO: 36985 - protein, 250 aa, Sorghum bicolor
  Clone ID: SORBI-28MAY03-C13665_1.pep
QLATAGKVKKIFAHCLDTIKGGGIFAIGDVVQPKVKTTPLVADKPHYNVNLKTIDVGGTTLELPADIFKPGEKRGTIIDSGTTLTYLPELVFKKVMLAVFNKHQDITFHDVQDFLCFEYSGSVDDGFPTLTFHFEDDLALHVYPHEYFFPNGNDVYCVGFQNGALQSKDGKDIVLMGDLVLSNKLVVYDLENRVIGWTDYNCSSSIKIEDDKTGTPYTVNSHDISSGWKYHWHKSLVLLLVTMVCGNLIR

SEQ ID NO: 36986 - protein, 257 aa, Sorghum bicolor
  Clone ID: SORBI-28MAY03-C132182_1.pep
ARGYLIVIDDLWSSDQWGIIRCCFPDNSLGSSIITTTRNDALPTNHHCGSSKFVHNHKISLLSDNEAKELFLKKAFSSRNDYPQHLEDVFAKVLRRCGGLPLAVVSIATKLAHKQSRDEWEKHGLNLLYNSRPEGLDGLKQILNLSYNDLQPQLKSCLLYLSIFPENSEIETKRLVRRWIAEGFIAGTGSKEETAISYLNELIGRNLVQPLDLNHDNIPRRCTVHPVIYDFIVCKSMEDNFATLTDAQHVPNNNITV

SEQ ID NO: 36987 - protein, 243 aa, Sorghum bicolor
  Clone ID: SORBI-28MAY03-C132149_1.pep
ARGGSLPVPSKANALEHLLVYSPSGHVIQHELLPSSGSESTGSSPRVGSAPNSQLQDDEMHVTAEPIQWWDVCPRTNWPERDENIANIVLYNQRSSIMAMDASDCEDSEHSDSTASNDGISGKEIMRVRERSSWYLSNAEVQINSWRIPIWQKSKICFYVMDHPAAESVESVSSSGGEIEIEKLPLHEAEIRRRELLPVFKQFQYSERHSSDRNVANGRSIANGSFQNALSHISDAQYGSVKD

SEQ ID NO: 36988 - protein, 273 aa, Sorghum bicolor
  Clone ID: SORBI-28MAY03-C13240_1.pep
LLLLMLLRLRAGGDHPHLVRGYNSSSSWMSSLEMAKKLPMERQHELLNCLQSCSALCALCNDAPEDPVVTICGHVFCNQCILEQLTGDDSVCPVSNCRVRLNTTSLFSRGTLECSLSRLTCDFKSDDDTCMEMIHAEKRPGIDSSYASSKVRAALDILLSLPRIDPTQMTDSKCSIGLESEKFDGRGTSEQIDTKLTEKAIVFSQWTRMLDLLEVHLKASHVTYRRLDGTMSVAARDKAVKDFNTVPEVTVMIMSLKAASLGLNMVAACHVLM

SEQ ID NO: 36989 - protein, 377 aa, Sorghum bicolor
  Clone ID: SORBI-28MAY03-C13251_1.pep
TRVSSNSGDNSSNPNSKPASPAIATAAVKVIPSTAPSASQTVRKSLSYKEVAIAAPGTLVKAFSDVHTEEKDAGGRGASPESAKSQKEINGHPSGEKDGAIEVSPKADTSQVTKSSDGGKPEQTDVLIGSNQPETGHKKTSDPAETSVAQKYTDLPAPVTSSAAQTEEVGTPNEEAPTVLEANDSSSNDDERDSGEDTPGQLSSGGENEKSSLSESEKNDTPREGAKETSKLSAAAAPFNPSTVPAFGSMAVPGFREHGGLLPSPANVPPMLSIPLRKHPHQSATARVPYGPRLAGGYNRSGHRGLRKKPVLTSGEAPTETNTSAPKVMNPNAPEFVPGQSRSPNGHPASPNGPLSSPGGIPSSPQDLLSSPDSTVE

SEQ ID NO: 36990 - protein, 173 aa, Sorghum bicolor
  Clone ID: SORBI-28MAY03-C132934_1.pep
ARGESKINLVRSSSGGFTNSENGIKLGHGSHSRDRLIYVLTQLIGHHVDVHVKNGSIISGIFHATNSDKDFGVVLKMAQVIKDGSARGQRYSDDVVKKPETMIIPARELVQVFAKDVALGGDELAKGPGHDKRKDLLIDSAISRSHYLEERELERWAPDEGDSECIELEKYDR

SEQ ID NO: 36991 - protein, 97 aa, Sorghum bicolor
  Clone ID: SORBI-28MAY03-C13783_1.pep
RPIWRITRTLVFTSIRKRRPSGEARPRRAEGARNSMARNKTERSKEPEKTRGRKRHEGKQPAQEINFALHCTKAWNLKCGIEKSNKRYTKMHGKLQS

SEQ ID NO: 36992 - protein, 224 aa, Sorghum bicolor
  unsure (1)..(224): unsure at all Xaa locations
  Clone ID: SORBI-28MAY03-C1380_1.pep
DSGRPRVRPRVRREVGENFYTFETWGEQLNTFCAEVVQSEAFFICNSIGGVVGLQAAVMEPKKCKGIVLLDISLRMLHITKQPWFGKPFIKSFQSLLRNTIVGKLFFNAVATPESVKNILCQCYHDTSAVTDELVQIILQPGLDPRAPDVLLAFIXYCGGPVPEEGHHXVKRALLVARGENDTLKPVELCRAYASLDTSXDVAAMPDVAHCPPDEATCLVCTLV

SEQ ID NO: 36993 - protein, 58 aa, Sorghum bicolor
  Clone ID: SORBI-28MAY03-C13827_1.pep
RIMNKGKGGESGPSVPKIADRSREGDIFPAASLDEYAEQAREQEEEDSDEEAGDFVED

SEQ ID NO: 36994 - protein, 144 aa, Sorghum bicolor
  Clone ID: SORBI-28MAY03-C13761_1.pep
TRVRASGSCGERAARRYTETRTGSPCAMAPPSLLGSTDLWRPVAAARGGGWATAAALLLILASHLVVLLVRRRLRLRLRGGGRIAQPEAAVAPAPASASTGSASGLVTRTAFAAVGFPIEKCVSTGRGWMISDCAVSSLWLVTE

SEQ ID NO: 36995 - protein, 122 aa, Sorghum bicolor
  unsure (1)..(122): unsure at all Xaa locations
  Clone ID: LIB3480-006-P1-K1-E4.pep
RLRLRGGGRIAQPEAVVAPGPASGFTGSASGIEGLVTEGDLRQLVGSLGLSAREPETHGWEXVIXKSNDDVFYNAWCDKPTAGPPKYLSITTYERCSTVQLRDLYMDNEYRMEWDNTVTKHE

SEQ ID NO: 36996 - protein, 135 aa, Sorghum bicolor
  Clone ID: SORBI-28MAY03-C13861_2.pep
MARLGAGALLALLLAVAAVAFLAVPGSAKVGDLSAMDLTVGRSSKCSGPMSQCDVDEAEELGLSGGGFPAGDTIRRTLAARQPTNRYISYAALRADQVPCNKRGRSYYSNCASQQAANPYRRGCSAITRCARNMN

SEQ ID NO: 36997 - protein, 61 aa, Sorghum bicolor
  Clone ID: LIB3480-013-P1-K1-E7.pep
RRALAARQPTNRYISYAALRADQVPCNQRGRSYYSNCASQKAANPYRRGCSAITRCARNTN

SEQ ID NO: 36998 - protein, 168 aa, Sorghum bicolor
  Clone ID: SORBI-28MAY03-C14188_1.pep
TEADGQVNVDGGGPPADLLFVNPSKETKVGNEVGYRLVPAGATGASLLADDDYPQRRASYTKRQVWVTSYDRSEKWATGLYAEQGTGEDSLGAWSKRNRGIRDRDIVLWYTVGLHHIPYQEDFPVMPTLSGGFQLRPANFFDRNPLIRTRPPADHNNYPNCSCGVASM

SEQ ID NO: 36999 - protein, 266 aa, Sorghum bicolor
  unsure (1)..(266): unsure at all Xaa locations
  Clone ID: SORBI-28MAY03-C13549_1.pep
TRLVSVHQPPSGLAGFGRGAPSVPAQLGLSKFSYCLLSRRFDDNAAVSGSLVLGGDNDGMQYVPLVKSAAGDKQPYAVYYYLALSGVTVGGKAVRLPARAFAANAAGSGGAIVDSGTTFTYLDPTVFQPXWRTAVVAAVGGRYKRSKDVEEGLGLHPCFALPQGAKSMALPELSLHFKGGAVMQLPLENYFVVAGRAPVPGAGAGAGAAEAICLAVVTDFGGSGAGDEGGGPAIILGSFQQQNYLVEYDLEKERLGFRRQPCASSS

SEQ ID NO: 37000 - protein, 195 aa, Sorghum bicolor
  Clone ID: SORBI-28MAY03-C13512_1.pep
RTRGWDPSKRPKATEVLQHTFFQGCTSVPLPVRPKAPKTPPCVGAKGISENSVARRFSTGTLSTLKSHSNASAKLNSLSKTGVQRKLHLDRQSSHKSTKPTENSNKLTTNRVPARNSPGNPVLRHSRSLPETGRGTIQKVSSITEKLSQMSVTSRTRSTVKPAAPVLKAGHGKSDFLGKSDDIPPAKRPTRKLVS

SEQ ID NO: 37001 - protein, 233 aa, Sorghum bicolor
  Clone ID: SORBI-28MAY03-C13571_1.pep
KKSMAALYKELEEERSASAVAASQTMAMINRLQEEKAAMQMEALQYLRMMEQQADHDHLAIQDLHDLLTEREKELLDLEAELAQCRRILQNDPFNDDRLNGTDTMNNTDFVGSAMSHFEHDKAYILESLSRLEENLGISTNRLAFGDAGNSQEDILFEDHTRADGSPSNSDKLSGAASLKIEISLLNIRMRALEEDQEFLKQVLSSLRCGSDGLQCIHEITSHLAELRRAVTH

SEQ ID NO: 37002 - protein, 82 aa, Sorghum bicolor
  unsure (1)..(82): unsure at all Xaa locations
  Clone ID: SORBI-28MAY03-C13600_1.pep
PRVRGDSTYVALLPSGFAILPDGPSGVGAEHKTGGSLLTVAFQILVNSQPTAKLTVESVETVNNLISCTIXKKIKTALQCDA

SEQ ID NO: 37003 - protein, 139 aa, Sorghum bicolor
  Clone ID: SORBI-28MAY03-C13561_2.pep
LLINHWAEGASEAGQWRPRTLHSNLFLPLEMLAMTVCSPALALAPIVLWLGSSLTGAGAGAPSPPPPAVSSSAAAGASASATAGAGAADDPSSSAAAATVAAARSATSSANATKDGVLHDALPIAVPRGAVVMLAACFF

SEQ ID NO: 37004 - protein, 106 aa, Sorghum bicolor
  Clone ID: LIB5047-008-R1-XP1-E3.pep
LLINHWAEGASEAGQWRPRTLHSNLFLPLEMLAMTVCSPALALAPIVLWLGSSLTGAGAGAPSPPPPAVSSSAAAGASASATAGAGAADDPSSMMPCPSPSLEVLL

SEQ ID NO: 37005 - protein, 149 aa, Sorghum bicolor
  Clone ID: SORBI-28MAY03-C13904_1.pep
LLLSQLSGKDITELIAAGTTPPRSARRCSGQPPLPATAVPSPPSCGGGSPTFPAMRRPLHLPGSRSSTSARRLRPHGRGGFASPTRGGCRSRQRYGLPCPFPKPAARGFPSWSCGHATHPAPCICPHGGAHSSCGSGPAPVVSSAVTVS

SEQ ID NO: 37006 - protein, 93 aa, Sorghum bicolor
  Clone ID: SORBI-28MAY03-C13910_1.pep
NPVYLQYGGASCDIIYTSHFAHSASIFHKYSLQPECSALYEIVETHHGIFELGRRLLRADEDPAQGPPGPCVAPPLIAARAPGPEWQGRQPPG

SEQ ID NO: 37007 - protein, 224 aa, Sorghum bicolor
  Clone ID: SORBI-28MAY03-C13957_1.pep
CLDLLRGIVVCTNPWGPEDPELRFIPLPDGCPAVSATDYPYRPRAEEDRSAACVDGRIKLVAMVGILAGWNAHQFRLTTWTLSPDLSGWQQDGVFPLKDLWATEEYRVLNLRQYTPVCPVLSAREDGVVYAIVNDIEERTIYRGRQVDPGTELQFKSQYVIGIDMRRNKIVSTSSGNPPESLMQMMPRLLSIDFCASSLHGGAKDRQREVEASQVGDSGKRLKV

SEQ ID NO: 37008 - protein, 79 aa, Sorghum bicolor
  Clone ID: SORBI-28MAY03-C13918_1.pep
VEEALGYAKLALKCTEMRRRDRPDLATVILPELNRLRNLGHAYEARMSTAGANGGSAENGDLVSATSTTVGGSWKTAES

SEQ ID NO: 37009 - protein, 76 aa, Sorghum bicolor
  Clone ID: LIB3480-017-P1-K1-E7.pep
MDQSVAQLLLQKPSYRRDRPDLATVILPELNRLRNLGHAYEARMSTAGANGGSAENGDLVSATSTTVGGSWKTAES

SEQ ID NO: 37010 - protein, 238 aa, Sorghum bicolor
  Clone ID: SORBI-28MAY03-C13919_1.pep
MVPGYDCAASVLLCAEDNAAILGLDEEGEESSWAAAATPPRDTVVAAAATGIAVDGFLTELPLLSDECVAALVEREVEHMPAEGYPQKLQRRHGDLDLAAVRKDAVDWIWKVTEHYNFAPLTAVLSVNYLDRFLSTYEFPEDRAWMTQLLAVACLSLASKMEETFVPLPLDLQVAETRFVFEGRTIRRMELHVLSTLKWRMHAVTACSFVEQFLHKLSDHGAPFLLARSRSFDLVLST

SEQ ID NO: 37011 - protein, 155 aa, Sorghum bicolor
  Clone ID: SORBI-28MAY03-C13668_1.pep
MSKYGTIPTSSSAGGGAPLGGASPLDFISRAKARGASALATRRPWRELADVHAVGLPPSLGDAYLRVRANLAHFAMNYAIVVLVVVFLSLLWHPVSLIVFLVCMLAWLVLYFLRDEPLVLFGRVVADGYVLAALAVITLGLLLLTDATANILSSL

SEQ ID NO: 37012 - protein, 195 aa, Sorghum bicolor
  Clone ID: SORBI-28MAY03-C13681_1.pep
TTYEEYQIQIYEGASTLYGPHTLSAYIQEFQKLATSMVTNKEVVPTNLQPPDLLNRQIGLLPGVIVDETPPGVKFGDVRSDVPANSTFRKGSVVNATFYSACPRNDLLTDGTFALVEKLDGGSDWVPVYDDDDWSLRFRWSRPLPVSPMSFATLEWTVPEDATSGVYRLRHFGASKPLIGSINYFTGTSSAFVVR

SEQ ID NO: 37013 - protein, 128 aa, Sorghum bicolor
  Clone ID: SORBI-28MAY03-C13702_1.pep
DLLRENLDMRVRLVVNYNGLSVGAVRDVFEKSLGLRLQKINPNTDFHCLKTFGSHFTEDIAIPSGTKIDFCQTSDGKLITEIDGKQIGAVQSKDLCKAFFDMYIGDSPISMEAKKVVAQNVAGLIGRR

SEQ ID NO: 37014 - protein, 166 aa, Sorghum bicolor
  Clone ID: SORBI-28MAY03-C13730_1.pep
MSRDHRANYVEECERVAASGGCIEDGYLNGVLSVTRALGDWDMKTPDASVSPLIAEPEFRQATLGEDDEFLIMGCDGIWDVMTSQHAVSLVRRGLRQHDDPARCARELVMEAKRLETADNLTVIVVCFASEMGSQQQEQPVRPRSCKGLSTEALCNLRSWLETDHR

SEQ ID NO: 37015 - protein, 210 aa, Sorghum bicolor
  Clone ID: SORBI-28MAY03-C13715_1.pep
LPVRMCVTTDLSRRADLSRSGHRGQHSSRCRHQGRPRRRWARPARHGRPPPPLSLSLSLKRWRRGTRRRRGLQAGRRYWSKTSGIEISVICLVASASSPSRPPLLPSRVDERGSCFGYLVSVYSYSPSPALSPATRSPQWPGVAATSILFRPPSLPVPLRIRPATPGGRAAALHRRGARARRPPALRRRRAGLGPAGSSSPFLSRSLRPS

SEQ ID NO: 37016 - protein, 257 aa, Sorghum bicolor
  Clone ID: SORBI-28MAY03-C14096_1.pep
KRRRILWGWANESDTAADDVAKGWAGIQAIPRTVWLDPSGKQLLQWPIEEVEALRGKSVTLKNRVIKPGQHVEVTGIQTAQADVEVSFEVPSLAGAEALDDPALAGDAQRLCGARGAAVEGGVGPFGLWVLASANREERTAVFFRVFRPARGGGKPVVLMCTDPCKSSLDPNLYQPTFAGFVDTDISNGKISLRSLIDRSVVESFGAGGKTCILSRVYPSLAIGKNARLYVFNNGKADVKVSSLTAWEMKKPLMNGA

SEQ ID NO: 37017 - protein, 205 aa, Sorghum bicolor
  Clone ID: SORBI-28MAY03-C14109_1.pep
MACVHAQPAWALALAALGLVVSARAAARLALWLYAAFLRPAKPLRRRYGAWAVVTGATDGIGRALAFRLAAADLGVVLVGRSPDKLDAVAADLKSRRPGAQVRTFVLDFDADDVAAKVDALGEFLRGLDVGVLVNNVGRSYPYARYFHDVDEALARSLIRLNVDAVTRVTHAVLPGMLERGRGAIVNMGSGASAIMPSDPLYTVY

SEQ ID NO: 37018 - protein, 245 aa, Sorghum bicolor
  Clone ID: SORBI-28MAY03-C14173_1.pep
MDRRKGSNRDANGGLAEATASRLRFDTEEEAEEVGMEVEESLDAEGEDGQASAEVIGSEKTSADYYFDSYSHFGIHEEMLKDVVRTKTYQNVIFQNSFLIKDKVVLDVGAGTGILSLFCAKAGAKHVYAIECSQMADMAKEIVKSNGYSDVITVIKGKVEEIELPVPKVDVIISEWMGYFLLFENMLNTVLYARDKWLADGGVVLPDKTSLRLTAIEDAEYKEDKIEFWNNVYGFDMSCIKKQAM

SEQ ID NO: 37019 - protein, 97 aa, Sorghum bicolor
  Clone ID: SORBI-28MAY03-C14111_1.pep
MWACMWQGSICCGVYYPNIDLEGNVCLNILREDWKPVLNINTIVYGLNLLFTQPYDEDPLNHDAAAVLRDDPKKFEKNVRMAIAGGYVDETHFPRCM

SEQ ID NO: 37020 - protein, 176 aa, Sorghum bicolor
  unsure (1)..(176): unsure at all Xaa locations
  Clone ID: SORBI-28MAY03-C14187_1.pep
MSGQPLRVYSPAPTPTAGGGIPDIDTFRDKLDRLLPDWSRFDGELGPMHRYFGLDGPLDVRQRLAYLFVILDRSPRDGGVGVDELEAWLRRQAVARLDAXTRREMARHDRDRNGAVTLREFFADWSNMGHGKMARWMDKFASADRNGDGSLNAVEFNDFLHPEDTSQGDAQCPTLE

SEQ ID NO: 37021 - protein, 154 aa, Sorghum bicolor
  Clone ID: SORBI-28MAY03-C13863_1.pep
MTVGMINANPVVHERPERAAHPHAADALDPLDVFDTVRDIKDPEHPYSLEQLSVLSQESVSVDEKLGRIQITFTPTVQHCSMATVIGLCLRLKLMQNFPPHFKVDIKVAPGSLANEESVNKQLNDKERVAAALENPNLRQLVDECLCFNDPYSR

SEQ ID NO: 37022 - protein, 182 aa, Sorghum bicolor
  Clone ID: SORBI-28MAY03-C13865_1.pep
MATATATAAPRHAALLLLLLVGLHATATVAARAGAAHDAELTSKPSPGTKKPSVKPPGKPSVKPPPVGPGAGAGGVGGAIPTIPGFGGGIPGMGMGGGGFGSIPGMAGGWGGGYGGPSGGYARGGVVAPTVTCTEKGPCYRKKVTCPKKCFSSYSGAGKGYRGGGGGGSCTVDCKVKCTAYC

SEQ ID NO: 37023 - protein, 232 aa, Sorghum bicolor
  Clone ID: SORBI-28MAY03-C13878_1.pep
TRPTTAWFDPSDNTWRIVIGSKDDAEGDHAGIAVVYRTKDFVSFELLPGLLHRVARTGMWECIDFYPVATRGKASGNGVDMSDAFGKNGAIVGDVVHVMKASMDDDRHDYYALGRYDAATNEWTPLDAEKDVGIGLRYDWGKFYASKTFYDPAKRRRVLWGWVGETDSERADVSKGWASLQGIPRTVLLDTKTGSNLLQWPVEEAETLRTNSTDLSGITIDYGSAFPLNLRR

SEQ ID NO: 37024 - protein, 184 aa, Sorghum bicolor
  Clone ID: SORBI-28MAY03-C13881_1.pep
ILEQILACTSQEHLLPDVVTQEPPRPSTAGARSKAVLMTGLSSWYYENIRWKYWQSATATGEVVSVYQPSHEEHQLSGYTTHDMKAVAEMYLLGMTDKIVTSGWSTFGYVGHGLGGLTPWIMFRPENHTTPYPPCRRAKSMEPCMHGPPFYDCRAKHGADTGKLVPHVQHCEDMSWGLKLVHPE

SEQ ID NO: 37025 - protein, 152 aa, Sorghum bicolor
  Clone ID: SORBI-28MAY03-C13903_1.pep
TRPASIPSPLSRRSPLVVLARRAGPPLFCPSLPPSACPVDLRRSWCSCGGLPLHPPLLRRICVDVCSDLGFGVSTPSAPPVSAALSVFSGPLSFLVCLCPMCFPLSSPMICFVCFGVCSDLGVGVSTPSAPPVSAALSVISGPLSFLFRFQL

SEQ ID NO: 37026 - protein, 93 aa, Sorghum bicolor
  Clone ID: SORBI-28MAY03-C14267_1.pep
MPPSSALSKRGGGGDGILAAISRSQVAAHGREAAAMAKKLLRSTGKAAWIAGTTFLVLVVPLIIEMDREQQLNDLELQQQTLLGGPPPPAAAK

SEQ ID NO: 37027 - protein, 58 aa, Sorghum bicolor
  Clone ID: SORBI-28MAY03-C14298_1.pep
PWGLLITFIELIKNPRYNFWNRSFTHCAPEIEKLFESVARSCGAKAVDEGISVHDGSH

SEQ ID NO: 37028 - protein, 159 aa, Sorghum bicolor
  Clone ID: SORBI-28MAY03-C14336_1.pep
HGENRPTRPFCRRCAPGLNWPGRASGAVTLKKLECSKQAIALDTLAWDNIIGFRSYCVGLRDRSNDHLGRAGACLLRGRTCCSRLFVCRSAAIAVAWHVLIIPPRRFGPRRRLAHVAPEGCPKVSVGWISQANSELWAPCKLILLLLHFKFRPTSVENF

SEQ ID NO: 37029 - protein, 208 aa, Sorghum bicolor
  Clone ID: SORBI-28MAY03-C14345_1.pep
MGKRSVPRYPEDEDKGGCCGCLCWCCCFLLLIVAVLAGTAAYFFFVYKPKAPSYSVSNMSVSQFDFKSSDLTLYVKLTASVRAENPNEMITIKYGEGSHTVVSYRGTPLCSGKLPAFFQGYKNVTVMDISMEGRHGFGSGLQQALEESEKAGDIPLDIFVSVPVELQLGSLDLRQVKVNVHCALVLDSISPKKKPNIKSATYQANVEF

SEQ ID NO: 37030 - protein, 213 aa, Sorghum bicolor
  Clone ID: SORBI-28MAY03-C14356_1.pep
MSYHTKKKKKKMPPPPCYCSSLITITIILLLQQQNNPWTTAAAASAMATTTTKLGSSPLSDVVKDTCERCRQGNPQVNYTLCVSSLSSDPKSRQADLHELAMISAKLVRSGAVGMEAKMAELSRKERPWSRRRSCLEACMGVYHNSLYDLDASIAAIQERRYADAKTSMSATVDAPITCEDEFKEQGLEPPMKAESKRLFQQAAITLAIISLL

SEQ ID NO: 37031 - protein, 118 aa, Sorghum bicolor
  Clone ID: SORBI-28MAY03-C14346_1.pep
LQHLNRLILGWDRDQSDRDPKKEQDVLECLKPHNNLQQVCIRGHGGHTYPTWLCSDHSAKKLECLCLKGVAWKSLPPLLGVLLVVGEEHPNVTGQIFENRVAISAHVSQRTGDIHFRV

SEQ ID NO: 37032 - protein, 158 aa, Sorghum bicolor
  unsure (1)..(158): unsure at all Xaa locations
  Clone ID: LIB3480-017-P1-K1-C11.pep
GRVGNNLQEVCIRGHGGHTYPTWLCSDHSVKNLECLCLEGVAWKSLPPLLGELLMVGEEQPSVAEQTFQNLKILELVNIATLKKWSVDSPFSKLEVLTVKNCSVLTELPFAHMFPNVQEIYXSECEKLVSVPPIPWSSSLSKAKLQRVGKIIENLDYS

SEQ ID NO: 37033 - protein, 116 aa, Sorghum bicolor
  Clone ID: SORBI-28MAY03-C14777_1.pep
SEKEKNSAKRICIYLRFYFLNTNYQTLLKIQVYVSLCPISVQLSITSPEGPSRFVATSTVSSLCQPLHYILMKPLPRAEFVHLTKFSPLRIIKISTKISSTNESTQPQIQIDKITV

SEQ ID NO: 37034 - protein, 154 aa, Sorghum bicolor
  Clone ID: SORBI-28MAY03-C13989_1.pep
WNGCLCSRVRSYSRVVLLGDLNYRVAMDDEDEARQLVTARKWSMLLENDELLLELSKGRRFDGWHEGLVTFAPTYKYHRNSDKLYWWADGGADRGGHRNSKQHRAPAWCDRILWRGKGMMQTRYESCGGYRLSDHRPVRAVFHFHAVCEVAKHV

SEQ ID NO: 37035 - protein, 147 aa, Sorghum bicolor
  Clone ID: SORBI-28MAY03-C14037_1.pep
ARGSNSNSKTTGRRRRRRLRAKTSKRRSTRPRRLLLQMRMGNQLGRCRTPRNPWRPNRRSMSTRRRRRPSSQHRRRRRRRPPPAPTNRPLPPSSRAKWPPTNQHRLEGGREDLDDVRAARASIMHACILLNSGGLCVCHSVCLCLSI

SEQ ID NO: 37036 - protein, 131 aa, Sorghum bicolor
  Clone ID: SORBI-28MAY03-C13968_1.pep
MSWQTYVDEHLMCEIEGHHLTSAAIAGHDGAVWAQSATFPEFKPEDMTNIMKDFDEPGHLAPTGLFLGATKYMVIQGEPGAVIRGKKGSGGITVKKTGQALIIGIYDEPMTPGQCNMVVERLGDYLVEQGM

SEQ ID NO: 37037 - protein, 70 aa, Sorghum bicolor
  Clone ID: LIB3480-010-P1-K1-B1.pep
PSWMSIYGLAQFKFLSITKPTRPLHVSLFACIGSFSPPPQDENSSCSAGSFQFWLTPCSLHSWVASIIWL

SEQ ID NO: 37038 - protein, 181 aa, Sorghum bicolor
  unsure (1)..(181): unsure at all Xaa locations
  Clone ID: SORBI-28MAY03-C1404_1.pep
GFPTSMAIAAAAAAAVHPLPPPLARRTVAWLVCTHLAWAAVDAVICLFLASMWLFFLGLATNEIGRLACGEGCAVVTAAYNLVSVAAGVTVVLVLPFSVSVLLMASMMARAQAAATTATDIEATKEPALKTSYAAVRETLCDSLALGVAASMAFTLLMLIGDLGEVGLXRDXVSSXREWVQ

SEQ ID NO: 37039 - protein, 222 aa, Sorghum bicolor
  Clone ID: SORBI-28MAY03-C14049_1.pep
MSRRSVNPSRRVSDGSLPSVGGLFHPKSRSPPVLTIALVVLGVILLIAYFNSSSGVTVTSRESVTRSEGSCTSEVMRALPYLKKAYGNAMQKVLHVGPDSCTVVSNLLKEGKVEAWGVEPYDLEDTDSTCKSLVRKGFVRMSDIKFPLPYRPDSFNLVVVSDALDYLTPRYVNKTLPDLARVSTDGLVIFAGNPGEQKAKVSELPKFGRPGKLRSSSWGTRY

SEQ ID NO: 37040 - protein, 229 aa, Sorghum bicolor
  Clone ID: SORBI-28MAY03-C14431_1.pep
EEPEQEPEPQPVPDPEPHPQQTTGDLLNLDAEVNPSVAELEESNALALAIIAPGDCKASVSQSMFDVNSSGWELALVTAPSTHTSQAVQTNLAGGFDKLLLDSLYEDGARRQQIASVTYTGSLGAANPFSVNGNDPFAMSSSFAPPANVQLALMTQNQQQYYQAQQYFQPQQQYFQQHQQTSAMPTQNMYHHQYQYSVPPSGAPNPFGDPFSDLAPMGAPGKQSNSVFL

SEQ ID NO: 37041 - protein, 100 aa, Sorghum bicolor
  Clone ID: SORBI-28MAY03-C14485_1.pep
KKTQNGREESREDLFSTTTMLSDEVVSSDTSYESSSPFLPLLLILYPPTKKPTASQLLATLPKSNKPRTKPNEGEEFGCWPFRSIVWPWAAYSFTSSRGL

SEQ ID NO: 37042 - protein, 121 aa, Sorghum bicolor
  Clone ID: SORBI-28MAY03-C14496_1.pep
MASSSSFLLAMAALAALFAVGLCGNSVTLTVGKGTTPTYTHLVLVANLPIHELAIREKGAAEFLDDMKESPAKTFTQDSKAPLKGPLSVRFAVKGGGYRNRDEIFPVGLKPGAVINTNIPY

SEQ ID NO: 37043 - protein, 116 aa, Sorghum bicolor
  Clone ID: SORBI-28MAY03-C14503_1.pep
VQRIYALHSPHYWILAGPTTRHLGFWSFPRKFFFPYLYDLQEVASSLYWFSGFFPNRIHIHILQLTWVRKVVFCSTTFTIEKKREKGFSFAYCGLQNCIPDILTTTAFVLWLLDVL

SEQ ID NO: 37044 - protein, 159 aa, Sorghum bicolor
  unsure (1)..(159): unsure at all Xaa locations
  Clone ID: SORBI-28MAY03-C14522_1.pep
TLLGDMFGLMSAIXYGLFTVLLKKFCGEEGEKVDVQKLFGYLGLFTLVALWWIVWPLTALGIEPKFSMPHSAKVDEVVVANSLIGSVLSDYFWALSVVWTTPLVATLGMSLTIPLAMVADMIIHGRHYSAVYILGSVQVFSGFVIANLADRFSRSLGLL

SEQ ID NO: 37045 - protein, 156 aa, Sorghum bicolor
  unsure (1)..(156): unsure at all Xaa locations
  Clone ID: SORBI-28MAY03-C14523_1.pep
TVAPPPAASAAAMLLAAEPDDAHEEGENQQLLITTKGGPGLEGLVVGSYCHDVLIRGGRVVGETLGGAAAFVSNVLDAASPQDAALNGTAPFVVVAKVGHDFVYASAPAPARHPPLLCASPTTSFHAQFSETAASAHAPDRXLRRVRACDPIYPAD

SEQ ID NO: 37046 - protein, 141 aa, Sorghum bicolor
  unsure (1)..(141): unsure at all Xaa locations
  Clone ID: SORBI-28MAY03-C14213_1.pep
MHAATSAGGCSMALIDLGRGGGGGGSGTAPAKPRLVMIVADPGRESTAAMEWALSHAIVEGDDIMLLHVNMPYPHNGAAGPSRSSSGGSTGSPIAALLGGGGARAPAAXGPVDFVEAMRGACRGAXPAPRVQRXRRVEPAT

SEQ ID NO: 37047 - protein, 137 aa, Sorghum bicolor
  Clone ID: SORBI-28MAY03-C14242_1.pep
AQAALSAISEEETAAAVLAALAKRGGAEAIVGIDGAVARLVAEMRRGTEWGRENATAALVLLCRRLGARAVTQVMAVPGVEWAIWELMGTGTDRARRKAASLGRICRRWAAASAADGERGSVCPAASTVVPPAMMAS

SEQ ID NO: 37048 - protein, 83 aa, Sorghum bicolor
  Clone ID: SORBI-28MAY03-C14260_1.pep
LGTLPAGLVTFWNRTFPLDHSWHQLRLGYNPNVNEKDIRRAAVIHYNGNLKPWLEIGLPKYRKYWSAHVNYDQVFLRECNINP

SEQ ID NO: 37049 - protein, 272 aa, Sorghum bicolor
  unsure (1)..(272): unsure at all Xaa locations
  Clone ID: SORBI-28MAY03-C1426_1.pep
TRARNSTGASLVGERCGFRFAPYQFYNGDIMVQLRVGEPPAGKKTATTLVLAIVLAVLGGLCSLTLIIFCHWRKIRSPRKSSLFINVEDIESFESSLIGLSVLRSATSNFDEKNKLGEGGFGVVYKGALPDGQEVAVKRLSETTTQGLGQMTNELALLAKLQHRNLVRIVGVCLEEGEHLLVYDYMPNKSLDTIIFDPDKSRQLDWGARFKIINGIARCMQYLHEHSQLKIVHRDLKASNVLLDADMRPKISDFGLAKIFEDXQTRHVTSRY

SEQ ID NO: 37050 - protein, 244 aa, Sorghum bicolor
  unsure (1)..(244): unsure at all Xaa locations
  Clone ID: SORBI-28MAY03-C14661_1.pep
AVTQLSSSPHPLPFPPQESAATIPSALPDCAEHHPPFFSRSGSVVVWWDDDHGGGAVVSPLLPRRHRPRRGGVRGGRGRGGGAGGGXVDPSWRFPNQRLRDAYVALQTWKQQAIFSDPRGFTADWVGPGVCSYTGVYCAPLPRGVPGAGDLSVAGLDLNHADIAGYLPSELGLLADLSLLHLNSNRFCGLVPDTLRRLRLLVELDLSNNRLVGAFPAVVLDLPSLKFLDLRFNDFEGAIPPALF

SEQ ID NO: 37051 - protein, 153 aa, Sorghum bicolor
  Clone ID: SORBI-28MAY03-C14709_1.pep
MIVGPRSHASVPPIATRGVENCKENGGRGFKPKPCDNVVHNGSSKPEREPGNSSNKRTSGKMEDLGHKDNSSEVSYEYCVKVVRWLECEGYIETNFRVKFLTWFSLRATLQERKIVSVYVDTLIDDPVSLSGQLVDSFSERIYSKKRPSMPSG

SEQ ID NO: 37052 - protein, 160 aa, Sorghum bicolor
  unsure (1)..(160): unsure at all Xaa locations
  Clone ID: SORBI-28MAY03-C14635_1.pep
RSFLMAFDDHGPYGRXRYNWNMTPEVELDQWRKGSQWFEVHRELAIEIVKDTVYYPKFKEFCRPHCYVDEHYFPTMLTIEAPNSLANRSVTWVDWSRGGAHPATFGRGDITEEFLRRVQKGRTCLYNNQNSTMCFLFARKFAPSALEPLLELAPTVLGFG

SEQ ID NO: 37053 - protein, 45 aa, Sorghum bicolor
  Clone ID: LIB3480-052-P1-K1-H11.pep
MYLWEFCRPHCYVDEHYFPTMLTIEAPNSLANRSVTWVDWSRGGA

SEQ ID NO: 37054 - protein, 128 aa, Sorghum bicolor
  unsure (1)..(128): unsure at all Xaa locations
  Clone ID: SORBI-28MAY03-C14734_1.pep
APGHIGDVIVAFLDLVLGVLVPFGKMLIVXGIELELSLAPFGGLLDHLDARTQLVVLAIGFVEVDGTLGQGLELGNHDGDSAADGPGVAAVDGHGVGRQEVEAFPDAHGHGTCRIAEGVDEIPRCRRI

SEQ ID NO: 37055 - protein, 174 aa, Sorghum bicolor
  Clone ID: SORBI-28MAY03-C14759_1.pep
MAPAATGVGSLAAAPVAKGYTTYRKAAARSVVRLGLPALPPLPGLRLAAQGQASFCECKRLARNVVAMATGEPTAAPVADNEELTEFVNALKKEWDRIEDKYAVTTLAVAATLAMWSAGGVVSAIDRLPLIPGLMEAVGIGYSGWFAYRNLLFKSDRDAFFAKVREVYEDIIRS

SEQ ID NO: 37056 - protein, 115 aa, Sorghum bicolor
  Clone ID: SORBI-28MAY03-C14366_1.pep
MSDLDVQLPSAFDPFAEANAEDSSAGAGSKDYVHVRIQQRNGRKSLTTVQGLKKEYSYNKILKDLKKEFCCNGTVVQDPELGQVIQLQGDQRKNVATFLVEAGIVKKESIKIHGF

SEQ ID NO: 37057 - protein, 416 aa, Sorghum bicolor
  Clone ID: SORBI-28MAY03-C14376_1.pep
ARGQNAIFYLNSFADKGGAQLFVPAGRWLTGSFNLISHLTLSLDKDAVIIGSPDSSHWPVIDPLPSYGRGRELPGKRHQSLIFGLNLTDVIITGANGSIDGQGAIWWGWFRNHTLNYTRPHLVELMYSTNVVISNLTFKNSPFWNIHPVYCSQVLVQHVTILAPLNSPNTDGVSPDSSTNVCINHCYVRNGDDVIVIKSGWDEYGISFAQPSSNISISDITGETRGGAGIAFGSEMSGGISEVRAVGLRIVNSLHGIRIKTAPGRGGYVKNVYIADVSMDNVSMAIRITGNYGEHPDDKYDRTALPVISNITIKDVVGVNIGVAGILEGIQGDNFSNICLSNVSLSVQSAHPWNCSLIEGYSNSVIPESCEQLKSNCRQTPICYDGSGSSAMHVQQPRHTSSTSRLLNPLLELASF

SEQ ID NO: 37058 - protein, 88 aa, Sorghum bicolor
  Clone ID: SORBI-28MAY03-C14394_1.pep
KEEVKSISMLVFPGTGLLQKPLLKALPKGGQCSQGDKTEKSPDVANENSLCSDASVDPLDLGVKEPGDNSKNTDGTCNGDVSQQSPHS

SEQ ID NO: 37059 - protein, 187 aa, Sorghum bicolor
  unsure (1)..(187): unsure at all Xaa locations
  Clone ID: SORBI-28MAY03-C144_1.pep
RVPKGLAYLHHXXCLEWVIHCDVKPENILLDRNLEPKIADFGLAKLLNRGSSNQNVSRVRGTIGYIAPEWISSLQITAKVDVYSYGVVLLELVLGRRVLDMALAANEEVHKVLRKYVAMLALMLDKEEPSSIAEVVDCRLSGQFNYMQVRTLIKLAVSCVDEDRSKRPTMESIVQMLLLADESCSMC

SEQ ID NO: 37060 - protein, 114 aa, Sorghum bicolor
  Clone ID: SORBI-28MAY03-C14419_1.pep
PHKHMIMRAFAYPDLLAPVIVKVVSSDSGRPADQHFPTSHASVPYSCRADSLSTERDHTQILHRIRSDILKQVLKQSATWPTLSKGLLLVTEGFGWYNGNYTAISPVATKDTCT

SEQ ID NO: 37061 - protein, 217 aa, Sorghum bicolor
  Clone ID: SORBI-28MAY03-C14928_1.pep
YLHAWPPPPPPPPPPPPPPVPPPQSPPGVPRGPPGPGPRRSPPPPPAPPPSPPPPPPAPGPPPRGSSPPRIWPGAPGRGRRAAPRPPGPVPPPPGGGSVTGFPGWFGRVFFSPGEPRPLVACPLWCAWPGAGVCRPCWCFFRWFSTRLRTSGAARSRLHGSDSSPSWLHFHHGFQGGAFCIVFGPDPWLARRSRSAGGRVPCQAWPAGPQFIQSNVA

SEQ ID NO: 37062 - protein, 39 aa, Sorghum bicolor
  Clone ID: LIB3480-029-P1-K1-B7.pep
WQRSCFQVNILLSLLCALCDFHYLSTFFSALFRGFVGRA

SEQ ID NO: 37063 - protein, 55 aa, Sorghum bicolor
  Clone ID: SORBI-28MAY03-C14932_1.pep
KIYSERLMTLAGVYGFWKYVSKLERRETRRYLEMFYILKFRELAKTVPLAIDQPQ

SEQ ID NO: 37064 - protein, 79 aa, Sorghum bicolor
  Clone ID: SORBI-28MAY03-C15061_1.pep
IQLFFLVFERRKTPILERSKIAQTLGGNISYYRFRTAPTLSLNLFHIGPEEDGLAEHDDGSGLVERARDGGPGVRAGGV

SEQ ID NO: 37065 - protein, 153 aa, Sorghum bicolor
  Clone ID: SORBI-28MAY03-C1508_1.pep
MWSSSQASTRGVVEMGRVEAGPSHFPKRPAPRNSARVNLSRTVKPCSAGDRPGISVNCNLGWSSQTSPDLSQHFRGYSSASEAVLTAQSDLRKLLVGNEKIGVLLLNLGGPETLDDVQPFLVNLFADPDIIRLSRLFLFLQKPLAKFISVVRA

SEQ ID NO: 37066 - protein, 110 aa, Sorghum bicolor
  Clone ID: SORBI-28MAY03-C14955_1.pep
MGDHVAVDVGELVASRVGEAAGLVSRGKEETEALIGMVECRICQEEDLAKNLESPCACSGSLKYAHRECVQRWCNEKGDITCEICHESYKPGYTAPPQVHHDETTIEISG

SEQ ID NO: 37067 - protein, 83 aa, Sorghum bicolor
  unsure (1)..(83): unsure at all Xaa locations
  Clone ID: LIB3480-030-P1-K1-A9.pep
MGDHVAVDVGELVASRVGEAAGLVSRGKEETEALIGMVECRICQEEDLAKNLESPCACSGSLKYAXHRECVQRWCNEKGDITW

SEQ ID NO: 37068 - protein, 85 aa, Sorghum bicolor
  Clone ID: SORBI-28MAY03-C15090_1.pep
VPEKFLECVIQAPENEWNKVLLDGLTVGKGDVSPDDLYAVINKRIERVLIRTEGGSYQQRILVEYLKEIQARAEEVVKVLQGPTI

SEQ ID NO: 37069 - protein, 215 aa, Sorghum bicolor
  unsure (1)..(215): unsure at all Xaa locations
  Clone ID: SORBI-28MAY03-C20828_1.pep
MSQPPAPAPPYRPYRQVREATPHSRAVSCVRFSPCGRLLATASLDGTVALLSPSSLSVIAVLRGHSDGVSDLSWSTESYYLCSASDDRTIRIWDIRPVLAGGAQAAAADPGADRCIRVLKGHTNFVFSANFNPQTSSQIASGGFDCTVRIWDVKNGRCTRAIEAHSEPVTSVHFIRDGSIVVSXSHDGSCKIWDAKTGACPSDVIDEKKPAVSFS

SEQ ID NO: 37070 - protein, 151 aa, Sorghum bicolor
  Clone ID: SORBI-28MAY03-C20750_1.pep
MGRMYGPGKGMSSSVLPYARAAPGWVRSTAADVEEMIVRAAKKGHLPSQIGALLRDTHGVPLVHGVTGGKILRMLKARGLAPEVPEDLYFLIKKAVAIRKHLDRNRTDVDAKFRLILVESRVHRLIRYYRRTKKIAPNLKYESTTASALVA

SEQ ID NO: 37071 - protein, 76 aa, Sorghum bicolor
  Clone ID: SORBI-28MAY03-C20890_1.pep
MALTNFILTVVGVGAAVMLLRKDVKQSATMFRRNVRHIRNWLEEESAAAAKSEQSSVKELESQAAKKDAVPKEDKH

SEQ ID NO: 37072 - protein, 83 aa, Sorghum bicolor
  Clone ID: SORBI-28MAY03-C20898_1.pep
MASSSSSSSRFDDPAAVRRPPQRERKPPYMLLLPLIYAPVLPLIRIGLRHNPVVRDRLFYGVLAGAFAHGAYLISELYDVESK

SEQ ID NO: 37073 - protein, 236 aa, Sorghum bicolor
  Clone ID: SORBI-28MAY03-C15255_1.pep
SIIIIFCRVNQIDFEEVTVDLFKSQHLTPEFRKVNPMGQVPAIVDGRFKLFESHAILRYLASVFPGVSDHWYPADLFTRAKIESILDWHHTNLRRGAATLVQHTALAPFLGLTTSPEAVKQAEKLLMQSLGVIESVWLKGDAKFLLGNPQPSIADLSLVCEIMQLEILGDEVRDRFMGAHEKILIWMDNVKKATSPHFEEVHELLFHVKARMLQSKAAASNQAFEPSTKLKIASKL

SEQ ID NO: 37074 - protein, 203 aa, Sorghum bicolor
  unsure (1)..(203): unsure at all Xaa locations
  Clone ID: SORBI-28MAY03-C15335_1.pep
MLERALKDLNISQSADLEKGKDNSVKSCITKPVLNGNKCANKEEKALSACQDAVANGNEAVIADVEYIDSENLVDLPDVNAALSTLVKRLDSKDWVMTCEALNNVRQLAMYHKERLQELLEPLVPLIVKSVKNPRSAVCKTALMTCADIFKAYGDLMVDSIDPLLMQLFLKASQVKRFVCEAAEXSLISMTSWISPLLLITRM

SEQ ID NO: 37075 - protein, 126 aa, Sorghum bicolor
  Clone ID: SORBI-28MAY03-C15264_1.pep
MTTTTRPCAAVTAFLLLLLLSSAAVSLAAKTAGKESKQAAATSVYVVMVKAPAQGVNYKAYQMRILATALGSEEKAKQALIYSYKAVASGFAAKLTPEQVAALKKHPAVLQALPEVKYSLQDNRLT

SEQ ID NO: 37076 - protein, 86 aa, Sorghum bicolor
  Clone ID: LIB5047-011-R1-XP1-D5.pep
MTTTTRPCAAVTAFLLLLLLSSAAVSLAAKTAGKESKQALIYSYKAVASGFAAKLTPEQVAALKKHPAVLQALPEVKYSLQDNRLT

SEQ ID NO: 37077 - protein, 110 aa, Sorghum bicolor
  Clone ID: SORBI-28MAY03-C15424_1.pep
QSSQENHFSLLQRETEKLRGDIDKMRSELKYEIDKVTAGQRLDLNLERGRIRDELAKQNEETTELTTKLDKEIHSLKAQLEAAKYDVIKYCIGTIVSISAVGLAVLRIVM

SEQ ID NO: 37078 - protein, 233 aa, Sorghum bicolor
  Clone ID: SORBI-28MAY03-C15397_1.pep
SFGAPWFLDPIILGDYPSPMRKMLGPNLPEFTSKQKKILQASKLDFIGLNHYSTSYLKDCIYSSPCELDPFDGDAQISTSIDRDGILIGERTGSPYLNVVPYGMEKVVMYFKRRYNNTPMYITENGYAQASNSNMSAKDFTNDTGRVDYLQGYLTFLASAIRKGADVRGYFVWSLLDNFEWNSGYTQRFGLYHVDFKTQKRTPKLSAKWYSEFLKGSPLRTRPQNGNSYQYTA

SEQ ID NO: 37079 - protein, 56 aa, Sorghum bicolor
  Clone ID: SORBI-28MAY03-C1479_1.pep
MGHSNVWNSHPKNYGPGSRVCRVCANPHGLIRKYGLMCCRQCFRSNAKDIGFIKYR

SEQ ID NO: 37080 - protein, 155 aa, Sorghum bicolor
  Clone ID: SORBI-28MAY03-C14898_1.pep
HEDQLERKLKMKQHQLLLVVVVVAGSCLWLQSTTAAGEPSPLVANLPSSPVMRDFIHSRCETVQRPESAAGCYSLLLPYAASINGSAIRAARAAITAMVSELGAYAADLRKVGGTVSPQYDLSSCMQVAPEGTDGCKEPLAKLARLEEEEKKVVT

SEQ ID NO: 37081 - protein, 199 aa, Sorghum bicolor
  Clone ID: SORBI-28MAY03-C14805_1.pep
ESRSRGKARGAQPQTGHLDGLNWEVIVVKDDIVNAFCLPGGKIVIFTGLLDKFRADAEVATVLGHEVGHAIARHAAEQITKNLWVAILQIVILQFIYMPDLINTVSTLLLRLPFSRRMEIEADHIGLLLLAAAGYDPRVAPSIYEKLGKIGGDSALNNYLSTHPSSKKRAQLLSRASVMNEALELYREVSAGQGTEGFL

SEQ ID NO: 37082 - protein, 118 aa, Sorghum bicolor
  Clone ID: SORBI-28MAY03-C14908_1.pep
AVQQSMWPLHVMASAEWTVADLVAAAVALYVKEGRRPLLPSTDPAAFGLHYSQFCLESLDPKEKIMELGSRSFFLCPRSSAAGQDASSSSPGTANGVIRAASGKTPAWLSNMPFWPTM

SEQ ID NO: 37083 - protein, 153 aa, Sorghum bicolor
  Clone ID: SORBI-28MAY03-C1492_1.pep
VQSKSLNQDPLEGKSGATTKVVLLDEEDWLKPPPPKAAFRASAEEDSTFRELRLKRQEWAKFAESAQDILQKMDEMTNNEVGPKEPPEQIILDEESEPPVEKAREKIVISIQDKDGHQQMRVYKVILFFLAWTSIANKNTHIYNLPPQKRMSS

SEQ ID NO: 37084 - protein, 113 aa, Sorghum bicolor
  Clone ID: SORBI-28MAY03-C15484_1.pep
MQNNEGRTPFEDLTNTINCGNCFILIPFYALNLFVVVKLFSTNFETGGQSTSNSREQIDERVQRKREREKARSASMTQEQRDDKNKKLRKKYHQEKSEKNAIRHERYHQKKNM

SEQ ID NO: 37085 - protein, 83 aa, Sorghum bicolor
  unsure (1)..(83): unsure at all Xaa locations
  Clone ID: LIB3480-041-P1-K1-A10.pep
LCSLLKNNLIIMKDMQNNEGRTPFEDLTNTINCGGQSTSNSREQIDKRVQRKREREKARSASMTQEXRDDKNKNLRKSIIKKG

SEQ ID NO: 37086 - protein, 107 aa, Sorghum bicolor
  Clone ID: SORBI-28MAY03-C15578_1.pep
RLKELIKYKGFQIAPAELEGLLLSHPEILDAVVIPFPDAEAGEVPIAYVVRSPVSSLTEVDVQKFIEKQVAYYKKLRRVTFVDSVPKSASGKILRRELIAKVRSSKL

SEQ ID NO: 37087 - protein, 251 aa, Sorghum bicolor
  unsure (1)..(251): unsure at all Xaa locations
  Clone ID: SORBI-28MAY03-C15621_1.pep
LFEEINIRPIVAYEFEKLLICRFCNVKTSRTPXPPNLDEPSNIAQIIASWGLEYIVITSVDMDDLPDXGSGHFAETVQKLKXFYKKKLKALKPEMLIEALVPDFCGDTSCVEKVATSGLHVFVHNIETVEELQRNVRDYHANFKKSIDVLKMAKEYALPGTLINTXIILGCGETPDQVISTLEKVWAAGVDVITFGRYMRPSKRHMPVSEYVTPXAVEKYRALGVEMVCLCIGFDPELMNFRHHFVCEAGN

SEQ ID NO: 37088 - protein, 241 aa, Sorghum bicolor
  unsure (1)..(241): unsure at all Xaa locations
  Clone ID: SORBI-28MAY03-C15638_1.pep
MHMMRRLKSIASGRSAGSDPGGDSGSKRPKFEQDGAGDIVIEPHLTEEKPVRIDQESSSSSNRDAEASTSTSMKPAKTEEPGADILPKEMNDMTISDDKADGHNDKEGEGVTLDGNGTETGQIIVTTIGGHNGKPKQKVSYMAERVVGTGSFGVVFQAKCLETGETVAIKKVLQDKRYKNRELQTMQLLDHPNVVQLKHHFFSTTXRGEVYLNLVLEXVSETVYRVAKYYKPMNQRVPIIY

SEQ ID NO: 37089 - protein, 65 aa, Sorghum bicolor
  Clone ID: SORBI-28MAY03-C15696_1.pep
HASAGLMDNSTKTTLLGVWMLLFTVFAARKFQQPIKDDIGDKSVFMFNALRFDPETGEAKGTAAV

SEQ ID NO: 37090 - protein, 296 aa, Sorghum bicolor
  Clone ID: SORBI-28MAY03-C15195_1.pep
VALVGYCMDGARRLLVYEFVPNHTLEHHLHGKAGAGAGAGRLPVMEWTTRLRIAVGAAKGLAYLHEECDPRIIHRDIKSANILLDDDFEAMVADFGLAKLTSVNHTHVSTRVMGTFGYLAPEYASSGKLTEKSDVFSYGVMLLELLTGRRPGDRSSYGQDGLVDWARQALPRALADGNYDEIVDPRLRGDYDPTEAARLVASAAAAVRHAARRRPKMSQIVLALQGAMPLEELNDGVRPGHGAAFGSGSGSSGSAGSGSDYGGSDGSSYTAQMERIRRAAMPSPEYSADYPGSVPE

SEQ ID NO: 37091 - protein, 144 aa, Sorghum bicolor
  Clone ID: SORBI-28MAY03-C15161_1.pep
DDDIIFEHSGSQSDRKTSGSMASSDVLTVNQLMESVHETARQVANVPVSTNPVPYDQMKSQCEALVMEKQQKMSVLLSFKHSRTDSHGSAGVDGLETNESSLRSEPELRKGRMRRCDSASSESDCSFRLPPASPYDKFLKAAGR

SEQ ID NO: 37092 - protein, 91 aa, Sorghum bicolor
  Clone ID: SORBI-28MAY03-C15208_1.pep
MVRRMVLVAALVVATVAVLAGGARAQLKEGFYGSTCPQAEKIVKEFVKAHIPHAPDVAATLIRTHFHDCFVRGCDASVLLNATGGMEAEID

SEQ ID NO: 37093 - protein, 180 aa, Sorghum bicolor
  unsure (1)..(180): unsure at all Xaa locations
  Clone ID: SORBI-28MAY03-C15156_1.pep
MKDSQDIQSTTELQSSAQGTNEVQSQQPNPMATDAPAGNSGSLSVASNGNKKVSREDIELVQNLIERCLQLYMNKGEVVRTLSTRARIEPGFTTLVWQKLEEENSEFFRAYYIRLKLKRQIILFNHLLQHQYNLMKYPAPPNIPLAXIQNGIHHMPVSNLPMGYPVLQQPIMPAPGQPHM

SEQ ID NO: 37094 - protein, 136 aa, Sorghum bicolor
  unsure (1)..(136): unsure at all Xaa locations
  Clone ID: LIB3480-033-P1-K1-H9.pep
MNKGEVVRTLSTRARIEPGFTTLVWQKLEEENSEFFRAYYIRLKLKRQIILFNHLLQHQYNLMKYPVLQQPIMPAPGQPHMDXMACGLSSGHVVNGIPAGGYHPMRMNSGNDMVVDNGAPEAPHACATGSAMSSEM

SEQ ID NO: 37095 - protein, 64 aa, Sorghum bicolor
  Clone ID: SORBI-28MAY03-C15224_1.pep
LLTNEWDAKFCATTAFGSKYFFCFMSFWNNLWTLLVRRARTCCWVHTSLFGCYVYQSDCLLQTI

SEQ ID NO: 37096 - protein, 194 aa, Sorghum bicolor
  Clone ID: SORBI-28MAY03-C15891_1.pep
MAADSTAAARVASHLTSHDSDSLVHLPRGQVDLIDFIDWTGVECLNQDSSHSIVNALKQSLRDDEGLYLASDSDEQLLIYIPFMQVIKLHSALFKGPEEEGPKTIKLFSNKEHMGFSNVNDYPPSDTLELSSDHLIENKPLPLKYVKFQNVRSLTIFIEDNQSGSDVSKIHKIALYGTTVDTTNMKDLKKIEEH

SEQ ID NO: 37097 - protein, 126 aa, Sorghum bicolor
  Clone ID: SORBI-28MAY03-C15831_1.pep
LVLIVGRGGGEAGRDGGVVHGVVEALRLHHLHPQPARLVLRQHAEPPGRRRRPLPRLLRLLLGRGRARVDVVRLAGPPQQRRPPLGGARASAVGARPRPAGGRRGGAGAGPDRRSRRRRADGEDRP

SEQ ID NO: 37098 - protein, 38 aa, Sorghum bicolor
  Clone ID: LIB3480-048-P1-K1-H4.pep
KKKKGAARDLELGDDDEPPSLSRCRRADPNLRVAAVYH

SEQ ID NO: 37099 - protein, 131 aa, Sorghum bicolor
  Clone ID: SORBI-28MAY03-C15970_1.pep
PPEIDPRAEDKELKYQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 37100 - protein, 156 aa, Sorghum bicolor
  unsure (1)..(156): unsure at all Xaa locations
  Clone ID: SORBI-28MAY03-C16051_1.pep
MEAQHTTLAQVIKAEFWEWFVCEEGKEVEAAKVXDKVCRERLKDMYSEAHIQRVISYHHEVLGQKVTKKQATEMIMLPDTNITREQYMQFPADWCKSHMDCWAQFVDSWPPPEAYGERKKGGSSPHPRGHSPWLAWPDGGSGHDGGHDDDGSESQH

SEQ ID NO: 37101 - protein, 99 aa, Sorghum bicolor
  Clone ID: SORBI-28MAY03-C1607_1.pep
SPAPSSPQSSVTILCRRCASATPSRARREKGRINQRLSLLSRATTRQSWLTQRCGRDAARSTRGGAGHGSAGTSSLCVPSCGVEDRRGDDGVVGCGFGA

SEQ ID NO: 37102 - protein, 78 aa, Sorghum bicolor
  unsure (1)..(78): unsure at all Xaa locations
  Clone ID: SORBI-28MAY03-C1543_1.pep
HEVXXLSPPYRHTXLDSSGFLSLSIPTVQPLTKYEMPSLVDGSAVTLAVQGLESDSVRDKGLEIDAVHEKGVEVSSTP

SEQ ID NO: 37103 - protein, 115 aa, Sorghum bicolor
  Clone ID: SORBI-28MAY03-C15432_1.pep
KQEGRLSRPVHAHASEDLRVVAGAHALLSLAAAMAMLLMLTRAASSCTVLRRRRSVRDSMCPVRVERGEDPHVALGSASAAAGAAIFVAAHGAAEPELLLRTGEQRHRRGEVHEM

SEQ ID NO: 37104 - protein, 325 aa, Sorghum bicolor
  unsure (1)..(325): unsure at all Xaa locations
  Clone ID: SORBI-28MAY03-C15478_1.pep
MRVLNLSKAESGDAVDGEVSFDTSHSHSSSNMEAPQSESFQSEAPEVVGAAKREEHGDPPGSDDASITNGALNGSEVVPEESQETLTSKEPQDSGIKNVLPGDLDIPVQSSESTPCPSHESFATSDHQPAVPTLVEGDKETCREQFDVQIHGQSRDTEAACDSSVAICGAVPGHATTELDVESDSLDNSEPLPSSIQECEPIYQGEEHILGATNMVYENQEPVYEGESXLAEQADITGESSPSVDDKATEHQWELIDNFLQTTANQLTVYGLFCLQEGLNESELCVFFRNNHFNTMFKYNGSLYLLATDQGFISQTDLVLQKLDE

SEQ ID NO: 37105 - protein, 150 aa, Sorghum bicolor
  Clone ID: SORBI-28MAY03-C15551_1.pep
LVNVIATGGFSEDMIPTVGFNMRKVTKGNVTIKLWDLGGQPRFRSMWERYCRAVSAIVYVVDAADRENMAIAKGELHDLLSKPSLTGIPLLVIGNKIDKPEAFPKQTFTELMGLKTITDREVACFMISCKNSTNIDSVIDWLVKHSKKKN

SEQ ID NO: 37106 - protein, 204 aa, Sorghum bicolor
  Clone ID: SORBI-28MAY03-C15560_1.pep
MKSGGGGGGGGGGGGQQWPCDYCGEAAAALHCRADAARLCVACDRHVHAANALSRKHVRVPLCAGCAARPAAARVSPVPGADPAFLCAGCCDDAASAAVRVPVEGFSGCPSAAELAASWGLDLRRAEEGKDGAGGDIDDGDPFLSVLDYSVLGVAVDPDLRDLYVPCDPPRVPAPDAAGARPLMGHALCDQLAEMARRETDTVH

SEQ ID NO: 37107 - protein, 120 aa, Sorghum bicolor
  Clone ID: SORBI-28MAY03-C1620_1.pep
SAQSKKYAFKCHRKSEAGRDTVYPVNAIAFHPIYGTFATGGCDGFVNVWDGINKKRLYQYSKYASSIAALSFSKDGHLLAVASSYTYEEGEKTHEPDAIFIRTVNEVEVKPKPKALAAPQ

SEQ ID NO: 37108 - protein, 171 aa, Sorghum bicolor
  unsure (1)..(171): unsure at all Xaa locations
  Clone ID: SORBI-28MAY03-C16255_1.pep
RAESLCHRVADRVAVRVXSPAIDHLDAYDSNPLQLGLAVVDRLNALQQETGRLLAYLHVTQPRYTAYGQTESGQHGSAEEESRLMRALRGAYRGTFMCSGGYTRELGVEAVESGDADLVSYGRLFIANPDLVERFRRDAPLNKYVRKTFYTPDPVVGYTDYPFLGQPKARM

SEQ ID NO: 37109 - protein, 224 aa, Sorghum bicolor
  Clone ID: SORBI-28MAY03-C16267_1.pep
SSWGYQRSGAGGFRRFGRRRSGSASGPQRPGACSRLGPRSGASGPLPWCPGPPRGFGFVTFDDKKSMEEAIEAMNGMDLDGRNITVERAQAQSSGSRDRDGDRDYSRGGGDRDRYRGDYSRGRDHGRDFGGSRGGGSGDCFKCGKPGHFARECPSDDGGRGDRYGSRDDKYGGSNGSSRYGPDRGGDRYSGSRDGGSRNGGGSDRYNRDKSGPYERPSRGGYKY

SEQ ID NO: 37110 - protein, 260 aa, Sorghum bicolor
  unsure (1)..(260): unsure at all Xaa locations
  Clone ID: SORBI-28MAY03-C16310_1.pep
ALLDRVITEHRQRRRGNRRQEGDDHRDFVDVLLXVKFDNVAIKSNILVLFAAATDTTYTTLVWAMAELVNHPHEMRRVQDEIRAAVAGSGHDDDVVTEDHLDKLRYLRRVIKETLRLHAPLPLLLPHETMEDTELLGYHVPARTRVIVNAWAIARDLATWERADEFVPERFADDDEDDDKTDXLLGQDFRFVPFGAGRRGCPGVGFAAPAMELALASLLYHFDWALPAGGASKVEMEELNGLSVRLKAILHLVANPWYPQ

SEQ ID NO: 37111 - protein, 189 aa, Sorghum bicolor
  Clone ID: SORBI-28MAY03-C16291_1.pep
MGEKIAAPPDTVVEISNLNLGKLYAASIMYGYFLKRVDERFQLEKTMKTLPPNPKQQIVFENLQPNPFWDMESLVQITPDGEEISLDDEGSNPNKLKSYVSKLDADTLQRYATIRSKEAVSLIEKQTQALFGRPDIKVLDDGSVNAKDGRMVTITFTELNHLVLEAVTFGSFLWEAESYVESKYHFVNS

SEQ ID NO: 37112 - protein, 122 aa, Sorghum bicolor
  unsure (1)..(122): unsure at all Xaa locations
  Clone ID: SORBI-28MAY03-C15702_1.pep
MAQFLEEHPKIARVYYPGLPSHPEHHIAKSQMTGFGGVVSFEVAGDFDGTRRFIDSVKIPYHAPSFGGCESIIDQPAIMSYWDSKEQRDIYGIKDTLIRFSIGVXEDFEDLKNDLVQALEKI

SEQ ID NO: 37113 - protein, 137 aa, Sorghum bicolor
  Clone ID: SORBI-28MAY03-C15745_1.pep
GNETRLKKLEPPQSGPSHYQPTILTKTNYTFFLFFILVYKYKVRSNLWPQSATQLHANIQLDSLVTSWPSFYMSYITLLIITIYGCGLHGRDSLATPPGLCVLFILQPLMEALCIVPADPHFPFYAILLRTRGSSDR

SEQ ID NO: 37114 - protein, 193 aa, Sorghum bicolor
  Clone ID: SORBI-28MAY03-C15764_1.pep
MALASGTSRLLLGRPAGTARLHLAVSSSSPASSIRFRPDAWAGGGRAAVVSLRAPAPPAAAAAAATSGSIAPAISLTEKALKHLNKMRAERNEDLCLRIGVKQGGCSGMSYTMEFESRANASPDDSVVEYDGFAIVCDPKSLLFMFGMELDYSDALIGGGFSFQNPNATKTCGCGKSFATGKETEAAATACNN

SEQ ID NO: 37115 - protein, 197 aa, Sorghum bicolor
  Clone ID: SORBI-28MAY03-C15786_1.pep
MHLPYDQVLAKIPGFVAHIKYTIETLYSHGARKFWIHGTGALGCLPQKLAIPRDDDTDLDAHGCLNTYNAAAKRFNALLSDACAQLRRRMVDAALVFVDMYTIKYDLVANHTMHGIEKPLMACCGYGGPPYNYNHFKACMSAEMQLCDVGTRFISWDGVHLTEAANAVVAAKVLTGDYSTPRVTIARLVNSTLPNDD

SEQ ID NO: 37116 - protein, 134 aa, Sorghum bicolor
  Clone ID: SORBI-28MAY03-C15961_1.pep
TTRGWPWCCYLACCWPGRRPPPPPPRPATARLLARPSARSPALATGSSATSLIARGRRPTNTIVAATRSLGAAADPCMHAYVCVCAGGRSIQPHCASHACGPGVRAAGLAHRRFCVCVCVSPFRMLRYIYILYY

SEQ ID NO: 37117 - protein, 148 aa, Sorghum bicolor
  Clone ID: SORBI-28MAY03-C16513_1.pep
PWLVSASSDGRIALIDLRKLLTPKRSSKGLRVKSFDASAIEPPQRMLHGVGCDLFSIAIGADRIVCAGEDGSVRVWNFSEALEIERRAQALRSLRQENRMRRRKAQVEMNANGRRPDQCSIAMKKNQLKADKSATWHNKRAINEKAKS

SEQ ID NO: 37118 - protein, 118 aa, Sorghum bicolor
  unsure (1)..(118): unsure at all Xaa locations
  Clone ID: SORBI-28MAY03-C16534_1.pep
ARGELGGGGRGPGDRVRRQLQSVGRLAAYLGGGFLLLSAASSVAVRSLRALSDANQXFAMPCGACEGKGTYACRLCRGSATIQWSPMHDPVFVNPCLCPTCDGTRVQRCLNCLGNGYA

SEQ ID NO: 37119 - protein, 63 aa, Sorghum bicolor
  Clone ID: SORBI-28MAY03-C16582_1.pep
MGLLDALYRVVMRRNAVYVTFVVAGAFAGERAVDYGVHKIWDMNNLGKRYEDIPVLGQRPAEE

SEQ ID NO: 37120 - protein, 210 aa, Sorghum bicolor
  Clone ID: SORBI-28MAY03-C16580_1.pep
MASRQALHIFTPSRRAMHILTPSRGIASTPHLSSFGWFDKIKSTITGKKPEEGSEASSFTLIQFADTMEKARKLGTFKNFVAGRASEATVVNAFEKHSAVLRYLGAIDPTGEKLRNTDKINATKHCNCTIAEVEHILAKYTWAKEAQKKIEKLKEEGKPLPKSFNEVQSLMGSTPVDVGRTNLAKSGQISRNALCPCGSKKRYKRCCGAS

SEQ ID NO: 37121 - protein, 149 aa, Sorghum bicolor
  Clone ID: SORBI-28MAY03-C166_1.pep
EKKGDFIKVYANDQRKISCDPETKELIKRTLEIGHVTYEVQVQLPQVRFLDIWEPAVLAIKREGYSIKCNGQRGVVITEKFQQGTAIHIPYGHPTEFLITSAASADGVSYNLKPVENTLLRDTIVLVLRLFKNMALERRRGRKKGLFFK

SEQ ID NO: 37122 - protein, 268 aa, Sorghum bicolor
  Clone ID: SORBI-28MAY03-C1610_1.pep
PARGRSGLDGSPSAPCPSASGPRRQRARRTPTATAAVDWSLLPEELLLVIMGHLEVIDLVRSGAACSSWHPAFTAFRRLRIPSPKQAPCALYTARDEDPDIAVLCAPCRPTSIGASRSRLPSIRTALPGLPLSRRTFVGSAYGWLVTADEDSNLHVVNLLIGAQVALPPLASLYNVESLTDEGGDLTYRVFVNREADEEPTDNLTALAAREIMYFRAVLLCSPSAGAECIVLLIHWPEGELSFARLGDESWMPVSAMGHGPLERSGYH

SEQ ID NO: 37123 - protein, 67 aa, Sorghum bicolor
  Clone ID: SORBI-28MAY03-C16117_1.pep
MAATLRLRILAAAATAAAVASSLVGVATASEAAPAPGPASPSTAAAAAVTAPALAAFAVAAVGYLFS

SEQ ID NO: 37124 - protein, 262 aa, Sorghum bicolor
  Clone ID: SORBI-28MAY03-C16146_1.pep
MDRLDMMDNINCRRVMTNKPRIEAQSSSSVDRDREKEEDEAQQDEVAEAMKAPLLGWNHNHHEAAGGIGNNRRRLLSKQLSMKETTREAKWEKRRRQILRRSSMVSLNDGGSGSSKSIIDERHYCHHVMRSSSECVMRRLTDEDLDELRGSFELGFGFDEDTGGTHLRDTLPALEFYFAVNRQLSDRKLRTLAAASPTSTLSAVSSSSTLPDIPSPRSPNAGATANGGADSWKIFTPGDNPQLVKTRLRHWAQVVACSIKHG

SEQ ID NO: 37125 - protein, 182 aa, Sorghum bicolor
  Clone ID: SORBI-28MAY03-C16160_1.pep
MSSPHGGLDDQIERLMQCKPLAEPEVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFD

SEQ ID NO: 37126 - protein, 94 aa, Sorghum bicolor
  Clone ID: SORBI-28MAY03-C16137_1.pep
ATSPLIATVELTVALGPAGLGMGIVHVDAQTSALVNYAPWFGQLSHAAPLFLVVHLQNSSPPRALSPLLSAPTNPNSLLTQWGAWIWADDKSPR

SEQ ID NO: 37127 - protein, 94 aa, Sorghum bicolor
  Clone ID: LIB5048-010-R1-XP1-B3.pep
VALYKKRGKGNNYMPLHEDYQALVHLRHLTDTSLVLFMMDAQATNKSRITIRCLLDGSATTEGRMRMTLEGGRGSHHVPLTAASPMDPRHPSAR

SEQ ID NO: 37128 - protein, 296 aa, Sorghum bicolor
  Clone ID: SORBI-28MAY03-C16170_1.pep
HEGPSESSSSMPRGTRNQNVVQRSRFGLTGESPRLHIDISEPDEASNHQDASHRPAAIAGEQEENNYNEGPNLTLEAHEVEMNGPSESSDVSSLNQLLCPLCRGGVSGWKIIKEARQYLDEKSRACSREACTFSGNYREIRRHARRVHPTTRPADVDPSRRRAWHHLEHQREYADIVSAIRSAMPGAVVLGDYAIEGGEMFSHDREARGPSEPSGSLLTTFFLFHMLSSSPIRSGDEPRGASRGLRRQRRRYLWGENLLGLQYDDDNDNDDDDDDEGEDEGDAVDEEVQRPRSRRR

SEQ ID NO: 37129 - protein, 264 aa, Sorghum bicolor
  Clone ID: SORBI-28MAY03-C16972_1.pep
MRPLLTRLFTSTHIAMASSSFSSSPSRRLAHLTRHLASSSSGELSSVGAPAAAAADAVPAKTPRSAPSKVHAAVLVCLFEDPSSGPRVLLTKRASSLSSHSGEVSLPGGKVEDGDADPKATALREAKEEIGLDPALVNVVTVLEPFLSKNGLNVVPVIGMISDKALFKPVLNKAEVEDIFDAPLEMFLKDDHRRTKQMSWMGIDIPVQFFDYEADGKRFVIWGLTAHIVTRAAAVIFGRKPSFDELPRPKYASAPVAGTNESKP

SEQ ID NO: 37130 - protein, 175 aa, Sorghum bicolor
  unsure (1)..(175): unsure at all Xaa locations
  Clone ID: SORBI-28MAY03-C17054_1.pep
MRFTAALLLGVAALLCLGGGGRAAASTDFNFPAVFNFGDSNSDTGGRVAAGFEAIFPPYGSTFFGGPAGRFCDGRLIIDFLMEAIDMPLLNAYLDSLGTPSFRTGVNFAQAGCSITPAKPTSVSPFSFGLQIKQFFAFKDKVTKLLVXRRYVPEIYFLRKITFPKGLYMFDIGQK

SEQ ID NO: 37131 - protein, 86 aa, Sorghum bicolor
  Clone ID: SORBI-28MAY03-C17086_1.pep
MGDVSLNRPIKAEPTAKGNRVLDTMSAGWTDERHMMYISSMEASFVDQLYNHGNHPHNANGTGFKVLRRGVWEYIKYEKTNNAPVR

SEQ ID NO: 37132 - protein, 194 aa, Sorghum bicolor
  Clone ID: SORBI-28MAY03-C17161_1.pep
TRDSATRKRNIHGVLNAVSWGVLLPSGAGRARYLKTFQAADPAWFYLHVTCQLMGYAVGVSGWATGIQLGKESKGVTYTDHRNIGIAVFALGTLQVLALFLRPKKEHKYRVYWNMYHHSVGYTVIVLGIVNIFKDMNILGVEQRWRTAYIAAVCVLLIAAAALEAVTWGVVLRRRKAESKTFNSASSGHLPHSV

SEQ ID NO: 37133 - protein, 93 aa, Sorghum bicolor
  Clone ID: SORBI-28MAY03-C1719_1.pep
MSVAKDDTGRTIPKFGEWDVNNPASVDGFTVIFSKARDEKKAPTTKPQPGHITQRSASADSKDSRTDKMTSYNSRTNASKKWFCCVSPSPTQS

SEQ ID NO: 37134 - protein, 186 aa, Sorghum bicolor
  Clone ID: SORBI-28MAY03-C17208_1.pep
MAGGSRSSRTPAAPHSLVLLALVTLTTAGKGSAATFQVTNLCPFTVWPAAIPVGGGTQLEPGQTWLLKVPAETTGGRVWGRTGCRFAPSGHGWCATGDCAGALRCQLSGKPPATLAEFTIGAGAADYYDLSVVDGFNLPMDLRCDGEAHTIRCRNAGCPDANHRPGEGKVRSCKADSDYHVIFCPK

SEQ ID NO: 37135 - protein, 176 aa, Sorghum bicolor
  Clone ID: SORBI-28MAY03-C16312_1.pep
ADARRRLGGQLPARQPAHRVRVRDAARPELAQPQHPGRGGAAPAPARRRRQHTGLRERTREARRRGAGAGAHAVAEQLPPLPAVPAGARARARSRAAPRRRAVRRARVRQGWELHGADGARYQAALEGWTAAAAQRDGDAQEVCDCMGLTRPPGPAVRRREPVVMNFAISIRGAVS

SEQ ID NO: 37136 - protein, 344 aa, Sorghum bicolor
  unsure (1)..(344): unsure at all Xaa locations
  Clone ID: SORBI-28MAY03-C16329_1.pep
LSLPPPPLFFPPPAVAAPPRCPPRLLPPPPLLLAAPRGGGFVPPGRRPAPRAAAVVLPSAQRFVGGRHSPRPLPRLGRQAAAPLPRAWLARRSPLSRCRGTVGETAAAPAGRRPAAPRPASHPNAGPALPCRPMAPRCCPPPRVRPLVLPAPSLALLSLLAACLRPSPPCAPPRDATAVPSVVRSPHVFHLVARRRGGERRHLFLESYVCRLAFVSSSGNYSSEGTRPIRSTGSAAKPHISTVVQGKAGAAPRNTSQHNAVCYNARPRQTKRAQCAEEQRAAEGPPRRRAGHFHGRAEQHHGELRAECPDRGRLLRQNLPRRADXRGARRHQEARSQRVQRLSG

SEQ ID NO: 37137 - protein, 271 aa, Sorghum bicolor
  Clone ID: SORBI-28MAY03-C16370_1.pep
ARGNQACAEYAKKKMSTPEFKLDKNAPNVSWADTKNGGESASTSQVKSLYIPRVRKTVTQEQLKRLFEHLGEVTKVVIPPAKAGHENRYGFVHFKERSMAMKALKDTERYELDGHLLDCSLAKPLAEKKDDTTSVPKGGPLLPSYTPLGYGLMGAYNPLGNGLAGAYNPHGNGVAGAYGVLGAQAAQPMLYVPGAPLGSTMIPMVLPDGRLVYLPQPAGQQTVPMTSPPPQKGGRHNGGSTGGGSSSGGRRQRGDDSGSSNSSRRGRYRPY

SEQ ID NO: 37138 - protein, 423 aa, Sorghum bicolor
  Clone ID: SORBI-28MAY03-C16502_1.pep
HEASVGIEKLSMQANKLMPLEDVNGKMMQQIAWEAAPALESGERYDALDYHSIDALVGGGGNAPSGKKKKGRCAELSSLGGENASEYVSLEDLAPLAMEKIEALSIEGLRIQSGMSEEDAPSNISAKPIGEFSSLQGKCAESTLSLGLEGTAGLQLLDVKQSGEEVDGLMGLSITLDEWMRLDSGVVDEEEQYSDRTSKILAAHHAKSMELVAENRNGDRKSRRSGRRWGLLGNNFTVALMVQLRDPLRNYEPVGTPMLALIQVERVFVPPKPKIYSTVLDKPNSEQDDEEPKTEEVPDKALVTEEKAEELEDPIPQFKVTEVHVAGFKSEPEKTKPWGNQTQQQSGSRWLLAAGMGKGNKHPLMKSKAIVKPTKEAAGQAGDTLWSISSRVHGAGTRWGELTGNKNHSRNPNIVLQKDKRFR

SEQ ID NO: 37139 - protein, 222 aa, Sorghum bicolor
  Clone ID: SORBI-28MAY03-C16503_1.pep
TRLGCFYIHIKRIKPKPKSLALPDAEDPDAGYYPMVLVQIPMCNEKEVYQQSIAAVCNLDWPKSNFLVQVLDDSAHASAQTLIREEVAKWQQQGARIVYRHRVLRDGYKAGNLKSAMSCSYVKDYEFVAIFDADFQPHPDFLKRTVPHFKDNDELGLVQARWSFVNKDENLLTRLQYINLCFHFEVEQQVNGVFLNFFGFNGTAGVWRIKALEDSSGWMERT

SEQ ID NO: 37140 - protein, 149 aa, Sorghum bicolor
  Clone ID: SORBI-28MAY03-C17451_1.pep
AGRAGFGNAIQSAVTLATVSELARSDLRWAAGKLNESLAAYGDGTIRRAAAAWQAAPRCFPLGNPDGAVITMGSSNRFPMYEGNDFGWGRPLAVRSGRANKFDGKMSAFPGRAGDGSVDIEVCLPPETMAALLRDAEFMQYVSCPSHLL

SEQ ID NO: 37141 - protein, 174 aa, Sorghum bicolor
  Clone ID: SORBI-28MAY03-C17439_1.pep
MLLTCRSLSTWVRRLVACMGGCFGCCAKPTPITAVDEPSKRLRIQGRSVRKASLSEDFWSTSAREMENSGIQSQRSISSISTVAQSSDQHAAGSSSNPNEFVNQGLMLWNQTRQQWVGSKKRHSRSQQPREPKLSWNTTYETLIGSNKPFAQSIPLGEMVDLLVDAWDQEGLYD

SEQ ID NO: 37142 - protein, 186 aa, Sorghum bicolor
  unsure (1)..(186): unsure at all Xaa locations
  Clone ID: SORBI-28MAY03-C17465_1.pep
MEEAKVVESKDGTISVASAFAGHQEAVQDRDHKFLSKAVEEAYRGVDCGDGGPFGAVVVHNDEVIASCHNMVLKNTDPTAHAEVTAIREACKKLGKIELSDCEIYASCEPCPMCFGAVHLSRIKRLVYGAKAEAAIAIGFDDFIADALRGTGFYQKANMEIKQADGNGAMICXTVFEKTKEKFQMY

SEQ ID NO: 37143 - protein, 227 aa, Sorghum bicolor
  Clone ID: SORBI-28MAY03-C17472_1.pep
MSGATDYQEMAASVPPSLKAITLTHVRYRRGDPLGLFLAWVSLVPVFISLGGFVSHFLFRRELQGLCFAAGLLVSQVLNEIIKHSVAQSRPAYCELLEACDSHGWPSSHSQYVFFFATYLSLLSLRRSRARQVMAALPWPLAFLTMLSRVYLGYHTVAQVFAGAVVGLVFGAIWYWIVNTMLVNYFPMIEESAIGRWLYIKDTSHIPDVLKFEYDNARAARKKVSTD

SEQ ID NO: 37144 - protein, 167 aa, Sorghum bicolor
  Clone ID: SORBI-28MAY03-C17558_1.pep
PAGPGFSPPASRKGLQKQPGGRRGAMEEQVVTERIRRKLEEVNATVQQHLAGVQDHVNFTMQQAYFKCAHDCFDRRRTQEGINSCVENCSVPVLTANNVVENEMAKFQERLNRSLMVCQDKYEAAKLQKLKTDATQELESCVNRSIDDSIRVLPHVVEQIKSALSIN

SEQ ID NO: 37145 - protein, 210 aa, Sorghum bicolor
  Clone ID: SORBI-28MAY03-C17738_1.pep
MAGIRLTPEEPEMPVGTPPRPQLPPSVAGAGGGSGGLEMASDDERSIAADSWSVRSEYGSTLDDDQRYADAAEVLAASAASANFPSAASDYCSDKDDEDPGDVEGSMLGLQSYWDASYLEDLANFQEHGHTGEIWFGADVMDTVAVWTKSLCSIIEGRIPSGQDSIESEVDENLFSNYPVLDVGTGNGLLLQALAKQGFTDLTGTDYSKG

SEQ ID NO: 37146 - protein, 189 aa, Sorghum bicolor
  Clone ID: SORBI-28MAY03-C1669_1.pep
MAAAAALRPALSQGPEQRASLLCTPKHRVSASASRRSLRFAARASSNPGAQVSIPKQWYNLIADLPVKPPPPLHPQTHQPLNPSDLSPLFPDELIRQEVTDERFVDIPEEVIDVYKLWRPTPLIRARRLEKLLGTPAKIYYKYEGTSPAGSHKPNTAVPQAWYNAAAGVKNVVTETGAGQWGSALSFAS

SEQ ID NO: 37147 - protein, 180 aa, Sorghum bicolor
  Clone ID: SORBI-28MAY03-C16702_1.pep
VHTFCSQLPMATTKANANADYWNASSSRQGGQTSRGSGPQNVCVTNMQAALSSSSSGHGTKSYSHSVDHSSSHKSESERSMGATDNLDSLVADSIGRLAFEAGVEPDFVHLPSFNGVIDLLTRGVRIAMPSYEYILQVQLNEVQKREKAMRQHWERRGCSLILDSWKSRCGRSFISAFVH

SEQ ID NO: 37148 - protein, 136 aa, Sorghum bicolor
  Clone ID: SORBI-28MAY03-C16732_1.pep
GASATAKISVDASLARGIGGKGGVNSGQISGVTGVKLSIRDHESNPSQKNIELEGNFDQIKQASDMVRDLIATISASMPAKNLSASAAPAGGRGGGLGGRSNYKTKLCENFVKGACTFGDRCHFAHGETEQRRGAA

SEQ ID NO: 37149 - protein, 135 aa, Sorghum bicolor
  Clone ID: SORBI-28MAY03-C1674_1.pep
MQSSVSFSDFSVSVCTKEDGLIKLQVNVSGTMTDSIFEKVFTKNVAAAQPLPGFRRMKGGKTPDIPKEVALHLIGPSKVKKETIKKIINSTVAEYVQKEGLTASKNLKVQQSYEELEAAFEPGKEFCFDATVHLQ

SEQ ID NO: 37150 - protein, 250 aa, Sorghum bicolor
  Clone ID: SORBI-28MAY03-C16741_1.pep
MPGAVAPAPTLAPTRSSAYTSAAAASTLSPNPTSRGDPLTLSSCRNAPASATPLVPLAATRRHVRGFRGAPLVASPSPHHARNPRLRFASAAAAAEGMAAEASTADAAAAAEAKPFAVLFVCLGNICRSPAAEAVFRTLVSKRGLDSKFLIDSAGTIGYHEGNKADSRMRAASKKRGIEVTSISRPIRPSDFRDFDLILAMDRQNYEDMLNSFERWRRKEPLPENAPDKVKLMCSYCKRHTESEVPDPYY

SEQ ID NO: 37151 - protein, 170 aa, Sorghum bicolor
  unsure (1)..(170): unsure at all Xaa locations
  Clone ID: SORBI-28MAY03-C17868_1.pep
MAPSLLGGFTKSLAMTVLSEIGDKTFFAAAILAMRHPRKLVLAGCLSALIVMTALSASLGWAAPNLISRKWTHHVTTLLFFVFGIWSLWEGFKEDGDSEELAEVEAELDAAFKSNTGESKNKSKANDDTKKQXRPFLMQFFSPFLXKAFSITFFXEWGDKSQNATIGLGC

SEQ ID NO: 37152 - protein, 312 aa, Sorghum bicolor
  Clone ID: SORBI-28MAY03-C17880_1.pep
MAATSAFESSPEMERFLCERLLDAEQPIAERFRALFSLRNLRGDAPRRALLQAARDPSNLLAHEAAFALGQMQDAEAIPALVAVLKDLSLHLIVRHEAAEALGAIGLEKSIPLLEESLTTDPAVEVQETCELAPRRIEEQKKANGAESTVASPFLSVDPALPAKHGLSVDQLRDLLLNEQESMYERYAALFALRNDGGDAAVSAIVAALSVKSALLRHEVAYVLGQLQNKAASDALSTVLKDVCEHPMVRHEAAEALGSIAAQESIALLEEFAKDPEPIVSQSCEVALSMLEYERSGKSFEFLFLQTPHVQS

SEQ ID NO: 37153 - protein, 216 aa, Sorghum bicolor
  Clone ID: SORBI-28MAY03-C17883_1.pep
MLRKAVVAFIACAALYLAFSAYSRRQSIAEVQLPAVTHRVYLDVEIDGQHIGRIIIGLYGEVVPKTVENFRALCTGEKGVGSNGKPLHYKGTPFHRIIPGFMIQGGDIVRGDGKGSESIYGGIFPDENFTVKHTHPGVVAMANSGLDSNGSQFYITTIKTSWLDGEHVVFGRVIQGMDTVYAIEGGAGTYNGKPRKKAVITDSGEIPKEKWGDQEA

SEQ ID NO: 37154 - protein, 97 aa, Sorghum bicolor
  Clone ID: SORBI-28MAY03-C18069_1.pep
MEKGSGGSAPPPPPLHMEDFQLEGKKPVKNPFVPIGALVTAGVLTAGLVSFRYGNSRLGQKLMRARVVAQGATVALMIGSAYYYGDEIKLFKKGSSP

SEQ ID NO: 37155 - protein, 138 aa, Sorghum bicolor
  Clone ID: SORBI-28MAY03-C17952_1.pep
MAQRAMCLLRRSMGFMAPPAQRALSTTATTAAEGAAVAEATAKEVKRRKKKNLFDVVQFLPEWGIGYKVAKTTWRDVSYQITKINLYKDGRHGEAWGVRYKAGVQAADAPTRISGVNKRGWKYIKESQKKLQDAPKVT

SEQ ID NO: 37156 - protein, 205 aa, Sorghum bicolor
  Clone ID: SORBI-28MAY03-C18070_1.pep
HEGQKQFTAASGGSILRQKNTHGILNAVSWGLLLPMGAIFARYLKTFKSADPAWFYLHVACQLIGYGVGVSGWATGIHLGNLSKGITYSLHRNIGITVFALGTLQIFALFLRAKKDHKYRLYWNIYHHSVGYTIIILGIINIFKGMSILDVEQKWKTGYIIAIAILGAIAVILEVVTWGIVLKRRKEDSKTYNGTSNGGRLPLSM

SEQ ID NO: 37157 - protein, 139 aa, Sorghum bicolor
  Clone ID: SORBI-28MAY03-C2487_1.pep
CTLANCIYSYTNKGRDGIGDGWWRLRVGVGLRSATRRKRRIWVPVGASSHSSNRPVLLGVQGSQGNGTERNGMKSDVVATGGSWTDTFALGPVRPAAAGRPAGLPLVLAVEKPFLFSFSCGGGGCVPEQCGMGESRAKF

SEQ ID NO: 37158 - protein, 136 aa, Sorghum bicolor
  Clone ID: SORBI-28MAY03-C24890_1.pep
TTGHCVKTLIDDESPPVSFAKFSPNGKFILAATLDSTLRLWNFSAGKFLKTYTGHVNTKYCIPAAFSITNGKYIVSGSEDKCVYLWDLQSRRIVQKLEGHTDTVIAVSCHPTENMIASGALDNDKTVKVWVQKEED

SEQ ID NO: 37159 - protein, 135 aa, Sorghum bicolor
  Clone ID: SORBI-28MAY03-C24960_1.pep
AKIVSSIDQLLETAEIQKVLFLETPEGISSALRPYWAKAIEGRAHVVQAQPDMLELVPPATSKGNGVKILLNHLSISPDEVMAIGDGENDIEMLQLASFGVALANGSDKTKAVANVIGATNDEDGVAQAIYEYAF

SEQ ID NO: 37160 - protein, 110 aa, Sorghum bicolor
  Clone ID: SORBI-28MAY03-C24982_1.pep
MSASSSVAVSKKASSLVVAASMSAVEALKDQAGLCRWDYALRSLYNRAAAANKVVVTGRAVPVSLSSSQAAGGSAAASTPAAAAGRAARPRRSEEEKLHKAYHLVCWGPN

SEQ ID NO: 37161 - protein, 130 aa, Sorghum bicolor
  Clone ID: SORBI-28MAY03-C18219_1.pep
MAGAGDEYYYGGPGPRGAPHGLLLAVVVGLVVAGPLFLGDGGEALTEAVAELLSPVGLLLLPVCLLFLIRVLSSDRGAAALADVFAFGGSPDAVHRVGGSPVGVAFMLLLILALLYYRSSLFGGDGGDDE

SEQ ID NO: 37162 - protein, 93 aa, Sorghum bicolor
  Clone ID: SORBI-28MAY03-C1824_1.pep
MARAASSYISRRGLSAAITVAESSAKKVEEKAVKLGTVAKDIASAMATTTEEKTAFWEPDPETGFYRPVTGTKEVDAADLRAEMLKQRMLQQD

SEQ ID NO: 37163 - protein, 182 aa, Sorghum bicolor
  unsure (1)..(182): unsure at all Xaa locations
  Clone ID: SORBI-28MAY03-C18287_1.pep
MMDEEHEQQQPVPVPVAAEAAVEKDNKKTAKRNNKVCVFCGSSPGVERGMDLVYGGGCAALMGLVSRAVHDGGGHVLGVVPKAVLPLELIGETPGELKPVAGMHQRKADALPGGYXIHTKPVGLLNVDGYYDPLLAFVDKAVQEGFVTPLERTIIVHANTNSSTSSSSSSTTNINADADADA

SEQ ID NO: 37164 - protein, 92 aa, Sorghum bicolor
  Clone ID: SORBI-28MAY03-C18309_1.pep
MASGGLAAASEFAVVFLVRPVLAIAFVFTLILLSWYVAWRTVLVHVPLVQEIAGLRPKKPSKPKPANRGRFAKFYQNQAEAAQRNSKSEGTS

SEQ ID NO: 37165 - protein, 81 aa, Sorghum bicolor
  Clone ID: SORBI-28MAY03-C18376_1.pep
KMVNAQPSGQDHLNVPWLGSTGGVKGNAQNGMPPVSAPVAGRPDEIPIEVPAVTPPAKPMRVKVGAKKRGRPKGSKNKKKL

SEQ ID NO: 37166 - protein, 161 aa, Sorghum bicolor
  Clone ID: SORBI-28MAY03-C17786_1.pep
MPGDHGSKVDISFAGRFTASAIAACFAEICTIPLDTAKVRLQLQKNVVAAAAAGDAAPALPKYRGLLGTAATIAREEGAAALWKGIVPGLHRQCIYGGLRIGLYEPVKSFYVGKDHVGDVPLSKKVAAGFTTGAIAISIANPTDLVKVRLQAEGKLAPGVP

SEQ ID NO: 37167 - protein, 200 aa, Sorghum bicolor
  unsure (1)..(200): unsure at all Xaa locations
  Clone ID: SORBI-28MAY03-C17833_1.pep
MAAEAGKTAATKSGGGQIMTVVRGLDVARYMGRWYEIASFPSFFQPRDGRDTRATYRLLEDGATVHVLNETWSKGKRDYIEGTAYKADPNSDEAKLKVKFYLPPFLPVIPVVGDYWVLYVDDDYQYALVGEPRRKNLWILCRKTSIDEEVYNQLVERAKEEGYDVSKLHRTPQDDPPPESDAAPTDXKGVWWVQSLFGND

SEQ ID NO: 37168 - protein, 235 aa, Sorghum bicolor
  unsure (1)..(235): unsure at all Xaa locations
  Clone ID: SORBI-28MAY03-C17835_1.pep
MGLGVKATPFTYAAHALAAAAAVLVLVWCVHFRGGLALEAQNKNLIFNVHPVLMLIGYIILGSEKLMIYTRFFQLKTDTAQLTHLILHAIARLLGALGIYCXAFMYHRQSGIANLYSLLSWLGIGTLSLYAIQWVFGRELFFFRRGAPSVRRSAVPWHALFGLFVYVLALATAELGFLEKLTFLESGGLDKYGAEAFLVNFTALVVVLFGASVVVAAVTPAHVEEPRXYAPIPIN

SEQ ID NO: 37169 - protein, 184 aa, Sorghum bicolor
  Clone ID: SORBI-28MAY03-C17752_1.pep
MAAADYDRAYRPYAAPALAPAGEYDRPYRNEVVPYGDRRLDIVVKPPARSPPPVSTRSGGSGGAGSAWCFSDPEMKRRRRVASYKAYSVEGKVKASFRRGFRWIKAKCSELIHGWYGSGLLLLLPPSPSYRVLPSSSQYSRTSIGDSRLLWFPSMGHVPFPAHCPASSGAFNLHVTVCMDYWYD

SEQ ID NO: 37170 - protein, 117 aa, Sorghum bicolor
  Clone ID: LIB5049-007-R1-XP1-D12.pep
MAAADYDRAYRPYAGPALAPAGEYDRPYRNEVVPYGDRRLDIVVKPPARSPPPPLPVSTRSGGSGGAGSAWCFSDPEMKRRRRVASYKAYSVEGKVKASFRRGFRWIKAKCSELIHG

SEQ ID NO: 37171 - protein, 188 aa, Sorghum bicolor
  Clone ID: SORBI-28MAY03-C17861_1.pep
MSSSDQNPAATPASGGPAEPSPPGRPTAVSSQVLDAGARLVQSLKPVRQMKQHACSFALYAHDLHRQMEVHHFVSRLNQDVLQCAVYDSDKPSARLIGVEYIVSDSIFEGLPPDEQRLWHSHAYEVKAGLWTDVGVPESLQSSEMASLAKTYGKLWCTWQVDRGDALPLGAPALMVSPQAVEPGRAPR

SEQ ID NO: 37172 - protein, 133 aa, Sorghum bicolor
  Clone ID: SORBI-28MAY03-C18835_1.pep
MAKARSSAKQSRAQAQAQQSNGGGHALSSKLARYLDPEASLDKDQLLDAVHWIRQAVGLICGLLWGAVPLVGAVWIALFLTISTGIIYWYYTYLLKIDEEEYGGHGALLQEGLFASFTLFLLSWTLVYSLAHF

SEQ ID NO: 37173 - protein, 107 aa, Sorghum bicolor
  Clone ID: SORBI-28MAY03-C18888_1.pep
MSTALKAFINSPVGPKTTHFWGPVANWGFVIAGLVDMNKPPEMISGNMTAAMCVYSGLFMRFAWMVQPRNYLLLACHASNESVQLYQLSRWARAQGYLEKKEPEAQQ

SEQ ID NO: 37174 - protein, 219 aa, Sorghum bicolor
  unsure (1)..(219): unsure at all Xaa locations
  Clone ID: SORBI-28MAY03-C1890_1.pep
ETLPSSRGNSRNCLVKSSLAANFRKQFSNLMIAISEERILYPLTWIMTSFAVVPILSGTMFCFQTQYLNLDPSVIGLSKVVGQVMVLSLTVLYNRYLKRIPLRCLTTGLQILYALAVLSDLVLVKQINLVLGIPNEIHVLCFSALAEALAQFKVLPFSVLLSSLCPPGCESSLFAFFTSGLVFSAILSGVFGVGLCTLIGXSSVDYSSLPVGILLQSLA

SEQ ID NO: 37175 - protein, 125 aa, Sorghum bicolor
  Clone ID: SORBI-28MAY03-C19004_1.pep
CGARAGRVGTLIGVGFDCNPMIFAADDTGLWSFIRFLDERKVAPSASKASQLSEALGKLYGQSKQGTSSDTVEPSKPRGGAHENCITCIVPLIKGSDGTIKQFSTSGLDGKIVVWDLENHIIIAK

SEQ ID NO: 37176 - protein, 132 aa, Sorghum bicolor
  Clone ID: SORBI-28MAY03-C19005_1.pep
MDPHRLTGPAASDADDADDWDNDDFVIPSFSVEESDLGDWESSRATDPQPPPKATKDTENIYLGPHGAPPSRAKKAEDTLATAGYRDKNSKAREADQKAFGTGRNTKGGNNAGDFHRHNGANHGKDPYKRSV

SEQ ID NO: 37177 - protein, 81 aa, Sorghum bicolor
  Clone ID: SORBI-28MAY03-C18083_1.pep
MVANGDAPARGSAAAAASLRRRRTTSGAAGGGGGASSMLQFYTDEAAGRKMSPNTVLIMSIGFIAVVAMLHVFGKLYRTSN

SEQ ID NO: 37178 - protein, 197 aa, Sorghum bicolor
  Clone ID: SORBI-28MAY03-C1814_1.pep
MARSVSVVVVLLLSVLVSAASAARTVGDTVQDACSKTQFPKICVDSLAAKPESQKATPRKLAELFVNIAAEKGSGMATFVHGKYNNDAKDSALFKCYDSCSDDVEEAVAHLNGLVREPTDAKFLELKSWLSSTLGGTSTCEDACKDAPKSGDKDAVVNFSLDFEKLQRVTLDLITEASGSMSAGIATARPTGPAPTT

SEQ ID NO: 37179 - protein, 228 aa, Sorghum bicolor
  Clone ID: SORBI-28MAY03-C18161_1.pep
MAPKILVILLLLAAASPAALAAFDVIEMLADKPRYATFSKLLQQTKVAGEANQLRAATLLVVPDKLVKSLASLPNDKLQPAVANHVLLSYFDPIKLDEMKTRTAILPTLLSNTDKKLGVLNYTRADDGQMYFGAPGASCVAKLVKVVAARPYSVSIMEVSEPILPAGFVTSTAVAPGRRGKGGRGKIKPSAAGLEDSKMVARMPGEGVSGKGSPKDTVTKSSAPIPAP

SEQ ID NO: 37180 - protein, 173 aa, Sorghum bicolor
  Clone ID: SORBI-28MAY03-C18188_1.pep
NLMDESVLVDSPSPRDTVLNNIREMRPNVFIHTVVNGTYGAPFFLTRFREALFFFSAQFDMIDATIPRDNAERLLIERNIFGSFAMNVIACEGADRVERPETYKQWQVRNHRAGLRQLPLNPEVVKAARDKVKIYYHRDFLVDEDNRWLLLGWKGRVLYAMSTWVAEDGKPIF

SEQ ID NO: 37181 - protein, 119 aa, Sorghum bicolor
  Clone ID: SORBI-28MAY03-C19196_1.pep
GHTGARTAVKKPSEQGHRLYVKGKHISFQRAKHSIRPNTSLIKIEGVDDTKAATFYNGKRIAYVYRGKKEIRGTKIRVIWGKVTRPHGNSGVVRAQFKHNLPPKSLGAMVRIMLYPSSI

SEQ ID NO: 37182 - protein, 110 aa, Sorghum bicolor
  Clone ID: LIB5048-004-R1-XP1-G5.pep
MSADNKSHRLYVKGKHISYQRGKRNTNPGTSLLKLEGVDDVKAAQWYAGKRVAYVYRAQRAIQGSKIRVIWGKVTRPHGNSGVVRAKFKNNLPPKSFGASVRVMLYPSSI

SEQ ID NO: 37183 - protein, 112 aa, Sorghum bicolor
  unsure (1)..(112): unsure at all Xaa locations
  Clone ID: SORBI-28MAY03-C19301_1.pep
MSTSELATSYAALILADDGVDITADKLQSLIKAAKIEEVEPIWTTLFAKALEGKDVKDLLLNVGSGGGAAXPLPEALLLPXWGAADAAPAAEEKKEEEKEESDEDMGFGLFD

SEQ ID NO: 37184 - protein, 101 aa, Sorghum bicolor
  unsure (1)..(101): unsure at all Xaa locations
  Clone ID: SORBI-28MAY03-C19368_1.pep
MMGSPLVYPSWMLLINLYAAAAHSMNLLERGSLHPRPPPPPPRAVRRKPPRDHPETHRECTRRRRMLWAPREQGGGLPRRRRNVTAAGARHCLDPAXSSAA

SEQ ID NO: 37185 - protein, 140 aa, Sorghum bicolor
  Clone ID: SORBI-28MAY03-C1937_1.pep
CAARAGRAGRNGPCRRGPCGCACSTPPPRPPFSLLACSLSRRLPPPPSASFPASQVFVRPFSGESTQIVNLYSLKMAGFRSLAPKTRNLVVAGGLSAFVLGVYYYTMRAVGGTDELQVAIDKFEEMKKKDAARNSNPGGS

SEQ ID NO: 37186 - protein, 149 aa, Sorghum bicolor
  Clone ID: SORBI-28MAY03-C19158_1.pep
MGRVRTKTVKKSAKVVIERYYPRLTLDFETNKRICDEIAVISSKRLRNKIAGYTTHLMKRIQRGPVRGISFKLQEEERERKDQYVPEVSALDFTQNSESGMLDVDQETKDLLKSMGFDSIPVNVVAVQQQQTVERPRRFGDGLPRGGRN

SEQ ID NO: 37187 - protein, 147 aa, Sorghum bicolor
  Clone ID: LIB5051-003-A1-XP1-F12.pep
MGRVRTKTVKKSAKVIIERYYPKLSLDFETNKRICDEIAIIASKRLRNKIAGYTTHLMKRIQRGPVRGISFKLQEEERERKDQYVPEISALDFTQNSESGSLDVDQETKDLLKSMGFDSIPTNVIAVSQQQVVERGPRRFNDRPARS

SEQ ID NO: 37188 - protein, 96 aa, Sorghum bicolor
  Clone ID: SORBI-28MAY03-C18393_1.pep
WSTQNTYWYQFCWIRIDTIISAFHRQGRGGNKREGKINAHLATLHLVSTQQWPLTTSRHPGAGSRLTALDPPYALQLLTIPGLTATVNRQRRPERA

SEQ ID NO: 37189 - protein, 240 aa, Sorghum bicolor
  Clone ID: SORBI-28MAY03-C18696_1.pep
MAALRHLAGAGPTYHHHHHHHGVAAATASLQLHRLPLLLPLPSCRPLRSRSFTRVYAISSNDIRVGTNVEVDGAPWKVLEFLHVKPGKGAAFVRTKMRNYVTGNTVEKTFRAGSTLQEPSLSKETKQFTYKDGAQFVFMDLTTFEESRLNEADVGDKQKWLKEGMDCNLLYWNGKIIDFELPITVRLTVTDTDPGASDSAQGGTKPATLETGAVVTVPSFVNVGDDILVDSRTGQYMNRA

SEQ ID NO: 37190 - protein, 134 aa, Sorghum bicolor
  Clone ID: SORBI-28MAY03-C18711_1.pep
MAEAANGKEDAKRTGLEGTGLPLQGGSHGNLRSAGSDQQLRQMLDSLKSSKSPAVINYGASWCRVCSQILPSFCKFSDKFKNLTFVYADIDECPETTQNIRYTPTFHFYRDGERVDEMLGTGEERLHDRLWLHS

SEQ ID NO: 37191 - protein, 110 aa, Sorghum bicolor
  Clone ID: SORBI-28MAY03-C18744_1.pep
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLFYERKKYGFKKR

SEQ ID NO: 37192 - protein, 207 aa, Sorghum bicolor
  Clone ID: SORBI-28MAY03-C18747_1.pep
MAVALALAVALAVASLHAEAVWLDVPQSGTKCVSEEIQSNVVVLADYSIMFESHPHSHPTIAVKVTSPYGNTLHHSENATVGQFAFTTAEAGNYLACFWIDSAEKGSGVSVNLDWKIGIATKDWDAIAKKEKIEGVELELRKLEVAVQAIHQNLIYLKEREAEMRTVSEATNARVVWFSTLALWVCIAVSVLQVWHLQGFFRKKKLI

SEQ ID NO: 37193 - protein, 100 aa, Sorghum bicolor
  Clone ID: SORBI-28MAY03-C1880_1.pep
KVMSLQRFKVSVANAVINAENSSLKTMNTDQLLDLFTSTPASRKASVLPRGSSDEQSKDSKRKSGGKGLKSILNGLDELWDQSQYAVEYDLNQFLAKLNG

SEQ ID NO: 37194 - protein, 120 aa, Sorghum bicolor
  Clone ID: SORBI-28MAY03-C1957_1.pep
LTVFLSIIAAQGLGLVIGATLLDIKKATTLASVPVMTFMLAGGFFVKRVPPFISWLRYLSFNYHTYRLLLKVQYDPVPDILTTTKHMDNGATEGAALVAMIIGYRVLAYLSLRRVKGGSS

SEQ ID NO: 37195 - protein, 122 aa, Sorghum bicolor
  unsure (1)..(122): unsure at all Xaa locations
  Clone ID: SORBI-28MAY03-C1965_1.pep
GLPLXLFXXXGLPFWSLRVXFGGXLPLLXLPQRRPVDAAERRQRGGAGAARRPRNAEVEGVQRSAAACARDDAARGASAREGLQQAVAGVNAMADGASGEASAAALRAMVALLAGPFSCYHA

SEQ ID NO: 37196 - protein, 147 aa, Sorghum bicolor
  Clone ID: SORBI-28MAY03-C19708_1.pep
GGGGTARLLGEAGWTPDQWGHSKSRSAFSPDYNTYRQQLANLMRTLLKNLSEHPDAWPFKEPVDSRDVPDYYDIIKDPIDLKTMLRRVDSEQYYVTLEMFVADMKRMFSNARTYNSPDTIYYKCATRLENFFSTKIASLVSQASTKS

SEQ ID NO: 37197 - protein, 88 aa, Sorghum bicolor
  Clone ID: SORBI-28MAY03-C19913_1.pep
QEQNDGTDAVDIQKSSYSVSCRRLQYAGKSEDDLLKEVNDTKQFVVTSLATLSAQFPGRFGPVIEQHVDPANKSVLLQLCAAYNANIV

SEQ ID NO: 37198 - protein, 254 aa, Sorghum bicolor
  Clone ID: SORBI-28MAY03-C1992_1.pep
MATRVLLMLRETSPWALAGAAASVALLWLVAWTLEWAWWTPRRLDRALRAQGLKGTRYRLFTGDLRETARVNREARKNPLPLGCHDIAPRVQPMLHSAMKEYGKLSFTWFGPTSRVMFPDPELVKEVLSNKFGHFGKPRSSRIGKLLANGVVNHDGEKWAKHRRILNPAFHHEKIKRMLPVFSTCCIETIIRWENSMPSEGSSEIDVWPEFQNLTGDVISRTAFGSNYQEGRRIFQLQGELAERLIQSIQTIFI

SEQ ID NO: 37199 - protein, 160 aa, Sorghum bicolor
  unsure (1)..(160): unsure at all Xaa locations
  Clone ID: SORBI-28MAY03-C1904_1.pep
FAVKLESKKWPSELTSRLFFRFVVLALGGVTGFQALMLQGMKMTSPAIASAMPNLAPGFIFVISGCLGFERVDLKCRYTRAKILGTVVCLGGAVAMSFLQSPDARSGHVLPRSPDHAASWVVGCVCLLGAVLVLSGTIVMHAATMLLFXAPFTLCSVTSL

SEQ ID NO: 37200 - protein, 139 aa, Sorghum bicolor
  Clone ID: SORBI-28MAY03-C1909_1.pep
VRFNLPGQYFQDVNSGGDIGEAHIAKLTGFRLFCLLNATALFISLAVVVVQITLVAWETGAQKQIIKIVNKLMWTACLSTGAAFISLAYVVVGPQHAWMAFTVSAIGGPIMIGTLLFLDYLLVRPRVKVGEDRQRRIKR

SEQ ID NO: 37201 - protein, 252 aa, Sorghum bicolor
  unsure (1)..(252): unsure at all Xaa locations
  Clone ID: SORBI-28MAY03-C19153_1.pep
MFLSNKLSIADVDLKGKRVLIRVDFNVPLDSDKNITNNQRIVGALPTIKHAVDNGAKAVILMSHLGRPDGKPNAKYSLKPVVPELEKLLGKSVTFTDDCVGKSVEDTVNGASGGQVILLENLRFHAEEEGSYIEDEGKKQNKDKSKIEEFKAHLAALRNVYINDGFVTVHRAHSSTHGVHSPMVASGFLVKKELDYFAQALEYFKRPFLETLRPFLASVGGALIDDQIELIDSLIIXVNTLFIFGGMAFTFK

SEQ ID NO: 37202 - protein, 118 aa, Sorghum bicolor
  unsure (1)..(118): unsure at all Xaa locations
  Clone ID: SORBI-28MAY03-C1919_1.pep
VRLKRRPXCFLAFVYTAIVAILKSYPSAGDSALYLGLLGLFVNELAEMQFTFFLFFGYIGVSLLSPVMHNLWIWRGTGNANFYFATGLAYTCLQTVLLVESVSSMIKHDRKLRLLVTS

SEQ ID NO: 37203 - protein, 238 aa, Sorghum bicolor
  unsure (1)..(238): unsure at all Xaa locations
  Clone ID: SORBI-28MAY03-C19277_1.pep
MSPPPSPLVVLPLLLLLAAVSHFAANVAGAGAPPPVPTPWPEQFHAVVFTNLTESGGRLQLIDLYYDWPRGRNLNLIRDQLSGDPLYDVEWTNGTSYFFDSGSCRTVRVPVGLLPPDWLAAGAVYLGREHVDGFDCHLWTKVDFIWYYEEVATGRPVRWNFFNGMQQHVMSFEVGGVLEDSKWQAPAYCFXGGNADTANVAADGVDSDAGRSSRVDVDVMNSLIRFAGAPAVAASFDQ

SEQ ID NO: 37204 - protein, 157 aa, Sorghum bicolor
  Clone ID: SORBI-28MAY03-C20061_1.pep
MQFTTIASLFAAAGLAAAAPLESRQDTASCPVTTEGDYVWKISEFYGRKPEGTYYNSLGFNIKATNGGTLDFTCSHSADKLEDHTWYSCGENSFMDFSFDSDRSGLLLRQKVSDDITYVATATLPNYCRAGGNGPKDFVCQGVADAYITLVTLPKSS

SEQ ID NO: 37205 - protein, 189 aa, Sorghum bicolor
  Clone ID: SORBI-28MAY03-C20136_1.pep
DIYLVNPHQSADSVHYSTKLDHATRRSGYNTIAGSTTTTRFVPWTRRGFNRPQIVRGHRTPTADANLTAQRRLPRERERKRRCRRRPSQHRRRRPSSLRGRRRASRGRRSAGPPGSARAPTRRAGRTPPMSACRRCRTSPGSTWWRICWDLPLSLGSAPEVPEGKLVSLTCCGLVGDQRLAPGRRPALE

SEQ ID NO: 37206 - protein, 134 aa, Sorghum bicolor
  Clone ID: SORBI-28MAY03-C20159_1.pep
MAGENKVFGFEEVAKHNVTKDCWIIIAGKVYDVTPFMDEHPGGDEVLLAVTGKDATADFEDIGHSDSARDMMEKYHIGQIDASTIPAKRTYVHPQQAPSHADKDNDLLIKILQFLVPIMILGLAFGIRQYTKSE

SEQ ID NO: 37207 - protein, 146 aa, Sorghum bicolor
  Clone ID: SORBI-28MAY03-C20077_1.pep
RRRPYCNCLIDVCRNHGFPPQRAREVFHLAQTYGLYTKLQSRKDEEWSLDLRSLSVGAAKTAFDDWMQTVSERWVQQKALPESFSVYTGSSTHKFAQGLASAFAAHLEQMAVPFHASESQAGSFISSRDDLVSWLQMSSSSAVVAG

SEQ ID NO: 37208 - protein, 124 aa, Sorghum bicolor
  Clone ID: SORBI-28MAY03-C20178_1.pep
PMGTSCRRLASYGYRCCRMHGMHLRARAPIGQQTLCTHLICLACCLPGSACTPLSVSNATAARRRRRRAVWPALATCRSYILYVLCSVCTDRSDFGSRAVWTRAGAPRVVARRNCVVETRMHAA

SEQ ID NO: 37209 - protein, 138 aa, Sorghum bicolor
  Clone ID: SORBI-28MAY03-C1943_1.pep
SDLCGLKLIKKISLQSNRLTSMDGFQECTALEELYLSHNGIQKMEGLSTLQNLRILDVSSNKLTTIENIETLTRLEDLWLNDNQIPSLDGIETALAGSREKLTTIYLERNPCAKTPEYSSTLKKIFPKLEQIDSDIIA

SEQ ID NO: 37210 - protein, 128 aa, Sorghum bicolor
  Clone ID: SORBI-28MAY03-C19495_1.pep
MQIFVKTLTGKTITLEVESSDTIDNVKSKIQDKEGIPPDQQRLIFAGKQLEDGRTLSDYNIQKESTLHLVLRLRGGIIEPSLKALASKYNCDKMICRKCYARLPPRAVNCRKKKCGHTNQLRPKKKLK

SEQ ID NO: 37211 - protein, 110 aa, Sorghum bicolor
  Clone ID: SORBI-28MAY03-C1949_1.pep
EDCEFADPAGSFRGLRRFKRNCNNFGSLLEKSNMKLTKWEDMEDKSIGHWRFSCVMSFPWRPILSATGYTEYYFDAESGKVCRHVENWNVPKMALLRQIFRPSRWVWEKR

SEQ ID NO: 37212 - protein, 100 aa, Sorghum bicolor
  Clone ID: LIB3481-001-Q6-K1-E12.pep
MGGHGAMLVIGDEKQTNKNPLIGAAALVASGSQDKSIGHWRFSCVMSFPWRPILSATGCAEYYFDAESGKVCRHVENWNVPKMALLRQIFRPSRWVWEKR

SEQ ID NO: 37213 - protein, 143 aa, Sorghum bicolor
  Clone ID: SORBI-28MAY03-C19535_1.pep
MAMASVPAAPSSYGCAACGADLNLSAAHLYPADFYFEAGNKGTLSFSWVDESRLRFAPEDRIRPFFETLDYWGIQRKRTRISCDACGCLLGYVYDDGPPVMQGTGQFGMGPSQVIPRRPRYRFKIKAVAATSSPPAAAAAYGK

SEQ ID NO: 37214 - protein, 103 aa, Sorghum bicolor
  Clone ID: SORBI-28MAY03-C19532_1.pep
MVYVDSWDEFVERSVQLFRADPNATRYVMKYRHCEGKLVLKVTDDRECLKFKTDQAQDAKKMEKLNNIFFALMTRGPDADISEVSGKEQAEQQQSKKGRGRRQ

SEQ ID NO: 37215 - protein, 200 aa, Sorghum bicolor
  Clone ID: SORBI-28MAY03-C1920_1.pep
KISIPCLNALFAPYEIAGFVHTAFNFFYEAGIGKGNIQGMIPQGALVRIVQKGLQYIELEANSEIGNDDEHHFFESLDLMANDLDDLMKKITSSGKHSSVKNEKEQKIDSVETDKAQMIGFSETTTTYRKQPVQKTKAAQNSKPDETATMRRAEPVKHVKAQNINSAETVQNTSSVEATAGLGCHLSWIGRKPRLRKRKH

SEQ ID NO: 37216 - protein, 119 aa, Sorghum bicolor
  Clone ID: SORBI-28MAY03-C20440_1.pep
RGKHPRKWLALPASSGFPLNGCMPRVAWQQLGTSSRRTRNTSTSLRHGGCCVNDGRRRVVVVVRLLLLLLQPTPPPAWKQQDPAMADRAAAAPGRGALANPEAGVNGLAVVGVVSTRPA

SEQ ID NO: 37217 - protein, 305 aa, Sorghum bicolor
  Clone ID: SORBI-28MAY03-C20702_1.pep
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGQ

SEQ ID NO: 37218 - protein, 120 aa, Sorghum bicolor
  unsure (1)..(120): unsure at all Xaa locations
  Clone ID: SORBI-28MAY03-C2069_1.pep
ARGPPPPPRPPSPPPLPPPPPPPPPPPPPPAPSPPXPPPPPPPPPGRGGGAPARAAAAGGRGATARRCAGARGWVARVVVDGAAPVVGFLRYDALRPPLRRCAPPPCPISLCSELQSTFH

SEQ ID NO: 37219 - protein, 225 aa, Sorghum bicolor
  Clone ID: SORBI-28MAY03-C20719_1.pep
MATMFARPLLAALLLPAFLLSAASAADSKDNPADQLVALINSNRTASKASAVSDNQGLGCIALQYIRAYEGHCDQVDDKKPMESSFTDTFAPTCGVQATTLSKITGRLVGCQSKYATPAEAFNILVNDAKGLQILHSKNHTEVGAAVSGTDGGGPYFWCVLFSDGKPTTSFKVDGEVPKAAIHPGCFSGNNDDCMGATNGAISTNAGASRLVAALPFAVACAFAL

SEQ ID NO: 37220 - protein, 134 aa, Sorghum bicolor
  Clone ID: SORBI-28MAY03-C20746_1.pep
FSSNTYIFSFAVGGNWWPLVVVLPHGFVAIVVAGARRQKGGIRHPGGILGMRNTSLWSVAPGRPPRASTPRPRSVEVCVGTSRANTTTWRWLASASASRNRQQALSTKSLGPIVMSTSILQAGASSKPYGVGRH

SEQ ID NO: 37221 - protein, 188 aa, Sorghum bicolor
  Clone ID: SORBI-28MAY03-C19819_1.pep
MALLRVLRRALPALSSPAAVLPRRAPYPLPRPPAPLRFLDPIGLRPFSAAAAVTASQAPSMGSTLFGGLMDTRFPKRRPGFANRRKRASLRPKGPYYWVKCKPDEPIPASQPNQGSVRGRKEKKRIKQRKDFIMAEKKKRRAQYSAAVKRKEAERTERKMAAVARDRAWAERLIELKQLEEEKKAAMA

SEQ ID NO: 37222 - protein, 188 aa, Sorghum bicolor
  Clone ID: LIB5051-001-Q1-XP2-A2.pep
MALLRALRRALPPLSSPAAVLPRRAPHPLPRPPAPLRFLDPIGLRPFSAAAAVTASQAPSMGSNLFGGLMDTRFPKRRPGFANRRKRASLRPKGPYYWVKCKPDEPIPASQPNQGSVRGRKEKKRIKQRKDFIMAEKKKRRAQYSAAVKRKEAERTERKMAAVARDRAWAERLIELKQLEEEKKAAMA

SEQ ID NO: 37223 - protein, 250 aa, Sorghum bicolor
  unsure (1)..(250): unsure at all Xaa locations
  Clone ID: SORBI-28MAY03-C200_1.pep
MKVGSDRHAQLEQEVVERVDVAIRSAEELWAVKFINFIVGTNQLMFEGMTREIPVIGFVEGSWMIGIIDEIKMPTVGVSLQPMLVDTKTRSTRTIPSEARKSSGRLQLMCYKYLWDNLTTQKFPAENFFSYFDLDPNYLLSDDVKGYINSLGFNAKTFEXLLKYFKVTCHTLPRSQEQLLLRYELQEDHSLLEAYGFTYDARWFKDQIQEVLSFWIGSHEPKFVAEEERWKCRFCKFVSDCPMTASMPRF

SEQ ID NO: 37224 - protein, 89 aa, Sorghum bicolor
  Clone ID: SORBI-28MAY03-C19996_1.pep
RRAAMAADAPTAAAALELHTLEERSVAAPNKPLAHSRLLAEDGRPQDEVRRRRRHGRRPRGVSRARRAPRPRWMRACFSVCLIAVILGA

SEQ ID NO: 37225 - protein, 145 aa, Sorghum bicolor
  unsure (1)..(145): unsure at all Xaa locations
  Clone ID: SORBI-28MAY03-C20044_1.pep
MMGENKWMGKRWEDMDTDVLVKIFKELNLVELSPVSQVCRLWRSACSDPLIWGTLDFGLLKSNFIQTRASPYIWVDDRSDKRLARILRVAMAISCGNVNCMIFHYNLFMKDEHLHFISERSPHLKRLVMPAWDRITKXAICQAIQ

SEQ ID NO: 37226 - protein, 250 aa, Sorghum bicolor
  Clone ID: SORBI-28MAY03-C20083_1.pep
MYFRPPPKGPEWYAGDAETGQAARPLYPMMLEDPRLRWSFIRKVYSILSIQMLLTVAVAAVVVYVRPIALFFVSTPGGFGLYIFLIILPFIVLCPLYYYYQHHPVNLLLLGLFTVAISFAVGLTCAFTKGEVILESAILTAVVVLSLTAYTFWAAKRGHDFNFLGPFLFAAVMILMLFALIQLFFPLGRISLMIYGGLAALVFCGYIIYDTDNLIKRYSYDEYVWAAVALYLDVINLFLSLLTLFRAADS

SEQ ID NO: 37227 - protein, 152 aa, Sorghum bicolor
  Clone ID: SORBI-28MAY03-C21052_1.pep
KKMRGNAPERLVSGSDDFTMFLWEPTISKHPKARMTGHQKLVNHVYFSPDGQWLASASFDKSVKLWNGITGKFVAAFRGHVADVYQISWSADSRLLLSGSKDSTLKIWDIRTHKLKMGLPGHADEVYTVDWSPDGEKVASGGKDRVLKLWMN

SEQ ID NO: 37228 - protein, 204 aa, Sorghum bicolor
  Clone ID: SORBI-28MAY03-C2087_1.pep
HAALAPALAPSRSPPPPLALSLSLAPARSLAPSLSLRRLGGSPPSRPRPPAATASCPASALQCPVLAPPPAPRSVAAAGPPVAPKPPALVQATPLGSEPAAELPQRPKPLPRIGDLPLEARRPPSMVQRPRMVRAASLWPRPLPRLRVWWLPRVPRWPPSIWDTLTYVCASLFVDRLAASARRAVVAQCTNFSVQNLRHDTYKM

SEQ ID NO: 37229 - protein, 143 aa, Sorghum bicolor
  Clone ID: LIB3481-003-Q6-K1-D5.pep
MALLLSPTVSFLVSPAAPRSRALSTAANVSYPASRLQCKNLSSLQSPLNVTATCASFAEKRPVLVHATADGSEAGAEQPEEPKPVTKIEDMPLESKQKMIMEQRARMKLAKKLRQRRKRLLRKRKLRKKGRWPPSKMKKLKNV

SEQ ID NO: 37230 - protein, 167 aa, Sorghum bicolor
  Clone ID: SORBI-28MAY03-C20927_1.pep
NLKFTMVSFTALALLATSAMAGPVARQIAIPENWDWQVENWEAGCGRSGCYYNFNVTVPTIKGEILGVKAYCHGYEQGYDNSFTVPSTYETCQLLEGVNNGVAARFSLRENDGQGFGPKEIEVSFLFAGYEDRPAYNFSGSHEARYNQFVAPQLNFTITPTKVFGIA

SEQ ID NO: 37231 - protein, 79 aa, Sorghum bicolor
  Clone ID: SORBI-28MAY03-C2107_1.pep
KTILPDRSLAPHAWKANTFINIILGIKERESLSQMLIFDSTDVDRFRTLAFQVHCRKSKSLMLLGKNWIDCLYKYTSNQ

SEQ ID NO: 37232 - protein, 77 aa, Sorghum bicolor
  Clone ID: SORBI-28MAY03-C21128_1.pep
CGAQAAGCTRVVCKEQVEAVIDKIIEKARTGEIGDGKIFLIPVSDVVRIRTGERGKEAERMTGGLSDRLLSSVVSIS

SEQ ID NO: 37233 - protein, 207 aa, Sorghum bicolor
  Clone ID: SORBI-28MAY03-C20276_1.pep
MASRILARSKALNLAAALNRAAADAAPPIAGARALSSLPRYPSAPSPHALGKFLGYEPTSHLSGAQVLPRWFSSLASNGSQMQKSQISETYKSSEEATPKVMAFSPLEAAIAKPRSSPLTSESSKVRRSEMASKITFYMIPAMLLVSKNSISTSLMVGAVFHQVYMFHKEILLDYVHHDITRKWALIYLKLLLLVMAKDTIMYFNLF

SEQ ID NO: 37234 - protein, 117 aa, Sorghum bicolor
  Clone ID: SORBI-28MAY03-C2025_1.pep
RPLHSFVQSFEMAQQKVVLRVPTMTDDKIKQKAIEAVADIYGIDSIAADLKENKMTIIGEMDAVAIAKKLKKIGKIDIVSVGPAKEEKKEEKKEEKKEEKKEEKKEEKKEEKKEEKK

SEQ ID NO: 37235 - protein, 94 aa, Sorghum bicolor
  Clone ID: SORBI-28MAY03-C2023_1.pep
WSMEVGPNEVVGWAQSKVIKLTELPPGDPIDSLSLTGFAHGLDVILVCTLEGIFTIDPKSVRVTKVCQDSSLACFTFPYMSFYTPALGAAASAE

SEQ ID NO: 37236 - protein, 80 aa, Sorghum bicolor
  unsure (1)..(80): unsure at all Xaa locations
  Clone ID: LIB3481-002-Q6-K1-E11.pep
PLGPPSPLGFKGPLVMISNVFFKXXQLFSMSXXTSHGCWPPRSTFCARDHILCLCEVCLGLSAKLTLCMYYSTPRVRSIP

SEQ ID NO: 37237 - protein, 116 aa, Sorghum bicolor
  Clone ID: SORBI-28MAY03-C20362_1.pep
ASSEGAQKYPTLMGLATLCLDFGKNPEPEPGRCRRTDGKKWRCWRSTIPNEKYCERHMHRGRKRPVQVVVEDDEPDSASGSKSTPGKATDGAKKADDKSPSSKKLAVAAPAAVQST

SEQ ID NO: 37238 - protein, 169 aa, Sorghum bicolor
  Clone ID: SORBI-28MAY03-C20314_1.pep
MARFFLRWALAARSLPAPSFQPSSRAEHMSKLPSLVCKIKGARTLVSYFPPVPGQQGAEQQATPSSAQGRQNAQAPTPRSQGFSFAPPATAGLRSLLTVTGASNTATDPQDQQDSETTPPPASVPTPESGFKVRDTSNLKISPRHDLAMIFTCKVCETRSMKMASKDSY

SEQ ID NO: 37239 - protein, 204 aa, Sorghum bicolor
  unsure (1)..(204): unsure at all Xaa locations
  Clone ID: LIB5052-004-A1-XP1-E11.pep
RPVXEVFHRSRLFETPTRDRRRPSPPPALLSAPALRRRPPPASALGSAMARVFLRWALAARSFQPSSRAEHMSKLPSLVCKIKGARTLVSYFPPVPGQQGAEQQATPSSAQGQQNAQAPTPQSQGFSFAPPATAGLRSLLTVTGASNTATDPQDQQDSETTPPPASGPTPEAGFKGRDTSNLNTSPRQRPRHDLYVQGVRDPIY

SEQ ID NO: 37240 - protein, 129 aa, Sorghum bicolor
  Clone ID: SORBI-28MAY03-C20591_1.pep
PQMVEIPRSTFNFDFEYERRILAEAEKENPNWTKFVVERQAPPPVAQQARPASSGDPVVGRYVSMGLGREAVSFAVLNYGDNPTKVKEFVKSYNILHEMGFTSPNVPELLAIHDNDPDKVIQRLLSSPS

SEQ ID NO: 37241 - protein, 345 aa, Sorghum bicolor
  Clone ID: SORBI-28MAY03-C24992_1.pep
HEGRFFLKQHWTDGEDDVKDSIKHKPLWESYMPKNKKERRGTGKKKHGSLYRTYGTRVIPVFVLSLADVDAELLMEEESLVWASKDVVIVLEHNNEKIPLSYVSETTRQFALPSLAQRHILAGLASAVGGLSAPYERASRIHERHVVNWLWAAGCHPFGPFSNSSQISQILQDVALRTTIYAQVDAALRKIRDTSEVLHAFPPALLKTPLGELVKGNKNKSTTELWVEKFYKKVTTLPEPFPHDLVEKLEEYLDKLEGQLVDLSSLLYDHRLADAYQNSTDILQSTIFTQQYVERVLANERDRMKCCSIEYSHPKQSSQAFVYGGILLAGFLVYSLVIFFSSPVR

SEQ ID NO: 37242 - protein, 147 aa, Sorghum bicolor
  Clone ID: SORBI-28MAY03-C2132_1.pep
PSAESREGERVRGRARGEEEVRGRDGARGATGRREVERRGSVRGRRARGLRRRGRQHVRQHRSAAVERGDHGRRARLEAEAAGARGRAVPVGHGVQGRGFVVLRGAPEGNHVVRRRQLQKDRRRRRHRRGVLGRRRWQRRSGRLARS

SEQ ID NO: 37243 - protein, 122 aa, Sorghum bicolor
  Clone ID: SORBI-28MAY03-C21381_1.pep
RLAGLYKIDRGAHVFWLRKGTLDTRPDHIINQIHYEDAASLAVAIMKKRLRSRIFLGCDNKPLSRQEIMDAVNKSGKFDTKFEGFTGTDGPLGKRMENSKTRAEIGWEPKYPSFTEFLGISS

SEQ ID NO: 37244 - protein, 230 aa, Sorghum bicolor
  Clone ID: SORBI-28MAY03-C21469_1.pep
MSAPSDAAAAVAAPAPTTTAAASSSGGFTFKLHPLVIVNVSDHHTRVKAQAACSGDSSSSSSAAGSGQPPRVFGCVIGVQRGRTVEIFNSFELVLDPVSGTLDRAFLEKKQELYKKVFPDFYVLGWYSTGSDVHETDMQIHKALMDVNESPVYLLLNPTINLSQKDLPVTIYESELHVIDGSPQLIFVRSNYTIETVEAERISVDHVAHLKPSDGGSAATQLAAHLTGIH

SEQ ID NO: 37245 - protein, 232 aa, Sorghum bicolor
  Clone ID: SORBI-28MAY03-C21448_1.pep
MAEDATSSHPSRYVKLTKDQDAPTEDIRPGELNQPVHVPQLEGRRCSECGQVLPESYEPPADEPWTTGIFGCTDDPETCRTGLFCPCVLFGRNVEALREDIPWTTPCVRHAVFVEGGITLAILTAIFHGVDPRSSFLIGEGLMFSWWLCATYTGIFRQELQRKYHLKNSPCDPCMVHCCLHWCANCQEHRERRGRLAVGLGCPMTFVNPTSHSEMSMSENRGPAALETEQQR

SEQ ID NO: 37246 - protein, 88 aa, Sorghum bicolor
  Clone ID: SORBI-28MAY03-C21512_1.pep
MAMRLAAAAAFVRRLVPARPPVPVLAAASTAEAEAVTCGRGDKKTKRGKRFKGSYGNARPKREKKIERIKDRVEVPRSTPWPLPFKLI

SEQ ID NO: 37247 - protein, 222 aa, Sorghum bicolor
  Clone ID: SORBI-28MAY03-C27135_1.pep
SSSPSFELAEKVIDACREKLKPVFLQSLKGTSLSEYSQIVASVCEEVSDDREDNNADPSGKDMVDDGKLSERTISDELPQESSKAEQDVSRPEQDGTSMNGNTGTAISSGAAPPDTGESDDQGPPSTKEKIEKLCNDENIADADQLKTDHNEGADFNAAKPKKKAALDSDKSTKNEDLSTPTNCEAIVDSDADTKKGDLVASAEGTNGAADDASRPADSTPT

SEQ ID NO: 37248 - protein, 124 aa, Sorghum bicolor
  Clone ID: SORBI-28MAY03-C27160_1.pep
QLCVLQCNAFRCASFLDRHHLRIRLQLTDYLLLVLVPNPSKGQPETSNRHYRVVDRFPILTSLLTLVSILCPVRRNTMFCSSPLTLMETYFLFMPCCWHTASCFRHCIHLHVLCCCTCKNVACG

SEQ ID NO: 37249 - protein, 198 aa, Sorghum bicolor
  Clone ID: SORBI-28MAY03-C27136_1.pep
MFWRMTGLSAASPVDTILDKENFTLEELLDEDEIIQECKALNSRLINFLRDKAQVEQLLRYVVEEVPEDAERKRSFKFPFIACEIFTCEIDVILRTLVEDEELMDLLFSFVKPDHPHSTLLSGYFSKVVICLMLRKTAPLMSYVQGHPEIVVQLVDLIGITSIMEVLIRLIGADEAIYSNYGDTLQWLENTDVLEMIA

SEQ ID NO: 37250 - protein, 151 aa, Sorghum bicolor
  Clone ID: SORBI-28MAY03-C2713_1.pep
AHTRFLKAQEELKRSQARFERLGDLLASDILKRGANEEVSSINVDEDPNGPYERSPNAATAKKRSILYSTSEEAKAVKKRRERDSDTTRPDKYRSEATIAEFEKPIKGTEPTKSLYLKKKLWEDEKDKIGNFVSSANTDKYEADDEEVDVD

SEQ ID NO: 37251 - protein, 103 aa, Sorghum bicolor
  Clone ID: LIB3481-013-P1-K1-D10.pep
CHDKHSTTQKNQGTTKRLATRGYIRYSTGNRACCLQESKKKVDCLNRIHQGSLMNAFLCKVNSSIKYIGLYTCQSYRSFQYHLDILLSPRRLPHHQPHTARKN

SEQ ID NO: 37252 - protein, 97 aa, Sorghum bicolor
  Clone ID: SORBI-28MAY03-C27230_1.pep
KRLTLQFPLLRFAGAAQIRTSASRTCHTPGLSDLISRLLKRYIRTRSPNRAPSLLPVLCIPLTQDRRIHSSMASHTSCITSQFLLVSTDQNLNFIFL

SEQ ID NO: 37253 - protein, 141 aa, Sorghum bicolor
  Clone ID: SORBI-28MAY03-C21831_1.pep
MSTQSKRLKDVEISFPIVYGTISFWLGKKASEYNSHKWTVYVRSANNEDLSVIVKRVVFQLHPSFQNPTRVVEQPPFELSESGWGEFEIAITLYFHSDVCDKRLDLFHQLKLYPEEEAGPQSTKRPVVVETYDEIVFPEPT

SEQ ID NO: 37254 - protein, 157 aa, Sorghum bicolor
  Clone ID: SORBI-28MAY03-C21832_1.pep
MAVSSISCSLRPPAPVREASARLTPPQPSPPKTTATPWADGLRRACVAAAATAACVVIGTAGGGDVVAASMPRDTPVLAVDARPAAAAPRWSDRRECPPWRANSLENIVPENLPRPSARRRFNTVKRAPRKAPALGRQAVAPPFLALRSGVDDCFTL

SEQ ID NO: 37255 - protein, 85 aa, Sorghum bicolor
  Clone ID: SORBI-28MAY03-C22039_1.pep
MAAAAATATTTVVPRCSKREGDIAGAGTSPNKGKIGRSSPPAEEVEAFLAAAESGMARRFAAKYNYDVVKDAPMDGRYEWVRVGP

SEQ ID NO: 37256 - protein, 63 aa, Sorghum bicolor
  unsure (1)..(63): unsure at all Xaa locations
  Clone ID: SORBI-28MAY03-C21987_1.pep
RGAAAAIASEASLPEPRPRGREREQSLRRERKAAVPXAMRAKWKKKRMRRLKRKRRKMRQRSK

SEQ ID NO: 37257 - protein, 164 aa, Sorghum bicolor
  unsure (1)..(164): unsure at all Xaa locations
  Clone ID: SORBI-28MAY03-C22092_1.pep
PRKSDDKDYGLEALEEIMSVMDSGKIVXIFAGYCDPMKRVITSNDGFCRRVTKFFYFDDFSTTELAEILHMKMMSPSESSLLYGFKLHPSCSIEVIGELIARETTEERWKQMNGGLVDTLLINARENLDSRLDFNCDDTDTMITIMLEDLEAGLRQISRQRQLQ

SEQ ID NO: 37258 - protein, 154 aa, Sorghum bicolor
  Clone ID: SORBI-28MAY03-C21158_1.pep
QTPAKSQSTDAQSTLVYICTGEWAHCTHSPTSSQVFTVLISSRLVHNYDRYSRFYQRKKIRQRQMITDTNCLNRYHEAKIGDQCRGKWVTQQRERMTMQEISSLLFLANASVVNRFAAAWGSLIDFTRSTASWFFITFHNPSLGRMTNSIFELI

SEQ ID NO: 37259 - protein, 113 aa, Sorghum bicolor
  Clone ID: SORBI-28MAY03-C21099_1.pep
MEAMEGLIPFIYKAVKERRTRSYYSRCNSTGSSRGRFLGARVEDSSWDQQKQWDRSAGGKATTAAEREMVAHRRHRSLEELAGEVGASPEWRRRLGALPRGRSVRIFSCIRGM

SEQ ID NO: 37260 - protein, 250 aa, Sorghum bicolor
  Clone ID: SORBI-28MAY03-C21218_1.pep
MADYHFVYKDVEGRSTEWDDIQRRLGNLPPKPEPFKPPPFAPKVDADEQPKSKEWLDEREPEELEELEDDLDDDRFLEQYRKMRLAELREAAKAARFGSIVPITGSDFVREVSQAPSDVWVVVFLYKDGIPECGLLQNCLEELATRYPATKFVKIISTDCIPNYPDRNVPTILVYNNSAVKGTYVGLQKFGGKRCTPESVALALCQSDPVLNDGHGGSDSSRDNVIEGVRRKFIEKVVAQHEEREEEDSD

SEQ ID NO: 37261 - protein, 119 aa, Sorghum bicolor
  Clone ID: SORBI-28MAY03-C21275_1.pep
MALRGVWQLQKLVVNYCDWGGSSRGIRAFMEAHLPAFKEKNPHLEVVTELVRGQHPNLKGIYKNHNERVVCVRNLPPEEILLQATRLRNSLGRKVVKLRTRHVTKRPSVQGTWTTELKM

SEQ ID NO: 37262 - protein, 236 aa, Sorghum bicolor
  Clone ID: SORBI-28MAY03-C2129_1.pep
MSVSRFVLTVLVVASVCTAAAPRALAVRELARVRESAAVAAAMVSRHEKWMAEHGRTYTGAAEKARRLEIFRANAEFIDSFNDAGKHSHRLATNRFADLTDEEFRAARTGFRPRPAPAAAAGSGGRFRYENFSLADAAQSVDWRAMGAVTGVNDQGECGCCWAFSAVAAVEGLNKIRTGRLVSLSEQELVDCDVNGEDQGCEGGLMDDAFQFIERRGGLGLESGYPYQGDDGSCRS

SEQ ID NO: 37263 - protein, 217 aa, Sorghum bicolor
  Clone ID: SORBI-28MAY03-C22378_1.pep
EGAQLIGRHDEATIFTLRQLAEATKNFSEDYLLGRGGFGCVYKATLSNGQVVAVKQLDLNGFQGNREFLVEVLMLNLLHHPNLVNLHGYCVDGDQRLLVYEYMPLGSLEDHLHDLAPDQEPLDWRTRMKIAAGAAAGLEYLHDKANPPVIYRDIKPSNILLGEGYHAKLSDFGLAKLGPVGDKTHVTSALVLTCHCKDAYFAYILKDNCGYRRIVRR

SEQ ID NO: 37264 - protein, 94 aa, Sorghum bicolor
  Clone ID: SORBI-28MAY03-C22593_1.pep
MAGLVKIGTWGAGDHGSAYDITVAPQRLESISLRYGKIIDSISFSYRDRDGKLHAAGPWGGAGGVSDEVITLGAHEYVTEVSVYTCDPPHAPTR

SEQ ID NO: 37265 - protein, 188 aa, Sorghum bicolor
  unsure (1)..(188): unsure at all Xaa locations
  Clone ID: SORBI-28MAY03-C22511_1.pep
LTSIDPAFSPPRPQHIQERTIPRHADRLHPGTGGDAPRRRDNDRAPPPAAAAHGAAVSPGADDDDDGQEQGRQAXTKLLVNVTVDRSLWPVHLVLDADATVADLVRAAVAAYVREGRRPPLQTGTPADATDGFELHLNKYSLESMSMEVLLLYVGXRCFLLCLRAQATRACPRAHAAFLALLASLIII

SEQ ID NO: 37266 - protein, 116 aa, Sorghum bicolor
  Clone ID: SORBI-28MAY03-C22644_1.pep
MASEQSLHMKTGEGEASYARNSTTQNAGQNRMKHLIQEAVRSLWKNTNTRKSVVITDLGCSAGPNALTLVKTAVDAIFHHCSDHKEMVPEISVLLNDLPDNDFNDVAKRLHAFQQS

SEQ ID NO: 37267 - protein, 134 aa, Sorghum bicolor
  Clone ID: SORBI-28MAY03-C22647_1.pep
MAASSLSLPVPATQAALRHGPALPRRSPAAATRCAALRRDASGGRGQYGGALVDEGMSVLRRRIREARMAETNYEAPAEWAPGEKRYYPAYVSDVSSLVGALQLLLMGTRPGVAIAHHLALLADVVLQAGNPIS

SEQ ID NO: 37268 - protein, 204 aa, Sorghum bicolor
  unsure (1)..(204): unsure at all Xaa locations
  Clone ID: SORBI-28MAY03-C2156_1.pep
RPKMSTNLGGAPCCCFRLSQLQPAAVRLRLPPARATDTSASQSPARLRAVLEQVDQALSKGNDEAALALVRSSQGVSGGLRAFGAARQVPQRLYTLDELKLNGIDTSAFLSPVDLTLGSIERNIQIAAILGGLSVSAALELSQLQILFLILGLLSLWSVEXVYFGGGVRNLVLDTIGHYLSQKYHNRVVQHEAGHFLIAYLLGV

SEQ ID NO: 37269 - protein, 142 aa, Sorghum bicolor
  unsure (1)..(142): unsure at all Xaa locations
  Clone ID: SORBI-28MAY03-C21596_1.pep
PEPCLPAEEIRNSPAAATEKAXISVHSNSSPRQQSIVVQNNLAQARSTPLKAGKNIIGSKKVRAAVAFPFELIKPCSFSGDITLNDINKKLHAPPPYKIRHKSNEEPNSLQASAMTGKPVVHKTKIHTEGGRGSITITRTRG

SEQ ID NO: 37270 - protein, 82 aa, Sorghum bicolor
  Clone ID: SORBI-28MAY03-C21619_1.pep
MGGDHGGGHAGGDFRQKVWSMTGGPYCRPVHWRRNTAIAMFGVFLICIPIAMKSAELEQRPHHPVRPIPSQLWCKNFGKKEY

SEQ ID NO: 37271 - protein, 69 aa, Sorghum bicolor
  Clone ID: SORBI-28MAY03-C21765_1.pep
PGRRQIEKDTEKAMRMTTRQTLTEIWRSGGMKGLFTGVGPRVARAGPSVGIVISFYEVVKCALHQRNTS

SEQ ID NO: 37272 - protein, 213 aa, Sorghum bicolor
  Clone ID: SORBI-28MAY03-C21625_1.pep
PGPQQGNFQTNRSQQDGRGYAPQRNYAQGGQDGRGFGRNDYADRSGYNGPPGGFQGQAQYQGHVNPAGQDQGYNNPQERRNFPQGQGGGYRPGGPSAPGSFGQQSAPGSFGQQSAPGSYGRPSAPGSYGQPSTPGSYGQPSTPGSYGQSSTPGNYGQAPPSANPGGRVPGANPSYGGDGRQGTGPAYGGDNWQRDSGQYPSPGEGQGNWQGRQ

SEQ ID NO: 37273 - protein, 50 aa, Sorghum bicolor
  Clone ID: SORBI-28MAY03-C21685_1.pep
RFGQGTNVDKAEEEKRKARAARFGDTSSGSAQENGKDSSKLDAAAVTGTA

SEQ ID NO: 37274 - protein, 190 aa, Sorghum bicolor
  unsure (1)..(190): unsure at all Xaa locations
  Clone ID: SORBI-28MAY03-C2323_1.pep
RPRTRGLCLGTKLEHVIXAQLAHDVAEKHPAIEGDVIVKPSDEXFWFGKPRIILYLIHFILFQNAFEIAFFFWILSTYGFDSCIMGQVRFIVPRLVIGVVIQLLCSYSTLPLYAIVTQMGSCYKKEIFNEHVQQGVLGWAQKVKMRKGLKGAAAASKNESTINADSAGPSVKIEMAKAEGEDVEVVGNTG

SEQ ID NO: 37275 - protein, 72 aa, Sorghum bicolor
  Clone ID: SORBI-28MAY03-C23326_1.pep
MADGRCCTFLEILLAIILPPLGVFLRFGCCRIEFCICLLLTILGYIPGMIYAIYVLVALDSDRHEREYYTLA

SEQ ID NO: 37276 - protein, 112 aa, Sorghum bicolor
  Clone ID: SORBI-28MAY03-C23412_1.pep
MKLFAFVRRARRSPDAAPEDTATATAVSAAAGKRRRRPSSSSSSSSGSAAAWKPTLGAISEDAAMTAASMAKAQAKPASAPKARARSPRRATRAASYDDDLLHYGQPTVLPA

SEQ ID NO: 37277 - protein, 330 aa, Sorghum bicolor
  unsure (1)..(330): unsure at all Xaa locations
  Clone ID: SORBI-28MAY03-C23438_1.pep
TRKKPPISGRCSFSSPTSAPLSSLPIRTSATMASSKRRGGGGVAGGDKKDLFHVVHKVPAGDSPYVVAKHLQLVEKQPDMAIVWFWKAINSGDRVDSALKDMAVVMKQQDRSEEAIEAIRSFRHPCSKQAQESLDNLLIDLYKKCGKVEEQIELLKQKLKMIYLGEAFNGKATKKARSHGKKFXVSIQQETSRILGNLGWAYMQQNNFEAAELVYRKAQTIEPDANRACNLXGLCLIKQGRHEEARQALEDVRLRRIYGSEDEKVVARAEQLLRELNPLKCVSSPFEVGLSVHEEIMGKLDLMMNEWTPFRSRRLPVFEEIATFRDQMAC

SEQ ID NO: 37278 - protein, 94 aa, Sorghum bicolor
  Clone ID: SORBI-28MAY03-C23331_1.pep
MAAAAAAAPTRTEVLALFRSLLRTAKQFSDYNIREYTRRRAADAFRENRALADAPAAAAAFSEGKKQLEVAKRQALVYSLYAPKAKSVMELKVQ

SEQ ID NO: 37279 - protein, 94 aa, Sorghum bicolor
  Clone ID: LIB5121-002-A1-PF1-A9.pep
MAAAAAEDPTRTEVLALFRSLLRTVKQFSDYNIREYTRRRAADAFRENRGLADAPDAAAAFSEGKKQLEVAKRQALVYSLYAPKGKSVMELKVQ

SEQ ID NO: 37280 - protein, 155 aa, Sorghum bicolor
  Clone ID: SORBI-28MAY03-C23415_1.pep
MEGAGEEARPVLLPPVQELAGQLGAAADVPARYVARAGAGNDDDRKATETAPVPAIDLARLCQPGGDGGAADEASKLRLALQSWGLFLVTNHGMEASLMDAMMDASREFFRQPLQERQKHSNMIDGKHFQIEGYGNDWAPSESEEQVLDWTDRLY

SEQ ID NO: 37281 - protein, 127 aa, Sorghum bicolor
  Clone ID: LIB5121-001-A1-PF1-C2.pep
MEGAGEEARPVLLPPVQELAGQLGAAADVPARYVARAGAGNDDDRKATETAPVPAIDLARLCQPGGDGGAADEASKLRLALQSWGLFLVTNHGMEASLMDAMMDASREFFRQSLQERHKNILLDPTV

SEQ ID NO: 37282 - protein, 152 aa, Sorghum bicolor
  Clone ID: SORBI-28MAY03-C2345_1.pep
VRDAWKRCFVDPCSIAHMARYCIVDSHTWDMMPLSLYFNSTMDQSDPRDENRILLQNSCGGSLSKYLMVASGRMSVFILLARAEKQIKAWDHAVGVICVQEAGGQTCDWRGEPLDFAADQTGRRIIYPWGGVLATNCALHDELVEMITATYN

SEQ ID NO: 37283 - protein, 223 aa, Sorghum bicolor
  unsure (1)..(223): unsure at all Xaa locations
  Clone ID: SORBI-28MAY03-C222_1.pep
PGYDPRRPAMIAVLWEXVFRGTDTVAVLIEWVLARLVLHPDVQARVHDELDRVVGRDRAVTESDSGSLVYLHAVIKEVLRMHPPGPLLSWARLATSDVQVDGHLIPAGTTAMVNMWAITHDPXVWAEPAEFQPERFMGSTTGGEFPIMGSDLRLAPFGAGRRSCPGKSLAMATVALWLATLLHEFELLPSPLPARGVYLSEVLKLSCEMAVPLAVTARPRQAV

SEQ ID NO: 37284 - protein, 50 aa, Sorghum bicolor
  Clone ID: SORBI-28MAY03-C22204_1.pep
MAVGDLAFKALTAGLGVATLYLAATFSVNVYRGLSWHSEQSKLEKAKNED

SEQ ID NO: 37285 - protein, 110 aa, Sorghum bicolor
  Clone ID: SORBI-28MAY03-C22263_1.pep
LMCRAIDAPQLTTAGALRTALVSVFEEPVVDDMAEAQSKAGVEDCVCCATVHGIGPSIGVFDSIKDGKLDWTCMYPSPLHSRKQVQEIFDKVKQILHHAAAAEENFEDCA

SEQ ID NO: 37286 - protein, 157 aa, Sorghum bicolor
  Clone ID: SORBI-28MAY03-C21996_1.pep
RPGFSFHLPFQPALIPHTAQQPGYGAGRGGGPAWTTEPPAAGGGLSHLLVIAAPALMRTASIALAMTTPAPPGWCPNHDVSRTGSGGSIYTTSNDNLHITVDSSSPSPDLAAPVPRRHVRTLDDAVGTGRAAEVPSPSMREWRVIKEHKKGMAMMVI

SEQ ID NO: 37287 - protein, 149 aa, Sorghum bicolor
  Clone ID: LIB5050-011-R1-XP1-A9.pep
SIHLPFQPALIPHTAQQPGYGAGRGGGPAWTTEPPAAGGGLSHLLVIAAPALMRTASIALAMTTPAPPGWCPNHDVSRTGSGGSIYTTSNDNLHITVDSSSPSPDLAAPVPRRHVRILDDAVVDFYFMIDSDVYYRNRQSRRGAKSVYA

SEQ ID NO: 37288 - protein, 196 aa, Sorghum bicolor
  Clone ID: SORBI-28MAY03-C2229_1.pep
FPNSIPSSLGWRWHDDDDGDSGRGLGGVPDLAGGGGEGAQCATRRVVQSRCVREEVEPGRFVRKCEKTEQLLRDCVGRPSELVESKTENTEEDVTEEMKSGSLSLGFPRNEPFAFPGLRSDMEALEKDFFGSLGNVLDEAERMTNSFIKSFGFPPVHDRESSPFRRQPAEKHIEEDTARKTKESDYSEFRSKISDV

SEQ ID NO: 37289 - protein, 102 aa, Sorghum bicolor
  unsure (1)..(102): unsure at all Xaa locations
  Clone ID: SORBI-28MAY03-C23666_1.pep
KSTSSNEETMPCDTYRSATIFHQKQQDKKTTAAPSKTRSRLPTAEDIDAGVAALICEEPTATGSSSPAGSEQVGWWPAPASSAAMSAWMTAVAXSRCRVAFR

SEQ ID NO: 37290 - protein, 143 aa, Sorghum bicolor
  Clone ID: SORBI-28MAY03-C23667_1.pep
MLHPLLAAVTAAVSSSFVSPPRRVPASPGPGRRRRRPGGFAVRCAPNGGGVTAGADTKSKLKVGSPIVIVEAPVMLKTAASVPSLRHNSGQVKAGDVGRIMARKPKDVWVVRLAVGSYLLDGKFFRPLDSDDGDGDEPQAQDE

SEQ ID NO: 37291 - protein, 218 aa, Sorghum bicolor
  unsure (1)..(218): unsure at all Xaa locations
  Clone ID: SORBI-28MAY03-C23701_1.pep
MDSLAAACLCSRRRRARRLLLAAAAATAGYGLYRLYRHHRRRIVAALSLADAVSQVGSDLAEFLRSDSDQVPRSLLQLSKLAASEPVSSAASSLSESLASGVLRAISHQRQLHQQQQQNPQTPLQDRILDRLLSPEGAGFASAVVGSFARNLVLSSXTPARRTPATARSPGGWLRSAAXTGKEAAADLVRVFVSTAVAAYLDRTAAVRTNSQLLAGLS

SEQ ID NO: 37292 - protein, 73 aa, Sorghum bicolor
  Clone ID: SORBI-28MAY03-C23678_1.pep
MNNSTSPAVDWGDDSAGEMDSEDAAPSSSVGMGVGIAISSMMEVDADDRRPPSAPDADFFNAFPDDFDDQDLD

SEQ ID NO: 37293 - protein, 222 aa, Sorghum bicolor
  unsure (1)..(222): unsure at all Xaa locations
  Clone ID: SORBI-28MAY03-C23777_1.pep
MTKVEELAGLGHLLVFAFLFCFSAFMVAPVMTDVTMAALCPGRDECSLAIYLTGLQQAVTGLGALVLTPVVGNLSDRYGRKALLALPATASIVPLGILAYGRTKGYFYAYYVTKTLTAMVAEGTMMCLSLAYVADRVPETRRAAAFGVFSGVCSAGFVASTVAARFLXASSTFQVSAVAAVVTAVYMKAFPQXTDGGALISSSCSSSSSNRRRRGAPGRSAF

SEQ ID NO: 37294 - protein, 270 aa, Sorghum bicolor
  unsure (1)..(270): unsure at all Xaa locations
  Clone ID: SORBI-28MAY03-C23924_1.pep
MGRVIRNQRKGRGSIFTANTRLNKNPAQFRTLDFAERNGYIRGVVKEIVHDSGRGAPLARVTFRNPYKFKHNTETFIANEGMYTGQFIYAGKNAALTIGNVLPLASVPEGTVLTNVEDKNGDRGALGRTSGNYVTVIGHNPDEGKTRVKLPSGAKKVLPSSCRGMVGIVAGGVVTDKPLMMMSRAKHKFATERNSLKASRAKHKFAAXRNSWPKIPTSISVPARPSPGTPPHQKRPVSLTSSRYACSGLTAGLIPARRTGIFRGTQKTKE

SEQ ID NO: 37295 - protein, 116 aa, Sorghum bicolor
  Clone ID: SORBI-28MAY03-C2274_1.pep
GSGTSPAAVAVAPPPHPPHDARGEADGDEQQDVEQRQRAAAAHRRAVRRRLPRPFPAPRLGLMLLVLAVPVLAHAPRSAPDREPAADDSILESPSLGRPGGGPPAGLRSLTRSQES

SEQ ID NO: 37296 - protein, 159 aa, Sorghum bicolor
  Clone ID: SORBI-28MAY03-C22777_1.pep
MASSSSRPMLRRLAELARGRVRANHRMLSSAFPSTAAIERASQSPAEAQAVRMTEGCVRRLKELHAKEPSAEGKMLRLSVEAGGCSGFQYSFALDDKKNSDDRVFETDGVKLVVDDISYDFVKGATVDYEEELIRSAFVVSTNPSAVGGCSCKSSFMVK

SEQ ID NO: 37297 - protein, 220 aa, Sorghum bicolor
  Clone ID: SORBI-28MAY03-C22821_1.pep
GTIADICDQYIDYQDKLYDNENGRLEFRGDNWGALWPGTCKPGLWMNAASRLGVLYNLIIREEELYTQERNKMGETIRLDRDEEIMLVIPPVFNYCTKVLDPKEQIAARDLYWEAICSDDRKERDWEKVEKVLLESIQKNPFVGEPRLVAAQVYLNMERYAEAKEEAEEGLKLLLEWGISWDKRMTWESWVSWGRVMLDKAKENEWPHTAAGIINLGLVK

SEQ ID NO: 37298 - protein, 244 aa, Sorghum bicolor
  Clone ID: SORBI-28MAY03-C230_1.pep
MAAASATRRGLSALLLYSSRALPRRLVPLAASAASAHVAPWALLASRGARTASSGGSGYSPLNDPSPNWSNRPPKETILLDGCDYEHWLIVMEFPTDPKPSEEEMVGAYVKTLAAVLGSEEEAKKKIYSVCTSTYTGFGALISEELSYKVKGLPGVLWVLPDSYLDVPNKDYGGDLFVDGKVIHRPQFRFNERQQVRSKPRPRYDRRREVVQVERRETMQRGPSTQQHRPPPFPQQATQNQEQH

SEQ ID NO: 37299 - protein, 226 aa, Sorghum bicolor
  unsure (1)..(226): unsure at all Xaa locations
  Clone ID: SORBI-28MAY03-C2302_1.pep
MADVVFGAMVAEAVRSAGPEFAGDLQSLSWSSMAVGGIFGSLLGGYALSNLPLHAIYVVFSALPFLQLVSCMFVEDSPKGFHSANDEHKYADNQSSVTAFSEKGSSEALRYEGTRRRKGTRKNNKRRSLSKRTESDEKHNGSINSLPSLSLRSAFFSLCTAFKQPNILRPMAWFLSASVPRPHVSPVSFSCQSRGLRLDASFLGTARVIXGWFSLMLGTYTYXRYF

SEQ ID NO: 37300 - protein, 179 aa, Sorghum bicolor
  Clone ID: SORBI-28MAY03-C2309_1.pep
RVRPRVRPRVRPRVRRDHKPSCNREKMRIEALGGYVDDDYLNGQLNVARAIGDWHMEGMKACDGLGPLSAEPEVMTTDLTEEDEFLIMGCDGIWDVFRSQNAVDFARRKLQEHNDPAACCKELVDEAIKRKSGDNLSVVVVCFNSRPPPVLTTPRPRVQRSISAEGLRELQSFLDSLAD

SEQ ID NO: 37301 - protein, 131 aa, Sorghum bicolor
  Clone ID: SORBI-28MAY03-C24357_1.pep
FFFFFFFHNPCHILLSIVTQSLSTLFTPSISPINSQQMKTTYAYTTITLQYTLIWSGISGMNMCSRQDLWLQEIMHIHHISLALLLRSRRLLTHQAGHDPLNPSTWLSAATRFGIVKQQIGQSVASPVSLQ

SEQ ID NO: 37302 - protein, 162 aa, Sorghum bicolor
  Clone ID: SORBI-28MAY03-C24402_1.pep
HMVRAMGRHAQHMAVNYYPPCPQPELTYGLPGHKDPNAITLLLQDGVSGLQVQRGGRWVAVNPVPDALVINIGDQMQALSNDRYKSVLHRVIVNSESERISVPTFYCPSPDGVIAPADALVDDAHPLAYRPFTYQEYYDEFWNMGLQSASCLDRFRPGGSIE

SEQ ID NO: 37303 - protein, 59 aa, Sorghum bicolor
  Clone ID: SORBI-28MAY03-C24392_1.pep
LKHHTGFRHEEAELIECTKMLVSAHSTAAESKLRVVYKKYSSEQFGGVALRPPAVEICK

SEQ ID NO: 37304 - protein, 178 aa, Sorghum bicolor
  Clone ID: SORBI-28MAY03-C24483_1.pep
MAPAISKPLLSDLVAQIGKVPSSHIRPVGDRPDLANVDNESGAGIPLIDLKMLNGPERRKVVEAIGRACESDGFFMVTNHGIPAAVVEGMLRVAREFFHLPESERLKCYSDDPKKAIRLSTSFNVRTEKVNNWRDFLRLHCYPLESFVDQWPSNPPSFRQVVGTYATEARALALRLLE

SEQ ID NO: 37305 - protein, 95 aa, Sorghum bicolor
  Clone ID: SORBI-28MAY03-C24514_1.pep
AVVWDRASREIKLKNMLYHTARINSLAWSPDSRLVATGSLDTCAIVYEIDKPATSRITIKGAHLGGVHGLTFLENDTLVTAGEDACIRVWKVVQQ

SEQ ID NO: 37306 - protein, 119 aa, Sorghum bicolor
  Clone ID: SORBI-28MAY03-C23457_1.pep
MAATAVAASLSVAQGLGKPLCAGSNASSLRVLAPRRSAARRMAVVVRASAQQKQHPAKEWAAAAAVAAALVLPEVAEAAPGISPSLKNFLLSIVSGGVVLVAIVGAVVAVSNFDPVKRG

SEQ ID NO: 37307 - protein, 228 aa, Sorghum bicolor
  Clone ID: SORBI-28MAY03-C2347_1.pep
RPVRWELKDLNKYNILAPCYHHPEIQELEFSKSSLPQSFRRLGETDRPFPVRKRMAGRSWPLRLALKDGHVPMWPGLGGRSLPCTSDEVATTWLDDEDVRAAIHAKPKSLIGSWELYTARIDFTHDTGTMLTYHKKLTGLGYRVLIYSGDHDLCIPYPGTEAWVKSIGYQVVDRWRPWYFGDQVAGYTEGYGHNLTFLTIKGAGHAVPEYKPKEALAFYSRWLAGEKF

SEQ ID NO: 37308 - protein, 138 aa, Sorghum bicolor
  Clone ID: SORBI-28MAY03-C23561_1.pep
MAKQFLVLAVLSVACKIAAATTVYDVLEQNNLPRGLLPLGVKSYVLHPDGALEVTLPKECNFFITVGGTKLQFRYGTSVNGIIKSGSISRVSGVRFQVKFAWLGINQVSHTGNQINLQVERSTKSFPASAFSQSPSCN

SEQ ID NO: 37309 - protein, 170 aa, Sorghum bicolor
  Clone ID: SORBI-28MAY03-C24688_1.pep
HEGALSALLSTYHDNRLYDRAVRAFNTLPAELGIKPGLVSHNGLLKALVASGDIAAARSAFDKMPDTAGVQPDIVSCNEILKGYLSTGDDAAFDQLVKEIAGPNRRLKPNVGTYNLRMAMLCSKERSFEAEELLDAMGANGVPPNRASVNTVIKGLCNEGEVGAAMALFK

SEQ ID NO: 37310 - protein, 152 aa, Sorghum bicolor
  Clone ID: SORBI-28MAY03-C24769_1.pep
MAMASHNGGTTKHLPPMEVSMEAGNGDAAEYLDDDGRPRRTGTFWTASAHIITAVIGSGVLSLAWAIAQLGWVAGPAAMLLFAFVTYYTATLLAECYRTGDPDTGKRNYTYMDAVRSNLGGARVAFCGCIQYANLVGVAIGYTIASSISMQA

SEQ ID NO: 37311 - protein, 114 aa, Sorghum bicolor
  Clone ID: SORBI-28MAY03-C2480_1.pep
MKLAGLKSVDGAHEESIWAAAWAPAADHRPTAVLLTGALDETVRAWLPDDLAALGSPARGHALGVVSLAAHPAGALAAAVSLDSFIRVFDVDTGASVATLEAPPSEVWGVLFHP

SEQ ID NO: 37312 - protein, 190 aa, Sorghum bicolor
  Clone ID: SORBI-28MAY03-C24837_1.pep
ARGVIETCDDPFSTVDTYVAKLKELRSGGAILEGIGLEGHFSKPNIPLMRAILDKLATLGLPIWFTEIDISNKFDAQTQAAYLEQVLREAYSHPAVSGVMLWTALHPSGCYQMCLTDWNLANLPTGDVVDRLLNEWRTLQAGGQTDAHGAYSFSGYLGEYVLTVSYNNRTTQSTFSLSPGDETRHINVQM

SEQ ID NO: 37313 - protein, 60 aa, Sorghum bicolor
  Clone ID: SORBI-28MAY03-C24807_1.pep
RIMKSRKVLGHHQLVMECVEQLGRMFKPDFKAIKKRIEVLITRDYLERDKDNPNVYRYLA

SEQ ID NO: 37314 - protein, 173 aa, Sorghum bicolor
  Clone ID: SORBI-28MAY03-C23965_1.pep
MAAEAQAEGPALPPAPPPPLAHGSSSASPEKRGLLIPGNDGGGAEEERQLPEPKRRRACVAALDSVPSSVTEEEAADSPGSGCGGDGASFSFQHARGGFVALETTPKFGSFNPPGEAELAGLDLKPPGHEAEAEGSTEADDKVEVPEASAPGAEVKDENSQLLGGEVDGQVQA

SEQ ID NO: 37315 - protein, 187 aa, Sorghum bicolor
  Clone ID: SORBI-28MAY03-C240_1.pep
ARGRVPPARAQQQEQQVEEEAAEVATLPPAQGGAEEQAQARKGDAQSLPRQPLAENKNMSREYGGQWLSCTTRHVRIYAAYIDPVTNVFDQTQMDKLTLMLDPQDEFAWTDEACQMVFNEFQDLVDHYEGAELSEYTLRLIGSDLEHYIRKMLYDGVLKYNMRSRVLNFSMGKPRMKFNSNQIPEAK

SEQ ID NO: 37316 - protein, 91 aa, Sorghum bicolor
  Clone ID: SORBI-28MAY03-C24239_1.pep
ELGRHGIRVNCVSPAAAATPLATAYVGLEGEAFEQAMEAVANLKGVRLRVADIAAAVLYLASDDARYISGHNLLLDGGFSIVNPSFGIFKD

SEQ ID NO: 37317 - protein, 242 aa, Sorghum bicolor
  Clone ID: SORBI-28MAY03-C24096_1.pep
MLAKGRKIAGRGEEMSAHYAFGPQDDDAIIKHRLLTRTTTTRGEPPLKKLQKKFMSFATEIEKDTDNASDCERLYKAFLQEINTFELPLLKSKAVVDANIREKESFNDLQVEIERQILQAKTDIEDLKKQLEQSKIERQHKEECEAIRKLICLQPPRSETEKLIADLEKEIADLEAENVACIRTLELRKKQFALLLHVVDELQISIEDEQKSIADELRAITGEQKMNIEEGSVVASDSMVVD

SEQ ID NO: 37318 - protein, 119 aa, Sorghum bicolor
  Clone ID: SORBI-28MAY03-C24299_1.pep
MADYEQEQDMEVEALQAILMDDIKEIDPSESGIATTARCFQILLSPQDDDFDESAYVPVQLALIFAHTEKYPDEPPLLNVKSVRGIKPHDLTSLKEKLEQEATENLGMAMVYTLVSSAK

SEQ ID NO: 37319 - protein, 106 aa, Sorghum bicolor
  Clone ID: SORBI-28MAY03-C25019_1.pep
KAVAVLGKVVLFIRHENVAPLYYLICDFKRSYFILSVYGLHNDAIKEGDRVVLFEPYYRILDASCKDKHYQFKSIRVDFPEQILINERAPAPHHVARASIHAHNRS

SEQ ID NO: 37320 - protein, 226 aa, Sorghum bicolor
  Clone ID: SORBI-28MAY03-C25051_1.pep
MSISMRLAIPAPAAAPPRLRVRAAAAAAAGDGGCLPVARAAVRTETAALRGCASLPLKPLGAGQPCRHRGAAAVCHSSAYLSAQTMQWISAGASAVLLLAKGTAIHKSFLVPFFALQAPCSIISWIKGDYGQWTAFLALLVRLFFFIPGELELPLSTMLLVSVAPYQLMNLRGTQGGAVLSLAIAVYLAFQHFTRVGGLGKAFEQGSIIATLAIICITIVPLMLLF

SEQ ID NO: 37321 - protein, 108 aa, Sorghum bicolor
  unsure (1)..(108): unsure at all Xaa locations
  Clone ID: SORBI-28MAY03-C25043_1.pep
FKRMPEVXRQKGKGVSPNFETYIMLLEALVNKNLFDPALEVCKECLHNKWAPPFQAVKGLVESLLKSRKAKHAREVLMAMRKAVKGDAKQEWTKVEAQFPMLLADKKA

SEQ ID NO: 37322 - protein, 320 aa, Sorghum bicolor
  Clone ID: SORBI-28MAY03-C25155_1.pep
GTRTQACKKRRGVYISSESGDSDTDSDVEGIKLCRKSGVPSISTCQHQSSYKVKAASMKSSRMIRLCGNIVRKLIDHKGGWLFKEPVDPVLYGIPDYFDVIHNPMDLGTVKNILTKKQYVSIEEFAADVRLTFSNAMKYNPPENDVHKVAKELNGIFDSEWESVERKFRVQNPVQEQQTMKAIKVRGIMDSKSTVPRELVACSNSKPLVARGPVACSNLIANKTLTDVLSSKVKIKFSVRSSERTSSKDIPVQAAGSKERSLNHSVPTGNKKASLNCTLPCTKENAKISRIRESDRSSGSIGNGSLLCNDTSTSPLASSA

SEQ ID NO: 37323 - protein, 115 aa, Sorghum bicolor
  Clone ID: SORBI-28MAY03-C2456_1.pep
HWDVRGDDKDDPTTYLVTFDKEEGAKYLPLPTKLVLQKKKAKEGRSGDEIEHFPVPSRITVSKTAHGGTMERGESSGLHVNSKPRRSHVDDDLDEHPKRSRVEDIDQYSGEEYSE

SEQ ID NO: 37324 - protein, 115 aa, Sorghum bicolor
  Clone ID: SORBI-28MAY03-C24588_1.pep
SNNPARMSINYVDDDKRCGYRQQLISPSSVSTSIKGDTLSTISCSVSSESFFVSITVDGDMLSTISCSLSSSEPFFVSMTVDGDTLSSISCPSAPCKSFFVLVTVTGDMLSCISC

SEQ ID NO: 37325 - protein, 127 aa, Sorghum bicolor
  Clone ID: SORBI-28MAY03-C24611_1.pep
TRDMKVKGKAAIDVVCNPLGKSGGALIQQFMILTFGSLANSTPYLGGILLVIVLAWLGAANSLDKQFSALAKEDLKKEKAAQEKVEPSLLKAPAEGTGDVPVEQTNGSVTSQATGTESSPSNSSPIQ

SEQ ID NO: 37326 - protein, 85 aa, Sorghum bicolor
  Clone ID: SORBI-28MAY03-C24639_1.pep
NSYCPLQQAHRRQNCETSGGRSNTVQKAITQAMSCAPIFSSFSTDFGRSIRVNKGTSNLSTSHELTMPKHHNATTVVNQGYQEQD

SEQ ID NO: 37327 - protein, 120 aa, Sorghum bicolor
  unsure (1)..(120): unsure at all Xaa locations
  Clone ID: SORBI-28MAY03-C2468_1.pep
SPPTSXRAAARRSSFLRPPTLWTALSWFSTSTRFRVLGWRRRCWTSALATSSSARGDLRLGRELIELAASLDHRRPDARSRCRACTWKHRRRKSSRAVVTHAKGYAHQVFRSTTHRDLPL

SEQ ID NO: 37328 - protein, 134 aa, Sorghum bicolor
  Clone ID: SORBI-28MAY03-C24665_1.pep
MDEWLPLPNVFGRLLDTNDQDQWPPEATLLIAANDGNVRRLKEIARGLDVNGRGINSVLRRTTFKGMDALHAAAGGKGKLPICRYLVEEAKMDVNKRDTFKGKSMTPLQHAVFSGNLPIVRFLLDHGADLHQEG

SEQ ID NO: 37329 - protein, 137 aa, Sorghum bicolor
  Clone ID: SORBI-28MAY03-C25274_1.pep
SMHIRMGDKACEMVVVGFEEYMELAGNLRKRFPSLKNIWLSTEMQEVIDKTKLYPHWSFHFTSVARQGSNMTMAMYEASLGRETSTNYPLVNFMMATEADFFIGALGSTWCYLIDGMRNTGGKVMSGYLSVNKDRFW

SEQ ID NO: 37330 - protein, 70 aa, Sorghum bicolor
  Clone ID: SORBI-28MAY03-C25295_1.pep
SPRLPPGGLAALNPKFTVVRKHNSNDADDDLPSVMTCANYLKLPPYSSKEKMREKLLYAITEGQGSFHLS

SEQ ID NO: 37331 - protein, 362 aa, Sorghum bicolor
  unsure (1)..(362): unsure at all Xaa locations
  Clone ID: SORBI-28MAY03-C25310_1.pep
TRPYSTEAELLEQFSSMKDRGTRIIIYNLWEDDQGDLELDFDAEVHDIQLRGGNRDEKNIQMAKQFPNSKHYLTYRHSLRSYASILYLRLPTYFQMILRGKDIEHHNIVTDMMLKKEVTYRPVAPNGHPKDSNMVADVTIGFVKDAKHHIDVQGFNVYHKNRLIKPFWRVWTAAGSGGRGVIGVLEANIIEPAHDKQDFERTTLLARLEARLGQMQKDYWSGNAHRIGYVAPRSGRNSDAGDGEDSRENTAGAQXSPYHSGKGYTQAKDMNNNIKKGGKASTSFGIQQRAEKSARTKRSMKSILHGLSDSDNSDSEFMGTLLRSRSHTVNRNQKLFQNGSTDLTTPQSSGLIERDRGCLLLL

SEQ ID NO: 37332 - protein, 203 aa, Sorghum bicolor
  Clone ID: SORBI-28MAY03-C25297_1.pep
TSRSGETKQTAHELDEFLNKVRRGERVSNDEILSFAKLFNDELTLDNMSRPRLVNMCKYMGIRPFGTDHYLRFMLRKKLQDIKNDDKLIQAEGVESLSEEELRQACRERGHLGLLSTEEMRQQLRDWLDLSLNHAVPSSLLILSRAFTVSGRMKPEEAVVATLSSLPDEVVDTVGTVLPSEDSVSERRRKLEFPEMQEELIKE

SEQ ID NO: 37333 - protein, 230 aa, Sorghum bicolor
  unsure (1)..(230): unsure at all Xaa locations
  Clone ID: SORBI-28MAY03-C2953_1.pep
LLIXCEAGPGDDVEDNDDNDDDPEESHRPATSLAAAYRLLTPSVKVQLLIYFMLKFAMEILLSESSVVTTFYFKWTTSTVAIFLAVLGLTVLPVNVIVGSYVTNLFQDRQILVASEIMVLIGIVMSFRFTPHYSVPQYVTSALITFVFAEVLEGVNLSLLSRVMSSRLSRGTYNGGLLSTEAGTLARVAADMTITAAGNLGQSRLLNATLLPSLVICLASIVATLCTYNS

SEQ ID NO: 37334 - protein, 120 aa, Sorghum bicolor
  Clone ID: LIB3481-016-P1-K1-C6.pep
RPLVLVAIFLAVLGLTVLPVNVIVGSYVTNWVQDRQILVASEIMVLIGIVMSFRFTPHYSVPQYVTSALITFVFAEVLERVNLSLLSRVMSSRLFRGTYNGGLLSTEAGTLARVAADMTI

SEQ ID NO: 37335 - protein, 262 aa, Sorghum bicolor
  Clone ID: SORBI-28MAY03-C29635_1.pep
TRARLRPHNWNSSDDLTVQLIQSVTSSTSTAARKDMQSLVNGLLSKSSVYQKDSSGLNKESLYQICYSCLESLVDLFEEAREPTDYTGQAVAVRGSKPLIERVSRQAENLNWLLEILVNNDIAEEFVELWAKQDMLIRMHEQASAMVRYELSRISAGVFIALGKGKVQCRGDVRSLLFRGWFSTMLLDFGWLQRCPKGLDLRSLEENLGRGLLTLPLRQQQCLFEEWFQFYATKGAECPNLIRAFQVWWRRSFIRSLVEPQS

SEQ ID NO: 37336 - protein, 49 aa, Sorghum bicolor
  Clone ID: SORBI-28MAY03-C2965_1.pep
GLLYNSYFHGSSISQAQLVVDMTFRLLLLDYVLIQSVVEIFNFVGSVEL

SEQ ID NO: 37337 - protein, 134 aa, Sorghum bicolor
  unsure (1)..(134): unsure at all Xaa locations
  Clone ID: SORBI-28MAY03-C2964_1.pep
QFYNSSNSAAKDTCEAMDQWAQHPQAETALSNILPCVDESTTNRTLYQSKEVVVRLVGIVNRAISALSNRRPHHKHPGQFMPYLCSPYDSNLNDRPCNHREVTFENATTACFXYSSCMAQDTDLCSVFGNVFPT

SEQ ID NO: 37338 - protein, 173 aa, Sorghum bicolor
  Clone ID: LIB3480-018-P1-K1-E8.pep
AAKDTCEAMDQWAQHPQAETALSNILPCVDESTTNRTLYQSKEVVVRLVGIVNRAISALSNRRPHHKHPGQFMPYLCSPYDSNLNDRPCNHREVTFENATTAWLNYTCMAQDTDLCSGNTTLTYDIYGQLVLAANVSYALYHYAHLLLNLQDLKFVRATFSAIAFQYCPPLEH

SEQ ID NO: 37339 - protein, 222 aa, Sorghum bicolor
  unsure (1)..(222): unsure at all Xaa locations
  Clone ID: SORBI-28MAY03-C297_1.pep
LSAAAVPAQELPVQHPPAAAAGKTKKRFVSFRCVSSGGGQDHRREATVVVGRRRGLASCALAGLAASFSPLAADRAARALVLEEDDDIELLERVKEDRKKRLQKQGVISSSGTETGYLQDLIYKLSKVGQAIDKDDLPAASSVLGPSSDAKWVQNINMAFSKFSSSPEERNVVDSFNSSLATLFTSVNKLDAESSKSAFVSSATALEKWIALXGLGGQLKGY

SEQ ID NO: 37340 - protein, 162 aa, Sorghum bicolor
  unsure (1)..(162): unsure at all Xaa locations
  Clone ID: SORBI-28MAY03-C25364_1.pep
VPGPLDGIKLGLVGDLANGRTVRSLAYLIAKYQNIKIYFVSPDVVKMKYDIKDYLNSKGVEWEESSDLLXVASKCDVIYQTRIQKERFGERIDLYEAARGKYIVDKKVLDVLPKHSVIMHPLPRLDEIRVEVDSDPRAAYFRQAKNGLYIRMALLKLLLVGH

SEQ ID NO: 37341 - protein, 166 aa, Sorghum bicolor
  Clone ID: SORBI-28MAY03-C25441_1.pep
CSFLVCWWCGAAPPADAVLPPCAAAAGVVPMALLHLSLASAAASASHCCASDSEPWLPWPWLSPCFAVAVTWCAPSPRACWLLLLALLNRSSAARMASADRCCASARYLPISSRFIAWPWPWPAASSWPLPACCCFLACCCDAIVRVVRRALELAGRRRPQWRVES

SEQ ID NO: 37342 - protein, 141 aa, Sorghum bicolor
  Clone ID: SORBI-28MAY03-C25447_1.pep
MAGNDWINSYLEAILDAGGAAGEISAAAGSGGGGDGTAGEKRDKSSLMLRERGRFSPARYFVEEVISGFDETDLYKTWVRTSAMRSPQERNTRLENMSWRIWNLVRKKKQIEGEEASRLSKRRMELEKARQYAATDLSEDL

SEQ ID NO: 37343 - protein, 98 aa, Sorghum bicolor
  Clone ID: SORBI-28MAY03-C25468_1.pep
IPRQSRLTSLPPRPLHSTSIRYLHSTSIRRSCSCSCSCSSRNAPHPHHAELLRSTGTTSRLRRPSVGSVLCWRWWSEGRWGKLGRWGEPRIATNRRHQ

SEQ ID NO: 37344 - protein, 180 aa, Sorghum bicolor
  Clone ID: SORBI-28MAY03-C25455_1.pep
ARGLFWKTRKECHCIDADLLLNELKKDAGNKDGEIGSSKGWRGPVNIADSLGDDEVDLVIPQAPYDADKDGDLSADEHGDDFRKSSTTYKRSRFMSLSDSDAEENERNHVSRDSVPKVPKRRGRSLFTEEQERLIRDLYEKYKDDRKCSHLIADALDSSGKITSAQVSRKLTQLGLRNVT

SEQ ID NO: 37345 - protein, 173 aa, Sorghum bicolor
  Clone ID: SORBI-28MAY03-C25627_1.pep
ADYIGINQYTASYIKGQKLLQQKPTSYSADWQVQYALERNGKPIGPQANSNWLYIVPSGMYGCVNYLKQKYGNPTVFITENGMDQPGNLTREQYLHDTTRVQFYKGYLAELKKAIDDGANVAGYFAWSLLDNFEWQSGYTSKFGIVYVDFSTPKLERHPKDSAYWFRDMLQKH

SEQ ID NO: 37346 - protein, 187 aa, Sorghum bicolor
  Clone ID: SORBI-28MAY03-C2518_1.pep
ARGDSDGVKFNYLTSCEIKVKYVLDGSTIFWATGHKSGVVAKHTEHCGQEVGMVVPFEDINGELTVSLVLKEWQFSDGSVTLSNSLGNGLQSSFDGSIKLQSTTGRRLRARVVEGRALTANSKSGKCDPYVKLQYGKALYRTKTLSHTVRPVWNDKFEFDEISGGEYLKIKCYNADMFGDESIGSAR

SEQ ID NO: 37347 - protein, 341 aa, Sorghum bicolor
  Clone ID: SORBI-28MAY03-C25174_1.pep
MSTQNLLTGACTSSAPTPPEADGGDRTPLADAADAAEELYRLRDTFFPRDPGEKAAALRARTDAALALLDALPSEQKKSPQLRGVYEFLRGKILDVFPDYHKEAEDHLSKAVKLNPSLVDAWLCLGNCIWKKGDLSAAKNCFSLALGKGPDKKILCQISMLERSMAQGSADQALLVEESIKRAKEAIMLDIRDGNSWYNLGNAYLTSFFVGGAWDHTKLHHSVKAYQNAEKDQTMNLNPDLYYNCATADKYLENYERALRGFEVAALKDPGLGADIEVQKIISLLDKLENAMKGQLRTKKLASFVSSLSGVKLKSSHKKATIATLSEGLNKAVAVLGKVVL

SEQ ID NO: 37348 - protein, 97 aa, Sorghum bicolor
  Clone ID: SORBI-28MAY03-C25240_1.pep
TEEDGRATPKAIRRSASMDSPLFLVAVPEAQDDVVRYSCKLPNAREMKVFRVKEKEAGTSSSSCQSGRFKIGRSMSSSGQGFFFSRNGRSSGAVLPL

SEQ ID NO: 37349 - protein, 234 aa, Sorghum bicolor
  Clone ID: SORBI-28MAY03-C2520_1.pep
HEGGPDPDYDPALDIERIESSTVRLLDEQKRMVGVVSVSEAVKIADDNDLILAILSLDGDPPVLRLFEERDYKKHRYEQQKKKKIQQKRSVAKRMGLKELKMGYNIDIHDYSVRLKAAKKFLKAGDKVKIIVNLKGRENLYKKEAIELLRRFQNDVGEQATEESKNFAERNIYLVLVPNKIAIQKEQDELNKKGTVKEERDQSDSDEPEEDSDEPLTQLLEESMEPEAEVSANV

SEQ ID NO: 37350 - protein, 156 aa, Sorghum bicolor
  Clone ID: SORBI-28MAY03-C25244_1.pep
DGPLAFPGVCWALGHSSGSGMLIPRWKVVFSGASPPGPPRSLASRPASVLIHEATFEDSMKDEAIARNHSTTKEAIEVGTSAGAYRIILTHFSQRYPKIPVIDEVDMEKTCIAFDLMSVNLADLPVVPKVLPHLKVLFKDELVVDEADELQEAAVY

SEQ ID NO: 37351 - protein, 75 aa, Sorghum bicolor
  Clone ID: SORBI-28MAY03-C25249_1.pep
AAAIGKSSMDNGYKFALARQQELKFYRFQKKNTLNLIQDNMGWTIYINLFLHQTRANLLLYPPCLMKLAITRWLL

SEQ ID NO: 37352 - protein, 128 aa, Sorghum bicolor
  unsure (1)..(128): unsure at all Xaa locations
  Clone ID: SORBI-28MAY03-C25263_1.pep
MTKQRTAVRRXLVITEEHFQRVTQALVMRLRQHEESVKKDGDGLAGMKQGDLIIWYVEQQNAKGAYSSTAEVKEEVKCIKAIIERLIQREGHLIVIDEGTAAPAEDGSGVRRTSESRILAVNPNYVVD

SEQ ID NO: 37353 - protein, 126 aa, Sorghum bicolor
  Clone ID: SORBI-28MAY03-C25564_1.pep
ARGELGCSGRCATSLCGGGGTASARRPSAFRVAEFLSCCDMCRRALDGKDIFMYRGERAFCSMECRYHAIVSDEFQEEKERKRRAAAAAAMSSAADVPKKSAAAEMAGSPCSGSGQIFFTTGIVAA

SEQ ID NO: 37354 - protein, 104 aa, Sorghum bicolor
  Clone ID: SORBI-28MAY03-C25573_1.pep
CVVPAGSGNPPNIIVDHLVSIVDGGGLPGFINLVRSADIESARLGLQFLELVMRGYPNNQGPKLVEREDGIEAMERFQFHENEVMRNMANGLVDKYFGEDYGLE

SEQ ID NO: 37355 - protein, 378 aa, Sorghum bicolor
  Clone ID: SORBI-28MAY03-C2562_1.pep
TREPFVTINHYDIPEELQQRYGSWLSPEIQEDFTYFAEICFKMFGDRVKHWATFNEPNLMAKLAYFNGKFPPSHCSKPFGKCNSGNSSTEPYIAAHNMILAHAKTVNIYKKNYKTKQGGSVGITVYMRWYEPLSVRTDDHLAVSRAQSFEAPWFLDPLFFGDYPHQMRQILGPNLPEFTEGEKQLMKNQIDFIGVNHYKTLYVKDCVYSLCDLDTYAGDALVSESAERNGIPIGKPTPVANNYVVPSSMEKLVMYLTQRYKSIPLYITENGYAQIGNSSPPTEELINDTERSSYIRDYLTYLSFAIRKGADVRGYFVWSLMDNFEWLSGYTIKYGFYHVDFKSLKRTPKLFVKWYSNFIKGYEQIEMAFEESPKHMVS

SEQ ID NO: 37356 - protein, 95 aa, Sorghum bicolor
  Clone ID: SORBI-28MAY03-C25662_1.pep
MARGGEGRRSERKCVRDWRWRCDDDGDDDEGEGWRRRRHDGSGRRPGGGGRDGGWARAARQGDRGWRGGARPRRRRERGGHRRSQGGEAQARLME

SEQ ID NO: 37357 - protein, 137 aa, Sorghum bicolor
  Clone ID: SORBI-28MAY03-C25311_1.pep
DVANKALLSSIDSSLKLDHDACANIGAILTPCHGEMRELKGEHHHKVVEISENAGKCLEEEYLVDEPSCSTPRRRQIDLPSVESIEELRTPDYDELLKSFRESRGSWKQANGDTRHLSETAQEPTVMDSRIPLIGRN

SEQ ID NO: 37358 - protein, 142 aa, Sorghum bicolor
  Clone ID: SORBI-28MAY03-C25349_1.pep
PPPPAEEDATKITIGEALEATARAGGGRPIDRADAEAIRAAEMSAHGADVAMPGGLGDQARAAARANAQATRDGDKVKLGDVLSDVTAKLAGDKAARTEDATRVVQTETFNDAEARAKAGGVGAALTTAARLNEDNDLSGDT

SEQ ID NO: 37359 - protein, 272 aa, Sorghum bicolor
  Clone ID: SORBI-28MAY03-C2533_1.pep
MADDEQAERKEEVPELAPFDPTKKKKKKKVVIQEPSDEVDNLAEKTESLTVAESSEPSFAGMKKKKKKHVELDPSLTETGDGDEAGDDQVREDEEGEGIVLSGAAATRYPWEGTDRDYKYEELLGRVFNILRENNPDLAGDRRRTVMRPPQVLREGTKKTVFVNFMDLCKTMHRQPEHVMMFLLAEMGTSGSLDGQQRLVIKGRFAPKNFEAILRSVRNEYVICNGCKSPDTILSKENRLFFLRCEQCGSSRSVAPIKAGFVAQVGRRKAGS

SEQ ID NO: 37360 - protein, 168 aa, Sorghum bicolor
  Clone ID: SORBI-28MAY03-C25363_1.pep
GVHVNGMVYYLTKFRYIASSRINCLNLESEKFDVMMLPPRKSYGGHCSLTELEGKLCLLIVDGALEGPPRTMDILMLNSHDKQDWTPRYHFSLPWLMPSCYFTPKHTLFHEGKIWVQLLARSLYCFDPSSSSDELTTAWPELDFSFSTHTFIESIVPLRKDYYFKQIQ

SEQ ID NO: 37361 - protein, 164 aa, Sorghum bicolor
  Clone ID: SORBI-28MAY03-C25351_1.pep
MRRWWCAAGGLGRRVLSSSTPAVASHARPLPLPLIPKSPSFTVPFSLSCRRHHSLQGFFHPAIASSPFRPPSAHHQQVRHYAKKERSRAPLTPTKSKVKKYKIKAPSSMKFRFRTMKDGQVRRWRAGKRHNAHLKSKEAKRRLRKPALVHLAYAKVIKKLNFCG

SEQ ID NO: 37362 - protein, 286 aa, Sorghum bicolor
  Clone ID: SORBI-28MAY03-C25431_1.pep
MAGGGKKEKGEGLGRALIRQRNKAAAAAKERGEALAFGRRRAMPLESVIDVSDIDAVLQRAAEADQLAEAASVSSDSDLIIDLDATGETEDERRRLRKEQEALHASSLRVPRRPPWHSQMTVEELDVNERRAFLVWRRNLARLEENDKLVLTPFEKNIDIWRQLWRVLERSDLLVMVVDARDPLFYRCPDLEAYAKEIDEHKRTMLLVNKADLLPLNIRKRWADYFKAHDILYVFWSAKAATATLEGKKLSGYSEEESASLDLDTKIYGRDELLMKLQAEAESIVA

SEQ ID NO: 37363 - protein, 111 aa, Sorghum bicolor
  Clone ID: SORBI-28MAY03-C25902_1.pep
SPEQGQRRIRRRFSVAEVEALVLAVEKLGTGRWRDVKLRAFDNAKHRTYVDLKDKWKTLVHTASISPQQRRGEPVPQELLDRVLAAQAYWSQQQAKLQPKTPPLAEARLLT

SEQ ID NO: 37364 - protein, 116 aa, Sorghum bicolor
  Clone ID: SORBI-28MAY03-C25984_1.pep
AEVPKHQQQHCGCSTHVTESYCCGGGACLGPQKTQLHAGPPMQFPLRAPRAMQLWLHSFGIQSSPNLITAGSQSPLPLLSVDAVVPTSFDSSTMKASNRKTWVALILIGVLKRWLA

SEQ ID NO: 37365 - protein, 72 aa, Sorghum bicolor
  Clone ID: SORBI-28MAY03-C25978_1.pep
WTVSKDTTEKVEGLHSAIKKVQVIADEWVKMNSTINRIWSFTKETEKRVEGLYSDLKKGFKQTKRKVPFWRD

SEQ ID NO: 37366 - protein, 87 aa, Sorghum bicolor
  Clone ID: SORBI-28MAY03-C2600_1.pep
SDDCLIFLLPRTHTHEIHIERLIEGPHCGLIPIGMPSTSTTTTGLRWNLDNTSMSYGGLISTSNIVEEDKVTVASDSYLIWTISLRK

SEQ ID NO: 37367 - protein, 269 aa, Sorghum bicolor
  Clone ID: SORBI-28MAY03-C25481_1.pep
GTYQSWQQNAPPPQPPEHVVKMHPSPPPAYANRPPQPPPPPPPAMLNSSGGSGSNYSGGEILPPPSPGAALGFSSKSTFTYEELLRATDGFSDANLLGQGGFGYVHRGLLPNGKEIAVKQLKLGSGQGEREFQAEVEIISRVHHKHLVSLVGYCISGGKRLLVYEFVPNNTLEFHLHAKDRPTMEWPTRLKIALGAAKGLAYLHEDCHPKIIHRDIKASNILLDFKFEAKVADFGLAKFTTDNNTHVSTRVMGTFGYLAPEYASSGKLT

SEQ ID NO: 37368 - protein, 139 aa, Sorghum bicolor
  Clone ID: SORBI-28MAY03-C25497_1.pep
MAQAQPRRQDDPLQAQQGNKAQQDEGLQPEEAAIRYGHVFAVSGDLAGQPIGPRDAAAMRSAEDSVAGVQVPQGAGGGFSAATAMETAAAYNQAVGAVHPGQASDTAAMHGIAVTQTAVPGGRIVTEFVAGQVVGQYSV

SEQ ID NO: 37369 - protein, 128 aa, Sorghum bicolor
  unsure (1)..(128): unsure at all Xaa locations
  Clone ID: SORBI-28MAY03-C25508_1.pep
NLARLLCGCKNQWVLGVAPSQLAADLSWPSGELMEHKKARAVEDPARLICDDALTEVFRRLPARALAACRLVCKSWMSVLTDPHFIHEHLSRGQQKLLLFANDRANDRSLAMVLADDXSMYQLSRPAA

SEQ ID NO: 37370 - protein, 143 aa, Sorghum bicolor
  Clone ID: SORBI-28MAY03-C25512_1.pep
MAQLRAPADEERLQQEAPHGVAGGGDVSSNKKARAGLCGVLRERKVVELARAKRRLVEVPYTATLAHTANALLAARVSGVAVAAPPGHWIGAGGSMILESDPATGAVRKHYIGMVNMLDILAHIAEASDDAEADGESVDLDRR

SEQ ID NO: 37371 - protein, 154 aa, Sorghum bicolor
  Clone ID: SORBI-28MAY03-C25561_1.pep
SVPPVILRGPRSVGTRHAVKAAKLRNVAKPFAANPSRPLPGALSRAPVPNRVLSGLVLHFSRPSAVPSRSDLIKIFSQYGPVNEAKADVANSASSAQVIFKRRMDAEAAFAGAGKISALGPALVSFRLTDFPASASGNKASHVASKSDRVLHDQ

SEQ ID NO: 37372 - protein, 139 aa, Sorghum bicolor
  Clone ID: SORBI-28MAY03-C26211_1.pep
MASTVLEATRAAHEDLERLERLAVRELQRDPANPRDRLFQSHRVRHMLDLVVSTSGKLVEIYEDKDNARKDEINTHLTAPTQSGLFSKYYERLKEIREYHRRNPSARFVSTTDDYEELLKEEPIIEFTGEDCLIPLVGS

SEQ ID NO: 37373 - protein, 109 aa, Sorghum bicolor
  Clone ID: SORBI-28MAY03-C26245_1.pep
MASKLQALWNHPAGPKTIHFWAPTFKWGISIANVADFAKPPEKISYPQQVAVACTGIIWSRYSLVITPKNWNLFSVNVAMASTGLYQLSRKIRQDYFSDEKETAASHEG

SEQ ID NO: 37374 - protein, 213 aa, Sorghum bicolor
  Clone ID: SORBI-28MAY03-C26246_1.pep
ARGRNVIDMYSFDKCADLPKSMLKRLKAEGQTKKKFMRALVLDKELSNGQTSNHSEGAIGLTQSDPEGDKFGSVEATWEKGISSETMKRRRGRPKKILKQTNDSISDRDKGEHIEAKEDVDISGGKDLRNVKTSEHTETQNSMMIIKEVNNNNTAENKLSKTVGDKSDLVTGMALHKQENVRLTEVSEKATFSTVHKFYKRRNCNQTLGSRKR

SEQ ID NO: 37375 - protein, 165 aa, Sorghum bicolor
  Clone ID: SORBI-28MAY03-C26280_1.pep
MGGIGVSPCDLDREFAPQIAQLLATPPLQSAQEYYDELIRSKKPDGIRVSYSGKHGKGVCANRDFAEDDLVLKDQMLVGAQDSLNKIDCVVCSYCFRFIGSIEFQIGRRLYLQSLGGSVDGSTERHCHGSDAGPSTGCSGASSGNSNAVPQEVLMSLMDGNMSLP

SEQ ID NO: 37376 - protein, 259 aa, Sorghum bicolor
  unsure (1)..(259): unsure at all Xaa locations
  Clone ID: SORBI-28MAY03-C2629_1.pep
HEGDWIGSSGECSKILYEEIDYINEGKNADRFRRDFRNIKWVRVPLIMWDYTTEKVLTLEYVPGIKINNLDVLDNRGYSRSLIASRAIESYLIQILKTGFFHADPHPGNLAVDKDGSLIYYDFGMMGDIKSFTRERLLSLFYSVYEKDANKVMKALIDLEALQPTGDLSPVRRSIQFFLDNLLNQTPDQQQTLAAIGEDLFAIAQDQPFRFPSTFTFVIRAFSTLEGIGYILNPEFSFGKXAXXYAQELXTXNXXNNGG

SEQ ID NO: 37377 - protein, 154 aa, Sorghum bicolor
  Clone ID: SORBI-28MAY03-C26700_1.pep
APGGMQIRQMHRWVLRCHACYKVTQEVGKIFCPKCGNGGTLRKVSVTVGENGITMASRRPRVTLRGTKFSLPMPQGGRDAITKNPILREDQLPQKVLHPKSKKSSKEDDFLGVDDIFSHSGDKKAPLKPPVRKALAMFSGKRNPNDNHFSRKKH

SEQ ID NO: 37378 - protein, 150 aa, Sorghum bicolor
  Clone ID: SORBI-28MAY03-C25664_1.pep
GPKGFFRGTGATLCREVPFYVAGMCLYAEAKKAAQHVLKRDLEAWETVAVGALSGGVAAIVTTPFDVMKTRMMTAPPGTPVSMQMIVFSILRNEGPLGLFKGAIPRFFWIAPLGAMNFAGYELAKKAMIEDESKSRESIEEKKTMVGSRG

SEQ ID NO: 37379 - protein, 166 aa, Sorghum bicolor
  Clone ID: SORBI-28MAY03-C25701_1.pep
MRPPVSRAAFASVLMGPRALGASLVAARCAASSPAAAATAAVTAYDHASFVNEIAVTSPPEHLNSLLNVLQARGEKIVSPGAKRGLIPCVVPLSESPAGNLTSLLRWPTAPTGMEMPVVEVRKHGLWLLAKNVKQYIHRILVEADINADTGDDLWTAVGEAGNLYA

SEQ ID NO: 37380 - protein, 208 aa, Sorghum bicolor
  unsure (1)..(208): unsure at all Xaa locations
  Clone ID: SORBI-28MAY03-C25744_1.pep
MASLLRRSAAPARQLLLLPRHLAAAGGSAPASSRSFSRFHPRDDSSMFDPPEPPVNWGVSIVPEKKAFVIERFGKYLKTLGSGFHLLIPAVDRIAYVHSLKEETIPIPHQNAITKDNVTIQIDSVIYVKIMDPYLASYGVENPIYAVLQLAQTTMRSELGKITLDKTFEERDALNEKIVSAINEAATDWGLKCIRYEIRDITPXIGIK

SEQ ID NO: 37381 - protein, 81 aa, Sorghum bicolor
  Clone ID: SORBI-28MAY03-C25776_1.pep
TRQRFHPPAVDAVDAGDEAEIPWILIENLAYVADRRNSTTAFSDWRYDGQVQVTLIVVPPPRVSYLCVFCRRQRRRRGPPY

SEQ ID NO: 37382 - protein, 224 aa, Sorghum bicolor
  unsure (1)..(224): unsure at all Xaa locations
  Clone ID: SORBI-28MAY03-C25764_1.pep
ARGRARFEILHAEHSAIKLNNANSSIHIDAVIDPLSPIGQKLAPLLRILWKQIQPSMRIVLNPISSLADLPLKNFYRFVLPSMDDFSSTDHSVHGPKAFFANMPLSKTLTMNIDVPEPWLVEPVIAIHDLDNILLENLGDVRTLQAVFELEALLLTGHCIEKDRDPPRGLQFILGTKQRPHLVDTLVMANLGYWQMKVSPGVWYLXLAPGRSADLYELPPKLIA

SEQ ID NO: 37383 - protein, 160 aa, Sorghum bicolor
  Clone ID: SORBI-28MAY03-C25802_1.pep
TTRIVVCTWIRERLLLTNWATVFFLAASFWQTSSSWSELWILAQICESSTLLCSQMKYPEVVLLVRPAGDDPPGRTLLAAGTAADAANRSTNASSPECHLLHPLRRIYRALPQAHLALSLASSTSDGHVRERTLPPRANWSTDAVGPILASNAMPRFAGI

SEQ ID NO: 37384 - protein, 58 aa, Sorghum bicolor
  unsure (1)..(58): unsure at all Xaa locations
  Clone ID: SORBI-28MAY03-C26506_1.pep
IRWLRHHDISSSSDVIDLLPVRLLRCLLFILDLLQQLEAQEGGWHSXKXVCKYVRRNW

SEQ ID NO: 37385 - protein, 68 aa, Sorghum bicolor
  Clone ID: SORBI-28MAY03-C26525_1.pep
HDELQKACEEFGIEDAHLEDIIRDIDQDNDGRIDYNEFVTMMQKGNNPLGKKGHYQMSFGLREALKLG

SEQ ID NO: 37386 - protein, 83 aa, Sorghum bicolor
  Clone ID: SORBI-28MAY03-C26552_1.pep
SPSIHVAQNMGNVASESSNQIQLPHSNGDSAAQMVLAAPQQSSSVEQLSTSSTTAVIVGEPGSSRRSRPLESPPIRRTRRRLQ

SEQ ID NO: 37387 - protein, 206 aa, Sorghum bicolor
  unsure (1)..(206): unsure at all Xaa locations
  Clone ID: SORBI-28MAY03-C26677_1.pep
LEGHDRIKSALAHIGTHALLKMLLVDNFVHADMHPGNILVRVVQPKNSNNTLIKSRPHVVFLDVGMTAELSSNGRVNLLEFFKAVARRDGRTAAESTLKLSKQQNCPNPSAFIEEVERSFXSFWGTAEGDVVHPAECMHQLLEQVRRHKVNIDGNVCTVMVTTLVLEGWQRKLDPDYNVMKTLQTLLFKEDWAKSLQYTIQGLMAP

SEQ ID NO: 37388 - protein, 103 aa, Sorghum bicolor
  unsure (1)..(103): unsure at all Xaa locations
  Clone ID: SORBI-28MAY03-C25986_1.pep
TVNRVTILTDKFGQPKGFXAYVEFLEQEAVQEAINLNESELHGRQIKVAPKRTNVPGMKQRPPRGYNPYHGYPYRSYGAPYFPPYGYGRAPRFRRPMRYRPYF

SEQ ID NO: 37389 - protein, 116 aa, Sorghum bicolor
  Clone ID: SORBI-28MAY03-C26085_1.pep
ELVQDTKLVREDDQRPSTQCKSHKINHTSVQNKLATIHELLNTTPYLCWHVATQRLPLHYFSLLERLAAQDEKGGAEGSLPATQRLPSFTISVSLLRGLRARTKKVAVKIPSRHTL

SEQ ID NO: 37390 - protein, 158 aa, Sorghum bicolor
  Clone ID: SORBI-28MAY03-C26026_1.pep
ELLTEEDQKIFKYLDSVDVDDSDVKAGYSIHLNFSENPYFEDTKLTKIYSFADDGTTTIKASQIKWKEGMGPANGNGLNKKGSKRPLVEESFFTWFGDTELKSLADGVQDEVAEIIKEDLWPNPLKYFNNEVEDEFEGDEDDDDLDEDDDDDDGGEEN

SEQ ID NO: 37391 - protein, 197 aa, Sorghum bicolor
  Clone ID: SORBI-28MAY03-C26183_1.pep
MKGLFKSKPRTPVDIVRQTREGLVQLDLHSGSRSGDAKREEKMTELSKNIRDMKSILYGNGESEPVTEACVQLTQEFFRENTLRLLIIHLPKLNLETRKDATQVVANLQRQQVSSKIVASEYLESNKDLLDILILGYENMDIALHYGAMLRECIRHQSIARYVLESEHMKKFFDYIQLPNFDIASDASATFKELLTR

SEQ ID NO: 37392 - protein, 191 aa, Sorghum bicolor
  Clone ID: SORBI-28MAY03-C26102_1.pep
TRPRTTMTIDAALLAIVVAFLLPLRLVSLGLRLACGRHSTSARHLRRSCAALAVAAALLAVIFALPRDQARECAAPVASVSSGGDDFGGFREELRSEVEQLKLQLARLESLWDSKSKVVDEKLDPLEEENDRVVRAMELDIQSLINEQENIKIQESLCSSYFGDSIKAIENEVQILKDGSRKMNSDIWTVS

SEQ ID NO: 37393 - protein, 123 aa, Sorghum bicolor
  Clone ID: SORBI-28MAY03-C27011_1.pep
MASLISPYLSVPTAPGHARLAAPAAPRRRRMAVVRAKIREIFMPALSSTMTEGKIVSWTAAEGDRVAKGDPVVVVESDKADMDVETFHDGIVAVVLVPAGGTAPVGAPIALLAESEEEVALAR

SEQ ID NO: 37394 - protein, 266 aa, Sorghum bicolor
  Clone ID: SORBI-28MAY03-C27022_1.pep
ARGDDVCISVNSSPSKVINCNATFNNGLPVVSSSVLCAKASMLLQDVSPPALLRFMREQRSQWADSNLDAFFASAMKPNFCNLPMSRLGGFSGQVILPLAHTFDPEEFLEVIKLGNASNYQDALLHRDLFLLQMYNGVDENMVGTCSELIFAPIDASFSDDSPLLPSGFRIIPIDAPLDTSSPKCTLDLASTLEVGTPRCRINGSGPGNAASAGSKAVMTIVFQFAFESHLQDSVAAMARQCMRSIIASVQRIALALSSSRLVPHG

SEQ ID NO: 37395 - protein, 290 aa, Sorghum bicolor
  Clone ID: SORBI-28MAY03-C27061_1.pep
MEAGAWAVVAAAVALYMAWFWRMSRGLSGPRVWPLAGSLPGLVQHAEDMHEWIAANLRRAGGTYQTCIFAVPGVARRGGLVTVTCDPRNLEHVLKARFDNYPKGPFWHGVFRDLLGDGIFNSDGETWVAQRKTAALEFTTRTLRTAMSRWVSRSIHARLLPILGDADADVVVVDLQDLLLRLTFDNICGLAFGKDPETLARGLPENAFASAFDRATEATLNRFIFPECVWRFKKWLGLGMETTLARSVQHVDRYLSAVIGARKLELTGGKQNDASATPHDDLLSRFMRKG

SEQ ID NO: 37396 - protein, 123 aa, Sorghum bicolor
  Clone ID: SORBI-28MAY03-C27094_1.pep
MVSMSTTPKPLDTAAAVAGGGGGGDEGGGGGGKKQVRGAAAAAAVMAPPPMAVPVPPAAGEEVRKVRKPYTITKSRESWTEPEHDKFLEALQLFDRDWKKIEAYVGSKTVIQIRSHAQKYFLK

SEQ ID NO: 37397 - protein, 295 aa, Sorghum bicolor
  Clone ID: SORBI-28MAY03-C2712_1.pep
SDKITYSRTVQQLMKEQPDGTKFPPALDAIKDLKMKDMDLVESYHAYHRLLQKMSENKCHGCIKLKEHISLMKEEKMYKDELSKLKFQMSDEALKQMPEFQGRIELLKIIEYIDSDLVVQLKGRVACEMNSGEELISTECLFENQLDDLEPEEAVAIMSAFVFQQRNASEPSLTPKLAEAKKRLYDTAIELGKLQADLQVPVDPEEYARDNLKFGLVEVVYEWAKGTPFSDICELTDVSEGIIVRTIVRLDETCREFRNAASIMGNSALFKKMEIASNAIKRDIVFAASLYVTGI

SEQ ID NO: 37398 - protein, 117 aa, Sorghum bicolor
  Clone ID: SORBI-28MAY03-C2636_1.pep
AKKQSHPFITETDGSTEAPSQIAFTSHGANHSKQVEERVTSRPQEKTKAAFKCHDTDTRWTHSGRGDTPSAGSQSRAGPACSGRPWPPVPHTRHGCRGAYVHLSSSSCAAMANQNGS

SEQ ID NO: 37399 - protein, 167 aa, Sorghum bicolor
  Clone ID: SORBI-28MAY03-C26338_1.pep
VLRQLGSRTWIKSLSVSCVTIEFVVCAPSTDKLLPWVYPKVDCRPAFVDTGAPGRGCACNFSGGQDGHDPSFRGRARRPHVHRRPDHVDDARRRPRDHGSGGDPDPIWDHAGSDHPRDGSELPTTAPALQGKGDRLLGPPPGARSRRLQATRSLPTSRWGPAPARPS

SEQ ID NO: 37400 - protein, 129 aa, Sorghum bicolor
  Clone ID: SORBI-28MAY03-C26460_1.pep
SEDDFMDVCSSHDGSSIVGHDYCPRRSRKLSGSRAWERANETDQADGGYDVILISDVPYAVNSLKKLYALISKCLRPPYGVLYVASKKNLVGSNGGARQLRALMEEEGVLGGHLLTEVCDREIWKFFFK

SEQ ID NO: 37401 - protein, 60 aa, Sorghum bicolor
  Clone ID: SORBI-28MAY03-C26421_1.pep
MMVVRETALQCLVAFSTLPHSKIYPMRRKVVQAAIKALDDKKRAVRQAAVRCRQTWQSFA

SEQ ID NO: 37402 - protein, 141 aa, Sorghum bicolor
  Clone ID: SORBI-28MAY03-C26473_1.pep
ADEHDTVLRSSSTSHQRRFSSTVPPMNRRTQEGTQNRPGFLPFPRPRTTEFFVCFFAGTKNRRKRREKKGGVFVFSHCSKSRKTAKTPGAGPRTDRQNARENLLSSDELEKKNGAGEAECLCSSSWLDQLSWRAAAGTPAR

SEQ ID NO: 37403 - protein, 71 aa, Sorghum bicolor
  Clone ID: SORBI-28MAY03-C26477_1.pep
FFFFFLAAQHSSYYKVQSVVSFVRHITIDSSRCCTIQHFCVAPASSGTNEEDTCSSKCIGHHTMNSIPNCL

SEQ ID NO: 37404 - protein, 93 aa, Sorghum bicolor
  Clone ID: SORBI-28MAY03-C27275_1.pep
RREEDVRGRSQVRFSILPTSGGALILELFCRSINIHCAAAHKECHVVAEAYSIYCLGLKAWNLCASNAYPMNQKVQKIEGMTTNSVHFHQFRF

SEQ ID NO: 37405 - protein, 209 aa, Sorghum bicolor
  Clone ID: SORBI-28MAY03-C27294_1.pep
HEGPPPPPPPHRPSSSLNQHQPPAPSAAARAGAGGRQVPLLKEFSLAELRAATGGFAAENIVSESGEKAPNFVYKGRLEASRRAIAVKKFTKMAWPDPKQFAEEAKGVGKLRHCRLANLIGYCCDGDERLLVAEFMPNDTLAKHLFHWETQTIEWAMRLRVAYYIAQALEYCSTEGRPLYHDLNAYRVLFDENGDPRLSCFGLMKNSRD

SEQ ID NO: 37406 - protein, 148 aa, Sorghum bicolor
  Clone ID: SORBI-28MAY03-C2731_1.pep
NIDKIGLVNCPVLVIHGTSDDVVDCSHGKQLWEHCKVKYSPLWLSGGGHCNLELYPDYIKHLKKFVSSVSKKTSKPAPKEITAKDGTTSKETKEAYSEKPQEATKCSQISRKSLDSRVGKSKTVDVPDKPRMSSDDIDKFRRRRCLVW

SEQ ID NO: 37407 - protein, 202 aa, Sorghum bicolor
  Clone ID: SORBI-28MAY03-C27340_1.pep
MASPKHSHQHRASAAPPASSNSHSKHMSKQHYARAAASSTKQRPLSLRRAMLHSCVCFLVGLLTGFAPSDWTDAASRAAVHANAAATAQVFRALHAMNNTAAAGALGHLLTLQHYQSSYQQPQQPPPLDLVVVVTTTTTSTGLSERERRSAGLTRTAHALRLVSPPVVWLVVESAREAGPTARLLRRTGVVYRHLTYGENFT

SEQ ID NO: 37408 - protein, 224 aa, Sorghum bicolor
  unsure (1)..(224): unsure at all Xaa locations
  Clone ID: SORBI-28MAY03-C27349_1.pep
RLARPPAPPRPGAGGANPAARPPAPSASARAPPLPRSRSPPSLPPPARARAAAPAPGPAGCRARGGAAAPPGFAAGSRGTRFISSKGIGWKSWNKRWFILTRTSLVFFKSDPSTFPQRGGEVNLTLGGIDLNNSGSVVVREDKRLLTVLFPDGRDGRAFTLXKAETSEDLFEWKTALEEALAQAPNAALVMGHNGIFRALAAAPAQAPIPARVMGHNGIFRNDT

SEQ ID NO: 37409 - protein, 235 aa, Sorghum bicolor
  Clone ID: SORBI-28MAY03-C34475_1.pep
ARGFSLVEVVPLFVDEMEVTETFAIVRFTNDWSGFNDALTLENHCTRNKLGKKEFETRDSGLGSVEGDGGKGEVKVYGWVARAEDYDATSVVGRFLRKHTVLKTIDEVSKTELEKSGEMVAILASQIEEKNRYLQDLETKKNATELSISRLEDDNRKLHEAYNEEMRNLHRRARENAMRIFQENENLRIDLENKRRELNLRAKELEKMSAENANDRKTLDDEKQKAKYDNSELEL

SEQ ID NO: 37410 - protein, 200 aa, Sorghum bicolor
  Clone ID: SORBI-28MAY03-C26752_1.pep
ARGEGIQGLPFVHPASPQAVLIDPFRKGLLEQIEYYFSDANLCKDLYLRQRMDDQGWVPLSLIAGFPQVQKIANNIQFILETVMLSNVVEVQGDKLRRRGAWENWLLPKQNYSAGSSSGSLSPVTSNIDSLASQFRSVGFEGATYHANMPGMHGEALLTRSATSVSLGYHASTFGGLQSNGSGPLFGPKSARNLLRSDTF

SEQ ID NO: 37411 - protein, 182 aa, Sorghum bicolor
  Clone ID: SORBI-28MAY03-C26822_1.pep
ARGLAFFKAAYALYDSDFYVKADDDIYLRPDRLSLLLAKERSHPQTYIGCMKKGPVFTDPKLKWYEPQSFLLGSEYFLHAYGPIYALSADVVASLVALRNNSFRMFSNEDVTIGSWMLAMNVNHENTHALCEADCTESSVAVWDIPKCSGLCHPEVKMLELHQRKECTGGPTVAAEVSESED

SEQ ID NO: 37412 - protein, 92 aa, Sorghum bicolor
  Clone ID: SORBI-28MAY03-C26781_1.pep
HLNSDVYEDPLAFNPWRWKDTPEPVGGSKDFMAFGIGLRLCVGADFAKLQMAMFLHCLVTNYRWKAISKGKMMFYPGLRFPDGFRIQLLTKA

SEQ ID NO: 37413 - protein, 186 aa, Sorghum bicolor
  Clone ID: SORBI-28MAY03-C26970_1.pep
HEASTQCGAFPHLPPQQELEHAIGDLWRRHPLLISSPMCVLHHSVSSPTSTPAMVAFPWWIQGVLDFHGGYMEHDADLVVWWWSPPPSRRWRPIPHPIHGGGSICTLDGAPNPCASPLSLISWFPYIAATVDFVVLQSFIGDVSVVHSRCFSSSSVVVAIICFFLFLTSSSQCCCSIASLRCCSMF

SEQ ID NO: 37414 - protein, 149 aa, Sorghum bicolor
  unsure (1)..(149): unsure at all Xaa locations
  Clone ID: SORBI-28MAY03-C26976_1.pep
MELHATLLLTSLVLIGLLPHTHQAITQGNCERSGLCTYIVRVSPPPSISMDMSPTNLESWYRSFLPPHMERSPRSASPFIHTYKEAIFGFAIDLTNDEAEYVKSKDGVLMMYKDTLLPLLTTHTPDSLSLRPNGGAWDSLSMGEGSIIX

SEQ ID NO: 37415 - protein, 181 aa, Sorghum bicolor
  Clone ID: SORBI-28MAY03-C2753_1.pep
AQGHVRTRLYFTSESHIHSLMNVLRYCNLDESLQGEESLVCQSALDRLHRTRELDYMSNIVLRMFENTEVPLEDEKRFRIEMTFSRGADLSPLEDTSGESSLLQEHTLPIMGPERLQEVGSCLTMDKFEKMVRPFAMPPEDFPPAAPPQALGYFSKGAGGVLERLVSLWPFHKSANAANGK

SEQ ID NO: 37416 - protein, 198 aa, Sorghum bicolor
  Clone ID: SORBI-28MAY03-C27614_1.pep
MAAAASLSGKLLFPSSLCLCLLLLCCSGAGGAAASSSWGASRGGAARECGFDGKLEALEPRHKAQSEAGSVEYFSRFTEADRELTCAGLFAVRVVVDALGLVLPRYSNLHSLVYIAQGRGIIGFSFPGCQEETHHQQQYGYGYGYEHHHQRPDEHHKIHRFQQGDVVAMPAGAQHWLYNDGDTPLVAIYVFDTNNNIN

SEQ ID NO: 37417 - protein, 179 aa, Sorghum bicolor
  Clone ID: SORBI-28MAY03-C2757_1.pep
SGEYEPSGRPLDGTDYARAQNARRFMIYVHSKMMIVDDEYIIVGSANINQRSMDGGRDSEIAMGAYQPCHLNTKGQVARGQVHGFRMSLWYEHLGVLHDDFLNPGSLECVQRVNQMADKYWDLYASDSLDADLPGHLLRYPVTVTKEGTVTELPGAKFFPDTQALVLGALGKFPPFLTT

SEQ ID NO: 37418 - protein, 157 aa, Sorghum bicolor
  Clone ID: SORBI-28MAY03-C27538_1.pep
MVSSQPSSLTAILTQGPNLCPVKILLPMGPPDVVSSDNIEYDFSDVFGSTPVQTPTNLGGLGPDSPSPTVESNEEFYSDPIIIINRSHSLVGPTSLVSRSLRLSKLSLGKTEGSSELVKCLSEEKEGDQGQLSDEELGNAMTEDEGVGLDDFEILKL

SEQ ID NO: 37419 - protein, 249 aa, Sorghum bicolor
  Clone ID: SORBI-28MAY03-C27653_1.pep
MRPLPTIQPGPARRRASLSRRALLGRPTAFLCATRSGGAGAGSPPPRAAARHQQEVLAQIAMLQAQKVRITDFLDERSAYLTKFAKDADSEFDLIGQNAMKELDAVGDQILERLDSKMQAFEQAPELLWPVTGGCGEVSGVLVPWPALQQHRGMFFQSLGKVKPRNKKEIKVKAKVEAQKVKEIAKESAGSKTRMNIYLGLMGILGITIANAIFATAEVEWRKVAALGLIFIGLVAQIIYEQDISPPKN

SEQ ID NO: 37420 - protein, 182 aa, Sorghum bicolor
  Clone ID: SORBI-28MAY03-C31952_1.pep
MKGAGAGAASPGDYVARGSVVPLHKISIGSKLWSYYDFGPKVVPPLVCIPGIAGTADVYYKQIMSLCMKGYRVISIDVPQVWNHHEWIHSFEKFLDSMNIHHVHIYGTSLGGFLAQIFAQHRPRRVKSLVLSNTFLETHKFAAAMPWSPVVNWTPSFLLKRYLLTGIRDGPHEPFIADSVDF

SEQ ID NO: 37421 - protein, 162 aa, Sorghum bicolor
  Clone ID: SORBI-28MAY03-C320_1.pep
LPLLPSNQPPLLPLPPTATKDRRRRPSRPPPPATERSAAQKKPLERATPLPPAPVVTEALDDLEQEVARNFVEDLLHMLAPPPSSLPLPSFSLVVKACPAKDTRLVAPAAPSCNVEAATADGIRGLLRLSDTRRTPTSPPWYSIINISPPILFLGLGKLNAY

SEQ ID NO: 37422 - protein, 150 aa, Sorghum bicolor
  Clone ID: SORBI-28MAY03-C32003_1.pep
AKDEEVYDAARRAAIHDTIMNFPDKYDTVVGERGLKLSGGEKQRVSIARVFLKEPSILLCDEATSALDSTTEASILNSLKSLSVDRTSIFIAHRLTTAMQCDQIIVLENGKVVEEGPHDFLLSKGGRYAELWYQQNSSDASDSAAVSLEV

SEQ ID NO: 37423 - protein, 105 aa, Sorghum bicolor
  Clone ID: SORBI-28MAY03-C32028_1.pep
HCYLLLAIKSSAIVAILVLTTHRFLLCCLVPTHYNSLYCIPQLKCGICLVRTVNYNTLYIGNCFVRVGMLSGAPPVVASDTGCPRSIHGPAAASPGCSCFSWFRN

SEQ ID NO: 37424 - protein, 224 aa, Sorghum bicolor
  Clone ID: SORBI-28MAY03-C32007_1.pep
FPCSSSAAGFPAGAEHDYLVHVLLIRVSGVRASRLLSPCARDVLCRVTRSTIGAGFAPASLPVGVRPLLAPCALAAGPARYRAITSAYYRGAVGALVVYDVTRRITFDNAERWLRELRDHTDANIVVMLVGNKADLRHLRAVTPEDAAAFAERHGTFSMETSALDATNVDRAFAEVLRQIYHVVSRNALDIGEDPAAPPRGKTIDVGAAKDEVSPVNTGGRCSA

SEQ ID NO: 37425 - protein, 69 aa, Sorghum bicolor
  Clone ID: SORBI-28MAY03-C27760_1.pep
ETKKPPAQLKCYTETPREAIKQYTTSLCSFHHPTLMIRLVRKRQGMMWTVESRITLLQIVETKTKQNCS

SEQ ID NO: 37426 - protein, 66 aa, Sorghum bicolor
  Clone ID: SORBI-28MAY03-C27861_1.pep
ATTFFCFTVPHCPSSVVIFKTPWLRLEIFLLLYLNGSLVENTLCKLIFVHYLLLISEMTNDCAVGT

SEQ ID NO: 37427 - protein, 280 aa, Sorghum bicolor
  Clone ID: SORBI-28MAY03-C2790_1.pep
HEALVARPASRRPAPLSPVPFCPSPWPGRAALRLRLAPAGSRPCPRRSTTTPPPGQSLRPDRDSGRSSHRPGGHRPGLPVPAGPARHSSVARGHGFRRLFDGQLLQDLVTQRDWANLEKQLKILVSAVDVHGDPEKLHPSLFIIVVREWIVDHIKKKEHGAALKMFIDKVSILYEVEGAFINRSDLKLQINRLHKIANAKAKAKATPVKAIQDRLSDYIYLYFADFYGPEKQAGCHSHLWRFAKMIGKPPGQEDPSFRCLACRTTFKNCPISKMRDHLDT

SEQ ID NO: 37428 - protein, 101 aa, Sorghum bicolor
  Clone ID: SORBI-28MAY03-C27900_1.pep
AVSVLISIAWIGYELYFNATDPLSELWQRAWIFPSVWPVPAAPLLAFLCCPRSPSPTPTGFAYSEDAGEGADEEGLSLVGSAVKGTGDMVNMHIFPEDKRA

SEQ ID NO: 37429 - protein, 176 aa, Sorghum bicolor
  Clone ID: SORBI-28MAY03-C27906_1.pep
MQQLIQQCKLKHWMEQLKHHGHSTTTTPNNCCNNMKQTTTTCRMKQLKQHLKNTILQQRLKPTAMSRENHCNNDKSEAESSPKPYPTATSLEKHYSSEPRRCLHLQMHGGHKSEGERAGRKGVAPFTGSYHRRALLRWLRGRVGRSGEVLYNPKAFFIHAAWMHQACAHCAIFPTD

SEQ ID NO: 37430 - protein, 184 aa, Sorghum bicolor
  Clone ID: SORBI-28MAY03-C27363_1.pep
MEAWPPLAPAAAAAATPTAAASGEAAAAPAVAGAWGAVATAQRKAVVKESAAQAVSRIVASCANSSGVAVAVVDANAVISGGSALSTSAERLVTVPEVLEEVRDAAARRRLGLLPVPVETVEPAPEFVKKVTRFARETGDIQTLSDVDIKIIALAYMLEAEIHGTSHLREHPPPLREVNVRKLS

SEQ ID NO: 37431 - protein, 177 aa, Sorghum bicolor
  Clone ID: SORBI-28MAY03-C2740_1.pep
ARGGSVPPPRCGHSATMIEKRLLIFGGRGGAGPIMGDLWALKGIARGDNETPGGTQLKLPGQSPSPRCGHSVTSGGPYLLLFGGHGTGGWLSRYDVYYNECIILDRVSVQWKRLPTSNEPPPPRAYHSMTSIGSRFLLFGGFDGKNTFGDLWWLVPEDDPIAKRYQILYLVPICLVS

SEQ ID NO: 37432 - protein, 303 aa, Sorghum bicolor
  Clone ID: SORBI-28MAY03-C27413_1.pep
HEDDDITEERLYQNIFASHFGQLAIIFLWTSGNLFHVAWQGNFESWIQDPLHVRPIAHAIWDPHFGQPAVEAFTRGGAAGPVNIAYSGVYQWWYTIGLRTNEDLYTAALFLLFLSTLSLIGGWLHLQPKWKPSLSWFKNAESRLNHHLSGLFGVSSLAWTGHLVHVAIPGSRGEYVRWNNFLDVLPYPQGLGPLLTGQWNLYAQNPDSSNHLFGTTQGAGTAILTLLGGFHPQTQSLWLTDIAHHHLAIAFIFLIAGHMYRTNFGIGHSIKDLLEAHTPPGGRLRRGHKGLYDTINNSIHFQL

SEQ ID NO: 37433 - protein, 148 aa, Sorghum bicolor
  Clone ID: SORBI-28MAY03-C2744_1.pep
YAHASGFVLTDSRLPDMPIIYASDAFTSLTGYSREEILGCNCKVLNGPGTSLEVLEEINQHICSEQACTVDLLSYRKEGSSFCDLLHVSPIRDASGKVAFHIWVHLDMGAKHEFNGLVPEVWLLGAVGAVRVAVRGLSASGSLLRPSQ

SEQ ID NO: 37434 - protein, 280 aa, Sorghum bicolor
  Clone ID: SORBI-28MAY03-C27418_1.pep
HEGLKQETDKLAKEVEQLQSDRFADVEELVYLKWINACLRYELRNKDAPSGKTVARDLSKTLSPKSELKAKQLIMEYANGGAEDSHLGHVEFGSECASSRASSGELDDVSIDIASMTKHNNNDNKNPKKKKFFSKLRKLVLGKGKENREVSTLERRVSISSCSFDDFTGRDSHDSYSSFMAEPNISDSRRHGDHGFGTHSSFDSAKSSPRGTEIVGERSDDSGIKTVCSREEKVNAFGHSARLDSSKAIPEDVEIHKFADALITSRSGSMSSRKSSSFRH

SEQ ID NO: 37435 - protein, 85 aa, Sorghum bicolor
  Clone ID: SORBI-28MAY03-C27507_1.pep
HPSSALPSSSSPYHPAPAAATFAAAGACPPPPGRRTPVSPTRVARSSCHVIVAAADILPPRRRSLSLRPRVRAPPVQERGWKLEA

SEQ ID NO: 37436 - protein, 126 aa, Sorghum bicolor
  Clone ID: SORBI-28MAY03-C28080_1.pep
LLGFGSDGVNEERLNDIATQIGNAVGKLHDGGLVHGDLTTSNMIIKNSNYQLVLIDFGLSFTSTIPEDKAVDLYVLERALISMHSSCGDVMEKILAAYRKASKQWCSTQNKLAQVRQRGRKRTMVG

SEQ ID NO: 37437 - protein, 102 aa, Sorghum bicolor
  Clone ID: SORBI-28MAY03-C2817_1.pep
RPGNQFGQLGTGSDQAETVPKLVDATSLENKNARSVSCGARHSAIITDEGEVFCWGWNKYGQLGLGDSMDRNVPCSVPVDAYHPLNVSCGWWHTLVLAESPT

SEQ ID NO: 37438 - protein, 149 aa, Sorghum bicolor
  Clone ID: SORBI-28MAY03-C28189_1.pep
AGITPLALVWKDETCSQYVIDTDKKGEIPSEQHLVLELLEDGSVVTSDDPPVAFGSLDSAFIQKSNLRPGNLLRFAVRDESVKLVDGKMQIGQLQFVGKPNRARAFADSHSKVLFQYAARHVPLRIEDLVASIQSNNMELESTDVEMQD

SEQ ID NO: 37439 - protein, 76 aa, Sorghum bicolor
  Clone ID: SORBI-28MAY03-C28211_1.pep
DRFSRLILVWPVSMNAKRLFFGSILCAFSIGGPLFHTSSGVLMNWLWLLHHAGVFLELPSVPVPVPCETRDYAYSA

SEQ ID NO: 37440 - protein, 84 aa, Sorghum bicolor
  Clone ID: SORBI-28MAY03-C28213_1.pep
TRKCCDQPIIYVVRDQMIFSGTKMLRTPRYLCTSPSSSDGNNTAASRSPALGLHRSPARESLTCKTTQHSSTQSSALINVQGLC

SEQ ID NO: 37441 - protein, 161 aa, Sorghum bicolor
  Clone ID: SORBI-28MAY03-C27662_1.pep
MAVLVARQGRELQRYSQSTGGRIVVGCIPYRVRPCDGELEVLVITSQKGHGMMFPKGGWEVDESMDEAARREALEEAGVLGDTEPVLGFWHYKSRRYVDQTYEGFMFPLRVADELHQWPEMASRKRTWATVQQVMDGCPHWWMREALERLVARHAVLQSAL

SEQ ID NO: 37442 - protein, 265 aa, Sorghum bicolor
  Clone ID: SORBI-28MAY03-C27675_1.pep
MASSSDEQPKPPEPPAAAAVVAAAAAAVPPQTHAEWAASLQAYYAAAGHHPYAWPAQHLMAAAAAGAPFGTPVPFPVYHPGAAAAYYAHASMAAGVPYPTSEAVPAVVPAAPLPEGKGKGKGGGASPEKGSSGAPSGEDASRSGDSGSDESSDTRDDDTDHKDSSAPKKRKSGNTSAEGEPSQTAVVRYAAVESPYPTKGRSASKLPVSAPGRAALPSATPNLNIGMDIWNASPALAVPAVQGEANPGLALARRDGVTQLDEREL

SEQ ID NO: 37443 - protein, 188 aa, Sorghum bicolor
  Clone ID: SORBI-28MAY03-C27706_1.pep
ARGPPQQASVAARAPAVAPVPALDPRGSGFRSSRAPMLAKQAPRVGQQLHSPGMVAQTPPNVRFGQPIGNGAQSHIAQGTFPNPCNLAQAGRTRPARERATWCGNNRRGSLLASAPHRAVLSHAAEPGARVAPPGDGANRAPHWSLPTLVPQRHGCSSLIGSGCAEPANCWPLSLSLSECLASFCLVT

SEQ ID NO: 37444 - protein, 272 aa, Sorghum bicolor
  Clone ID: SORBI-28MAY03-C27739_1.pep
MAPLASHPLPSRAPTTAPRFLAAPAIRVLSLSRSASPLLSASAGRFPQAPRAPCSAAREHRRDTVRECTRADAAGPAPLSKTLLDLKDSCWRFLRPHTIRGTALGSIALVARALIENSHLINWWLLFKAFYGLLALICGNGYIVGINQIYDVAIDKVNKPYLPIAAGDLSVESAWLLVILFAAAGFSTVIAKFGPFITSLYCLGLFLGTIYSVPPFRLKRYPVAAFLIIATVRGFLLNFGVYYATRAALGLTFQWSSPVAFITCFVTLFALV

SEQ ID NO: 37445 - protein, 78 aa, Sorghum bicolor
  Clone ID: SORBI-28MAY03-C277_1.pep
GGVALGELELNPEFNLMQLSVEDFENKIQDAIRPTYERSIKAAQDYGIMKESPESLVHGANICAFLNIAQAMADQGCV

SEQ ID NO: 37446 - protein, 151 aa, Sorghum bicolor
  Clone ID: SORBI-28MAY03-C2859_1.pep
GVPLSSAQVQFSLLSMGDDQMELKTVCDSLGIRLIAYSPLGLGMLTGKYDASKLPRPTRPVLFRQILPGLESLLSCLRRIAEKKGKTMSQVAINWCICKGTIPIPGVKMVRHVEENLGALGWRLSSAEIAELEAAAMAAPKKMVQNVFQTA

SEQ ID NO: 37447 - protein, 190 aa, Sorghum bicolor
  Clone ID: SORBI-28MAY03-C28562_1.pep
ARTPKAQHCSAWLGLSSSFVAMATKMVLCRFVALAALACLLRPGAPVELHRRLSAWSGDAGATWYGAPTGAGSDGGACGYQNAVDQPPFSSMIAAGSPSIFQNGEGCGSCYQVKCTGHASCSGSPVTVVLTDECPGGACLAEPVHFDLSGTAFGALAKPGQADQLRSAGLLKIQYTRYVSSRSAPRARAA

SEQ ID NO: 37448 - protein, 232 aa, Sorghum bicolor
  Clone ID: SORBI-28MAY03-C28594_1.pep
HEGNGLAFIDFTLDDRSPMSEPFGDNHDAYSQPVNKYQLIRVSAKGMNEGCKWVEMFEDVSMVIFSVALSDYDQLGAPASGSSRTLTNKMIQSRDLFEATIRQPCFRDTPFVLVLNKYDLFEEKIGRSPLSSCEWFGDFCPLRTNHNNQSLAQQAFYYVAMRFKDLYAASTGRKLFVWQARARDRPTVDEAFRYIREVLRWEDERDAAGYCPEESFYSTTELSSSRLIVAAE

SEQ ID NO: 37449 - protein, 150 aa, Sorghum bicolor
  Clone ID: SORBI-28MAY03-C28605_1.pep
NNSKKEQSRAEQRRGKRPASQAAMEMGDSFEYYWETQQYLESEELSIYLGTQDDALSCYDSSSPDGSISNNSSWAAPAGTGATAAAGKEEEGPGGAGGGGAVAAANKNIIMERDRRRKLNEKLYALRSVVPNITKMDKASIIKDAIEYIE

SEQ ID NO: 37450 - protein, 185 aa, Sorghum bicolor
  Clone ID: SORBI-28MAY03-C28649_1.pep
HEERIKEEAEKQAAVEKGAPDASWDVDSKETQDHVQEDENKVAEQHDGHATDHDNHVTESGASVEQHGSVSKDGISAEAGTVDELPQKESAASTLEKDLSSDNPEGLSREELGRMVASRWTGESVNEVSKDDKKGHKDEQEIPEPAEEALEDEIEIPEPAEESYGGYHSEVEDDRHKYEDEEFDH

SEQ ID NO: 37451 - protein, 125 aa, Sorghum bicolor
  Clone ID: SORBI-28MAY03-C27927_1.pep
EDAGVAPEEVNYINAHATSTLAGDLAEVNAIKQVFKDPSGIKINATKSMIGHCLGAAGGLEAIATIKAITTGWGHPSINQFTPEEAVEFDPVPNVKKQHEVNVGISNSFGFGGHNSVVVFAPFKP

SEQ ID NO: 37452 - protein, 170 aa, Sorghum bicolor
  Clone ID: SORBI-28MAY03-C27930_1.pep
EDHEAFWCFVGFMRKARHNFRLDEVGIRRQLKTVSQIIKRKDSHLYRHLQKLQAEDCFFLYRMVVVLFRRELTFEQTMCLWEVMWADQAAIRAGIGRSTWARIRLHAPPTDDLLLYAIAACVLQRRKLIIEKYSSMDEILRECNSMAGQLDVWKLLDDAHHLVVDLHDKI

SEQ ID NO: 37453 - protein, 165 aa, Sorghum bicolor
  Clone ID: SORBI-28MAY03-C27959_1.pep
GGPTGELARAAGQGPCADRALTRVLCIPAAGPPRLGSSVPVPRRTHQIRVHLKHAGYPIANDELYLSGNFCPRSTKGTSASKEIAPSDPDNSAVDHGSKDAETDVEFDIDPMCTNCPNLAPVGYDGDEEGLWLHCARYTGPDWTYECPYPDWAFLGSVSTKKMKS

SEQ ID NO: 37454 - protein, 153 aa, Sorghum bicolor
  Clone ID: SORBI-28MAY03-C28014_1.pep
RIILPTILETSKQPPPHARNCSPHEACCWTKDDIARAGFARPTECVPIHMPIDEAGAMASLILCHGRGLHRAPDRPVGSHGLEHYMSNFFSGHLTPPRVLAPALTDIALQVQWSCKSRQTMPQNGEEKKKKNVAHAPPPVEGEKAHAPPPTHL

SEQ ID NO: 37455 - protein, 169 aa, Sorghum bicolor
  Clone ID: SORBI-28MAY03-C2804_1.pep
FRNTMTRARHPSTTHSSMRCGGRRIDGDMGRPASGKDGCATAPRAAGVLVVAAWCRVASQQIFPWNISSLLPVYLLVLVAGEGSSEDMAKGRRKPRHLASRESACGALRPGGRRWAASCPWPAPSLGGAAPRPWPAPSPGGLTARERSRRRSRCVGEVVSGEWGSQAPD

SEQ ID NO: 37456 - protein, 112 aa, Sorghum bicolor
  Clone ID: SORBI-28MAY03-C28791_1.pep
MRICELGDGDGGLVLQQEQQEEAVQASGGGELVRLKAKRALVGAGARVLFYPTLLYNVLRNRYEADFRWWDRVDQFILLGAVPFPSDVPRLKQLGVQGVVTLNEPYETLVPT

SEQ ID NO: 37457 - protein, 116 aa, Sorghum bicolor
  Clone ID: SORBI-28MAY03-C28888_1.pep
EVVTGVAKKQSKAPNGSSKSSKSNSKPSKQTNSNSKPAKPTHPKEEEDSGHEDAEEEDQAYLCGSCGESYANGEFWICCDVCEKWFHGKCVRITPAKAEHIKQYKCPSCSTKRSRE

SEQ ID NO: 37458 - protein, 109 aa, Sorghum bicolor
  Clone ID: SORBI-28MAY03-C29017_1.pep
AITDNKLEELFQLSLRMFDTRLPPGVTVMSPFADDSSLNKMGVESFPEELFSVLRTIQLLRGLTVGMGLTFSCAQHWRPIAEEVLLKAGRQNASKSRNQKRSFLRRLFW

SEQ ID NO: 37459 - protein, 179 aa, Sorghum bicolor
  Clone ID: SORBI-28MAY03-C29028_1.pep
LPSFVQQVKSPSNLGFLYSLMNSSFSFYLFSYQVHEKSILLPLLPASLLALEEPRMYGWFVYFALFSMYPLICRDQLLLQYIAVLGLFFLIHYSPGGSYGKRSNMSCRAKLVLSLPFLCSLLLHITYLQIEPPNRYPFLFDALIMFVCFSQFVILALYTNYKQWMLDTHFRSIGVKKDL

SEQ ID NO: 37460 - protein, 181 aa, Sorghum bicolor
  Clone ID: SORBI-28MAY03-C28314_1.pep
MSALPIIVKQTTTSTVKLPTAILSTYAKAKSRAKKDAESKANQEKATEEASGSTSSKAAKAQEKDADAMQVDNATEKKAPEPEATYQLLTNPARVIPAQEKFIKFLENSRYVPVKPAPSGFILLRDLQPTEAEDLALTDAPTTVAGSTGNTAPAAGQQGSGSSAMAVDDEPQPPQPFEYTS

SEQ ID NO: 37461 - protein, 130 aa, Sorghum bicolor
  Clone ID: SORBI-28MAY03-C28320_1.pep
KGEKAGKAETFVDLPGCPDNIRLGSDGHFWIALIQLRSPWLDFITRWTFTKRVVASFTGLIEWSKGTAKGAMVAQVTEDGNIVRILDDSEGKVINFVTSVTEFNGDIFLGSLATNFVGKLSLAQVIQQEQ

SEQ ID NO: 37462 - protein, 52 aa, Sorghum bicolor
  Clone ID: SORBI-28MAY03-C28331_1.pep
TKRIHGYARLFIAEVFAKGLGDKLQVFSTDFIDGDFVDACAGVTKARVEGTA

SEQ ID NO: 37463 - protein, 131 aa, Sorghum bicolor
  Clone ID: SORBI-28MAY03-C28359_1.pep
MDMEAAAIFGTASASFSPAPSSSRSRGGGGGTSISRLPARVAGAVVRSLVTFVFAAVGMVLGAVTGALIGLATESGLVRGAGIGAISGAVVSMEVVDSSVAIWRSDESGIWSVLYVLDVLWSLLTGRLVRE

SEQ ID NO: 37464 - protein, 286 aa, Sorghum bicolor
  Clone ID: SORBI-28MAY03-C28369_1.pep
ARGSSCRCRSRDADGEHRPGPSLRRSRSNLQSWELRRLLRTRPSRALCSACPRPPALSPGGRAAAAALRQLLRLLSVPAPAASTPLLDGAAITVGVALAGPAADVLHEPLSPGCQEVSLSAFAFLFSELVQYNQTQVDNITELERRLEDAGYAVGARVLELLCHREKGNRRETRLLGILSFIHSTVWKVLFGNVADSLEKGTEHEDEYMISEKELLVNRFISVPKDMGAFNCGAFVAGIVKGVLENAGFPAVVTAHFVPIEGQQRPRTTILIKFAEEVLHREARLG

SEQ ID NO: 37465 - protein, 114 aa, Sorghum bicolor
  Clone ID: SORBI-28MAY03-C28486_1.pep
STCSVPLFWCYEITAWGLAVLYGGTAFFLRPRAAVVLDEGEDTTHNVGLEMLESKMEVTPEMQRRINDGFKQWMGSSLLSSDDEDEATDDYIEHDAPSPTALGQQHQQEHDLET

SEQ ID NO: 37466 - protein, 131 aa, Sorghum bicolor
  Clone ID: SORBI-28MAY03-C29354_1.pep
MFLVREAWVLYQQGRLLDIVDASMERYPEKEVLRYIKVGLACTQATPSSRPTMRQVLALLSRPVALPETEMRPPSFAEYRGHHTAPGGLPAGPLLRASPRARWPPQALAAAAAATAPKCSASFTYSEVAPR

SEQ ID NO: 37467 - protein, 120 aa, Sorghum bicolor
  Clone ID: SORBI-28MAY03-C29386_1.pep
MKVEFLPFSFENANTRRYFVFGKVRRKKDLESTFSFAFSLRKITQSKSNYLLYKNEMLVMPNILSLTCICFNSVLCPTSFFFAKLPEAYAIFNPIVDVMPVIPVLFFLLAFVWQAAVSFR

SEQ ID NO: 37468 - protein, 126 aa, Sorghum bicolor
  Clone ID: SORBI-28MAY03-C29395_1.pep
ENRNTTDPEESELSPSSIQNKHGVTEVPSFQELNSDHVPNVEADKHPISSAEAEIVDKSVIQEELVMKTEAKSLPTEKSNPHPAEDDDEKEVDDWLQDVDHVSSKTGNTTAVGEEEDVSFSDLEDD

SEQ ID NO: 37469 - protein, 102 aa, Sorghum bicolor
  Clone ID: SORBI-28MAY03-C29373_1.pep
GARARNQHRLAKSLNHYHTSKERKGISKMFRGNPRASASNELPIESVVRVKKVERIEANNLATKPSQMATAKVTRSLTVSIVRVGDVDEMPDSFVSVPIAHT

SEQ ID NO: 37470 - protein, 116 aa, Sorghum bicolor
  Clone ID: SORBI-28MAY03-C29348_1.pep
HFSGGQWNSGGSCDKESEPITNEQYLSTYPPKMSILEDVIHKMKTPVVYLNITRMTDYRKDAHPSIYRKQNLTDEERRSPERYQDCSHWCLPGVPDSWNELVYAQLLIRQHQMRQQ

SEQ ID NO: 37471 - protein, 82 aa, Sorghum bicolor
  Clone ID: SORBI-28MAY03-C28704_1.pep
YDPDPATKKMMTMVAELAFRCLQQNGEMRPPIKEVLEVLRSIQGECLTEKDGDKKNKDGPVSPTTVHAPWDSRATTPNTSKD

SEQ ID NO: 37472 - protein, 112 aa, Sorghum bicolor
  Clone ID: SORBI-28MAY03-C2869_1.pep
VRPRVRKFASTKKLVDLLKKQAESNKPYGAICASPAHVLQPHGLLKGKKATAFPPMSHLLTDQSACEHRVVVDGNLITSRAPGTATEFALAIVEKLFGRDKAVSIAKEMIFM

SEQ ID NO: 37473 - protein, 154 aa, Sorghum bicolor
  Clone ID: SORBI-28MAY03-C28754_1.pep
MATPPRFPPALAGCFPRRGSPRGPDNPNPRPSSPLPGSPEDALLRAAFDGDLRLVKKMTRVLDGGEERGAEKVRAVRSSNGLGALHLAAARGKLPVCRYLVDDLGLDVNSINEAGLTPLTCAIDAGSVDVVQYLLNNGADTETLVSTGLTPLVY

SEQ ID NO: 37474 - protein, 135 aa, Sorghum bicolor
  unsure (1)..(135): unsure at all Xaa locations
  Clone ID: SORBI-28MAY03-C28762_1.pep
MQQASACFSSTTSSSLLVMPVVALVMVVPLLLGLLSTTPSLAWAAPVSRTITVDCHGRGDVRTVQSAVDSVPDGNRDWIKIHVMAGSYWHXREKVSIPKQKGYILLEGDGSSTTDISFDAHAHAGIDDIMGRPNL

SEQ ID NO: 37475 - protein, 82 aa, Sorghum bicolor
  Clone ID: SORBI-28MAY03-C28780_1.pep
TRISTEIDISIFYRGLDHGSKHTLVSVVCYYGQHYHCFAFKDGRWVMYDDQTVKVIGSWDDVLVMCEKGHLQPQVLFFEAAN

SEQ ID NO: 37476 - protein, 64 aa, Sorghum bicolor
  Clone ID: SORBI-28MAY03-C28783_1.pep
KIGHVIHMLEVDDFPYRDERRGGKAPTQARSVETPASEPGDSSGNNTPKDAPKGDPFKWRNQED

SEQ ID NO: 37477 - protein, 123 aa, Sorghum bicolor
  Clone ID: SORBI-28MAY03-C29512_1.pep
PPKHDDQRSSLNSLSGKSSNSPDSSGFGRTLSKKSLDMALRHMDIRRSIPNNLRPLMTSIPASSVHSARSGSTRSRPISVSDSPLATSSNASSEPSVNNNLMCLDSIDIDDELCSDRAGPYGR

SEQ ID NO: 37478 - protein, 146 aa, Sorghum bicolor
  Clone ID: SORBI-28MAY03-C29523_1.pep
FSSNSFNFIQTLLLQLLAGHLEPLTDQQLVGISNLQQSSQQAEDALSQGMEALQQSLAETLASGSLGPAGPSGNVANYMGQMAMAMGKLGTLENFLRQADNLRLQTLQQMQRILTTRQSARALLAISDYFSRLRALSSLWLARPRE

SEQ ID NO: 37479 - protein, 157 aa, Sorghum bicolor
  Clone ID: SORBI-28MAY03-C29580_1.pep
PLRPDEAELFEKSAQNAYALFRDKAAMSRSMSVDQMEIVAQGRVWSGHDAFSRGLVDSVGGLSQALAIAKQKANIPKDKKIQLVEVSKPSPSLPEFLSGIGGSLLGVDRPVKGVLQDMTTLSGVQARMDGILFENLGDMSGENQLLLLVKDIMNYFD

SEQ ID NO: 37480 - protein, 132 aa, Sorghum bicolor
  Clone ID: SORBI-28MAY03-C29603_1.pep
QQFKPQHSIHKAGVSNQYQAALTQNVLPAINQISQLVAGSHRPVGIQNQAIAVPPQYGSGSLASYYGVTSTTPYRSSTLAPGPGALNGPSAQASSRSKLYSGDPLAAVSRSSDKKGSSYKYSLSSMSTYDHK

SEQ ID NO: 37481 - protein, 125 aa, Sorghum bicolor
  Clone ID: SORBI-28MAY03-C29613_1.pep
FSKVSNAALVKNPEWEGSPNLGQKSGLISTLISTHFSTAAQKPAPRPADVNINSAVYPGGPPVPAQAPKLLKYVDTAEMVRGPQDTPGYWVVSGAKLQLERGKISLRVKYSLLTAMVPDEYTLDE

SEQ ID NO: 37482 - protein, 147 aa, Sorghum bicolor
  Clone ID: SORBI-28MAY03-C2904_1.pep
MVVEEITEGVKNLAVAGDAAAASGGEGQRRGGGGSSNRIQVSNTKKPLFFYVNLAKRYMQQHGDVELSALGMAIATVVTVAEILKNNGFAVEKKIRTSTVEINDESRGRPFQKAKIEIILGKSDKFDELMAAAAEERGEVEDGEEQA

SEQ ID NO: 37483 - protein, 194 aa, Sorghum bicolor
  Clone ID: SORBI-28MAY03-C29074_1.pep
YIYAPQHDYTTKCMFNVRAHLLVNNKGGHAQYKRLGNLVIDDLINMSTFMCRFLSPSVRGARRVASPQLARINRGQVNVAVHGAVDGLQRRLLEDGGQVLLLLVHRRLLLERHELLLYLGPHLQPPLYHLEFVDAAAHVLDVRRRRRRSSLPQRQLPRLLQDEPHRRRQELDDRLLRRADAGGALHLVARHPGV

SEQ ID NO: 37484 - protein, 148 aa, Sorghum bicolor
  Clone ID: SORBI-28MAY03-C29266_1.pep
PPQQPQAQPQLQLHTQTQQPMQSQLQLHSLTQHSLQPQLQLQPQSQPQQLPQVQLHPQPQQQTQVQMHPHPPQPPQVQVHPQPSQPQVQIHPQPQQPPQVQLHSSAQQASQPEPQVHLQSQEPSQAQLQSQLPGQLQTQAQSGPGVDS

SEQ ID NO: 37485 - protein, 169 aa, Sorghum bicolor
  Clone ID: SORBI-28MAY03-C29132_1.pep
GDESTAALTYEHLKRLHYTHAVLYENMRLFPPVQFDSKFSAGSDVLPDGTYVAGGTRVTYHPYAMGRMPRIWGADHGAFRPDRWLTGPGGTFVPESLYRYPVFQAGLRVCLGKELAVTEMKAVAVAVVRAFDVEVVGDGGNAACAPKFVSGLTASISGGLPVRIRRVVR

SEQ ID NO: 37486 - protein, 140 aa, Sorghum bicolor
  Clone ID: SORBI-28MAY03-C29309_1.pep
IGKVPHLSEFLNSLYNCQYKSFFIAFSGLTEPIKLDRYLQPHFRYYMREVRTVVYSQFLESYKSVTMEAMAAAFGVTVDFIDQELSRFIAAGKLHCKIDKVAGVLETNRPDARNAFYQATIKQGDFLLNRIQKLSRVIDL

SEQ ID NO: 37487 - protein, 159 aa, Sorghum bicolor
  Clone ID: SORBI-28MAY03-C29682_1.pep
VNVDFADVKAVMKNSGTAMLGVGVSSSKNRAQEAAEQATLAPLIGSSIEAATGVVYNITGGKDITLQEVNKVSQIVTSLADPSANIIFGAVVDDRYTGEIHVTIIATGFPQSFQKSLLADPKGARIVESKEKAATLAHKAAVAAVQPVPASAWSRRLFS

SEQ ID NO: 37488 - protein, 116 aa, Sorghum bicolor
  Clone ID: SORBI-28MAY03-C29703_1.pep
SPEASTEAEVIHSSLQVDEPLIPEPSTEVEGMDSSLEHTSVVNGQAALIAPTITSALSMSAATMPVSNDSCGCYLGTNRIQVYPRHTDMVIPEGATMLPISDNQWVAVSLPYSNNN

SEQ ID NO: 37489 - protein, 172 aa, Sorghum bicolor
  Clone ID: SORBI-28MAY03-C29709_1.pep
MPSLKEAFARDHNLDCENVDCFSCADDVNDVTPDKSDYKNKCFLLQGLSEAQNLTLMCDYNGVVFHRDLEWCPTFNNLRTLLLNEWWCKDPDFYGLNLILKHSPVLERLNLHLFTKGPQHKVEMIGRYNQMERPATILKHLKEIEVKCDVVNEQVHKVLKFLGTFGIHFLFK

SEQ ID NO: 37490 - protein, 114 aa, Sorghum bicolor
  Clone ID: SORBI-28MAY03-C29718_1.pep
DPEEALAFLGKYCKWAVVTLASKGCMAKHGKQVVQVPAIGESNAVDTTGAGDLFASGFLYGLVKGLPLEECCKVGACSGGSVTRALGGEVRPENWQWMYKQMNARGLLLPELKN

SEQ ID NO: 37491 - protein, 251 aa, Sorghum bicolor
  Clone ID: SORBI-28MAY03-C29782_1.pep
LRFPSDPWDRVSDSAKELVTGMLRRDPRQRLTAKQVLEHPWMQEHADQSQDSCSHCHEIGLRREDPGSCSFSMPLASRSRDMSFNTGGAIACQGTPEDEACCSPTFATACRSSFSAFVTDPAPSSCLASTSGGSGFSFGGACEPPCGGFPLPVPSMPSFSFFSAQDCSEPEPSVAAAAEKAPCDATVAASSLRTAKGATSRGVVGVNGRRNHTIGAGGREHLDVAVSESVIRWASCTNFSTTHSLRASLVC

SEQ ID NO: 37492 - protein, 109 aa, Sorghum bicolor
  unsure (1)..(109): unsure at all Xaa locations
  Clone ID: SORBI-28MAY03-C29445_1.pep
RGSEVRFVSAHPMQTIVTKLEEIAKVKSXAVRRKDWRVSLEGTRESEKGPLTIGAEVFELTPSLVVVEVRMKAGDREEYEDFCEKELKPGMQHLVHHTASVPDIPSDTE

SEQ ID NO: 37493 - protein, 158 aa, Sorghum bicolor
  Clone ID: SORBI-28MAY03-C29446_1.pep
SRDVKLFMPQVIDIFKDAFVESTDEHSDIFSDMVNCKNGDQEKDFRGMYCALLTASTHVVSAAILKVRMEQIAELVLIATRRECRKKGYFILLLKSIEANLRAWNVSLLTAPVDPEMAQIWSEKLGFTILSAEEKESVLESHPLVMFKNLVLVQKSLA

SEQ ID NO: 37494 - protein, 136 aa, Sorghum bicolor
  Clone ID: SORBI-28MAY03-C29448_1.pep
ADQKWLNEDVEVEEGELIEEDHHDIISKSKLKPRNVVLKSVIETGSAEQLQVNNTMSKDAACNNRATRECDDKHILEVMEKMQKRRERFKEAIAPQKEDGDKKDLSSLACSTDYIQNQRPARKRRWGGNSWMLEMP

SEQ ID NO: 37495 - protein, 125 aa, Sorghum bicolor
  Clone ID: SORBI-28MAY03-C29450_1.pep
GSCQDSSKVEQRKTAYRCRKCRRVIAVEDNVVSHVPGEGESCFDWNRRKSGHPYNSKEQDCSSLFVEPLKWMTPVEDGALEGKLSCIHCGARLGYFNWAGIQCNCGSWVTPAFQIVKSKVDISTI

SEQ ID NO: 37496 - protein, 151 aa, Sorghum bicolor
  Clone ID: SORBI-28MAY03-C29495_1.pep
ANYIEEQYWPPSDFDHLLSAKLKDLSTSGKLIKVNRKYRISPSSPNSEGRSPKMLLLEDVQRAPVKIWSDDSKTLTRSQVDAELARMSTMTAEEASVAAAHAVAEAEAIMAEAEAAAKEAEAAEAEAQAAQAFAEAAFLTLKNRNAAKLMA

SEQ ID NO: 37497 - protein, 69 aa, Sorghum bicolor
  Clone ID: SORBI-28MAY03-C29503_1.pep
VELTYTLIPEEHQIPSVSIHARERHDLRLIHSLRAGLIIRPADGCKLSLSLLPPPSLSSTSAFSLLTAC

SEQ ID NO: 37498 - protein, 171 aa, Sorghum bicolor
  unsure (1)..(171): unsure at all Xaa locations
  Clone ID: SORBI-28MAY03-C30062_1.pep
MPETHPPPPRPVMLADLNFEPAESDGEDRPPTPTPNPAATAAVAVAAAPAVTTDSFTRSGNEEGGLMKNVIATKDTDTVECEDADQHCQGASAPREEKVSNLKAALVHVARKMPKNAHAHFMLGLMYXRLGQAQKAIASYEKSTEILLQDEEEVRRPDLLSSVRIHHAQCI

SEQ ID NO: 37499 - protein, 221 aa, Sorghum bicolor
  Clone ID: SORBI-28MAY03-C30080_1.pep
SFYDLALDAKGCSDVYASFDKYVAQERLEGDNKYQSEEHGLQDAKKGMLFIDFPPVLQLQLKRFEYDFVRDTMLKINDRYEFPLQLDLDRDDGKYLSPDADRSVRNLYTLHSVLVHSGGVHGGHYYAFIRPKLSDQWYKFEDERVTKEDMKRALEEQYGGEEELPHTNGLKNAPIRFTKHSNAYMLVYIRESDKEKIICDLDDEDIPDHLKVRLRKEQEEK

SEQ ID NO: 37500 - protein, 157 aa, Sorghum bicolor
  Clone ID: SORBI-28MAY03-C30146_1.pep
MAGGGGGGGGGGGPKHDDLTPHPVKDQLPGVSYCITSPPPWPEAVLLGFQHYLVMLGTSVIIPTALVPQMGGNNEDKAVVIQTLLFVAGINTLLQSFFGTRLPAVVGGSYTFVLPTISIILAGRYANEPNPHIKFLRIMRGTQGALIVASALQIIVG

SEQ ID NO: 37501 - protein, 177 aa, Sorghum bicolor
  Clone ID: SORBI-28MAY03-C30190_1.pep
TRVKSRHETRKGQRRHNLDDRRNAIFVEKEKPTDSYPSRYDRKYEKRRSSSSSLRTNYHNSVRNQSYEQRYSPLERIALKNDEHYFSNESNYHRRQSLSCDISEGEDVDECFSSANEWQRDRDHIYHSMVKTDMPDADDGQMYRERYSQEKRRAIHDRSMDVEFSHYTDYRICEWQS

SEQ ID NO: 37502 - protein, 192 aa, Sorghum bicolor
  Clone ID: SORBI-28MAY03-C34067_1.pep
MTPANGAPAPAAESVPPEVESEADAFRRQVDDLVSKTDVLEKRVKEVVDFYDGKKHGSGGRKGGGGGRHGAYSRGMPDLMRQFGVLLKEITSHKDAWPFLKPVDVVTLHIPDYHKIITQPMDFSTIQKKMERKDGTCYTNVREICSDVRLIFANAMKYNDDQNVVHLMAKSLLEKFEEKWLHFLPKVESEEK

SEQ ID NO: 37503 - protein, 145 aa, Sorghum bicolor
  Clone ID: SORBI-28MAY03-C34258_1.pep
KKEEKKEEKKDGDGKKEEGDGKKDGGDGKKEEGGEGKKEEAGDGKKDGGEGKKEDGDGKKEEDGKKEEGKKEDEKKPAAVAPPWMHHQHQLPPQYMHMLTADYMNQYHRPPPPPPVYHPYVPPQPQYYYMRNMSMEENPNSCAIC

SEQ ID NO: 37504 - protein, 250 aa, Sorghum bicolor
  Clone ID: SORBI-28MAY03-C34322_1.pep
TRPQNTFFGTKRLIGRRFDDPQTQKEMKMVPFKIVKAPNGDAWVETTDGKQYSPSQVGAFVLTKMKEARGSYLGKSVSKAVITVPAYFNDAQRQATKDAGRIAGLDVERIINEPTAAALSYGMNNKEGLIAVFDLGGGTFDISILEISNGVFEVKATNGDTFLGGEDFDNTLLEFLVSDFKKAEGIDLSKDRLALQRLREAAEKAKVELSSTSQTEINLPFITADASGAKHLNITLTRSKFESLVHNLIE

SEQ ID NO: 37505 - protein, 190 aa, Sorghum bicolor
  unsure (1)..(190): unsure at all Xaa locations
  Clone ID: SORBI-28MAY03-C3414_1.pep
MAEHLASIFGTEKDRVNCPFYFKIGACRHGDRCSRLHNKPSISPTLLLCNMYQRPDMITPGVDAQGNPIDPERIQEDFEDFYEDIFEELSKHGEIESLHVCDNLADHMIGNVYVQFREEEQAXRALQALQGRYYSGRPIIAEFSPVTDFREATCRQFEEHSCNRGGYCNFMHVKQVGRDLRRKLFGHLHR

SEQ ID NO: 37506 - protein, 90 aa, Sorghum bicolor
  Clone ID: LIB3481-022-P1-K1-H2.pep
MAEHLASIFGTEKDRVNCPFYFKIGACRHGDRCSRLHNKPSISPTLLLCNMYQRPDMITPGVDAQGNPIDPERIQEDFEDFYEDIFEELS

SEQ ID NO: 37507 - protein, 219 aa, Sorghum bicolor
  Clone ID: SORBI-28MAY03-C30349_1.pep
MAAPSGGGGGGAGERAASAAAAATIGAHGVDQVAEAMWQMNLGETMAPMELGPYPERVGEPDCSYYMRTGMCRFGMTCKFNHPADRKLAVAAARMKGEYPQRIGQPECQYYLKTGTCKFGATCKFHHPREKAAMATRVQLNELGYPLRANEKECAYYLRTGQCKFGSTCKFHHPQPSTMMVAVRGSVYSPGQSATSPGQHAYQGAVTSWPLSRSASFIA

SEQ ID NO: 37508 - protein, 203 aa, Sorghum bicolor
  Clone ID: SORBI-28MAY03-C30378_1.pep
MAPPRPPLPLIHDVMVEIFLRLPPDEPEHLFRAALVCKPWLRILCDPGFLRRYRAFHGAPPLLGLLHRLKVMQGDPEPRLTPTTAAPLSPYPDRGRSRALDCRHGRVLLHVRAVGWPFGLGGPPAAGDRRPVPPPVPGLCLSGAAPGPGPARGRLHRHGRGGPFRVVFMATHDYKPTIFACVYSSETGAWSQQISLDSSCEHY

SEQ ID NO: 37509 - protein, 176 aa, Sorghum bicolor
  Clone ID: SORBI-28MAY03-C30379_1.pep
MPPKKAAPSKAELAKKQKVVEDKTFGLKNKNKSKNVQKYVQSLHQAVQPKPDASKTAAKKKKEEEKAREKELNDLFKVAVSQPKVPVGVDPKSIVCEFFKAGQCQKGFKCKFSHDLNVQRKGEKIDIYTDKRDAETMEDWDQETLEKVVESKKMEYQQNKPTDIVCKYFLDAVEKK

SEQ ID NO: 37510 - protein, 163 aa, Sorghum bicolor
  Clone ID: SORBI-28MAY03-C30391_1.pep
MGALEEAYLADAACACEEEEEESDDLGLLAGDAAAAGDAIEPAVRALLLGLGEDDRREGLRRTPKRVAKAFRDGTRGYRQKVKDIVQGALFPEVGVDKRTGSAGGTGGQVVVRDIELFSYCESCLLPFSIQCHVGYVPSGGRVVGLSKLSRVSDVFAKRLQNP

SEQ ID NO: 37511 - protein, 217 aa, Sorghum bicolor
  Clone ID: SORBI-28MAY03-C30436_1.pep
RTGSTRATAAMADATPSIPSAIASLQAYSTALSAFTAAWRAVETHASSLDSTLAARLAGYTELELICSAMDGAGLLAYLTEHRDELKEPARALDAALQVAPDPGLLVLSAAATFCRTPPEKAKNDGSVKASCRLLMALLDRLRAIGFKPSPEARDEARAVAADWKRGKRIGTEVMFKQETFAFLHLVGVFGLVEDVGGAGEVLDLVVSISGRERAVE

SEQ ID NO: 37512 - protein, 231 aa, Sorghum bicolor
  Clone ID: SORBI-28MAY03-C298_1.pep
MAAGAALYYHPAAGKASLGSVAAPSPSLALRPSRSKVLCVSSGSRWWMRRRWEGKASSVSSGARARASARPALFSPVAMDWQECTTELEVDVPCSVAYQCYSERETIPQWMPFISSVKVLEDKPDLSRWTLKYEVLGRDVEFSWLARNMTPTKNQKIHWRSLEGLPNRGAVRFFPKSSSSCRVQLTVAYEVPEILAPVASALKPFLESLLLKGLESFATFAKERNSKIPQA

SEQ ID NO: 37513 - protein, 118 aa, Sorghum bicolor
  unsure (1)..(118): unsure at all Xaa locations
  Clone ID: SORBI-28MAY03-C29822_1.pep
XPCILGLEDYGIVHQLVTSVSNVSSEYHRQLLENTMLCGGTASMTGFEDRFQREADLSASAICPSLVKPPEYMPENLARYSAWLGGAILAKVVFPQNQHVTKGEYDETGPSIVHKKCF

SEQ ID NO: 37514 - protein, 91 aa, Sorghum bicolor
  Clone ID: SORBI-28MAY03-C29870_1.pep
EEHKMIVFEKGDLVFVFNFHCNNSYFDYRIGCRKPGMYKVVLDSDAGLFGGFGRIHHAAEHFTTDCSHDNRPHSFSVYTPSRTCVVYAPAE

SEQ ID NO: 37515 - protein, 226 aa, Sorghum bicolor
  Clone ID: SORBI-28MAY03-C29961_1.pep
MARAALRLGARSRALALLVLVSVALLPPVSSDDGYKHCEGVVRGWADSSTGREKDGDKLSLKDLLFFLHIPRTGGRTYFHCFLKKLYTNAQECPRSYDKLRFDPSHPDCKLVVSHDDYSLTSKLPRERTSVVTILRNPVDRVFSTYEFSVEVAARFLVHPNLTSAKLMTTRVLTKSRAVSTLDIWPWKYLVPWMREDLFARRDARGGDKVHSSKKVNAYDVEDMVM

SEQ ID NO: 37516 - protein, 146 aa, Sorghum bicolor
  Clone ID: SORBI-28MAY03-C30026_1.pep
MPTRKKGKADGAAAAAAAAPDAGVDRISALPDDTLHHVLSFLPAEDAVRTCVLARRWQHLWKSATGLRIGFSSHGDAPPSVDSLLHFVHHLLLLRKRDSCLHTCELRLRSRYVNSWSIDEGINLNLWIRHVVEQREVRRLRLEIHD

SEQ ID NO: 37517 - protein, 279 aa, Sorghum bicolor
  Clone ID: SORBI-28MAY03-C30075_1.pep
MDAVVVDAGSKLLKAGIAAPDQAPPLVMPSKMKVDVEDQELADGAVVEEVVQPVVRGFVKDWDAMEDLLNYVLYRNIGWEIGDEGQILFTEPLFTPKTLREQLVQLMFEKFNVSGFYASEQAVLSLYAVGRISGCTVDIGHGKIDIAPVCEGAVQHIASKRLEIGGVDLTNLFAQELKKSNPSVNLDVSDVERLKEQYACCAEDQLAFEAIGSSCQPEKHTLPDGQVITIEKEGYIVGEALFQPCILGLEDYGIVHQLVTSVSNVSSEYHRQLLENTML

SEQ ID NO: 37518 - protein, 88 aa, Sorghum bicolor
  Clone ID: SORBI-28MAY03-C30594_1.pep
FQPTVAVGRDGSDNREVTKNSCKIFGISLTEKVPAIKEKDCGETNYPSPFLSLKQHVPKSLGNSCATIHEQRPVVGRVIDVSTVDMMI

SEQ ID NO: 37519 - protein, 216 aa, Sorghum bicolor
  Clone ID: SORBI-28MAY03-C30612_1.pep
EQRLDIAVDITDALDYLHNGCHPMIIHCDLKPSNILLTQDMRACVGDFGIARILNEAAKETCVNSNSTIGVRGSIGYVAPEYGEGLGVSTHGDVYSLGIVLIEMFTRRRPTDDMFRDGLNLHYFVEAAALPGQVMEIADSRIWLYDQAKNSNGTRDISRTRECLAAIIQLGVLCSKQSPKDRLSISDAAVEVHNIRDTYLCNMGMKHHKYVKEISV

SEQ ID NO: 37520 - protein, 119 aa, Sorghum bicolor
  Clone ID: SORBI-28MAY03-C30618_1.pep
PIQSGCCKPPTSCAFTYMNETYWTQNPGVPTVMNDPDCSRWSNDQQMLCFQCDSCKAGVLAGIKKSWRKVAILNIVVLIILVMVYVAGCAAFRNAKRIENDEPIGMARMTKSHLSRFQF

SEQ ID NO: 37521 - protein, 104 aa, Sorghum bicolor
  Clone ID: SORBI-28MAY03-C30639_1.pep
SSTCTSAETCAPSNAGASPILALKPPAPSTTKSPQLQFRSPEHLVRSEINTHERKRGQIVRGQKVTCETSGLSGRDDEEKDQSEQDHQQPAGRLQPCLVRAPRA

SEQ ID NO: 37522 - protein, 198 aa, Sorghum bicolor
  Clone ID: SORBI-28MAY03-C30623_1.pep
MQKMAGLAVLVLVALLAAATAQAQGSYGYGKSPAPAASPPESAPMPPPSSSPPTQTPPPPASPRTRLRFDFYKRSCPYAEEIVREAVRNATNVNPGLGAGLIRMAFHDCFVQGCDGSVLLDPTPANPRPEKLSPANFPSLRGFDVVDAAKAALEKACPGVVSCADVVQFAARDAAFFLSGSKIHYSLPGGRLDGRVSV

SEQ ID NO: 37523 - protein, 190 aa, Sorghum bicolor
  Clone ID: SORBI-28MAY03-C30646_1.pep
ARGQSSDRSTSGGTTSTDRKTIDTASIQDVDQVKSDENGATPEDLRGNKDNCSVQFKRQDSLKSIHVDHHPRPESKQPKIIEKIMTTLREESRLREINSPVRGGVKPSSGLSSNNQVEQPLQVSRTNSDMPCSLKSGNILSHDEHVNEVEASPPLKQLSPIVEHSAKMKTAGPSTPEPAKQITENGAAAS

SEQ ID NO: 37524 - protein, 182 aa, Sorghum bicolor
  Clone ID: SORBI-28MAY03-C30191_1.pep
MPHLVRERLYFGDIKDAIAALTESSPTPHFTHVLSVVSSASISFITDCRPGPSIPTEEVRRVVAGEKGAPPTAAVAPGTLMRVVERAGQGLRVTRMAVPLRDTEEEDLLDRLEPCLDFIDEGRKVGNVLVHCFAGVSRSASIIVAYLMRSEQKSLEDALEALKEISESACPNDGFLDQLKLF

SEQ ID NO: 37525 - protein, 183 aa, Sorghum bicolor
  Clone ID: SORBI-28MAY03-C30244_1.pep
MRIEEVQSTSKKQRIATHTHIKGLGLDTNGMAISLAAGFVGQAAAREAAGLVVDMIRQKKMAGRALLLAGPPATGKTALSLGVAQELGSKVPFCPMVGSEVYSSEVKKTEVLMENFRRAIGLRIKENKEVYEGEVTELSPEEAESTTGGYAKSISHVIIGLKTVKGTKQLKLDPSIYDALIKE

SEQ ID NO: 37526 - protein, 266 aa, Sorghum bicolor
  Clone ID: SORBI-28MAY03-C30236_1.pep
TRQHMALLCLGEIGRRKDLSNHVQIENIVIESFQSPFEEIKSAASYALGNIAVGNLSKYLPFILDQIDNQQKKQYLLLHSLKEVIVRQSVDHAGQSELQDSNIEKILALLFNHCESEEEGVRNVVAECLGKIALIEPKKLVPALKVRTSSPAANTRATVAIAIKYSIVERPEKIDEIMYSEISTFLMLIKDSDRHVRRAAVLALSTAAHNKPNLIKGLLPELLPLLYDQTVIKQELIRTVDLGPFKHVVDDGLELRKAAFECVDTL

SEQ ID NO: 37527 - protein, 441 aa, Sorghum bicolor
  Clone ID: SORBI-28MAY03-C30256_1.pep
MAADSGKGMADLEIGPASPVSEGAPSPASSAGASGERPDQSPSLLAKRPGLVMSFSGKRLDQSPGGSPSQSRPVLVMSHPRNRLDQSPARPVLVMSRSSNRLDQSSPASSPARVRGPVLVMSGSSNRLESSSPSPSPTAAAAAAPVLVLSNSGKRMDQAGRKKYVKQVTGRHNDTELHLAAQRGDLEAVRQIIAEIDAQMTGTGEEFDSEVAEIRAAIVNETNEMEATALLIAAEKGFLDIVVELLKHSDKDSLTRKNKSGCAPLHVAAREGHRDIVKVLLDHDPSLGKTFGQSKVTPLITAAIRGHTAVVNLLLERVCGLVELSKANGKNALHFAARQGHVEVVKALLDADTQLARRTDKKGQTALHMAVKGTNPLVVQALVNADPAIVMLPDRNGNLALHVATRKKRSEIVNVLLLLPDMNVNALTRDRKTAFDIAEGL

SEQ ID NO: 37528 - protein, 139 aa, Sorghum bicolor
  Clone ID: SORBI-28MAY03-C30275_1.pep
MDADEAAGSSRRMDLNLYLGLFRAARPRRSDLGSDLALSTPMPSSPSSSAASVDAPPPPPAPPEPLHPPYFPSRADLSPPPPEVCSRYNPEDSPVPDAHLSYMQTPEPLIPGPRNMPPPEPLALSRIREGLRELRDALH

SEQ ID NO: 37529 - protein, 154 aa, Sorghum bicolor
  Clone ID: SORBI-28MAY03-C303_1.pep
TRQKTFIKEEGQSMAPNQVAGEILSFFTRNNFTVSDRGEVITFEGTMIPSRGQAALLTFCTCISLGSVGLVLSIAVPEGGNNWFWLMTLSPLAGVYYWTKASRKEEIKVKMILSDDGSLSEILVQGDDVQVEQMRKELKFSEKGMIYVKGIFET

SEQ ID NO: 37530 - protein, 205 aa, Sorghum bicolor
  Clone ID: SORBI-28MAY03-C3072_1.pep
WAPYTVVSRFTAAVLVLHAPRRTNLTVGLGASPDSDDARAMPGTSSLPHPFCPPLLQIVARSTRTTPSPSDPARAEAGASHRHQHRTHAAARNRPASRARASAQSTASNPMALLVLRGCATPAVHAAPAAGSRLLPPPLRRRRLVAVASTASSAPSGEVASSSQHGREYGIVGGPNGNAVAPATATKSTVIETKSDLIGCYGTGP

SEQ ID NO: 37531 - protein, 262 aa, Sorghum bicolor
  Clone ID: SORBI-28MAY03-C30823_1.pep
MGCCSSRSSDSPASRVTRWRSTGIVALRDARLKEVPNEVLQVGNSLRTLDLTNNKLVEIPQEIGRLVNMQRLVLAGNLIENIPANIGYLRNLKILTLDRNRISILPEELGLLSNLQQLSVSQNSLLYLPKSVGDLRNMSLLNVSDNKLKGLPESIGACSSLEEFQANGNAIEDVPSSICNLVCLKSLSLNGNKIRQLPQNLLKDCTALQNLSLHDNPITRDQFQQMDGFEEFEARRRKKFDKQIDSRVMMGSTALDEGVDFH

SEQ ID NO: 37532 - protein, 113 aa, Sorghum bicolor
  Clone ID: SORBI-28MAY03-C30897_1.pep
NTLPADRKRCINELCTLIQTVEQLLCASSTTAEPILTPWPLMRALDDMENANAQVEVSVEEVTKARTQKIKIFENRAHEVGRERQIFVDFFCNPERLKNQVRELTSRVKALQD

SEQ ID NO: 37533 - protein, 76 aa, Sorghum bicolor
  Clone ID: SORBI-28MAY03-C30912_1.pep
MAASTKTVAVLLAVVLLALVASAAASRKLEEDALLGSLALAPAPAPAVGGAAGLAGAIPGTWAVAALVSLIAFLAN

SEQ ID NO: 37534 - protein, 167 aa, Sorghum bicolor
  unsure (1)..(167): unsure at all Xaa locations
  Clone ID: SORBI-28MAY03-C30443_1.pep
YISYLPLTKKKPAARGFSKKKKRAVXEKEEKASLRRRRVPHLPHPKQAPSINPICNMEFGSIDGGAGVTSGASGSGPSATSATAGTSATAARRRTPGRWRRIPRAIVPKQITLLEEITMLEEINLPEEVRRALPPLLPEEVWRAMPEEARKSREEVVRATQARLKDM

SEQ ID NO: 37535 - protein, 114 aa, Sorghum bicolor
  Clone ID: SORBI-28MAY03-C30506_1.pep
MAAASFTAAKFLVPVAARSGGERAPPLPPVGASSSSFARTLRRGGGAHHHPRLRTALAVSSDLVAGNKAAQAAATHPAVTREEALEAYEDMVLGRVFEDMCAQMYYRGKMFGFV

SEQ ID NO: 37536 - protein, 152 aa, Sorghum bicolor
  Clone ID: SORBI-28MAY03-C30501_1.pep
MADAQGHYDQIEELVPANSKSPPQVALVVSILLVCPLLVLLLRRLFGTTTTTPSTAREQLLSKLPSPPSRLPIVGHLHLVGPLPHISLRDLSTKHGRDGLMLLHLGAVPTLIVSSPSAAQAVLRTQDHIFASRATSPVTDILFYGSTDVVFS

SEQ ID NO: 37537 - protein, 71 aa, Sorghum bicolor
  Clone ID: SORBI-28MAY03-C3049_1.pep
KDSDIILWFICIVTKRNELKKRKHSGGLGPFWWKLGSKRLLYEALFEHRRQRKIKGSGEGKATGFSSTLDG

SEQ ID NO: 37538 - protein, 88 aa, Sorghum bicolor
  unsure (1)..(88): unsure at all Xaa locations
  Clone ID: SORBI-28MAY03-C30535_1.pep
KKLCDVIDDFSLVXNFSTLDIQDKESVGNLVKLIDKSNGYIFSSIDSSAVEFSKIAAAPLDWDYYRTGEVQEKYMKDDEYVQQTSRMQ

SEQ ID NO: 37539 - protein, 149 aa, Sorghum bicolor
  Clone ID: SORBI-28MAY03-C31050_1.pep
GSEAALNLRYHRRAAARRLPDHPPPALLPHQTPTPSPSRGHLSSLSFRLSQDVGLFLLFLRLTQLGSSTADRHWLLLQYRSCCFSRSAQSSCRGSLFSRIIGGIELSSRAPALIPLLPWRALLTVSDTLSCSLQGTALMFWPKIACALA

SEQ ID NO: 37540 - protein, 74 aa, Sorghum bicolor
  unsure (1)..(74): unsure at all Xaa locations
  Clone ID: SORBI-28MAY03-C31110_1.pep
XXKQSNRTTSSLAQQHELLHHFLVTMAMLKQEPKQHSDRQQLVPSSSSVVRSAPQEKMYQTLKTLIVTMRLNKG

SEQ ID NO: 37541 - protein, 187 aa, Sorghum bicolor
  Clone ID: SORBI-28MAY03-C31154_1.pep
MDSSGEELLKKIRELEVGQAQLKQEMSKLIPGAGERRRSQSVSPRRGAPVPPPPPAKGKAGAPGRRLSGGFEGGQRAWARGSASFPHSSPLQREGRSAGAGDASTSARLPERQYSKVLQSLGHSVHILDLDGRIIYWNQSAENLFGYPASEALGQDALMLLVDSHDHNAVNDIFRRISMGESWTGKF

SEQ ID NO: 37542 - protein, 148 aa, Sorghum bicolor
  Clone ID: SORBI-28MAY03-C3118_1.pep
KSLLVETLRTLKTSVWPFQSDQSSSLFLNAVAVNHYGPGTLGDNQARSHGNISAIEMAAAKAAHHRLMRGVWTNVCFGDMRRALAACERLILLHHDPHELRDYAALLYHCGYYEDCLHYLSLDLGGGSCEYSQSTANTYFSRGWLEQT

SEQ ID NO: 37543 - protein, 105 aa, Sorghum bicolor
  Clone ID: SORBI-28MAY03-C31135_1.pep
MGDVGEIQLQIAGIRGQEAGGDDHGQRAENGGACRATEAPRPPLSKRLAWWAVVLINIVFILGGQSVATLLGRIYYDQGGNSLWMQTVVQSCGTPLAIPLLLYFR

SEQ ID NO: 37544 - protein, 146 aa, Sorghum bicolor
  Clone ID: SORBI-28MAY03-C31402_1.pep
LGHVEVVKDLEFLKPCKLNAHTAGCYCIAMDPIDRYFAVGSADSLVSLWNVKELLCIRTFTKLEWPCTRVSFNHTGEFIAYASEDPFIDIANVETGRSIHQIPCKAAMNSVEWNPKYNLLAYAGDDKNKYSADEGVFRIFGFETHN

SEQ ID NO: 37545 - protein, 197 aa, Sorghum bicolor
  unsure (1)..(197): unsure at all Xaa locations
  Clone ID: SORBI-28MAY03-C30674_1.pep
MSHRKFEAPRHGSLAFLPRKRASRHRGKVKSFPKDDPKKPVHLTAAMGYKAGMTTIVRDLDRPGAKLHKKEIVEACTVIETPPMIAVGLVGYIETPRGLRSLTTVWAEHLSDEVKRRFYRNWYKSKKKAFTKYAKKHSENNGQSITRELERMKKYCTVIRVLAHTQIPKTPLKQKKAHLMEIQVNGGSIADXVSFGQ

SEQ ID NO: 37546 - protein, 257 aa, Sorghum bicolor
  Clone ID: SORBI-28MAY03-C30682_1.pep
YLSYLDSVKYFRPEIRTVSGEALRTFVYHEILIGYLEYCKLRGFTSCYIWACPPCTGEDYILYCHPEIQKTPKSDKLREWYLSMLRKASKEEIVVELTNLYDHFFITMGECKAKVTASRLPYFDGDYWPGAAEDMINQLRQEEDDRKLQKKSKTKKIITKRALKAAGHTDLSGNASKDAMLMQKLGETIYPMKEDFIMVHLQYSCSHCCVLMVSGRRWVCHQCRSFHICDKCYDAEQQLEDRERHPSNSRDTHMLHP

SEQ ID NO: 37547 - protein, 174 aa, Sorghum bicolor
  Clone ID: SORBI-28MAY03-C30713_1.pep
MPRQIVREGDPVKRMLFIVRGHLQSSQVLRNGAESCCMLGPGNFSGDELLSWCLRRPFLERLPASSSTLTTLESTEAFGLDAADVKYVTQHFRYTFTNDKVRRSARYYSPGWRTWAAVAVQLAWRRYKHRKTLASLSFIRPRRPLSRCSSLGEEKLRLYTALLTSPKPNQDDLL

SEQ ID NO: 37548 - protein, 232 aa, Sorghum bicolor
  Clone ID: SORBI-28MAY03-C30808_1.pep
KVLASPEMVDKSVDAILLKLRGLYARAKELSENEISASNALIGLLDGLLQSGASTAQKKKIEVGEQEKKRIKSDTDSARFSAASMRNQLDQAASPKGEQVAARVKSDDEKDEWFVVKVIHFDKETKEYEVLDEEPGDDEESTQKKYKLPMSYIIPFPKKGDPSSAPDFGQGRQVLAVYPGTTALYRATVASHRKRKSDDYILEFDDDEEDGSLPQRAVPFYRVVALPEGHRQ

SEQ ID NO: 37549 - protein, 140 aa, Sorghum bicolor
  Clone ID: SORBI-28MAY03-C30734_1.pep
HNCRCGSGDDQGCGDRSLRPQGQEWHSSGRRRLPQGEGEPGLCAEAVQAEARQQGTVAASDSDCNVRSLTIVLQGLPSASLSPGFFRYMTFVGTGCPMIVLVPSSKFFFFFFFVFLAVSCFVRATTCVLKRTQDVHAKEM

SEQ ID NO: 37550 - protein, 150 aa, Sorghum bicolor
  Clone ID: SORBI-28MAY03-C30892_1.pep
SDTLHTVLEMQFWSNTAAACVSVAGLFASGEWRTIAGEMEAYKKGELAYAMTLAWTAVSWQLCTMGLMGLVAAVSSLFTNIISTVGMPLSPVIAVIFLGDRMDGVKLMAMLIGVWGLLSYVYQHYLDDRAAKKIAEKSEEQHQAAKISAE

SEQ ID NO: 37551 - protein, 177 aa, Sorghum bicolor
  Clone ID: SORBI-28MAY03-C31346_1.pep
KKGKGQGRWGGGSRRRNEQRLGVGGGGALSLAAFASAKSRSTGYNPALIKKQREFYKNAKLISKYKKTKKQQSQSNNRPEIPIHEDGGDTAQDVPKAHHKGKKRIAHSLKEEYEKKCAEDEKAKKERDAEIQAKREHRESTRERERELREKMFKKTRSGQPVMRYRIEHLLETALSK

SEQ ID NO: 37552 - protein, 114 aa, Sorghum bicolor
  Clone ID: SORBI-28MAY03-C31369_1.pep
VARSTIQVYPGAWAAVLVSLDNVGVWNVRSENLDSWYLGQEVYVRVVNPEDTGNKTEMGIPDNALYCGQLHKYQKEQTPHHKMGVSAVAPSSLSLARRLVASALLVAGSFVLAP

SEQ ID NO: 37553 - protein, 145 aa, Sorghum bicolor
  Clone ID: SORBI-28MAY03-C31391_1.pep
LDSQEEKPEPSELKTIASEGIITCLQDAIESLEQGNDIKGVAEQWSFVPHVVNELLKLDGGGKGAALPKEQLCQLAAKCKKIYQAEFARVDMDGKNKDKHQNDSHVAEHRRKTKSDDDHYDSDETIEMTEEEIDFACRQLPGLCG

SEQ ID NO: 37554 - protein, 121 aa, Sorghum bicolor
  Clone ID: SORBI-28MAY03-C31396_1.pep
KEQLNERYPGARRAVLKTGGDFPFLSRPDEVNLYLQLHLRRVGVEPRSELVQGFTRDGSAGSSKDQRDGGDSFGNSGEDNGHHGSGGTDHDRHHCGSESHNSDEPIPTSTMLANTVLELVI

SEQ ID NO: 37555 - protein, 282 aa, Sorghum bicolor
  Clone ID: SORBI-28MAY03-C31403_1.pep
RNGWEPDAVTYSTYIVGLCRSGYIEEAFQQLETMVAKGLQLTVVGLNILLDHVAQNLDMWVGKEVLERCQELGFVVDVVTYNTVMDHLCKKGKWLRVLKLFTDLLKKPITPNVQTYNILISCLCRAGKFEFAKYVFSSKGFVADTVTCNILIHEFYEAGKEGELGFLFADVNAGKIAPDTITYNTLVDCLFRSGRRSQAVNFVRHIDGGYPTEPVAHLTYWLVRSGYIREALRLFDDIQIKGLVLDCRIFANVIKAFCRKGPTECSDMSQLCFVLDRMLGSG

SEQ ID NO: 37556 - protein, 64 aa, Sorghum bicolor
  Clone ID: SORBI-28MAY03-C30913_1.pep
LKHLYRDIPEDPPSDVIERMPVKLFYERNPVEEETPVTFSDHAAVKEFCRKLRAYSRKTEDANC

SEQ ID NO: 37557 - protein, 132 aa, Sorghum bicolor
  Clone ID: SORBI-28MAY03-C30917_1.pep
QEQAGSDDGFDRKSSSSDMDFDDSDEDNDFAEELGDKDVDDSFMESYSDALTKELSSTTLEKSFARAPRPETNNEGPSDDAATDAEMTPVDVDLNLVESILNSYSSQQGLPGPASNLLGLMGVKVPPDAKKS

SEQ ID NO: 37558 - protein, 106 aa, Sorghum bicolor
  Clone ID: SORBI-28MAY03-C30960_1.pep
LDLFHRAAAVNAVTAGGMRFPFKGYPVARPTPHQYFLYEQAAAAAAAAAAHRMLKVAPPPVTVAAVAQSDSDSSSVVDHTPSPPAVTAKKEVGFELDLNCPPPAEN

SEQ ID NO: 37559 - protein, 158 aa, Sorghum bicolor
  Clone ID: SORBI-28MAY03-C31017_1.pep
DVAPTSEAPPRPRPRPRPPPPPRAPAPARARPPPPPRSSQAGGRSSRGPRPHPDSASEPFFTFTASCLVRCRDSSTSTPSRVAKPRRRCRRPVNLRLDSDETTTATFPCLPTGCGPSPPPAVTVGRLAAQPELSPAYYFSLSLPLIKIQVWLLPGWLG

SEQ ID NO: 37560 - protein, 175 aa, Sorghum bicolor
  Clone ID: SORBI-28MAY03-C30971_1.pep
MARSPCDLRLLLLAAAAAFIYIQGRVLVAQSHYADRLAEAERSENQCTSQLKSLIDQVSMQQEKIVALEEIKVRQDEERAHLKILIKDLEKRSVQKLLDNNVVPVAAVVIMACNRPDYLERTVESILKYQTTVASKFPLFISHDGANGAVKRKALEYKQITYMQHVDLEPVQTER

SEQ ID NO: 37561 - protein, 139 aa, Sorghum bicolor
  Clone ID: SORBI-28MAY03-C31589_1.pep
KRSKNEEEGVRQRRLSRRKEMSQSWVLQGQEKVLQGQEDLTLRNHKHWDTKNMKKDENGGLNEKLNQDNAMIILRMNHLNCCSRWPHRTLSRLFMPSGHFLHMGLAGHRAPLRRNAAEFHRAFNSTPSFVRDNTIELAR

SEQ ID NO: 37562 - protein, 111 aa, Sorghum bicolor
  Clone ID: SORBI-28MAY03-C3170_1.pep
NEQIFEKESTLQSIKQEYESLKISEAAAQSSIKELKDMIDAMFSSESTVRSATASPRDAKGSKTKENSVAADDVYSDFERSTQPDDVKNPGKQKRKTILRKFGEIMKKRNS

SEQ ID NO: 37563 - protein, 162 aa, Sorghum bicolor
  unsure (1)..(162): unsure at all Xaa locations
  Clone ID: SORBI-28MAY03-C3177_1.pep
HASAPGLMGIYVVFLCWSAIRSEPHTEVCNKKAEVATSADCVNIASYVIAVIVIVAATFSTGIDSKCXQFKQAEGVSEEDDIPYGFGFFHLVFAMGAMYFAMIFVGWNASHTMERWTIDVGWASTWVRIGNEWLAALVYIWMMIAPVIWKTRQVGSSAETET

SEQ ID NO: 37564 - protein, 181 aa, Sorghum bicolor
  unsure (1)..(181): unsure at all Xaa locations
  Clone ID: SORBI-28MAY03-C31764_1.pep
MAHHLALLLLLLASPAATRLASAACGSEKFPAGRAYASCEDLPKLGASIHWTYDASKTSLSVAFVAAPAAAGGWVAWGLNPTGEGMAGTQALVALAGSGSAAPTVRTYNITGYVPLGKASTPLDFPATDLAADAAGSGGKIRVYGKLQLRKGMKAVNXVWQVGASSTGGAPDKHAFQADNL

SEQ ID NO: 37565 - protein, 245 aa, Sorghum bicolor
  Clone ID: SORBI-28MAY03-C3185_1.pep
MGSAGALLLHPPPQLQPGGVLFRKSRPLLRQRNLPLLSLAAAALEPERRRRQSLRCAAVDGDGGPWEAGPLPQKESPTSRIGAALEDPPPVENGSLGPSEEEQSALYNFLYPSKDLLPDDKEMSIFDHLEELRERIFISVLAVGAAILGCFAFSKDLVLFLEAPVTVQGVRFLQLSPGEFFFTTLKVSGYCGLLLGSPIILYEIIAFVIPGLTRDERKFLGPIGVGSSVLFYLGIFFSYTVLSPA

SEQ ID NO: 37566 - protein, 137 aa, Sorghum bicolor
  Clone ID: SORBI-28MAY03-C31216_1.pep
PLDFPATDLAADAAGSGGKIRVYGKLQLRKGMKAVNQVWQVGASSTGGAPDKHAFQADNLSAKSKLVLAGKAAAAEAPSPASPAPEAGGPSASGAGSDSGAASSMSPSKSPNAAVPAAGVSAPALLVLALVGFLVTV

SEQ ID NO: 37567 - protein, 240 aa, Sorghum bicolor
  Clone ID: SORBI-28MAY03-C3123_1.pep
MRRTTDGGDDFTFAAAQPPPRLLSAVGGGGGCMGPPLLYPIFGRPRSPPRASPAPELETATARVPLGRFLLVDRDPSPSPPPAPAPAPADDVVDDEGLDSVPAEMFCPWSPGWSASAAAAASSPARCKKSGSTGSVLRWRPRLVVGRSQSDGKEKFVFFSAASSGGSFGRRNQKGRGAVEGANGAASAGSAGAGAAHAWSYYVKNNNGGGARRRSFLPYKQDLVGLFANAAVFRRSYLPF

SEQ ID NO: 37568 - protein, 94 aa, Sorghum bicolor
  Clone ID: SORBI-28MAY03-C31262_1.pep
ESKSGKGKTHVCLLQLHWFTAISVKVGRRCSGDADGAARVGVGPSCSPGSGWRRGDEVFGDLVLGERGREGSLPSQSHRQPQRWERLPWVASNH

SEQ ID NO: 37569 - protein, 189 aa, Sorghum bicolor
  Clone ID: SORBI-28MAY03-C31234_1.pep
ESSIVLMVDSLRMKIKEIIESRLEACKAWEGPLTPTMEYKVQDEMLKAGKMTVLCSSETVFEVRGNAIFVVNIGNWECTCRRWQLSGLPCMHAIAVFNRLGRNLYDYCPKFFRIESYHLTYSGIIFPIPDMDSVDFSAGANLLPLPPKQRSSDKPRRKRSNSNKISTLVRLCSRCKQTGHNKATCEVQF

SEQ ID NO: 37570 - protein, 113 aa, Sorghum bicolor
  Clone ID: SORBI-28MAY03-C31274_1.pep
RRRRCQGQGQGRGHQAQQGQRSRGGDDRRAAGLRPQPAGRRRAAGGQAGTDDDDPARGLIHPSVVPTTAAPAAGELDGGLGFDGGRSYLVGWLIALLISVALRDVGCACSRSM

SEQ ID NO: 37571 - protein, 75 aa, Sorghum bicolor
  Clone ID: SORBI-28MAY03-C32041_1.pep
VNSLLCYMSLILPKNGTAISLLAFTYTPPDTLKPKAFQIVSDAAMLVPAPSKLILLLSLTQFINETGCNTVHPCS

SEQ ID NO: 37572 - protein, 364 aa, Sorghum bicolor
  Clone ID: SORBI-28MAY03-C32053_1.pep
ARGISQSSNKVSNIRARVLSAPSTLIVVDQFGFPYAEYRDQDDSRDKEGSTKGHRFSNPRPLPLPSPEGHSFRNSGSFRASNVSGPLEMSGPLPLPPKKCDGLRIFSYEEVLSACQWFSSDQCVSEALGSTSYKATFRDEFIDTKTTEATVARLLPSTQSLKEFKTQATTLALLQHPNLCKLIGYYAKEDSNERMLVYERLHHGSLDKLLFGRPDGRFMDWSKRLKVALGAARGLAFLHDEGPFQAMYSEFSTLNIQIDKDFTAKLSGYGCVGFNTEEISNAPASAANLSVETLEKGLLTPKSNVWSFGVVLLELITGRKNLDANSSKEERNIVRWSRPFLTDDSRLSLIMDSRIKGRFPTKAA

SEQ ID NO: 37573 - protein, 98 aa, Sorghum bicolor
  Clone ID: SORBI-28MAY03-C32172_1.pep
GDVPRVCGQLAVSRAFGDRNLKSLLRSEPDIKVEDIDHTAELLVLASDGLWKVMNNQEVVDLAKRYKDPYAAAKQLTAEAQKRESKDDISCIVVRFKA

SEQ ID NO: 37574 - protein, 187 aa, Sorghum bicolor
  Clone ID: SORBI-28MAY03-C32200_1.pep
MTASRIQIAGRFKPCAHMGCFDLEAFIEINQRSRKWQCPICLKNYSLENIIIDPYFNRITSLIKSCRDDTSEIDVKPDGSWRVKGRAELKDRAPGLRPEGTLSVATDTAAKPEICIVKHEVKEEPLSEEVGCLKLGLRKKSNGQWEISKLGDADLVPSSGNDHSRYFGCSGCLPRPCSIDARLSFWG

SEQ ID NO: 37575 - protein, 141 aa, Sorghum bicolor
  Clone ID: SORBI-28MAY03-C32215_1.pep
MAIVMLVRSVKDLATRRLPYKGGSEESYSALYPDSIQKEEFRPPSPIPGFAEADLFAAVLQRLGELEEKVQMLQEKPSEMPCEKEELLNAAVRRVDALEAELIVTKKALHEALIRQEELLAYIDSKEIAKAQRKKKTMFCY

SEQ ID NO: 37576 - protein, 154 aa, Sorghum bicolor
  Clone ID: SORBI-28MAY03-C31426_1.pep
PLSWGFLGYVLGSSIFSPRQSSSPSPTPSDSCPRPTAASNRSFSRASSDLRQPLTIPVLLCIIGPEGALTRIPSYTPGASNTLSRRHMGHQVSGLLRLQERHGSALNYTSAATIRWQHSRNVGKDVMFGRAIAHRSLPTGCLQNHVKKKYESSS

SEQ ID NO: 37577 - protein, 120 aa, Sorghum bicolor
  Clone ID: SORBI-28MAY03-C31483_1.pep
LMSPVIGGEAAGSWLLPDVLVNVSRGGDEVSNAVVKEVLPDGSCRVSLGPLGEGDELIVTANELEVVRPKKNEKLKIMNGPLRGATGKLIGLDGSDGIVKVEGSLDVKIVDMAILGKLAA

SEQ ID NO: 37578 - protein, 278 aa, Sorghum bicolor
  unsure (1)..(278): unsure at all Xaa locations
  Clone ID: SORBI-28MAY03-C31549_1.pep
FRSSNSTTQPARRSNGEHGARPGGDPRRLPRRLRLRRRHLRVPDXGARREGGKGDSIWDVFTDDKERVLDKSNAEIAVDHYHRYKEDIELMASLGFSAYRFSISWARIFPDGLGEKVNEQGVAFYNDLINFMISKGIEPYATLYHWDLPNNLQKTLGGWISDKIVEYFALYAEACFANFGDRVKRWITINEPLQTAINGYGIGIFAPGGCQGETARCYLAAHHQILAHAAAVDVYRRKFKAAQGGEVGFVVDCEWAEPFSEKAEDQIAAQRRIDFQLG

SEQ ID NO: 37579 - protein, 248 aa, Sorghum bicolor
  unsure (1)..(248): unsure at all Xaa locations
  Clone ID: SORBI-28MAY03-C315_1.pep
VRAPGRLATAAAGASGPGPSSPEPYPPESDDGLVELPLFPLPLVLFPDATHALHIFEYRYRIMMHTVLQTDLRFGIVFAGNSGSAAEVGCVGEVVKHERLADDRFFLICKGQQRFRVARVVRTKPXVAAVQWLEDRPPAEAPAPGEDAEALATDVEALMRDVIRIANRLNGKPEKEVGDLRRGLFPTPFSFYVGNTFEGAPREQQALLELEDTAARLRRERDTLRNTLNYLTAASAVKDAFPSSPSSG

SEQ ID NO: 37580 - protein, 211 aa, Sorghum bicolor
  unsure (1)..(211): unsure at all Xaa locations
  Clone ID: SORBI-28MAY03-C31564_1.pep
MDPMDIVGKSKEDVSLPKSTMFKIIKEMLPPDVRVARDAQDLLVECCVEFINLLSSESNEVCSREEKKTIAPEHVLKALSDLGFREYIEEVYAAYEQHKLDTLDSPKASKFTXGIEMTEEEAVAEQQRMFAEARARMNNGAPKPKEPEQDPPQQPQAQPQLQLHTQTQQPMQSQLQLHSLTQHSLQPQLQLQPQSQPQQLPQVQLHPQPQQ

SEQ ID NO: 37581 - protein, 80 aa, Sorghum bicolor
  Clone ID: SORBI-28MAY03-C34380_1.pep
MQRNGVVECSVCRSRVVVPSPRSVSRAYDKHRSKMSSKFRALNVFLVVGDCILVGLQPILVFMSKVDGKFQFSPISVNFL

SEQ ID NO: 37582 - protein, 55 aa, Sorghum bicolor
  Clone ID: SORBI-28MAY03-C32683_1.pep
LREGAAALLNSMTRAGFPYTTEQVRDAFAAAAAGGSDGAAAAQAAAFRKANEGKA

SEQ ID NO: 37583 - protein, 161 aa, Sorghum bicolor
  Clone ID: SORBI-28MAY03-C32645_1.pep
MSAAAAAAATSTAAALLAPGLKLCAGRARVSSCRLPLRRVAAMASAPNSSFRPEEARSPPALELPTPPLSKFKVALCQLSVTADKSRNIAHARAAIEKAASDGAKLVLLPEIWNGPYSNDSFPEYAEDIEAGGDAAPSFSMMSEVARSLQITLVGGSIAER

SEQ ID NO: 37584 - protein, 156 aa, Sorghum bicolor
  unsure (1)..(156): unsure at all Xaa locations
  Clone ID: SORBI-28MAY03-C32717_1.pep
HEAYYLSRNFSVSSWDDTNSIMXSSPNKKPKVDPADDMVTSFSNIDSQFGLSNSSLEMSGMDDYLQMQQDSVACRVRAKRGCATHPRSIAERERRTRISKRLKKLQDLVPNMDKQTNTSDMLDLAVDYIKELKDRVEKLKHDQANCCCLGVANKGC

SEQ ID NO: 37585 - protein, 85 aa, Sorghum bicolor
  Clone ID: SORBI-28MAY03-C32721_1.pep
PLGGKHTKDEERKLGKSESTVWEKNDEPSDKVDVQENGWGTWKQNASTSAWSYRALRSSALGPTMAMLRGKNSQRGKPPYRKNGK

SEQ ID NO: 37586 - protein, 153 aa, Sorghum bicolor
  Clone ID: SORBI-28MAY03-C32723_1.pep
TPGWKFNHYEMKGVPVRIEIGPRDVTNKSVVVSRRDVPGKQGKEFGVSMEPSILVNHIKGRLDDIQASLLQKAITFRDSNIVDVNSYGELKDAISEGKWARGPWSASDADELKVKEETSATIRCYPFEQPEGTKKCFMTGNPAEEVAIFAKSY

SEQ ID NO: 37587 - protein, 218 aa, Sorghum bicolor
  Clone ID: SORBI-28MAY03-C36478_1.pep
TRRIYLSHKILISTEKYLVLHEIVDTALKKLEAEVGPISGAPNMSPRGVSRLTVGAEVQKLCAQAIDAMESLFSDVSPASSRIQRPSMIPPNFVKFEAITPTSVVVFLDLVHCPMLAQEATSFNIWHRVAVTESYLSNPSGIILAPSKKLPVTGLAPATSYIFKVIAFKNSIELGSWEIRTKTSCQKDDPRGSMPGGTGLGQNSESPKANSDGQSDPS

SEQ ID NO: 37588 - protein, 160 aa, Sorghum bicolor
  Clone ID: SORBI-28MAY03-C3648_1.pep
YPPSKEMDAKLRDEEARRLRAAAKDKGEAKRTRPRDRSRRAGPAPEANAEIQANLDQRRRMITHANAKSKSEKFPPPHQDGGTGNRLGSCRHMEPMFEHQDASFSTVVPIEKGTSQTWSGPLFDPAALGQSRRKKQTTLDAKAAAYSKQLQKETGGIRAR

SEQ ID NO: 37589 - protein, 109 aa, Sorghum bicolor
  Clone ID: SORBI-28MAY03-C3650_1.pep
RARPYDQKVDVYSFGIVLWELITGMLPFANMTAVQAAFAVVNKGVRPAIPQDCLPTLAEIMTRCWDPNPDVRPPFTDVVRMLEHAEMEILSTVRKARFRCCISQPMTTD

SEQ ID NO: 37590 - protein, 212 aa, Sorghum bicolor
  Clone ID: SORBI-28MAY03-C36526_1.pep
MAAAAVLALLTVSVLAGAAAGGDIVHHDDEAPKIPGCNNDFILVKVQSWVNGKEDGEFVGVGARFGPKIVSKEKHANRTKLTLADPMDCCSPPKHKVSGDVLLVQRGKCKFTKKAKFAEAAGASAIVIINHVHELYKMVCEKNETDLDINIPAVLLPKDAGSALHTLLTDGNAVSVQLYSPDRPVVDTAEVFLWLMAVGTVLGASYWSAWSA

SEQ ID NO: 37591 - protein, 129 aa, Sorghum bicolor
  Clone ID: SORBI-28MAY03-C36530_1.pep
RRPSRAALRRGCGPAAPPSPSASTRSPRCLLPLGSISMCFCARRNPSTCSCAGAAAPPWAHLDAASVCVSSSSCYTCYCLWINMHAIDSTPYGSNIHALQKFKGFMLIQLGHCAAVGAQDMHHLRRDIR

SEQ ID NO: 37592 - protein, 114 aa, Sorghum bicolor
  Clone ID: SORBI-28MAY03-C32901_1.pep
KKLHSLLLKEKELIFGSKPSPKKTSSFNRRTSNHHPNANGTGFMTPVPRRVSAGSATPELLTPRSYSGRYNNYFKENRRLTTAPLNFSVGSKEDSMSSFASISGSEPDSPLFLH

SEQ ID NO: 37593 - protein, 154 aa, Sorghum bicolor
  Clone ID: SORBI-28MAY03-C32948_1.pep
MASLLRLPSLLSPSKGPLLRRRLPAARLAASAASRGQASAAAETRGGDREGQVTPRSADFNAWYTDVIAAAELADYGPVRGTMVIRPYGYAIWEAIQDYLNVKFKETGHSNMYFPQFIPYSFIEKEASHVEGFSPELALVTIGGGKELEEKLGV

SEQ ID NO: 37594 - protein, 219 aa, Sorghum bicolor
  Clone ID: SORBI-28MAY03-C32929_1.pep
HEGLLSAEAPPKEWLPHADISFQPLVQCLDVDKLILLFTAVLLERRILLRSNKYTLLTLVSEAICHLIYPIRWQHVYIPIIFSSGVDYIDAPTPYMMGLHSGVDTSAVTMDGVVVVDLEYNRITTSEEIPPIPETEHSFLRGEILKLLQPNVMGIDFMKVNLANMSDRSLRAGTKSWSQEHDFQLRLIFLRFFAQILSGYRNFIDTTSTTGFNSQAFLK

SEQ ID NO: 37595 - protein, 292 aa, Sorghum bicolor
  Clone ID: SORBI-28MAY03-C33026_1.pep
MKVIEKIQEAAGNGRTAFSFEYFPPKTEEGVENLFERMDRMVAHGPSFCDITWGAGGSTADLTLEIANRMQNMVCVETMMHLTCTNMPVEKIDHALETIKSNGIQNVLALRGDPPHGQDKFVQVEGGFACARAWVQHIRAKYGDYFGITVAGYPEAHPDAIQGEGGATLEAYSNDLAYLKRKVDAGADLIVTQLFYDTDIFLKFVNDCRQIGITCPIVPGIMPINNYKGFLRMTGFCKTKIPSEITAALDPIKDNEEAVKQYGIHLGTEMCKKILATGIKTLHLYTLNMDKS

SEQ ID NO: 37596 - protein, 226 aa, Sorghum bicolor
  Clone ID: SORBI-28MAY03-C3226_1.pep
MGGAGGAVPSHGLACAPPAAVTSDPRARRASPGSGGHWSSPQQPLRSDLLPPPTVACRARSRSSSSSNVNFGRGDDADKLLEDLLKRHGEVVYSSCGPPSPTVEADDDAECLSFAVSLAKAASEIKATDIRVLCVKRLVYWTRFFIILTAFSNAQIDAISSKMREIGEKQFSIVASGDTKPNSWTLLDFGDVVVHIFLPQQRAFYNLEEFYGNATPIELPFDTQLQ

SEQ ID NO: 37597 - protein, 111 aa, Sorghum bicolor
  Clone ID: SORBI-28MAY03-C32274_1.pep
VHSPCPPAAMPDLSTGYLPPFPEFSLDAGTLTVDHAEDAAAAAADSAPPFASSSATVRGRGRVGLVDVDVVEHKHNRMYESTFHDESADINLTLLVYLFYYIDGQSEKFDY

SEQ ID NO: 37598 - protein, 101 aa, Sorghum bicolor
  Clone ID: SORBI-28MAY03-C3231_1.pep
NWHHDCFLCSLSEGIAPYSDSWLPACYVVPLDQQGTTSLWRARCGVSPLNSKRLSIRIWKLPQLHRMAKTVHLQRYHSANPRGSIELQRARVQPLQCYHQD

SEQ ID NO: 37599 - protein, 304 aa, Sorghum bicolor
  unsure (1)..(304): unsure at all Xaa locations
  Clone ID: SORBI-28MAY03-C324_1.pep
IKDIGRGGPMVEYERRIASGDLVDGDSFQVDTIHQLQRLYEELIENEEDCQLDRYKSSEKSGRSRWLWSRLITQPSTYAPVKGLYLYGGVGTGKTMLMDLFYEQLPSNWRKKRIHFHDFMLNVHSRLQMHKGVSDPLDVVAAEISDEAIILCLDEFMVTDVADAMILNRLFRQLFSKGVILVSTSNRPPDKLYEGGLQRDLFLPFIDTLKESXIVHPIGSAVDYRQLGSAEQGFYFVGKHYSTLLKQKLQSLIGDEEPSPQTVEVIMGRKLQVSLXANGCAYFPFEDLCDRPLGAADYFGLFKN

SEQ ID NO: 37600 - protein, 274 aa, Sorghum bicolor
  Clone ID: SORBI-28MAY03-C3252_1.pep
RPACLIWRTEDESLEAAQLRKVCLLIHKAKVERDHHVLEIGCGWGSLAIQLVKQTGCKYTGITLSVEQLKYAQRKVKEAGLEDHISFMLCDYRQIPTHRKYDRIISCEMIEGVGHEYMDDFFGCCETLLAQDGIFVLQFISIPEERYEEYRRSSDFIKEYIFPGGCIPSLARITSAMSAASRLCIEHLENIGYHYYPTLIQWRDNFMVNKDAILALGFDEKFIRIWEYYFIYCAAGFKSRTLGNYQIVFSRPGNDKLSNNGDPYASFPAANQAS

SEQ ID NO: 37601 - protein, 147 aa, Sorghum bicolor
  unsure (1)..(147): unsure at all Xaa locations
  Clone ID: SORBI-28MAY03-C32476_1.pep
MEKFCCFGAGCSDFTGHGSTASGKGKVCHGQVKVSYGYNLVRGMTNHPMEDYHFVDLVEVKGNELGLFAIYDGHLGDTVPAYLQKNLFTNILNEEEFWTHTDRAITKAYEKTDQAILSHTPDLGQGGSTAVTAILVNXRKLWVANVG

SEQ ID NO: 37602 - protein, 247 aa, Sorghum bicolor
  Clone ID: SORBI-28MAY03-C33137_1.pep
TRQLSKREAELLQQKEEVTKLAKSLKQASEDAKRIVEEERHEAHTEIETAKSAVQRVQQAVQEHEKMSQNTGKQDMEELKKEVREARRIKMLHQPSKAMDLENEIRILRNTFAEKSKDCVNLLKELEMHKRLKENGTIPSFDLEGLQCLGSMLRIVGLSGTHMDLSNISIQWFRIHPKESNKEIISGATRPVYALEPHDVGRYLQAEIDVGGEIAVAKTAGPVDPDAGLVDYVETLVRKPETEFNVV

SEQ ID NO: 37603 - protein, 186 aa, Sorghum bicolor
  Clone ID: SORBI-28MAY03-C3320_1.pep
VRSKVVRPEEVLESLKNDGSIDALRMKIIAQLKANEDMKKNTMMMVEQSKVLNTPGAEKKSKLECSDALRQELETPVLEKASKAVWELILDNGGLGKEITETVEKVFCRLSGIDMMPPPPSVSGARQEKDDMAVDEVVKSKEVDAFEPSSSRKRPFSDINRKGAGALPNGSATDQHDESEDSDQKI

SEQ ID NO: 37604 - protein, 180 aa, Sorghum bicolor
  Clone ID: SORBI-28MAY03-C33169_1.pep
MGRKPSAAAAAIDHESLAATMPADLLAAADCGGIHGHALFFDALVQLIPPRFYLPSGDEDRPWYQGLSKAAKAAMKAKSRANVKAARRARLDPSAPPASTLDLLKKSVAGQAAEEEEEDQEEKSGEESEESGEEASSEDDGDAEDGVEEDEMEIAPAAVVSEDRSVTYEELKGRLQRRIA

SEQ ID NO: 37605 - protein, 112 aa, Sorghum bicolor
  Clone ID: SORBI-28MAY03-C3323_1.pep
RCRNRKMDFIYEDELNNFVDGGVLSELIIAFSREGPTKEYVQHKMAQKAAELWSIISQGGYIYVCGDAKGMARDVHRTLHTIVQEQGSMDNSKTESYVKSLQMEGRYLRDVW

SEQ ID NO: 37606 - protein, 196 aa, Sorghum bicolor
  Clone ID: SORBI-28MAY03-C32761_1.pep
KKSRIVSDKDEGLRKARRPFIVQAFSQQFRKDFTIFLNTRAKELAPNGQMVLSMVGRPSSDTAYQSVQPWDFLFVPLNDMASRGVISRDILDSFYVPLYGPSDKELMEIIQDEGSFKINNIEVHEQMTGIDKSMQTPKIRALAARAAFEPTISQHFGRSEGVMDEFVGTIERQLSHVPASPAGSLLFLCVSLTKRV

SEQ ID NO: 37607 - protein, 108 aa, Sorghum bicolor
  Clone ID: SORBI-28MAY03-C32791_1.pep
EHFCIHAGGRAVIDAVQRSLDLSDEQVEPSRMTLHRFGNTSSSSVWYEMAYCEAKQLMRKGDRVWMIGFGSGYKCNSAVWKCILPARSADSAWANCIHRYPMEVPKQV

SEQ ID NO: 37608 - protein, 86 aa, Sorghum bicolor
  Clone ID: SORBI-28MAY03-C32814_1.pep
RPTHDPFSVSTNNTFPPIDLSSSLFVGHFVFSVLESSHSSFFLLREIYRDQFFSVLPPTIVGVHSPRKASLHVQADKNHSSESGCG

SEQ ID NO: 37609 - protein, 315 aa, Sorghum bicolor
  Clone ID: SORBI-28MAY03-C3281_1.pep
CGLVLSDPALSLGSESEKSGASIDHNMLLESKHEDINLNASEIHHEETAGKRQIILGHSSADPYGTNLPTISTGEGHDMVRDYPAAAKGSTGTVGGNKMEKADQNEALFCFSQQPGAIRSISHEIKLKKHSLLPSHCHSGSRICDDQTKSAPSSDMGSLDSNLTNKRQKTSYGKHSTCIFGDEMPPIKCLSKIHPLPTGQDDPFDVLQHCHRGPSDPVPLQKPVPDHIIHVLSSDDEDSPEPSTSLNKASLKADEGSSALLSLSLSMVATKRNLSGSDIVDDEPLSLSLGLPSIVDGSADQEMKQFLPEKPGINT

SEQ ID NO: 37610 - protein, 125 aa, Sorghum bicolor
  Clone ID: SORBI-28MAY03-C32926_1.pep
MAPAGLRRAGGRFLLAREIRSRRPGANVHFFGARGGVTMPRALLEDPAPAPAMDATATTTGRGSPPSASVSAAASRITPAVLFVTVVLAVVLLVSGLLHVLRRVFLKSHHASAGAGERQLQHLFF

SEQ ID NO: 37611 - protein, 110 aa, Sorghum bicolor
  Clone ID: SORBI-28MAY03-C32841_1.pep
EFNVVVLQLNGVDQPKESVHVLNVGRLRMRLTKGKSVVAKEFYSSSMQLCGVRGGGEAASQAMFWRPRNDLSLVLAFESTRERNTAIMLARRFAIDCNIILAGPGDKTPW

SEQ ID NO: 37612 - protein, 130 aa, Sorghum bicolor
  unsure (1)..(130): unsure at all Xaa locations
  Clone ID: SORBI-28MAY03-C33289_1.pep
MAAPRKGTATPLGAVFSPEETKRAVARVSESIAGRRAELGRLQGFVADNAALVSLVNRLPDELSHEIMVPFGGAAFFPGRLIHTNELLVLLGEGYYAXRSAKQTTDILHRRGQELEAQVEAMKATIADLE

SEQ ID NO: 37613 - protein, 167 aa, Sorghum bicolor
  Clone ID: SORBI-28MAY03-C33358_1.pep
MGTRARSLLRWLRHRSRSRRVSSSSSSSSFHLTSTTTNNNDSTATSGDLRARSLPHQFHAEEEEEEREVGEEIAAEPASESEGCIVLGDPEPGAGPRAPVPPLMDPSKKESEFFTEYGEASRYQVSEVIGKGSYGVVAAAVDTQTGERVAIKKIVDVFDHVSDATRI

SEQ ID NO: 37614 - protein, 120 aa, Sorghum bicolor
  Clone ID: SORBI-28MAY03-C33362_1.pep
MARCPAHVALCSLALLLLLPAARSATFTMTNNCGYTVWPGLLSGAGTAPLSTTGFALAHGASATVDAPASWSGRMWARTLCATDAATGKFTCATGDCGSGSVQCNGGGAAPPATLAEFTL

SEQ ID NO: 37615 - protein, 214 aa, Sorghum bicolor
  unsure (1)..(214): unsure at all Xaa locations
  Clone ID: SORBI-28MAY03-C33369_1.pep
MVVALGPGRFYGSGLPRPRGFPGDRVDPPASVTDPLLEWAREAHWSMGGFGVKRLRLQGRIEGSIDKLRRTARRDARAKAKAKAPSAGHMPASLAALGSDDDASDGDSEDEEEVAAREPAMKRELVDGDEDSGESEEXEENEPLAAIITAAKKRHARKLSDEFDRIAVEQQLVAKAPEKSRCRALLLPLQDLRLPPRLLPWLPLFRISVWIYIC

SEQ ID NO: 37616 - protein, 192 aa, Sorghum bicolor
  Clone ID: SORBI-28MAY03-C33401_1.pep
MASMQSWRKAYGAIKDTTTVSLANLNSDFKDLDVAIVKATNHVECPPKERHLRKVVAATSIARPRADVAYCIHALARRLAKTRNWIVALKTLVVIHRLLREGDPTFREELLNFTQRGRILQLSNFKDDSSPIAWDCSAWVRTYGLFLEERLECFRVLKYDVEAERLSKQGQGPEKGHSRTRELDSQDLLEQL

SEQ ID NO: 37617 - protein, 161 aa, Sorghum bicolor
  Clone ID: SORBI-28MAY03-C33028_1.pep
MAAVAPVVSDLVDFLNVSPTAFHAVDEAKRRLKAAGFVQLSEREEWAGLEPGRKYFFTRNHSTIVAFAIGAKYVAGNGFHIIGAHTDSPCLKLKPVSKVTKGGYLEVGVQTYGGGLWYTWFDRDLTVAGRVITREKKDGEVSYAHKLVRVQEPIMRIPTLA

SEQ ID NO: 37618 - protein, 182 aa, Sorghum bicolor
  Clone ID: SORBI-28MAY03-C33034_1.pep
ARGNVFASGERRGFLAVGRQKRLTIFRLDSGREFVEVKEFGVPDILKSMAWCGDNICLGIRREYMIINSMTGALTEVFSSGRIAPPLVVPLPTGELILGKDNIGVFVDQNGKLIQDGRIIWSDTPASVVIHRPFAVARLSRHVEIRSLRAPNALVQTVVLRDVQKLVQTDHCILAALSNSDH

SEQ ID NO: 37619 - protein, 336 aa, Sorghum bicolor
  Clone ID: SORBI-28MAY03-C33076_1.pep
LQLLRGLKSSTNGVSRPTGTFRIENSTEVSVHWFRILLGNCAPGYDGLIADILGDSYILALSRLQQMLPLSVIFPPAYSIFAMVLWRRYIFNREDPQLYQSLSNAISDITRHQPFREICFRNTHRLYNLLASDVGDSEFAAMLESHSPDRNSKILPFIPLRARLFLDALIDCNTPTIHGDGASEPCDPKDNELKLSERLMQLLDTLQPAKFHWQWVESTRLLDEQALMEKVAAGKTALESLRSLSPNAEGFALSDSEKGFTEVILSRLLARPDAAPLYSEVVHLLGKLQESLVMDVKWILQGQDAILGRRSTRQQLVHIAQRKGLSTKAQVWKPWG

SEQ ID NO: 37620 - protein, 193 aa, Sorghum bicolor
  Clone ID: SORBI-28MAY03-C33072_1.pep
MATMGSLIGLVNRIQRACTVLGDHGGGAGGEGSLWEALPSVAVVGGQSSGKSSVLESIVGRDFLPRGSGIVTRRPLVLQLHKTDGGHEYAEFLHAPRKRFTDFAAVRKEIADETDRITGKTRAISNVPIHLSIYSPHVVNLTLIDLPGLTKVAVEGQAESIVQDIENMVRSYVDKPNCIILAISPANQDIATS

SEQ ID NO: 37621 - protein, 199 aa, Sorghum bicolor
  unsure (1)..(199): unsure at all Xaa locations
  Clone ID: SORBI-28MAY03-C33103_1.pep
ARLSSKPISRLQLQNPSYCFAEFPLLRPLRPPLPVTAAASTLVPPAARSTCFSARCSPVATTTTTGSPPVMSSQVDSRSQSAGKRARTDGSRREDDWVCPSCKNVNFAFRTTCNMRSCNQSRPADHTAMQKPMQTPPHYPASGGYMGPGTPPSMYLGGGXAPPYGSSMFNGPAMPRYGIPQYPGGSAYPYGYGGRIPMG

SEQ ID NO: 37622 - protein, 174 aa, Sorghum bicolor
  Clone ID: SORBI-28MAY03-C33127_1.pep
MEETLASLRRPKRRGRPPRPREEYHAADFEDVADAEGLAPPQSKRKRAASAAAAASLEDQPLIDIIKHNGRLISHAVKRLVEDYESKKNLVTFQILTMLFEACGAKHEIYPDYLRESDVDDIVVSLVDLARKGLVEDNYNSKHKDLKNFKENLVCFWDSLVLECQNGPLFDDLL

SEQ ID NO: 37623 - protein, 227 aa, Sorghum bicolor
  Clone ID: SORBI-28MAY03-C33548_1.pep
MSPCAPPAAAAARGVNPAKPLRRAPSSSTHARFPHLFMSSSPPRTSPLAAAACGSGAAAPSSLLAADPGHREAVLLAARAAMGNCLGETRLDLAVPGLRLAAKGKVRDVYESGEHLVLVTTDRQSAFDRVLASIPFKGQVLNETSLWWFNQTRHITPNAVVSSPDKNVTIAKRCTVFPVEFVVRGFVTGSTDTSLWTVYNKGVRNYCGNALPDGMVKNQKLSANILT

SEQ ID NO: 37624 - protein, 250 aa, Sorghum bicolor
  Clone ID: SORBI-28MAY03-C3355_1.pep
MELASGDDELKSLLQNFHRVYQGYKDALMEVQALRVNCNTEFKRREALESHITDLKKDNERLRRLYTETLFKFTNQVKFHAEAQSLKEELEKANSRLISMEEEHKREAEQLKHSSEMNSNDLENKLSHALVQQARDEAAMKQLKSELSAHKAHIDMLGSRLEQVTADVHSQYKNEIQDLRDVISVEQEEKKDMHRKLQNAENELRITRMKQAEQQRDSVSVQHVETLKQKVMKLRKENESLKRRLASSVA

SEQ ID NO: 37625 - protein, 263 aa, Sorghum bicolor
  Clone ID: SORBI-28MAY03-C33566_1.pep
MVSERQQQQGKVAAFNLAESGFGDQADLLDDDGRERRTGTLVTASAHIITAVIGSGVLSLAWAIAQLGWVIGPVVLLAFSAITWFCSSLLADCYRAPDPVHGKRNYTYGQAVRAYLGVSKYRLCSLAQYINLVGVTIGYTITTAISMGAIDRSNCFHSKGHSADCEASNTTNMIIFAGIQILLSQLPNFHKLWWLSIVAAVMSLAYSSIGLGLSIAKIAGGVHVKTSLTGATVGVDVTATEKIWKTFQSLGDIAFAYSYSNVL

SEQ ID NO: 37626 - protein, 114 aa, Sorghum bicolor
  Clone ID: SORBI-28MAY03-C33635_1.pep
STRLVPCRPPLAPHPSPSPSPSPSPSPGPGLPSRHRRAQVRTSTRSPAPPSCTRSPAPPTCTRSPVPPSRSPVAVAPSRTPSPGPPRFRSVFCWHHVQSVEPYEYGGRRRDPRA

SEQ ID NO: 37627 - protein, 214 aa, Sorghum bicolor
  Clone ID: SORBI-28MAY03-C33659_1.pep
HEGQFGVAVNPVAPTQPAMGSYSGQNIVAAENARRLTPGMAPATANADLTSQNQILSSLPQTDDRLADGFQSKSGEDVSHGRVSSSAEAIGQLGAQLGPTQLNTQQLEDTRNQMSSTDLSNSMMPSQMMSTPSAASVQPSLTTVAGSDNQSSGWAVPAQVANTPGQSQITGNMTWGNTPQGDASLGWGMMGQSNMNMPWVASAQGASGYMGVAM

SEQ ID NO: 37628 - protein, 221 aa, Sorghum bicolor
  unsure (1)..(221): unsure at all Xaa locations
  Clone ID: SORBI-28MAY03-C33231_1.pep
MSLISQNAVQKRRLKKSEADDGNDENIGSPTSIDAEVGKEAKLKNHNKERKKKRTKVQESQQNKEGAGMRQLESSLFGSLYAPLEFGTEAGAAVVAPDRDAPLFFTDRSAGGGVDHFPIYEEDMAHEDEEDVVRIKGRLPGWXVEEEERTEVDIVKVSRLRKLRKEEDEHLISGKEYEARLRGQHAKLNPFTGWADMDRKTSLPAASDGESDDEGCVDDIL

SEQ ID NO: 37629 - protein, 119 aa, Sorghum bicolor
  Clone ID: SORBI-28MAY03-C33234_1.pep
RLSKLLRHRPCWVSFCVDPWTRGAQRQYHLQEVWYWRFFSLFWLLFEGDSFYWWSVYRVCVPSLRLRLHLLMYMGRCPWIPFVGLLLVGQSIPVLPLASVSGESGFVRDVQRLNNTVCY

SEQ ID NO: 37630 - protein, 116 aa, Sorghum bicolor
  Clone ID: SORBI-28MAY03-C33258_1.pep
AESAQVGRESSERPWGFMRTCSTISSSVLGRPDQHSSAAAIAGDLAFLPLLNLHLLEELAAAEWILEMGSLLLLKAGLFLEYTGRNNRTKILLDESTGGRLDLVTRTKREFCFSAG

SEQ ID NO: 37631 - protein, 388 aa, Sorghum bicolor
  Clone ID: SORBI-28MAY03-C33264_1.pep
TRGISNVRRTQNVAARAAAARLAQVMASQNAAAAAGDDDDDDDYAADHPPPPPGRFGSGRVAHGSNGVSLLGRSARSPSPALGRNIVEPPPTVRSSSAGRPAVASRPTTTVVPPIKTNTTLRTPSPIPPVSVEPPVDRTRPKRFDAGLHNSRESGLKREASTLHDELDMLQEENESVLEKLRLAEERCEEAEARAKELEKQVAALGARGSLEARLLSRKEAALKQREAALKAARESKDGRDGEVTTLRHELESAKEEVASAMDQLKEAESETKALRSMTQRMVLTQEEMEEVVLKRCWLARYWGLAVQYGVYPEIAVSKYEHWSSLAPLPLEIVLSAGQKAKEEPRKQGENGQGRNKLAREMSDVMGEGNIESMLSVEMGLRELSSLK

SEQ ID NO: 37632 - protein, 152 aa, Sorghum bicolor
  Clone ID: SORBI-28MAY03-C33278_1.pep
MVLKSYTNLLDMCCEDVFQQPLRSLPHVVTSPGIISDPDCESSNDGNLVGSTHICFKRKIIVANFLPMICAKNEATGEWSFAMDDNQLLVQLKDGFPIDNEVIYVGSLNVQVDPSEQDRVSQKLFQEHRCIPTFLPADLQQQFYHIFCKQHL

SEQ ID NO: 37633 - protein, 242 aa, Sorghum bicolor
  Clone ID: SORBI-28MAY03-C33341_1.pep
MLALATHEVHFSILREVVFTPGQQDKCFLCGQVGHLAANCEGKAKRKAGEYDEKGGARVPKKPYQFLNIWTLREYLEYEFRMPNPPFQIDFERIVDDFIFICFFVGNDFLPHMPTLEIREGAINLLMAVYKKEFPSMGGYLTDSCTPDLNRVEHFIQAVGSYEDKIFQKRARLHQRQSERIKREKAQAKRGDDLDPHVRDDLIVPVANFRGSRLASGAVPSPYEQNGSRRERNSQALKAPRV

SEQ ID NO: 37634 - protein, 113 aa, Sorghum bicolor
  Clone ID: SORBI-28MAY03-C33749_1.pep
SRYQCEGSTPEPKKSTTATACGKNEATCEKSEGQESNSGLAFLKLAHEKLSTAEYKEFVEYMKALKSKTMDTKVSLEAITKLFSSPGKFPLLEGFRVFVPKNYLPLYEQLVRR

SEQ ID NO: 37635 - protein, 151 aa, Sorghum bicolor
  unsure (1)..(151): unsure at all Xaa locations
  Clone ID: SORBI-28MAY03-C3383_1.pep
NREQLTIDIFGLPPHXCCEFIVRHLLKKRPVIHEVTFTPAILVYSVDAYGSEMCVPNIAYIGVKKTTQNGISMWPLWYETITEDMHGYPCEPYYLHNTGNFEGDSDLDSEHRREVHKQYYDLQDGNNEMTSRLKEYVAGFSDDSDWEPYAP

SEQ ID NO: 37636 - protein, 167 aa, Sorghum bicolor
  Clone ID: SORBI-28MAY03-C33832_1.pep
QVAKGADLSDQQISKAMYLLHLTLYQQTKEQINYLMCPRKERVPILVFPSTTVVTTLQTILSKISVPIMDSQFFISDITRQLPVQCGQWEAITVGSLHGLVVLAWVTGCLGEEQEGTHIRQVGYLHLFQERIMGASFSVELWTGGMSLIHCRRKLFVLAKLECDDSA

SEQ ID NO: 37637 - protein, 166 aa, Sorghum bicolor
  Clone ID: SORBI-28MAY03-C33754_1.pep
MQLQQQLQQQQQLQQNPQQQQQLHQNPQQQQLQQLQQQQQIQQQLQQQQQLQQQLQQQQQQQQQQQMGSPLQQAQVGSPAGSQQSLMMQQQQQISPQQMGQQAAMSPQLSSGTLQQMSNNVVNPVATPGPPPSPQLSSQTHGSVSSIANSPMEQLQGASKGGPGSM

SEQ ID NO: 37638 - protein, 126 aa, Sorghum bicolor
  Clone ID: SORBI-28MAY03-C33835_1.pep
EEAKKAYVAAREEPDHDAEVAAEEKVSSALIEKVDAMLQELEKEIDDVDAQIGNRWQLLDKDHDGKVTPEEVAAAAAYLKDTIGKEGVQELISNLSKDKEGKILVEDIVKLASQTENNEEEEEARQ

SEQ ID NO: 37639 - protein, 207 aa, Sorghum bicolor
  Clone ID: SORBI-28MAY03-C33403_1.pep
MAGRYYQGQGGGGGGGASMEVVSTPNQELALTNCAYISPADLRRFPNGLALVADAWVFTLRDHNAVASGRIALNAIQRRQAKVSAGDSVTVSSFVPPDDFKLALLTLELEYAKARANRNDELDAVVLAQQLRKRFLDQVMTSGQRVPFEFYGTNYVFTVNQALLEGQESSTPLDRGYLSSDTYIIFEAAPNSGIKVINQKEAASSKL

SEQ ID NO: 37640 - protein, 136 aa, Sorghum bicolor
  Clone ID: SORBI-28MAY03-C33409_1.pep
MASSTTQHVLSSIKLLPTGCFHHDRRNSCVLSVSVGRRCRSARNLGLVCASNTQSSVIEPVQLPGSPKSGATPKKSGESALILIRHGESLWNEKNLFTGCVDVPLTPKGVDEAIEAGKRICNIPVDVIYTSSLIRA

SEQ ID NO: 37641 - protein, 136 aa, Sorghum bicolor
  Clone ID: SORBI-28MAY03-C33428_1.pep
MGALLLFVCLLAPIVLLCAAVRGSRKRRSASPASSCGKALPLPPGSMGWPYVGETFQLYSSKNPNVFFARKQNRYGPIFKTHILGCPCVMVSSPEAARFVLVTQAHLFKPTFPASKERMLGPQAIFFQQGDYHTHL

SEQ ID NO: 37642 - protein, 91 aa, Sorghum bicolor
  Clone ID: SORBI-28MAY03-C33459_1.pep
MGGGGDGGSCDLLQLLFEGALAGGAAGVVVETALYPIDTIKTRLQAAQGGSKIQWKGLYAGLAGNIVGVLPASAIFVGVYEPAKRKLLEIF

SEQ ID NO: 37643 - protein, 197 aa, Sorghum bicolor
  Clone ID: SORBI-28MAY03-C33484_1.pep
MRLLPDAPASPFRHLHLRRALSVRASAAGTGTGTDGSSGPVRVRFAPSPTGNLHVGGARTALFNYLFARSKGGRFVLRVEDTDLERSTRKSEEAVLADLAWLGLEWDEGPDVGGEFGPYRQSERNSLYKQYAEKLLDSGAVYRCFCSNEELEQMKEVAKQGQLPPVRMGKWASASDVEVQQELEKGTPYTYRFRVPK

SEQ ID NO: 37644 - protein, 343 aa, Sorghum bicolor
  Clone ID: SORBI-28MAY03-C34016_1.pep
HEANTAAGRLVNSMQPLSRRTRSIKGDNHIGGPVDGFPKVSSVDGGSSFDGPAGNSLDMSESDGHTRKDSKSFSREIPIFLSCATPDEFLESMIKADAPLNVKYLRTLVQCLSMLGKVAAAGAVICQRVRPTIHDVITSKIKAYSEEASKSSIDKAAKMYDVLHSNGPIPQFQMLKQKTKSGASVMAAQLVVSPISPAMAPTGDAQRAATQLLKSIFECLVEILENHIIVGELLEQKSTEVDNVNTPHIANGDASWNPDSESSQATGGFSVAFSLSVVQSECQQLLCEILRATPEAATADAAVQTARLANKDPVKEKRDGSEGLSFAFRITDAATPVPNEGQG

SEQ ID NO: 37645 - protein, 150 aa, Sorghum bicolor
  Clone ID: SORBI-28MAY03-C34049_1.pep
MRKRDLGILLLAAFAVFFSLHHEGDFSFRESWYHLTDEDFPIKYEADRLPPPLVADLNGDGKPEVLLPTHDAKIQVLQPPHARHLSDDSAFHEARVMADISLLPDNVRLASGRRPIAMAVGNVDRSYRAGEARKQVLVVVTSGWSVMCFD

SEQ ID NO: 37646 - protein, 115 aa, Sorghum bicolor
  Clone ID: SORBI-28MAY03-C3406_1.pep
ARGDDVQSLAYYKDQRFGYTTLDAFYQGTQASTKLSPEFHGNQLLQGDVTAAEFRQEQSAGNFAVNVDLNAKLRVKVWAFKVRGPKRPISCQLSVPAPGAANASPFQPTNCKVWF

SEQ ID NO: 37647 - protein, 126 aa, Sorghum bicolor
  Clone ID: SORBI-28MAY03-C34110_1.pep
MALGGLVGQFLASSNELMVASLSAVSCADEVQEEGAEGAGCRDDAAALRLKEVAMAAILVAGVLGVGLPLVGRKRRAMRTDSAAFLAAKAFAAGVILATGFVHMLHDEAARVKAAAAAALVATTSS

SEQ ID NO: 37648 - protein, 157 aa, Sorghum bicolor
  Clone ID: SORBI-28MAY03-C34092_1.pep
MDKLRVHRCTGGAVEWSPSPIVALVASPCASQVAAAREDGSLELWLVSPGSVGWHNQLTIQGNAESRITSLVWGRRGGEATGRLLSSSVDGSVSEWDLFHLQQKTVLDTVGVPIWQMAIEPSDDAKSTENNCSESGVNGHPNQNDSSDSDLSNIDDG

SEQ ID NO: 37649 - protein, 164 aa, Sorghum bicolor
  Clone ID: SORBI-28MAY03-C34469_1.pep
MDLDGDVRERTLEGKEATDARLTAAAVAGRLAAVSVRGSHPARGVTDAGVSALARGCPELRSLALWDVPQVTDAGLAEIAAECHSLERLDITGCPMITDKGLIAVAQGCPELKSLTIEACSGVANEGLKAIGRCCAKLQAVSIKNCAHVDDHGVSGLVCSATAS

SEQ ID NO: 37650 - protein, 304 aa, Sorghum bicolor
  Clone ID: SORBI-28MAY03-C33705_1.pep
IKILLQLLGSRMVTHPVAIDSIRALACRVLLGLARDDTIAHILTKLQVGKKLSELIRDTSAQTSGGDNGRWQAELTQVAIELIAVLTNSGKETTLAATDAAAPALRRSARAGIAAATPISYHSRELMQLIHEHLLGSGFTATAAMLQKEAGLAPLPLTAAVLPAHQVAALEASSVQQQWPSGRVQGFLSDKINMSTDQSAQRSDSILPSSKKKALTFSSSFSRRALSPHPISGSRASNILKSPVPIAADIGDAEMLNKTPLSLPLKRKLVDVKDNNSASASKRLAATDQMYQPSAFQTPAPTRK

SEQ ID NO: 37651 - protein, 136 aa, Sorghum bicolor
  Clone ID: SORBI-28MAY03-C33717_1.pep
ARGDGRPYRIASSLSIGVLLLGEMKRLLAHRQFGCPSRSLVARSPALPALCNNVLPSYYRYYSAEKHDDTTLGEIGDKARSTAEEFVRVAKEKTDDVAERAKETLHETKEAVVGESDDEKEKFKRRVEEGRYNHQK

SEQ ID NO: 37652 - protein, 187 aa, Sorghum bicolor
  Clone ID: SORBI-28MAY03-C33721_1.pep
MDAGAKETLILDLHAVEAVKLGTFVLKSGITSPIYLDLRVLVSHPRLLASVASLLGSLPATRPYDLLCGVPYTALPFAAALSVSASVPMLLSRYDTKGVEGTFRAGGGQTVLIVEDLVTSGASVLETVGPLRAEGLVVADAVVVIDREQGGRENLAANGVALHSLMTLTEMLAVLVKHGRVDEDKVA

SEQ ID NO: 37653 - protein, 158 aa, Sorghum bicolor
  Clone ID: SORBI-28MAY03-C33728_1.pep
MTRVIHDSGDDMHKEALDLVSSDVNFPKGRFPDYRIGPNNQIIDPEETHEAVPLKEIVAKETAQLLEQHKRLSVRDLKEKFEKGLSGASKLSEEAKRREAASLDRQVLLKKLRDVLDTLKGRVAGRNRDDAEEAISLVEALAVQLTQREGELIYEKAE

SEQ ID NO: 37654 - protein, 128 aa, Sorghum bicolor
  unsure (1)..(128): unsure at all Xaa locations
  Clone ID: SORBI-28MAY03-C33738_1.pep
RRSSRXPRRTRRGTTRSPRPLPPPRAPRDRQPRQPPSPPATTPACRPPSSSLPRSPAAHARSSQPRPSPSRTHSLPPHTPVGRIPYASRLPPPHTYLYSLFSLLMAGVGSTRPVVGPGQNRGRAAGRV

SEQ ID NO: 37655 - protein, 131 aa, Sorghum bicolor
  Clone ID: SORBI-28MAY03-C34348_1.pep
MQVGGGAADSPGAAAGAEAPRPSRYESQKRRDWHTFGQYLRNHRPPLELARCSGAHVLEFLRYLDQFGKTKVHAPGCPFFGHPSPPAPCPCPLRQAWGSLDALVGRLRAAFEEHGGRPEANPFGARAVRLY

SEQ ID NO: 37656 - protein, 165 aa, Sorghum bicolor
  Clone ID: SORBI-28MAY03-C34414_1.pep
MATAAPALPTFLRLWPASPFLLSPSLHVPSSRRPTPSRLNSLRPARPLFPISAVEKTNEAAAVGEGELEGMPPEFYDEEWQARQRERTKEWHAYRQKEEAEEERITNEYREIGMRLKAYPQEEVCKARILVSSFIRAGEDVEKEIEKAAERGELTELVLMVIWNR

SEQ ID NO: 37657 - protein, 212 aa, Sorghum bicolor
  Clone ID: SORBI-28MAY03-C34416_1.pep
ARGDEDVYFDDESAEVVISSLRLGDDQDTCSLFTNSNWFTFDGDRGINDRLAASVPSSSPNSEEISLNTEETDEVLTGETTGTESLLESASLENGPVEEAKELAEVANDSDATTVSEKILCTEEHSASHEPETSERPVDAQEGQTGGVAEATSTEGATNEPFSSSEPGNLPESGDTDCHTANSSEPNEIAHESGSPAEVDDEKKSEIATTNE

SEQ ID NO: 37658 - protein, 244 aa, Sorghum bicolor
  Clone ID: SORBI-28MAY03-C34422_1.pep
MQNGAPSTAVVPVATSTEVPLVATDAGASRNNNENSSLTTGVDTQDGTSVEDLEEAKKTMPVAGKINVTPLEEKTNEEEPVVYASKMEAKNAFKSLLESVNVESDWTWDQTMRVIINDKRYGALKTLGERKQAFNEYLNQRKKFEAEEKRVKQRKARDDFLAMLEECKELTSLTRWSKAILMFEDDERFKAVERPREREDLFENYLVELHKKEKAKAAEEHKRYVAEYRAFLESCDFIKATTQW

SEQ ID NO: 37659 - protein, 69 aa, Sorghum bicolor
  Clone ID: SORBI-28MAY03-C33841_1.pep
LETQSKLICGCEEVNSNLNQSVMKLLTGIDRMVVTTSYVHVVYSDISVPIDFLKKEEKKKNASLHRLIT

SEQ ID NO: 37660 - protein, 114 aa, Sorghum bicolor
  Clone ID: SORBI-28MAY03-C33855_1.pep
VLENGDNWSVGQRQLIALGRALLKQAKILVLDEATPAVLAPADNLIQKIIRSEFKDCTVCTIAHRIPTVIDSDLVLVLSDGKIAEFDTPQKLLEDKSSMFMQLVSEYSTRSSCI

SEQ ID NO: 37661 - protein, 188 aa, Sorghum bicolor
  unsure (1)..(188): unsure at all Xaa locations
  Clone ID: SORBI-28MAY03-C33858_1.pep
IPPLFSFRRVQLSLQRILQNCSATARSWSSKCGLGGLGVIAEVTFXCVERHQLVXHAFVSNADEIKNKHKKQLSENKCIKYLWIPYTDTVVVQWNPPSKWRTPILTSKYGKDEALQHVXDLYCDSLKKYSLVDFMKKLMTLVQQREIQRSYLLNARNQRHYDSVIPRPLKKHHMHASSCGSEEKVAET

SEQ ID NO: 37662 - protein, 33 aa, Sorghum bicolor
  Clone ID: SORBI-28MAY03-C33892_1.pep
SLSVDPPWSVEVEKNFLNGKLKAITAYFEEQDC

SEQ ID NO: 37663 - protein, 69 aa, Sorghum bicolor
  Clone ID: SORBI-28MAY03-C33931_1.pep
SRAVSMLAGHVQVGEVVNKPSYITEWQIKGGDASSFMSSNVSGQSSVAPRSSAAQTSSPFLSSVIEEGR

SEQ ID NO: 37664 - protein, 127 aa, Sorghum bicolor
  Clone ID: SORBI-28MAY03-C33999_1.pep
MVVCKCRKATRVYCFVHQVPVCGVCICFPEHQLCVVKNYAEWVVNSEYDWPQHCSSCNSVLEGGTEETTRLGCLHVVHTKCLISHIQDFPSQTAPAGYVCPSCSAPIWPPSSIKDTGSRLHTKLKEA

SEQ ID NO: 37665 - protein, 99 aa, Sorghum bicolor
  Clone ID: SORBI-28MAY03-C34598_1.pep
ANSSGNKRQFEEDKFQEMLAKSANSELRLSVWMDDVYNFMRSQKRRRIQSSDISQDFDTMRKQLASDARIFRSKVPESLIDNLIKRLRSYFEGKYSPNA

SEQ ID NO: 37666 - protein, 143 aa, Sorghum bicolor
  Clone ID: SORBI-28MAY03-C34658_1.pep
LYRRVETEILKSEATPAMSLLNELLNLHDGSDNEKWLKKCRKRMLEVFPREDPFTVVFPAGFKMENHEGRIELPPQDDDLLLRVDFVREVDELLKEVQAEQDKNKQQVGFDPESVAYMLKQQEKMQTIRQVESLLDLAASLKW

SEQ ID NO: 37667 - protein, 263 aa, Sorghum bicolor
  unsure (1)..(263): unsure at all Xaa locations
  Clone ID: SORBI-28MAY03-C34666_1.pep
DQVRRQERKXRDGFRKMLEEHVADGTLNARTRWRDYCAQIKDSESYLAVASNTSGSTPKELFDDVIEELDKQYQEDKTQIKEVVKSGKIPMTTSWTLEEFQTAILEDDALKGISTINVKLIYDDQLERLKEKEQKEAKKRQRLGENFSDLLYSIKEISASSTWDDSKQLFEDSEEFRALDSETYARELFEECVVHLKERLKEKERLREEEKAKREKEREEKEKKKEKEREGKDRERKEKERDHREKEREKEKGKDRSRRDEMD

SEQ ID NO: 37668 - protein, 86 aa, Sorghum bicolor
  Clone ID: SORBI-28MAY03-C34693_1.pep
AGIYSAPVALSLYAKVFEEAGALDKLETFTSFNGPDFYGLPRNTSKIVLRKNAWKVPGTYKHSSGEIVPMFSGSTLEWLPSDQPKE

SEQ ID NO: 37669 - protein, 63 aa, Sorghum bicolor
  Clone ID: SORBI-28MAY03-C34702_1.pep
HNIVSLLYIMLCLLHCYVFIHLHLASHLGTLDELREGLYGGPIGMMEGLHKCCHLRCRQDGAS

SEQ ID NO: 37670 - protein, 163 aa, Sorghum bicolor
  Clone ID: SORBI-28MAY03-C38596_1.pep
MATMENVIELVNRIQRACTVLGDHGGGDVAALWEALPSVAVVGGQSSGKSSVLESIVGRDFLPRGSGIVTRRPLVLQLHKTEDGVQEYAEFLHMPKRRFTDFALVRKEIQDETDRLTGKTKQISPVPIHLSIYSPHVVNLTLIDLPGLTKVAVEGQPESIVQD

SEQ ID NO: 37671 - protein, 94 aa, Sorghum bicolor
  Clone ID: SORBI-28MAY03-C38646_1.pep
GSLQGSNMSSVGNFPKPHASYQQSPSSSSHHRDIDRQSQDLLSGIVAPTSATNQAPVEDNKNENQDDSIWLKEKWSIGEIPLGEPPQRHISHVF

SEQ ID NO: 37672 - protein, 252 aa, Sorghum bicolor
  unsure (1)..(252): unsure at all Xaa locations
  Clone ID: SORBI-28MAY03-C38655_1.pep
MPLGTRSGLVRGSLAAKVPIKAELVRKGPADGWLKNDKVAGTQSGLGGARLSTKTVSQDERVVEGFPDGWRKEYRPRKSGSFQDPYYIDPVSGYEFRSLKDVHRYLKTGDIRQCAVRPKKSTTFEVHVTESQTHTSSSSQYTRPGTADKGIQCEILTSDGIMVPWEELITQYNGNDTEHTVLTGPESLKASQGYGSKLDTVEHMSVQPVSVHNGSRQTKSVKRKEPXAEVKSKKRKTSSAVTPVRASPRLAA

SEQ ID NO: 37673 - protein, 116 aa, Sorghum bicolor
  Clone ID: SORBI-28MAY03-C38726_1.pep
RALDPSRQSEKVNLVNWARPLLSDRRKLSQLMDSGLEGQYNPKGALLAAQLTLKCLNGDPKSRPSMKEVVEALEKIESVKSRVMREPRNSSSSSRRSQVQSPRSDSARNNSSSRGR

SEQ ID NO: 37674 - protein, 141 aa, Sorghum bicolor
  Clone ID: SORBI-28MAY03-C38782_1.pep
MEPTTAEDAAAAAAAPDSWETADIDGPMSRLILSARRVSSSPDLADDQDPPQPPPPTLQPQSGPASSAAREDLVAQVDQFLREALEKPRERLSVLRMEQEILKFIRDPRRTEFEFNGLPTSYLRLAAHRLAQHYFLQSIAI

SEQ ID NO: 37675 - protein, 147 aa, Sorghum bicolor
  Clone ID: SORBI-28MAY03-C34857_1.pep
SFGLTHANAPQHMLQQPMFHPGANPQTNFLPGQPPLPSQPPPQQLYQQASSHYNTQSTTPMGVDRSAPWGRAPEGPTSGSHFPGQLPGLPGQMAQGIGGIQAGQAPLTPEMEKMLVQQVLGMSAEQINMLPPEQRQQVLQLRDMLRQ

SEQ ID NO: 37676 - protein, 185 aa, Sorghum bicolor
  Clone ID: SORBI-28MAY03-C34888_1.pep
LPFHHFSGGPEPSSPILPAKESLHSEPENIQHGDPACRLEEVIQLDMETDEPQPPENGNEDGHCETEDTEMSKSPSDDPSGTEQRFRTLNEERNIQQNQKTPREFELSVPVVPFDYAEARKNLVSSQPKAERRKDDAVARAINTDSGDKRIASKKPGGGEDEGNFQHPRRRQAFPPSGNRSATYH

SEQ ID NO: 37677 - protein, 173 aa, Sorghum bicolor
  Clone ID: SORBI-28MAY03-C34909_1.pep
DSAQGAGSPAMLDALSRITGSFNSSNSKLLEKAIQRSFLVSADMAHALHPNYMDKHEENHQPKLHGGLVIKHNANQRYATNAVTAFIFREIAERHQLPVQDFVVRNDMACGSTIGPILASGVGIRTVDIGAPQLSMHSIREMCAVDDISHAYEHFKAYYEEFTELDSKVKVDY

SEQ ID NO: 37678 - protein, 165 aa, Sorghum bicolor
  Clone ID: SORBI-28MAY03-C34917_1.pep
DRMKNLQELVPNSNRTDKASMLEEIIEYVKFLQLQVKVLSMSRLGATEAVVPLLTESQTESSGGLLLSPRSGSSGRQRAGGGSLPSSEARDGAAFEQEVAQLMENNMTTAMQYLQSKGLCLMPIALASAISDQKGSSSAAVQPENGGAKEMLRAVKPLGSPIQGR

SEQ ID NO: 37679 - protein, 62 aa, Sorghum bicolor
  Clone ID: SORBI-28MAY03-C3489_1.pep
LVLDGEKVAQASDQSELNDDFWAELLVEDFGDKAGQSELEGRTEDVDDLAQQLGYLSNSSPK

SEQ ID NO: 37680 - protein, 63 aa, Sorghum bicolor
  Clone ID: LIB3481-023-P1-K1-G2.pep
SVLLEYAGVKIRIVMMDLGNKADDPSFLPYPLCVCSCIFRFALIYFFSQLPSETFILNCSLFS

SEQ ID NO: 37681 - protein, 164 aa, Sorghum bicolor
  Clone ID: SORBI-28MAY03-C34484_1.pep
SSHKLKIMSWFKEIFKGSVNRRVSRGHYDGGWHEGHSSDHTRDTYDDSDNEDMDRAIALSLAEAEEDQNKGKAAAIDTVYNLEEDEQLARALQESLNAESPPRRNVPIEDVPVPPQWDVPVERAPPRQYVPANEPPPHVYSQSGSRICAGCHNPIGHGRFLSCM

SEQ ID NO: 37682 - protein, 162 aa, Sorghum bicolor
  Clone ID: SORBI-28MAY03-C34515_1.pep
TRATRDQLKNAIPSICISRRKCVVGDEGVKISACCIAVVALAEPNSMSQLDTIKKRVIPIILDTLLKGFLEFKDVEIQCQHDGELLVKVCMSHHCKGGRFWATLQNACIPVMELIDWELSRPSNVADIFCSYGIDSAWKYFVESLRSATTDIGRNIRSEHLL

SEQ ID NO: 37683 - protein, 295 aa, Sorghum bicolor
  Clone ID: SORBI-28MAY03-C34543_1.pep
DVQRQRFGVQQVMTSAVSMPVVTSSGTIPVVVSSATVPSLRYDDCTMCQKALPHAHSDNIIREQGNSRATGNLEGAPVFYIPHQDSASNKSSPSASSGTPANYAAEPRAGNTAVMAQFDSTLPARKHAVQATASPDTGLPVQPTMIALPVSSAPAPNGVFVGHSRPAGVEDHIRYQQQPFSYSMQPPQVPVNGPQGIDASGYKDSNHPAAEPLREYAHDLPHDYARAIDARMQAVHLGPIAPPESSVHGKPSIPHGVTDHAKVGKPPVNIDGSSIYKSQAGGYHMGITNAFTAPA

SEQ ID NO: 37684 - protein, 195 aa, Sorghum bicolor
  unsure (1)..(195): unsure at all Xaa locations
  Clone ID: SORBI-28MAY03-C34525_1.pep
MRAAAAASFHLAAATNPAHPRGSTTDSCSLKPAPTAQPPRLRSLARRAPLACASLGISHDKGSDISDPNVVGQNDLLIVGPGVLGRIVAEKWQKEHPGCKVYGQTASKNHHSELTDLGIIPSLKGTTIHQKVPHVIFCAPPSGSDDYPXDVRKCVQXAASNWSGEGSFLFTSSTALYDCSDNSMCNEDCSSVPIG

SEQ ID NO: 37685 - protein, 159 aa, Sorghum bicolor
  Clone ID: SORBI-28MAY03-C34561_1.pep
ISGVAITAKADVFSYGMMLFELISGKRNAGHGEQHGSTFFPTLAASKLHEGDVRTLLDPKLNGDANVDELTRACKVACWCIQDDETARPTTGQIVQILEGFLDVNMPPVPRSLKVLGESPDVINFFSDISSSQTSQTQNSTTTSQTRSATSGSSHPQSP

SEQ ID NO: 37686 - protein, 116 aa, Sorghum bicolor
  Clone ID: SORBI-28MAY03-C351_1.pep
TVRRSSRPGRESLVGVQVLGRKLKPPRILKEAAMVPHKSAQWELPLLPLLSPRMYAQGGRGPAAGRLASCSMTPYIACLGLGNGKLRAPRRDGAAPSCRARPAHRRHGAACCCSPC

SEQ ID NO: 37687 - protein, 96 aa, Sorghum bicolor
  Clone ID: SORBI-28MAY03-C35087_1.pep
SPHCSEPEPTHGSDSWPPNYHPYSYQLKVIRTIPFNSNDILCDMKKLMIPIPIALASVAGHLILAVAKHSRQFHTEMPGSLVIISGLLLLPFVSSF

SEQ ID NO: 37688 - protein, 189 aa, Sorghum bicolor
  Clone ID: SORBI-28MAY03-C35154_1.pep
LRPNSPNKRLESRVVLAPRELRQWASQRSYFPVHGSPPPGQLPQQGSQEGTGGTRRARSRDCCPSIETGTRQGSRPRRTETEVNRQRAWRLDLRSFQIAPRSALLRTSLPLPPHSPVLHTSTATVLLKPSLTPAWRWLVLDLSKGSPVLVHLLLSFWWFRLKGRQERSRGFGLLRLFCCLAVPVPREVK

SEQ ID NO: 37689 - protein, 112 aa, Sorghum bicolor
  Clone ID: SORBI-28MAY03-C34730_1.pep
KGFRNLSIEVEEGICQVLAHLWLESEIIAGSSSNVASSSEASSSSSSSGPTSSKKGAKTEFEKKLGAFIKHQIETDSSEAYGGGFRAGYPAVERYGLKRTLDHIKLTGTFPY

SEQ ID NO: 37690 - protein, 174 aa, Sorghum bicolor
  Clone ID: SORBI-28MAY03-C34758_1.pep
SKLFEQLLGVILSVCFVAAESVLAADSNLSKLFYDCKDYIIGICHDAMSKDELDEICKVYETMEAIVIHPEEALQIMEQPDEKSVDNKNRFKLKLNFMAKDRPPLWKRTTKDEKKMSPKDDKNTSEEKNTKIFSNLFDKKVNIFSKKNVKSPEVPAAPTSSSPGPFDESEWTIL

SEQ ID NO: 37691 - protein, 187 aa, Sorghum bicolor
  Clone ID: SORBI-28MAY03-C34768_1.pep
LMLALCRFLRDKYSLAAVTNDIFTKEDGEFLIKHGALPEERIRAVETGGCPHAAIREDISINLGPLEELSNLYKADLLLCESGGDNLAANFSRELADYIIYIIDVSGGDKIPRKGGPGITQADLLVINKTDLAPAVGADLAVMERDALRMREGGPFVFAQVKHGVGVEEIVNQILQAWEIVTGNKRR

SEQ ID NO: 37692 - protein, 97 aa, Sorghum bicolor
  Clone ID: SORBI-28MAY03-C34817_1.pep
DTASDGQPSVSPDDLLVLAQQYSSDLLQGELERTRLNIACFMESTLQSTGAPAGSKPGAYFFYQAQVPQHAPVQTSSPSFRRQQTGTSFPVVSRRRR

SEQ ID NO: 37693 - protein, 157 aa, Sorghum bicolor
  Clone ID: SORBI-28MAY03-C34847_1.pep
WSLKNPDAIIRSLKGAGLNCMEVYRSDGKVDGFSELAEKYGLLKLGGSDFHGRGGKDESDVGTVKLAITTLCCFLKMARSIWSSAMKDILLKFAEEPSAANLGNMLKFGRLTNFSGFSPINNGIHVVDFCLSSWSSAMEDVELEEVRLKLAHYVAER

SEQ ID NO: 37694 - protein, 188 aa, Sorghum bicolor
  Clone ID: SORBI-28MAY03-C3485_1.pep
MAFFSHHHLQQPHPQQAPPPHQQQPVLPSFRNALPVPVDGQIPAPLTFFNPPPAFPEQPAQAPLVDAMGLTAAAGLGWRQPREQELLGENSQMSSIDFLQTGSAVSTGLALSLEDRRHGGGGAGNSSGDSPLLLLPMLDDDISREVQRLDADMDRFIKAQSERLKQSILEKVQAKQFEALALSEDKIL

SEQ ID NO: 37695 - protein, 160 aa, Sorghum bicolor
  Clone ID: SORBI-28MAY03-C35365_1.pep
MEMEAVESNGSHGAADRRTPKRDHRIFWASVFILANNCFQCIAYFGVSTNLVNYLKDQLHEGSKAAANGVTNWLGTSSITPLVAAFLADAFLGRYWTIALFMVISVVAYVVLTVSAAVALESAAFYAGLYLLALGGALQPVLSSFGANQFDESDEGERGR

SEQ ID NO: 37696 - protein, 184 aa, Sorghum bicolor
  Clone ID: SORBI-28MAY03-C35369_1.pep
MAEKSPAADVEAGLLAHLNSAGEVPDSRSFASSLGVSHLELEGVIKSLSAFRIVESTDIVKETWVLTEEAKGYAAKGSPEAQLVAAIPSEGASKDALKAKLGDAFDVGMKAAARNKWIGFEKGNKDLVLRKVESVKDELQEQLRRLENGEVVPDKVIDDLKRRKLITKEKSIWYSLKKGAEFVL

SEQ ID NO: 37697 - protein, 302 aa, Sorghum bicolor
  Clone ID: SORBI-28MAY03-C35356_1.pep
LNMTDEMLSARSFSRQLMDQIYLAKTYVIVAKEANNLQFVAELSAQVRRAQSILAHAAAHGGTVMEQEAEKAIRDMSVLLFQAQQLRYDSGITIMKLKGQIQSLEEKSKAEADKSTKYGQIAAEELPKGLYCLGVRLTMEWFKSPELQRKFSDRSPSVQSNLRDNSLYHFCVFSDNILAVSVVVNSTAINSRHPDKVVFHLVTDDLNYAPMKAWFAMNDYRGVTVDIQKVEDFTWLNASYVPVLKQLQNAATQKFYFSGSGNRGTPIKFRNPKYLSMLNHLRFYIPEIYPELQKVVFLDDDI

SEQ ID NO: 37698 - protein, 234 aa, Sorghum bicolor
  Clone ID: SORBI-28MAY03-C35395_1.pep
TRVKYARWEEQQRDFARARSVYERALDVAHPRRTLWLKYAEFEMRNRFVNHARNVWDRAVSLLPRVDQLWYKYIHMEELLGAVANARQVFERWMSWRPDTAGWNSYIKFELRYGEVERARAIYERFVAEHPRPDTFIRYAKFEMKRGEVERARRVYERAADLLADDEDAEVLFVAFAEFEERCREVERARAMYKYALDRVPKGRAEELYRKFLAFEKQFGDREGIEDAIVGKRR

SEQ ID NO: 37699 - protein, 186 aa, Sorghum bicolor
  unsure (1)..(186): unsure at all Xaa locations
  Clone ID: SORBI-28MAY03-C34940_1.pep
ARGIIEETGVDAIDTGDDGTVKITARDLSSLEKSKTIIANLTMVPKVGEIYRNCEIKSIAPYGAFVEIAPGREGLCHISELSSGWLAKAEDAFKVGDRIDVKLIEINDKGQLRLSSRALLPDADSESNSGSTKEKAPQKDDXIKMTSRRPRRKRQSEPFGAENATIKTLEKSAAAPAGSKGSEVGK

SEQ ID NO: 37700 - protein, 112 aa, Sorghum bicolor
  Clone ID: SORBI-28MAY03-C34967_1.pep
NRFALVFGTLDGGIGCIAPVDELTFRRLQSLQRKLVDAVPHVCGLNPRSFRHFKSNGKAHRPGPDNIIDFELLSHYEMLSLEEQLEIAQQIGTTRSQILSNFSDFLLGTSFL

SEQ ID NO: 37701 - protein, 69 aa, Sorghum bicolor
  unsure (1)..(69): unsure at all Xaa locations
  Clone ID: SORBI-28MAY03-C35006_1.pep
NAYSRILAKEHPXLCINCVHPGYVQTDMNFHAGDLPLEQGARGALMMAMAPKGGVTGAYLDKTKVVSFV

SEQ ID NO: 37702 - protein, 67 aa, Sorghum bicolor
  Clone ID: SORBI-28MAY03-C35034_1.pep
HYKSSTKTHPSLQPWNLGTDESGWWLFPTGLMLLKCIQARLVDWHVANLEIQDRAVYSNDPNIFWQS

SEQ ID NO: 37703 - protein, 172 aa, Sorghum bicolor
  Clone ID: SORBI-28MAY03-C35076_1.pep
DKVQITGPSGKIMLLPEDDPKATHIMIATGTGVAPYRGYLRRMFMEDVPTFKFGGLAWLFLGVANSDSLLYDEEFTNYLQQYPYNFRYDKALSREQKNKNGGKMYVQDKIEEYSDEIFKLLDGGAHIYFCGLKGMMPGIQDTLKRVAEQRGESWDQKLSQLKKNKQWHVEVY

SEQ ID NO: 37704 - protein, 129 aa, Sorghum bicolor
  Clone ID: SORBI-28MAY03-C35015_1.pep
LDVGNNHLTGTLRDFIGNGNGFPSLRNLYLNNNELTGVLPDQIANLTNLEILHLSNNKMIGSISPKLVHIPRLIYLYLDNNNFIGRIPEGLYRHPFLKELYIEGNHFRPGTRSKGTHKVLELPDADILV

SEQ ID NO: 37705 - protein, 149 aa, Sorghum bicolor
  Clone ID: SORBI-28MAY03-C35594_1.pep
CALICCCLPCIISLMGFREDLNENRGATSDAINALGTYKFKTKKPRNTEGNEGGGGVFAPGTDKERAVSAEDAVCCICLARYVDNDDLRLLPCGHFFHKDCVDKWLKINALCPLCKAEIDIVPTTAPPAIGFGRRHSDNRVGNDIESQR

SEQ ID NO: 37706 - protein, 170 aa, Sorghum bicolor
  Clone ID: SORBI-28MAY03-C3559_1.pep
MAVGGGVCVASPSSSPSSSVEAPWGTRRTRTTTTTSGARRGAAAAATSVRCSIVGEAGGPGASGRLAEDPYRTLRLRPGATRGEVKKAFRRLALMYHPDVRKEKGRESDGVSDVQFQRINVAYQMVMSSMREADERLEYWRLKYGLTDEDLDRYRHHLNQEHGDDDWFDM

SEQ ID NO: 37707 - protein, 129 aa, Sorghum bicolor
  Clone ID: SORBI-28MAY03-C35668_1.pep
TRGIFLYELLFGKTPFKGSGNRATLFNVVGQPLRFPESPIVSFSARDLIRGLLVKDPQHRLGYKRGTTEIKQHPFFEGVNWALIRCASPPDVPKPVELDRPPKPAPANDKVAPAANQKGPDNFLEFEFF

SEQ ID NO: 37708 - protein, 222 aa, Sorghum bicolor
  Clone ID: SORBI-28MAY03-C35699_1.pep
TRVRFIGACKKSIVWCIITEYAKGGSVRQFLARRQNKSVPLRLAVKQALDVARGMAYVHALGFIHRDLKSDNLLISADKSIKIADFGVARIEVKTEGMTPETGTYRWMAPEMIQHRPYDHKGDVYSFGIVLWELITGMLPFTNMTAVQAAFAVVNKGARPVIPQDCLPSLSHIMTRCWDANPEVRPPFTEIVCMLESAKMELVSNVRKARFRCCISEPMTTD

SEQ ID NO: 37709 - protein, 100 aa, Sorghum bicolor
  Clone ID: SORBI-28MAY03-C35169_1.pep
RPFAHLILSFGHGREWGRESPRAQAETEKTPVGGEETMTRSRDGGGPEEIPRPGADGHESSSRGGDFDELTTYLSSSKDTALVRTWTSEFVIEVWPGNTG

SEQ ID NO: 37710 - protein, 193 aa, Sorghum bicolor
  Clone ID: SORBI-28MAY03-C35201_1.pep
PGAALQLPVVPPTRPVARTTPPVTSPRPATPPPPPPHPIASAAASASSSASSGRRKENQLVIDIPTRPVALNTPPMNSPLPASRMPGTADDMRSPVSARLRSLRRLLSRGKQAVVGTCSYSPPALPRRPRRLRRRRTDRPDPRLPSSVTHLAALADHRSAHMRSFFLSPFFFTLLLDLTAEKRLMWIGCCWGG

SEQ ID NO: 37711 - protein, 317 aa, Sorghum bicolor
  Clone ID: SORBI-28MAY03-C3514_1.pep
MAGGGADDDDVVEVSCGGRGGGDPGAYAAVLKRKLDLYCAAVAKSMEAKSQESSLGYPNSQASDTSQLISQASFDGDIDGAGLVTNSNVIIEDDDFQGKPTNSGTSKELSDDDGDLEENTDPTNAKKMRRMLSNRESARRSRKRKQAHLNDLESQVSRLTSENASLLKRLADMTQKYKDASLDNKNLTVDIETMRRKVNIAEEAVRRLTGTTLMLSTAFDKPMSSTPLSSCASDAASASVAIEDSAKHFLHAPLQSGQMKLDILNAAIPLTSEGIGTKPASLQRVASLENLQKRIIGDSMHSETASTFSEPEALADR

SEQ ID NO: 37712 - protein, 75 aa, Sorghum bicolor
  Clone ID: LIB3481-024-P1-K1-B1.pep
CSLRVHRISNDPLLQVLQASNTLQRSWLGAYPLTGQRNRRVQDVKLHLTALQWRMEEMFRAIFNGDRGRSRIICT

SEQ ID NO: 37713 - protein, 62 aa, Sorghum bicolor
  Clone ID: SORBI-28MAY03-C3519_1.pep
LEEKRAKAMEKAQNEVAKARRKAEEKRASAEAKRGTKVARVLELANFMRAVGRAPSTKRSFF

SEQ ID NO: 37714 - protein, 100 aa, Sorghum bicolor
  Clone ID: LIB3481-024-P1-K1-B4.pep
IHQALLLLNTLPPQPQRPPASPLLQQFPLPPPALLVAAGTVQLFVDAAACAVQFFAGLMDRSPLHSTGSDRVISAVLAAWNACFSVVSTTCMICKPFFSC

SEQ ID NO: 37715 - protein, 106 aa, Sorghum bicolor
  Clone ID: SORBI-28MAY03-C35237_1.pep
EKLDLCCFPGEKIPDWFSPSKLLRLKRLYFTGGMLRTFGNKNMSEVWSVEVLRLKFLNDLSVQWTQVHDIFPKLTFLEVFRCRKLESFPCDKDGVWMNHDTKDIRK

SEQ ID NO: 37716 - protein, 312 aa, Sorghum bicolor
  Clone ID: SORBI-28MAY03-C35249_1.pep
SPSHKPGRVPFYVTCTNRLACSEIREFEFRPSVTQYMDAPSPHGATNKTYLQMRLDDLLSLGHNEYQATVSNPTKEMVDLSKKISSLMTSNDSWSKLLKLASDNEPATDHNQDQFFEKRLKEKLHIWLVHKARDGGHEANVLDDEGQGVLHLAAALGYDWVIRPTVSAGVNINFRDAHGWTALHWAAFCGRERTVVALIALGAAPGALTDPTPDFPTGSTPADLASANGYKGISGFLAESSLTSHLQTLDLKEGKGSNAPEISGLPGIGDVTERRASPLAGEGLQAGSVGDSLGAVRNAAQAAARIYQVFRV

SEQ ID NO: 37717 - protein, 135 aa, Sorghum bicolor
  Clone ID: SORBI-28MAY03-C3527_1.pep
VRRNGVIEFGEFVRSLSVFHPDAPEEQKVAFAFKLYDLRQTGFIERHELKEMVLALLDESDLDIASDAVEMIVDRTFDQADTKGDGKIDQEEWTAYAKDNPYVLRNMTLPYLKDITMVFPSFVMHSEISETDMAV

SEQ ID NO: 37718 - protein, 197 aa, Sorghum bicolor
  unsure (1)..(197): unsure at all Xaa locations
  Clone ID: SORBI-28MAY03-C36019_1.pep
PRATPARPLAASSYRRLSRSRRSLLLPPPTPRAPLARPPSIVRDRSMVGDLSLLAVASASPVVLPPSKELHGVLPLQVQGKRPQDAGVQLCAPLQQQQQQHPPHHLEAGMPYHQGQPMQMVVPGVHQGQPLPAAYQAFVMPDTATLIDVQDSHPDSVQLSLGIAEQCARQEKLLKFLMSGSDVXELDESLLAEFTGQ

SEQ ID NO: 37719 - protein, 136 aa, Sorghum bicolor
  Clone ID: SORBI-28MAY03-C36025_1.pep
MGSSSHHDAISASGSLECADGSRSGISKWTKITSTNSWRWCLGLIYIVAVAGIWIAASYIVQSVVDAGVSPFLITYICNSLFVVYIPIVEAARYFEDSIGDFWTKLKFKDAESLQSGGQQSSDLESVNLLQSGGHE

SEQ ID NO: 37720 - protein, 201 aa, Sorghum bicolor
  Clone ID: SORBI-28MAY03-C3602_1.pep
NIRVLNLIIIYVLFCQIYEKMISGMYLGEIVRRILLKLAHDASLFGDVVPPKLEQLFILRTPDMSAMHHDTSHDLKHLGAKLKDILGVPDTSLEARYITLHVCDLVAERGARLAAAGIYGILKKLGKDKLLSDFSQQRTVVAIDGGLYEHYKKFSACLEATLTDLLGEEVASSVVVKLANDGSGIGAALLAASHSQYAEAA

SEQ ID NO: 37721 - protein, 354 aa, Sorghum bicolor
  Clone ID: SORBI-28MAY03-C36119_1.pep
MKAVERAKLVRSLRHESRRLRLLVLVIGFFLVTLTFVVVSKPDALLFNLNGRLLVDQAPRSLLIRQRVDAHDGRSADTLASASGDLKVVDDDTAGEEASTNAIGTSGEEERVLASEPEQSKRAVEATTSEILGGEHDEGRKSQQEGARGHQQHKLTLPTVSNYTIHDATDGTDNGNRDDAEFKPTLDVDQRNGRDRSHQAALDNVERDKPLCDFSNFRANTCEMRGNIRIHPNGSSVIYVEPTSSSPKRNEQWKIKPYPRKGDELCLNHITEVTVKSSKVAPECSKYHHVPAVIFALTGYTGNLFHDFTDVLVPLFTTASEFNGEVQFLITDMAIWWTRKYAVVFEKLTKYPLI

SEQ ID NO: 37722 - protein, 342 aa, Sorghum bicolor
  Clone ID: SORBI-28MAY03-C35449_1.pep
KNYEPPPGEFYFEVDDNSPARRDDPLLFDYNVEERVNDFVAAAVAQANITRTNHIMFTMGTDFKYQYAESWFTNMDKLIHYVNKDGRVNALYSTPSIYTDAKYAANELWPLKTNDFFPYADNPNAYWTGYFTSRPALKRYVRMMSGYYLAARQLEFFKGRHSSGLSTDSLGDALALAQHHDAVTGTEKQHVANDYAKRLSIGYTQAQELVSTSLACLTESGSKSHCSSPMTKFSQCLLLNVTYCPPSEMDLTKGKSLVVLVYNSLGWKREDILRIPVFSDSIVVHDSEGREIESQLLPIATASLNIRDKHVKAYLGTTPGAKPKFWLAFPVSIPPLGFNTYF

SEQ ID NO: 37723 - protein, 355 aa, Sorghum bicolor
  Clone ID: SORBI-28MAY03-C35450_1.pep
QRVEFFTMSPLASSSIHWLVGIVYMLQISIFVSLLRGVLRNGVLYFLRDPADPNYNPFRDLIDDPVHKHARRVLLSVAVYGSLIVMLVFLPVKLAMRVAPSIFPLDITIFDPFTEIPVDVLLFQICIPFAIEHFKPRATIKSLLHHWFAAVGWALGLTDFLLPKPEENGGQENWNGRAERRDRGHGGREMVAPQVEQRMIQHVAAEDNGRGNANEANDATEESDVDDQGDSEYGFVLRIVLLLVLAWVTLLIFNAGMIVIPISLGRLVFEAVPRLPITHGIKCNDLFSFSIGCYILWSAAAGTRYAIDYIRSRQLGFLVQQICKWCSIVLKSSFLLSIWIFVIPVLIGLLFELLV

SEQ ID NO: 37724 - protein, 206 aa, Sorghum bicolor
  Clone ID: SORBI-28MAY03-C35462_1.pep
LPETMSSGLDMSLDDLIKKSKSRPKANPASSSGPARRAPHPARAAPYPPAAPKAHEAADSPYGVYSEHIATIAAVAPPPAAAAATARSLETGTKLHISNLDPGVTVEDVQELFSEVGELKRYSMNYDKDGRSKGTAEVVFARKVDALDAIKRYNGVLLDGKPMNLELIGNNVEPPPMPPLIPNRPLQNYNDIHISVPQSQRGGQRR

SEQ ID NO: 37725 - protein, 193 aa, Sorghum bicolor
  Clone ID: SORBI-28MAY03-C35548_1.pep
METQSWEGGRVLQSASESSRKLDYEAEARLVAEARAAWERRAKGEVEDDDEDDPEMLLDYHAYRARKFRDTWNCLYFGYCGSFEDTTKIPSMRFTDKPPQQRCSAHLCATLQIFSVKVAERRRMGSLQWPLHVFGKIALRDSVDHNRNMIFDRTRDNCQILTQEVPNLKLTGPTRAVLLTDPVTFEGDLKVKG

SEQ ID NO: 37726 - protein, 307 aa, Sorghum bicolor
  Clone ID: SORBI-28MAY03-C35550_1.pep
MLPYFDPDYDNFNQRINPPRVCIDNTTCTDCTLVKVDSMNKNGILLEVLQVLSDLDLHIFKAYITSDGGWFMDVFHVGARQGQKITDDKTIKYIEKALGPESNLLCPKASNKQGRSVGLHSIGDHTAIELKGPDRTGLLSEIFAVLADLQCNVLAAEVWTHRMRVACVVYVNDVATGLAIDDPGRVSRIENRLRHVLRGYGGGGGGNDDDDGSGAHANFTDASSTPHHLDRRLHQLMHADVDVAPAAALAAGGQGDRPEVTVEHCEEKSYSVVNVKCRDRSKLLFDIVCTLTDMEYVVFHAAVSSEA

SEQ ID NO: 37727 - protein, 129 aa, Sorghum bicolor
  Clone ID: SORBI-28MAY03-C35552_1.pep
MAAAPANGDSQSGPQRNYQVVVAATRDMGIGKDGVLPWKLLGDLKFFKELTLTTSDPAKKNAVIMGRKTWESIPVKSRPLPGRLNVILTRSGSFDFATVENVVLCGSMNSALELLASTPYCLSIEKVFV

SEQ ID NO: 37728 - protein, 124 aa, Sorghum bicolor
  Clone ID: SORBI-28MAY03-C36430_1.pep
ATGECPQESRCKLHHPKKKNKSKRSKVDTVQNNSWGRYFETSIGHGSGARIVSLEEEERQKPEQVSGEDFADFIELGSDIEVPEDADASDDIQPMELDSGNLDMQADNLEAIIKPLRIMRTARV

SEQ ID NO: 37729 - protein, 174 aa, Sorghum bicolor
  unsure (1)..(174): unsure at all Xaa locations
  Clone ID: SORBI-28MAY03-C36453_1.pep
SXLQELKSNMGVLGKEAVAAMTAVEAQQQRLTLQRLIALVESERNYHQKVLQVLDQLEREMVFERQRIEGAPPPVVESSMPPPPAYEEVNGIFMRNTVAELVETVEYFLAEAIQSYRAESDTELNLSAGDYIVVRKVSNNGWAEGECRGKAGWFPYDYIEKRERVLASKVAQVL

SEQ ID NO: 37730 - protein, 183 aa, Sorghum bicolor
  Clone ID: SORBI-28MAY03-C36439_1.pep
GKLRPVIQQITSWERPLVTGTILVVALLTIYNEWFNYVLAASLIMAVGVMVWARQRKIGMICSEVIIVDTSSDKTTMESIVDALLRPFGVLRSTRTADLASLRPRSSARAWPPQHTETMIWMLTGAAVVVAVIPFKYILIGLMAGSFAANTRVARALLNPQGGRRWREWWESIPAVPVRTVHS

SEQ ID NO: 37731 - protein, 160 aa, Sorghum bicolor
  Clone ID: SORBI-28MAY03-C36460_1.pep
LKSSAQTIYVTVWASSNVPLHLGKTENADELREKHFGIRLQPPIGPERVNELGHWTERHIEVSGASWDVNSMDIAVSGLGWYSLGLKGTATVSLWTFEGIGVTERDAMILHRAQFLERPGFWLPIAIANALGEETRKKNEKRKAEQRRREEEELLLEEIV

SEQ ID NO: 37732 - protein, 141 aa, Sorghum bicolor
  Clone ID: SORBI-28MAY03-C36474_1.pep
NSPRHKTIPQKSLLEIGSNSGKTGSQLSTKIKKNEEHSEDKITNICHETQRAREGFGPSFPSQISTNTHTQSSDFFNLSKTKHQNLKKAGDLHAACRTEGAGCSFVRPAAGRPGLEGRAATPEGQAAARLRGACACAVPSC

SEQ ID NO: 37733 - protein, 110 aa, Sorghum bicolor; identical to SEQ ID NO: 37191
  Clone ID: SORBI-28MAY03-C35643_1.pep

SEQ ID NO: 37734 - protein, 151 aa, Sorghum bicolor
  Clone ID: SORBI-28MAY03-C35735_1.pep
KFAVIDVPPIGCCPYPWSLHPLGACIDVLNELARGFNRGVKDAMHGLSLSFQGLRYSVGSSHAVVQSIMKHPQRLGFKDVTTACCGSGRFNGESGCTPNATLCDNRHQYLFWDLLHPTHATSKIAAAAIYNGSLHFAAPINFRQLVEDDRY

SEQ ID NO: 37735 - protein, 163 aa, Sorghum bicolor
  Clone ID: SORBI-28MAY03-C35831_1.pep
RQRTRMFLNLKEIVAMADEIGYDVVVEEANVNSNVTHFAKVVNSVDVMMGVHGAGLTNCVFLPHDAILIQIVPWGALDGICRIDFGYPAEQMGLRYKHYSIGVHESSLTEQYPLDHEIFRNPLAFHKNGFEFVRQTFMDTQNVRLDCNRFRPILLEALDQLNQ

SEQ ID NO: 37736 - protein, 118 aa, Sorghum bicolor
  Clone ID: SORBI-28MAY03-C35843_1.pep
GATHYSTPVDIWSVGCIFAELVTNQPLFPGDSELQQLLHIFKLLGTPNEQMWPGVGKLPNWHVYPQWKPTKLCTLVPGLDSDGYDLLEKMLAYEPAKRISAKKALEHPYFNGVNKEVY

SEQ ID NO: 37737 - protein, 243 aa, Sorghum bicolor
  unsure (1)..(243): unsure at all Xaa locations
  Clone ID: SORBI-28MAY03-C35960_1.pep
MASPRSAGGVAGDEAIWRKLREAARGEDAVRRRDKAALIGYISRLESEIYDYQHNLGLILLEGKEMTSKCARLKASSEATEIMLKRERASHLSALAETRKREENLKRNLAIQKECISNLEKALHDMRGETAEVKVSYEAKLAEALQMIERAQKKFDEAEEKLLTAKSLEAECIRTRSASLRSLQDIEDREDQLRRYRTSLELENASKEKEINLLRKSLDDTXKVLHEKEQSLLXEQLLLNQRD

SEQ ID NO: 37738 - protein, 149 aa, Sorghum bicolor
  Clone ID: SORBI-28MAY03-C35958_1.pep
MSTMDEGYGPTWDSDDEYDNFIRKMNPPRIVIDNESSAEATIVRVDSANEYGILLEVIQVMIDLNLVISKAYITSDGGWFMDVFNVTDKEGKKIKDEATLTQIEDYIRKSLGADSRYIPSRRRSVDVAAAADHNVIELTGTDRPGLLSE

SEQ ID NO: 37739 - protein, 378 aa, Sorghum bicolor
  Clone ID: SORBI-28MAY03-C36628_1.pep
TRGLYDGFDLTMARKLRARIKRGVSCFGRYMPRMIAIPPGMEFSHIAPHDVDQDSEEGNEDGSGSPDPPIWADIMRFFSNPRKPMILALARPDPKKNITTLVKAFGEHRELRNLANLTLIMGNRDVIDEMSSTNAAVLTSVLKLIDKYDLYGQVAYPKHHKHVEVPDIYRLAARTKGVFINCAFIEPFGLTLIEAAAYGLPMVATRHGGPVDIHRVLDNGILVDPHNQNEIGEALYKLVSDKQLWTRCRQNGLKNIHQFSWPEHCKNYLARVVTLKPRHPRWQKNDVATEISEADSPEDSLRDIHDISLNLKLSLDSEKSGSKEGNSNTVRRHLEDAVQKLSGVSDIKKDGPGENGKWPSLRRRKHIIVIAVDSVQDA

SEQ ID NO: 37740 - protein, 164 aa, Sorghum bicolor
  Clone ID: SORBI-28MAY03-C36615_1.pep
SEGLGLSPRADVVDEEEAARKAGHTVKSARESAQNTASEVGKKAGDAKEAAADAAAGASSKAGQAKDKAKETVKGAAGEASSKAEYAKQKTKEAAEAASERGAEAHERSKQGKEKVEEKAREKAGQGYESAKDAAGKAQETLRQTTDAAAEKAAKAKEAAWETT

SEQ ID NO: 37741 - protein, 106 aa, Sorghum bicolor
  unsure (1)..(106): unsure at all Xaa locations
  Clone ID: SORBI-28MAY03-C36666_1.pep
MAKALVGLRVSAPAVPQPRSHRSRLLPTARLAAFRRGRQCTARAAVAGPPEVDEDDSMTIDNLHRFFDLNVGKWDGSFYQFDAXEDNLISLLQSLYIKQASSAISI

SEQ ID NO: 37742 - protein, 211 aa, Sorghum bicolor
  Clone ID: SORBI-28MAY03-C36705_1.pep
MAFSFASPPASNPFQTPAASNLFQTPAASNPFQAPAAPNPFQTPAPATSQAPSLSPSPFQFSFQQQQPQPQPQQQVAPAAQPQQPQPQQQKLMLYTTDMKPAGYNTKWEELHAESQKALLQIEDKIRDYRDESERLDQCSRLYDSSISNVNFEIDANRIAQELGGTTTVMEREKASIQELMTVVNEMMWNTEFAIRSYLMLRPRFTRPGAG

SEQ ID NO: 37743 - protein, 155 aa, Sorghum bicolor
  Clone ID: SORBI-28MAY03-C36650_1.pep
MASSGAAANLWVLLGLGIAGVFLAARRLRRPARPDHGAFIARLELLPPPQPPPPQAPHPLTGLCFAIADALHVSGYITSFGRLEWAKTHDAEVQTSPVVSALVDSGAICVGKTVIDEMAYSIHGENKYFDTPTNPATPDRVPGGCSSGSAVAVAG

SEQ ID NO: 37744 - protein, 78 aa, Sorghum bicolor
  Clone ID: SORBI-28MAY03-C36152_1.pep
SNAVQTGKEPAKEVPKETFFTCPICWNKMEEPSTTTCGHVFCDTCIKQAIKIQKKCPTCRKGLKMNSAHRIYLPKASS

SEQ ID NO: 37745 - protein, 165 aa, Sorghum bicolor
  Clone ID: SORBI-28MAY03-C36194_1.pep
MQVLQLLGCGLVLVPFRPGYLARAEPRSRPRSPRRFLYRNTFGRFKTEKDLLNDAEQSMMEYKTSIQNLKKESKYTLDKVAVGESDLQRGRTRLGSSPLLCQPLLGPGHTAEPTAAGLWACLRTIPTRQSLELRAEVASMASDLKNQRCALQERINKISEYGVRV

SEQ ID NO: 37746 - protein, 101 aa, Sorghum bicolor
  Clone ID: SORBI-28MAY03-C36250_1.pep
TEHIRILDSYELVCCKNLHTVQDGDSVANLKAIRIELRSTFFMNAIIVMLWTIWKIRNELIFNNSQIGIHGANVLFFQELRLTRVKGNLTERFEQWIQSLQ

SEQ ID NO: 37747 - protein, 61 aa, Sorghum bicolor
  Clone ID: SORBI-28MAY03-C36212_1.pep
SLQNVTNLCNIHGFKHICTWLLLSACKRIRGYACVIDASCTCISLGSLSCYGQLAVFTDSR

SEQ ID NO: 37748 - protein, 124 aa, Sorghum bicolor
  Clone ID: SORBI-28MAY03-C36255_1.pep
NRRNDGGGENYNRRSDGGGENYNRRNDGGGENFNRSNDGGGENFNRRNDGGEIFNRRNDGGENFNRRNNFRNQNEFPGRGRGPPPPGNSYHQNGNGVHPSRPYPNGNGRFSRVNNGPKQAPVAA

SEQ ID NO: 37749 - protein, 84 aa, Sorghum bicolor
  Clone ID: SORBI-28MAY03-C36348_1.pep
LDCAAARAELTAATETDDNEEVEILRKEAEAAESKAIELKTCYDLQVEDDEFMFQPVVPIAFITNSTGQHLSEIASSFGLSPQK

SEQ ID NO: 37750 - protein, 146 aa, Sorghum bicolor
  Clone ID: SORBI-28MAY03-C36854_1.pep
HHHVHHRHHHRYDHSHQSLQHLSPAPAPLHSTTFPSCGTCKRKKEHSTPKHHSSPFRGPRPVVPTASPNSYEASGPYVHPPSFHPRIPSSALPNVVFHAMPPGMRNPKPPNKFSSISPGASISFASRLSSHWWVVIASFLYWPMLK

SEQ ID NO: 37751 - protein, 192 aa, Sorghum bicolor
  unsure (1)..(192): unsure at all Xaa locations
  Clone ID: SORBI-28MAY03-C36876_1.pep
HEVYFLSKSGDVVSTNMQRSASKQYSSVVVPSSAPGDGDAVAYFLSYSGTVVACDTARRTFAELPRILPVYFEYSIDVVACGAAAYAVVLSEYLDTASLRVWEFAXGGAWRQVAAMPPAMSHGFHGTRADINCVGHGDRLMVCVTSAEASGCFMCDVASNQWEELPKHVNGDGEANEFLAAFSFEPRVEITV

SEQ ID NO: 37752 - protein, 71 aa, Sorghum bicolor
  Clone ID: SORBI-28MAY03-C36908_1.pep
SAVEVLAKANADLNAKDNEGQTALHYAAVCEREDIAELLVKHHADLQIKDEDGNPAQDLCPSSWSFMNQAN

SEQ ID NO: 37753 - protein, 49 aa, Sorghum bicolor
  Clone ID: SORBI-28MAY03-C36887_1.pep
CTYPLSISVSATTVNNSIPRHTILDACSRHDKTLALEKSRILLVYNRNT

SEQ ID NO: 37754 - protein, 126 aa, Sorghum bicolor
  Clone ID: SORBI-28MAY03-C40694_1.pep
VVARIQVLLSDRHHSVPLPQGDLGSLMQQVEQQVKNVAMLSEKLNRKPLPYRQGDQLHRLHTAASLSFLVARLFIDDRLEQQTLLQMDDTGQRLVREGMYLERRSKYLAAIAAIKDAFQHLSCNEM

SEQ ID NO: 37755 - protein, 110 aa, Sorghum bicolor
  Clone ID: SORBI-28MAY03-C40746_1.pep
IDNMSYEELLALEDHIGSVSTALTEEQFAKCVNQSVYEARNSGRDVNKIAADDVKCSICQEEYIEGEEIGTMQCEHQYHVCCIHEWLRQKNWCPICKASAIPSEMNKGDA

SEQ ID NO: 37756 - protein, 106 aa, Sorghum bicolor
  unsure (1)..(106): unsure at all Xaa locations
  Clone ID: SORBI-28MAY03-C4076_1.pep
SFHFNCLLHHVQLCPLYXHNPEVLLNELKSPSDLLDFGEFSDCMNFSTPHGSPLLDVVNPTFDYVPPKLVSLFITDTGGHSPSYMYRLIAEYYSADDLVVRRKATS

SEQ ID NO: 37757 - protein, 95 aa, Sorghum bicolor
  Clone ID: SORBI-28MAY03-C40788_1.pep
TRVYSFGVILWELATLRTPWQGMNPMQVVGAVGFQGRRLDIPKEVDPLVAKIIWDCWQKDPNLRPSFGQLTSYLKPLQRLVVPSHQEMPSPPAPQ

SEQ ID NO: 37758 - protein, 75 aa, Sorghum bicolor
  Clone ID: SORBI-28MAY03-C4083_1.pep
IRAYQMSKSHITRPGVQNNFKSCHLPKNESTSNNVSFSPFFFWFTILSGAITDVLGDIFGVSVSLLNLSPILAGE

SEQ ID NO: 37759 - protein, 76 aa, Sorghum bicolor
  Clone ID: SORBI-28MAY03-C40836_1.pep
EFTECHCNSFSNWKELILPCACFCTYKPGTQIRALVKRIITYCFTTIQLYIYQDIYYLRATTARTCLLTCHLNRNR

SEQ ID NO: 37760 - protein, 169 aa, Sorghum bicolor
  Clone ID: SORBI-28MAY03-C37013_1.pep
MALRHLVTGQNNCTPDGASSSNPLNALANAFLGQSSKAQSIKELPGSVSVPSTSDFSTPAPISNIPGAENEFKQDQRPLARGADFIRGGPANDWIESFRPPGVPQLGVEAQFRDFEQIYNNTGTTFQPPLDGPPQRVLSGVLHSFLTTGPAGVPFQPLPVPTALGLSES

SEQ ID NO: 37761 - protein, 184 aa, Sorghum bicolor
  unsure (1)..(184): unsure at all Xaa locations
  Clone ID: SORBI-28MAY03-C3707_1.pep
SQYTEMVAAAAAGTNNNPSSTSEGGSVSPSRKRKSESMDTAPAPPAAAQQQQQHGTHLHQQQHPGLAAPDQNECTSGEPCKRIREECKPKVSKLYVHADPADLSLVVKDGYQWRKYGQKVTKDNPCPRAYFRCSFAPACPVKKKVQRSADDTFILVATYEGEHNHXQXPPAAPSQAAHDGSPGA

SEQ ID NO: 37762 - protein, 80 aa, Sorghum bicolor
  Clone ID: SORBI-28MAY03-C37066_1.pep
MTTNGVGGGGKLPRKRFYRARAHSNPLSDSHFPVPISPKEVDLSQHYPRYFPADKGSDGEEAAAPQQIRFADVGCGFGGL

SEQ ID NO: 37763 - protein, 181 aa, Sorghum bicolor
  Clone ID: SORBI-28MAY03-C37031_1.pep
MGGGGGGGGRREAIERELKKLRAEREDLDGRIRLLESQLEATPAGVSGAAAGIGVEDGACGGSVACQSRVSNGFAPDGGLPADMVYRYSRHLLLPDFGVEGQRKLSQSSILVVGAGGLGSPVALYLAACGVGCLGIVDGDDVELNNLHRQIIHKEAYVGQSKVKSAADACREINSSIKVVE

SEQ ID NO: 37764 - protein, 196 aa, Sorghum bicolor
  Clone ID: SORBI-28MAY03-C36710_1.pep
MEQPQPQQQKGGAASAQAAAANGTGGAELIGYVDVHVRSARDIQNICIYHKQDVYARLSLPGDGAPAASTQVVNGGGRNPVFDQSLRLGVRAGDVDAALRCEVWMLSRVKNYLQDQLLGFALVPLPEVVAADGGTLAREFPLTTSDLFQTPSGFLQLELSYIGVVPEVVPISPTPKPALADDLEEEEPENNAADGV

SEQ ID NO: 37765 - protein, 297 aa, Sorghum bicolor
  Clone ID: SORBI-28MAY03-C36730_1.pep
MAQMISTMPMLDAAPAASAIMAPKLQAAAAACLDAPPSGITVVSRQHVRPDAASAIGDLTLSVSDLPMLSCHYIQKGLFFPAPDLPMPSLVSLLLSSLSRALAVVPALAGRLVTLPDDRIVIRCNDAGVDSLHAVAPGLSLDDFLVPDADVPTKLTKDLFPMDRTVSYEGHRRPLTSFQVTVLGDGAVFIGIVANHAVVDGTSFWQFFNTWAAICRGESPKMPDFRRNFFGESTAVLRFPGGVGPSVTFDVDAPLRERVFHFSADAIRELKTIANRRPSGGQDAEVYGKMAHDPKNP

SEQ ID NO: 37766 - protein, 219 aa, Sorghum bicolor
  Clone ID: SORBI-28MAY03-C36739_1.pep
MEEEDQARAAPLLQQPLPLGDFVDDEVGGGAATTTKAAGRAAVEWWVESKKLWHIVGPAIFQRIALYGVNVVSQAFIGHLGDLELAAFSIAATVVAGFNFGFLLGMASALETLCGQAFGAKKHHMLGVYLQRSWIVLLIFAAALTPTYIFMEDLLLLIGQTPELSRLAGQMSVWLLPQHFAMAMLLPLTRFLQSQLKNWVTAITAAVALAIHVVVTYVL

SEQ ID NO: 37767 - protein, 97 aa, Sorghum bicolor
  unsure (1)..(97): unsure at all Xaa locations
  Clone ID: SORBI-28MAY03-C36817_1.pep
XFFFFFWLHNKIRGVMDIVVHTFVLSGYTSLLKEYNGITIRPRSYHANPINYSPYILMIHETLIWGLHPLTAPIIQDTLLSKTANPIAPAVSMMGED

SEQ ID NO: 37768 - protein, 174 aa, Sorghum bicolor
  unsure (1)..(174): unsure at all Xaa locations
  Clone ID: SORBI-28MAY03-C36747_1.pep
METQEIAAAARHFSAMARIVGPDPKAVKMRRHAFHLHHSGSTTLSASALLLPRGALAEPPPLLDHICAVHGHVAGDVALTAASLVEPFLVAEQRNNSGEXELQPRLVPEVRLDVLVEQGSAQDGKSGPPRWLPARLLAMVDVPTAADSALSLLRHEEFIRRPTWDVGWSLADAN

SEQ ID NO: 37769 - protein, 131 aa, Sorghum bicolor
  Clone ID: SORBI-28MAY03-C36824_1.pep
KAVPPVRRDSAQLTKDEQPSVLLVSIIDHYGGSIATVQEKMSRGGGGSNMSKQARNFTQETTTRDCEVEMHNVLQAVATELHSLSWLTVSPVYTERRTALPFHCDMVLRMRRLLHYADKYLSQPAEKGETT

SEQ ID NO: 37770 - protein, 115 aa, Sorghum bicolor
  Clone ID: SORBI-28MAY03-C37309_1.pep
CPCRVWLRDDHVSAWPAYTGASQVSQFLAFPLPGHYSGGPGQLAFGAHESCAHAGWPPPPRLQSSCRVGGSCLAPPTAAVPVGAPGPGSGGRIAPYSSILLKANALEWWRQVIIM

SEQ ID NO: 37771 - protein, 80 aa, Sorghum bicolor
  Clone ID: SORBI-28MAY03-C37333_1.pep
QQPQQKAYLTRHSSTAVSCLPHGERTCDVVETTPPRSLKRSIAIQNELSSFQNIQRSNTLVRAHSCTYTNCSWLLLECLW

SEQ ID NO: 37772 - protein, 85 aa, Sorghum bicolor
  Clone ID: SORBI-28MAY03-C37368_1.pep
NQFSVTEHFRSGESGRMQALPGVFFFYDLSPIKVTFTEQHVSFLHFLTNVCAIVGGVFTVSGIIDSFVYHSQRAIKKKMEIGKFN

SEQ ID NO: 37773 - protein, 90 aa, Sorghum bicolor
  Clone ID: SORBI-28MAY03-C36923_1.pep
GDEIYIKEIGLYMKEGEKISFSELSERAVLRREVAIGYVKDGKQHINPINKSEPLFLEMNDSLIVISEFEGEQPIVMDEQPIMMAEGTSG

SEQ ID NO: 37774 - protein, 217 aa, Sorghum bicolor
  Clone ID: SORBI-28MAY03-C36930_1.pep
WIDAAINSGNSGGPAFNDKGKCVGIAFQSLKHEDAENIGYVIPTPVINHFIEDYHKSGEYTGFPILGIEWQKMENPDLRKAMGMKANQKGVRIRRIEPTAPESGCLQPSDIVLSFDGIDIANDGTVPFRHGERIGFSYLVSQKYTGEKARVKVLRNSKIHEFNIKLATHKRLIPAHIKGRPPSYYIVAGFVFMVVSVPYLRSEYGKDYEYDAPVKLL

SEQ ID NO: 37775 - protein, 182 aa, Sorghum bicolor
  Clone ID: SORBI-28MAY03-C36948_1.pep
ARGKTSPIPQDDAQGQASRYSKRDHSTSLRHSESGMVDQVLLTTNAERLGFVKVRMRSVRIPQIGDKFSSRHGQKGTVGMTYTQEDMPWTIEGITPDIIVNPHAIPSRMTIGQLIECIMGKVAAQMGREGDATPFTDVTVDNISKALHRCNYQMRGFETMYNGHTGRKLTAMIFLGPTYYQR

SEQ ID NO: 37776 - protein, 201 aa, Sorghum bicolor
  Clone ID: SORBI-28MAY03-C36961_1.pep
HEATTNPGGLLVFFLLPVQRFLFVLARGSTPEVIERTPILIPHAPPASPPPHVPRRPLSTPLSPSISLLWILPTRPIPFFGLRCASPPPPPPPPSFLPHQSLITATTSLVPPITGPLPPREILVCLLPSLNPIPQKLGILCCCCCCYYYQYYYPPVGRNGIGSVPVSCRGGYNAFPRGFRVVKERKIRYFLRIYRCYRTEG

SEQ ID NO: 37777 - protein, 186 aa, Sorghum bicolor
  Clone ID: SORBI-28MAY03-C36982_1.pep
HEGRRSISITPEIGDDIVRAVRAMNETLKQNRLQRDHVEGSCSYVTEDQSNANDCPNNDDASRRIGATDSDSRNRTGSTQKAMSLPSSPHEYRGQVTQKSDDFISKEKMALAWNKVFQSSPFLNKPLLPFEEWNIDFSEITIGTRVGIGFFPGASSFTFTKVYGILIIAYMLNMELSYSFIAKYVL

SEQ ID NO: 37778 - protein, 167 aa, Sorghum bicolor
  Clone ID: SORBI-28MAY03-C36967_1.pep
MAGNDNWINSYLDAILDAGKAAIGGDRPSLLLRERGHFSPARYFVEEVITGYDETDLYKTWLRANAMRSPQERNTRLENMTWRIWNLARKKKEFEKEEACRLSKRQPETEKTRADATADMSEDLFEGEKGEDAGDPSVAYGDSTTGSSPKTSSIDKLYIVLISLHGL

SEQ ID NO: 37779 - protein, 182 aa, Sorghum bicolor
  Clone ID: SORBI-28MAY03-C36998_1.pep
HEGQPPFATQSAPVAQQLPFMGPPRANAPAFGPPSWQAQGAGSGAMQPPMRMPGIPGSMQPNTLGPPGTPTIPYSPHAGTQVSTPSKMHPDQIPRPMPESSVIIYETRQGGQATIPPAASSEFIVKDTGNCSPRLMRCTVNQIPCTGDLLTTSGMPLALMVQPFSLPHPSEEPIQPAVETRF

SEQ ID NO: 37780 - protein, 56 aa, Sorghum bicolor
  Clone ID: SORBI-28MAY03-C37742_1.pep
MRSAVEVYAGPGFSTSPDPSSLPLPQFPTTRKAVAAAAVDAAAAATRDLRLILRLE

SEQ ID NO: 37781 - protein, 80 aa, Sorghum bicolor
  Clone ID: SORBI-28MAY03-C37822_1.pep
FRTFDLSYYRGVLKRRGLFQSDAALITDAASKADILSVVNAPPEVFFQVFARSMVKMGAIDVKTGSEGEIRKHCAFVNKH

SEQ ID NO: 37782 - protein, 166 aa, Sorghum bicolor
  Clone ID: SORBI-28MAY03-C37850_1.pep
TGVEFSKRLCGISVIRSGESMENALRACCKGIKIGKILIHREGDNGQQLIYQNLPKDIANRHVLLLDPILGTGNSAVQAISLLLKKGVQEANIIFLNLISAPQGVHVVSKRFPRVKIVTSEIEFGLNDDFRVVPGMGEFGDRYFGTDDYQSLTPFFCDDKNRVRLL

SEQ ID NO: 37783 - protein, 71 aa, Sorghum bicolor
  Clone ID: SORBI-28MAY03-C37159_1.pep
AGVQAAVAAYQGAGAPPGFQGPPGFQVGQATTQTSTAAAAAASAAGYQAGAAGQGQVPGAQIGGTGFQGGY

SEQ ID NO: 37784 - protein, 204 aa, Sorghum bicolor
  Clone ID: SORBI-28MAY03-C3717_1.pep
MEETAAAAAAATATSEKASSYRYWVREATGDAAPLPVPRKLDPTANGNGNGNPPPLGSVWNQAGTWEEKNLNSWANGRIKDLLGSLGSLDFPTGKASIDEVSKCSGDAFQVTVRNKKRVGYNYELSLRRPGEWLIKEENKKIKGHLDIPEFSFGEIDDLEVQVRFSDDKGLASEDKTRICKDLKTFLASIQEKMRVFEEELKGR

SEQ ID NO: 37785 - protein, 80 aa, Sorghum bicolor
  Clone ID: SORBI-28MAY03-C37197_1.pep
LRKCVEPAHEKMGVVDSQWIVHQVVPSLGNQGKAENGKAPWEGVRARCRKEWGIFQTRLTDAEKAYYLAQGITPPKSTVT

SEQ ID NO: 37786 - protein, 77 aa, Sorghum bicolor
  Clone ID: SORBI-28MAY03-C37207_1.pep
GSAPNLDAVAKEQLASKKDAKKKHNRIYKKELALSMLLLTAAARSLLSKQGIHFYFLLFQGISFLLVGLDLIGEQVE

SEQ ID NO: 37787 - protein, 161 aa, Sorghum bicolor
  Clone ID: SORBI-28MAY03-C37267_1.pep
DGFARGLRGFVKAAEQELKALRREQERVLELVQKTTEYYHAGATKERNAHPLQLFIVVRDFLGMVDQACVDIKRKVQQKKPAPSASQPNAAAAPTVAAAAAATTAATASMTKEATDGQAAPTQKPPEEADSKRKRVMPRFPNLPAHFMKDSADSDSSSDEE

SEQ ID NO: 37788 - protein, 138 aa, Sorghum bicolor
  Clone ID: SORBI-28MAY03-C37314_1.pep
PWLKLQTFTGSQQKAIRPPQPGIAAMERQGSSWQEGTAAGPARGGGGAKRQEAGGCPGEAGRERAGGARRLSRRSGNSMGLLSSANRCCCKNILSCNLLRCACCCSWIRSVCGRRTSKATQEASETKMKKKRGFCASC

SEQ ID NO: 37789 - protein, 131 aa, Sorghum bicolor
  Clone ID: SORBI-28MAY03-C37284_1.pep
SYGGFLSAMCLTRFPDTFCCAVSGAPVTAWDGYDTFYTEKYLGLPAEHPDAYEYGSIMHHTKNLRGKLLLIHGMIDENVHFRHTARLVNSLMADGKPYEILLFPDERHMPRRLGDRIYMEERIWDFVERSL

SEQ ID NO: 37790 - protein, 201 aa, Sorghum bicolor
  Clone ID: SORBI-28MAY03-C38003_1.pep
HEGQLYRKLIAKRTTASDMLKAYHLYLAACPFKRLSHFLSNQTILSMIKNASKVHIIDFGIYFGFQWPCLIRRLSKREGGPPVLRVTGIDVPQPGFRPSERIEETGQRLAEYAAKFKVPFEYQGIASKWETIRVEDLKVGKDEVVIVNCLYRFRNLIDETVAVDSPRNRVLNTIRQVNPAIFIHGIVNGSYSVPFFITRFR

SEQ ID NO: 37791 - protein, 219 aa, Sorghum bicolor
  unsure (1)..(219): unsure at all Xaa locations
  Clone ID: SORBI-28MAY03-C38022_1.pep
MGDGASGRGGAGRRVGEYELLRPIGSGAYSQVWLGRHRARGTEVAVKEIAMERLSNKLRESLLSEVDILRRIRHDNVIALHDSIKDHGRIYLILEYCRGGDLHAYLQRHRRVSEKVAKHFIRQLASGLQMLRDNNVGHRDLKPQNILLVENNENSLLKIADFGFAKFLQPFALAETLCGSPLYMAPEVMQAQKYDAKADLWXSVGVILYQLVTGIPPFN

SEQ ID NO: 37792 - protein, 154 aa, Sorghum bicolor
  Clone ID: SORBI-28MAY03-C38046_1.pep
MEVKTVKVSNLSLNALKREITEFFSFSGDIEYVEMQSESEWSQLAYVTFKDSQGADTAVLLSGATIVDRAVIITPAENYQLPPEAHKQLSGANPSTESAVRKAEDVVSSMLAKGFVLSKDALNLARSFDERHNILSNATATVASLDRQYGLSEK

SEQ ID NO: 37793 - protein, 177 aa, Sorghum bicolor
  Clone ID: SORBI-28MAY03-C38092_1.pep
ARGSSSPMEAAQTSHLPEPAKEVWRRYSQAKLPDWWPKVGATVMESGPEMEKWARMANRLVRAIIDNRVMGRDYRYDDAIQLRQLCKISGVKVCFDTENARDSFYRAAVNFVIDDCSRAAKDMGAAKLNGEDPREFLAGLASNIGLDKFRAATLVCASIATRTRTCFLQCWALEIQG

SEQ ID NO: 37794 - protein, 102 aa, Sorghum bicolor
  Clone ID: SORBI-28MAY03-C37384_1.pep
IIGCSPLSFGNIIVSDNCLRHKEAPPGKGTKEPEDAETKGGAPQTSLPCRRRSRTQEHDDAASTKERGLAPGMRRQGRRGKLSLRGKCAGSKRRLADASRHG

SEQ ID NO: 37795 - protein, 204 aa, Sorghum bicolor
  Clone ID: SORBI-28MAY03-C37516_1.pep
MQGRLRRVLRAPPPRILLYRAISSPPPGGNGGGGGDGGSGVAVKQVTRGNMAEALEKLRGRVREAAFVGVDLEMSGVTSAPWRDTFEFDRADVRYLKLRDSAERFAALQLGVCPFRWDPAKSAFVAHPHNFFIFPRKELPSDCSSHEFLCQTTSIDFLAKYQFDFNTCFREEHKRKRRYRNLIHCIMVKPLHLPPILKRTETYL

SEQ ID NO: 37796 - protein, 206 aa, Sorghum bicolor
  Clone ID: SORBI-28MAY03-C37486_1.pep
WGCGGGADDGGAPPVFARKWRSRREVVDWLASFLPVKALDSSKKFSKYRSFADNDIGSDGYGETDSFLHQNLGKDCSSDITWSGSFWTCGKERRHYQAFCRNGTTISTHTFVLILSEEENRYLAYLEDMYEDKKGLKKIKVRWFHQNQEFACAIPPPPPHPCEVFITPFTQVISVECVDDIATVLTPDHYEKCSNAMPTSSLAGIR

SEQ ID NO: 37797 - protein, 366 aa, Sorghum bicolor
  Clone ID: SORBI-28MAY03-C37536_1.pep
MAVAGANASCSIAAGACPSSSGSSSLFPHHRPSRPRRHGRIGIATIMCTSSSMHGYGYDSSSLPSLSLPFPIPAPRGVTSTGSGSRLRIFSGSANPVLAQEIACYLGMELGKIKIKRFADGEIYVQLQESVRGCDVFLVQPTCPPANENLMELLIMIDACRRASAKNITAVIPYFGYARADRKMQGRESIAAKLVANLITEAGAHRVLACDLHSGQSIGYFDIPVDHVYGQPVILDYLASKTICPNDVVVVSPDVGGVARARAFAKKLSDAPLAIVDKRRQGHNQAEVVNLIGDVRGKVAVMVDDMIDTAGTISKGAELLHKEGARAVYACSTHAVFSPPALQRLSSGLFQEVIITNTVPVQHLHS

SEQ ID NO: 37798 - protein, 223 aa, Sorghum bicolor
  Clone ID: SORBI-28MAY03-C37680_1.pep
MDGLLAKLRSLDAYPKVNEDFYSRTLSGGVITLASSVIMLLLFVSELRLYLHAVTETTLRVDTSRGETLRINFDVTFPALQCSIISLDAMDISGQEHLDVKHDVFKQRIDAHGNVIATRQDAVGGMKMEAPLQHHGGRLEHNETYCGSCYGAQESDGQCCNSCEDVREAYRKKGWGVSNPDLLDQCKREGFLQSIKDEEGEGCNIYGFIEVNNVAGNFHFAPG

SEQ ID NO: 37799 - protein, 92 aa, Sorghum bicolor
  Clone ID: SORBI-28MAY03-C37724_1.pep
MLNILEENARLLNQIEVNILTSQAYNNNDLFHHARRNINGLLQSMSQIPGIMSKMPPLPVSVDERLASYVLPRAPMAQVLGSSHLKEEPRVW

SEQ ID NO: 37800 - protein, 151 aa, Sorghum bicolor
  Clone ID: SORBI-28MAY03-C37730_1.pep
PDGTPVRARQRVIYFTYAMGRDKATWGPDCLEFRPERWLNDKSGAFAGGAESPYKYVVFNAGPRLCVGKRFAYTQMKTVAAAVLARFRVEVVPGQEVKPKLNTTLYVKNGLMVRFVAREQRHELRHPVPAAAHLAGEDSRSVRGPFFFSGG

SEQ ID NO: 37801 - protein, 142 aa, Sorghum bicolor
  Clone ID: SORBI-28MAY03-C38241_1.pep
RRLHPPQPPLPHAQAFPSLPSPPSSGHPSPPATQPRTHSTSPVRLSDPPPRQRRRRRPATARTVATGLFSEPFLVEAKLGKRRPFFGSLSCCCYLIEQARKCDRKRSELLFRTVRLPRSLQVGRTEIRRTFFLSWISSCLFL

SEQ ID NO: 37802 - protein, 180 aa, Sorghum bicolor
  Clone ID: SORBI-28MAY03-C38293_1.pep
TMTSRAAAKAALLLPLHLLSAALGPRFSCTSAAPLRWARSAAALLAVASLLTAICAMPDAGANVEADADADADALRLEIEALRLKVARLESLLEANAKTLDSKVSILEEDNKLNEAMEREIQLLMNEPDSTKNSQSKSYSAGNIKSMEDEYVRSIKLDGIYLRGASYARSCFSHTYKRSR

SEQ ID NO: 37803 - protein, 388 aa, Sorghum bicolor
  unsure (1)..(388): unsure at all Xaa locations
  Clone ID: SORBI-28MAY03-C383_1.pep
MLFAPSRLPPRSLRHAPGSPMASTLAILRPSAPAPLAGRRARAAAPATARVALSSRSRYSSARVSLGSEVAVGADALFADYKPTTAFLFPGQGAQTVGMGAKAQSVPAATKLFNQANEILGYDLLDLCTNGPKEKLDSTVISQPAIYVTSLAAVEVLRARDGGQDVINSVDVTCGLSLGEYTALAFAGAFSFEDGLKLVKLRGEAMQDASDAANSAMVSVIGLDSXKVQELCDAANEEVDDSERVQIANFLCPGNYALSGGVKGIEVVEAKAKSFKARMTVRLAVAGAFHTSFMQPAVSRLESALAATEIRTPRIPVISNVDAQPHLDPDTIKQILARQVTSPVQWETTVKTLVGKGLEKSYELGPGKVIAGILKRINKGASIENIGA

SEQ ID NO: 37804 - protein, 229 aa, Sorghum bicolor
  Clone ID: SORBI-28MAY03-C38300_1.pep
ARGAVEGGGPGAMEYLTARRSSKVYDVAIESPLQLATKLSDRLGVNLWIKREDLQPVFSFKLRGAYNMMAKLPREQLERGVICSSAGNHAQGVALSAQRLGCDAVIVMPVTTPEIKWKSVERLGATVVLEGDSYDEAQSYAKLRCQQEGRTFIPPFDHPDVITGQGTVGMEIVRQLQGPLHAIFVPVGGGGLIAGVAAYVKRVRPEGKIIGVEPSDANAMALSLCHGKR

SEQ ID NO: 37805 - protein, 109 aa, Sorghum bicolor
  Clone ID: SORBI-28MAY03-C3862_1.pep
VRADVFTMVGLQEFFYDQVPDKLRSLGLALYLSIFGVGSFISSALVSVIDRVTTARGGSWFNNNLNRGHVDYFYWLLAALSAVELLAYVFFAVTYKYKNKRAVHATVES

SEQ ID NO: 37806 - protein, 84 aa, Sorghum bicolor
  Clone ID: SORBI-28MAY03-C3786_1.pep
APNEILLVLDGTTGLNMLQQAREFNDVVGVTGFILTKLDGTARGGCVVSVVDELGIPVKFIGVGEGMEALHPFDAEAFVEAIFP

SEQ ID NO: 37807 - protein, 177 aa, Sorghum bicolor
  Clone ID: SORBI-28MAY03-C37882_1.pep
KRDAGEDSNAVIITQDGKEFNIDEIYKAESSYIGGLKSIEEFHHIEIPPNAPPGIDEEMLEEGKKPSEPAQESREEQMSDVNDREGSKAASASTQNDKLYTAEGILDPRKRKAEKKRRKANKFSVLNDMDADYDFKVDYQMEDASAANEDDGGAQADDEDGGDEAKDNEPMTGVDDA

SEQ ID NO: 37808 - protein, 103 aa, Sorghum bicolor
  Clone ID: SORBI-28MAY03-C37907_1.pep
YWRLALPAGASSRDHPWCNPLSRAAPRLETVPLPPVLVCVSETDILRDRNLELCRAMRKAGKCVEQAMYGGVGHAFQVLHNCHLSQPRTQEMLAHIKAFVSAR

SEQ ID NO: 37809 - protein, 165 aa, Sorghum bicolor
  unsure (1)..(165): unsure at all Xaa locations
  Clone ID: SORBI-28MAY03-C37911_1.pep
HENALCVEDLPTDPSSQSASHPPESSRDMNSQSLSSEMAIGGPGGLWHFIYKSVYLDQFVSSEFPSPISNKKQQKRLYKAYQKLYASMHDKATGPHKTQYRRDEDYVLFCWITQDFELYAAFNPLADKXKQSRCVIEYANGXGFXKMRYSCMEKAPFPGDILSCV

SEQ ID NO: 37810 - protein, 73 aa, Sorghum bicolor
  Clone ID: SORBI-28MAY03-C37923_1.pep
AKDDRQVHILKELKTRSTVINLSSFIHHGMRFPVHRCCSSLDATNNHKEWHKGGSKLCEAQRTKSWNKGILNA

SEQ ID NO: 37811 - protein, 102 aa, Sorghum bicolor
  Clone ID: SORBI-28MAY03-C37947_1.pep
MASKMAVDPDKRRHSSSRNGSTSRKALLSSSRGSGDPSDPNRSSHLVPTTTSSSRPSTNQRLHQSTGLEGRTSSFPKAGRIGHDDPTMRSIGRLTISAERRK

SEQ ID NO: 37812 - protein, 352 aa, Sorghum bicolor
  Clone ID: SORBI-28MAY03-C38_1.pep
SGVQSLLKPLVEEAIAALCRPAVPCRVGVADLGCSSGPNALALVSAAVDSLRHHHRRRRLGCQSSSSPEPNRRRRAEISVYLNDLPDNDFNLVFKAVPAFLEKHMGASGGDDDDGDGDGPLVLVLGAPGSFYGRLFAAQSLHLVCSSFSVHWLSKVPQELADGVLVNKGNTWAGRTSTPAVAAAYGRQFEHDLSLFLSSRAEEIVPGGWLVLSVAGRPGKDLSSQDRQSEFTAEVLCDMAARGVVTAEDVDSYNVPFYAPCADELRAAAELEGSFEAVRVESHAVLTCDGDPAKSAAMARSLRVISESTLVRHFGRVDDVGGEFARAAEARYRGPPAPVMEGVVHVLSLRRK

SEQ ID NO: 37813 - protein, 69 aa, Sorghum bicolor
  Clone ID: SORBI-28MAY03-C38471_1.pep
IYGNGIFNCQTCSQKVLHHCHGMRTMLTQGTQSNCIIRFVWMNLILLESKPLLPTKHYDYSLVKKKSIV

SEQ ID NO: 37814 - protein, 135 aa, Sorghum bicolor
  Clone ID: SORBI-28MAY03-C38568_1.pep
EVVELSFTICSNTYLSEIGLTQGIVMLIQSAPVRVLMLTGIGNFGDEGMRGLSSAQFLETLVLADCEMITDSGISFLSCAPSLSSLTLQQCNKVTDNGMAELVRSQKLESLTVVCCHRISLNGVQGAARSVHYSA

SEQ ID NO: 37815 - protein, 158 aa, Sorghum bicolor
  Clone ID: SORBI-28MAY03-C38595_1.pep
MAEDGEEKLLATVQHIVQTLGRTDTMTEDILKVFSNYDGRLSLDKLYATRAAAAAVGGAAGERSVPASPPMPPPPVAPSAAAAMPPVTSLERTVRTLDRQISQFVTMDRLIWADSADADAFLEAVDDLVGTVQELDAAGTNRGLLDRADELLSRCMAR

SEQ ID NO: 37816 - protein, 220 aa, Sorghum bicolor
  Clone ID: SORBI-28MAY03-C3860_1.pep
MACTVASRRAVPLVRALEKLLAASSAPGAGSTLRPVAVAGGLRGYNTGAQLRRYEGRESEDDSVREYESRRGSRDYAAPSLFSDVFRDPFSAPQSLGRLLSLMDDFAVAAPGRAGAVRRGWNAKEDEEALHLRVDMPGLGKEHVKVWAEQNSLVIKGEGEKESGEDEDVPPPRYSGRIELAPEVYKMDKIKAEMKNGVLKVVVPKVKEEQRKDVFQVNVE

SEQ ID NO: 37817 - protein, 141 aa, Sorghum bicolor
  Clone ID: SORBI-28MAY03-C38123_1.pep
AVRGPLVLARYTELMNGIIDTSKDVKILRRSGVVVNHMKSNKEAAGMWNGMARATRLTKVPRLDAVISAVNAHRSRSLPARLRKLLRRYVFRSWKMLTLVASVGLLLMTALQTFCSAYPCENHWFSGMVLPVPGTTDDPPQ

SEQ ID NO: 37818 - protein, 331 aa, Sorghum bicolor
  Clone ID: SORBI-28MAY03-C38138_1.pep
MGSKSVDEVLDAAAAAGVHYSALRLDGLNTQVSAASYEEQPTTSGLENGPRGPFVIGVAGGASSGKSTVCKMIIDQLRDQRVVVVTQESFYYGLTDEELVHVHDYNFDHPDAFHTELLLSCMQNLKRGKAVDIPNYNFKTYKSVPNARGVNPSDVIILEGILVFHDSRLRDLMNMKIFVDTDADVRLTRRIRRDTIDKGRDIKAVLDQYSKFVKPAFEDFILPTKKYADIIIPRGGDNDVAIDLIVQHIRTKLGQHDLCKIHPNLYVIQTTYQIRGMHTIIRDAATATHDFIFYADRLIRLVVEHGLGHLPFQEKQVITPTGSVYTGVEFS

SEQ ID NO: 37819 - protein, 298 aa, Sorghum bicolor
  unsure (1)..(298): unsure at all Xaa locations
  Clone ID: SORBI-28MAY03-C38196_1.pep
DDDKDGDDVSQPSPRGSGYAGERGSSLDDDPDPEPAQDWPRDKKHLHEDDASSSWRKRKKHFFILSNSGKPIYSRYGDEHKLAGFSATLQAIISFVENSGDHIKFVRAGKHQIVFLVKGPIYLVCISCTEESYEGLRGQLELMCGLLWLXSVNGCFEKNPRFDMATLLGGTDAVFQSLIHAFSWNPATFLHAYTCLPLAQSTRQAASAVLQDVADSGVLFVLLMCEHKVISLVGAQKATLHPDDILLLDNFILSSESFRTSESFVPICLPRYNPMAYLHAYVHFFDEHTYVALLTTRS

SEQ ID NO: 37820 - protein, 219 aa, Sorghum bicolor
  Clone ID: SORBI-28MAY03-C38197_1.pep
HEESILWDLNVGLEPLWQELSDCISATEAKFVHNSSLASHAPLMHAVEVGASSSGSSSLPPGTQRLLPFIESFFVLCEKLQTNQPVTLSDYSVTAPEVKESAGSSSSPSLKTSGICNVTFIRVAEKHRRLLNVFIRQNPSLLEKSLSMMLKVPRLIDFDNKRAYFRSRIRQQHDQHLSAPLRISVRRAYVLEDSYNQLRLRRTQDLKGRLTVQFQGEEG

SEQ ID NO: 37821 - protein, 146 aa, Sorghum bicolor
  Clone ID: SORBI-28MAY03-C38206_1.pep
MGILGKGSGWCFCSRGAKLERIKSSLLAAKGAAVAAVSFPSGGGGGGAGGKGGSGFLIHRGLLLTTHGTIPSAAAAAIAEVRLSHGRLLARLVPQRFFITSSILDLTIVGLDVVDDDLSSHGQQPHFLKTCLNPSLDLGSTVLLLG

SEQ ID NO: 37822 - protein, 181 aa, Sorghum bicolor
  Clone ID: SORBI-28MAY03-C38210_1.pep
HEGSPPAAPPARPSSAGPHHPLATGRTSPSASTSACSTSSAITGAVLRSGVGGRAAVEPVVPVSATGQSCVVGRSAAARCAIGVRWEAARWRTVGVRCGATATASAGFRHEWLCGCSPAMNLVGSGVWSRSTASSRKARPLLLPRAAAKDLLEEFEEEAIEGESIQSLIFMALSLLTSWNS

SEQ ID NO: 37823 - protein, 201 aa, Sorghum bicolor
  Clone ID: SORBI-28MAY03-C3886_1.pep
PALFILYVLYVHAGLNRTGKSCRLRWVNYLHPGLKHGRMSPQEERLIIELHARWGNRWSRIARRLPGRTDNEIKNYWRTHMRKKAQERKMSMSSPSSSCSSLTYQACHLDTVPVIGMSSGDTHNGGCVTSALENTQSVMGGYPMDQIWKEIEAPQAPALLGIAEGKEKTCRPIPCHLPSSAMWDYKYPEVFWKMEDQEIMM

SEQ ID NO: 37824 - protein, 199 aa, Sorghum bicolor
  Clone ID: SORBI-28MAY03-C38838_1.pep
SFDVGSSYHCDANSTSPSQSVNQAAVGSLPPSLEHYYCTAKAQHKVDTLRRCIHALEAQTVIAFMNNTKPLKDVVFKLEARGIKATELHGDLGKLARSTVLKKFKDGEFRVLVTNELSARGLDVPECDLVVNLDLPTDSTHYAHRAGRTGRLGRKGIVVTICEENEGFVVRKMRKQLAVAIKPCEFTEGELVVHKEDVE

SEQ ID NO: 37825 - protein, 161 aa, Sorghum bicolor
  Clone ID: SORBI-28MAY03-C38910_1.pep
VLLGVVLAVGTWIALTTMYANSEDGGIVQNFGKIDEVLFLEISLTENWLIFITRANGPFWSSIPSWQLSGAILVVDILATLFCIFGWFVGGQTSIVAVVRIWIFSFGVFCVMGGLYYFMQGSTGFDNLMHGKSPKQNQKQRSLEDFVVSLQRVSTQHEKSQ

SEQ ID NO: 37826 - protein, 166 aa, Sorghum bicolor
  Clone ID: SORBI-28MAY03-C38923_1.pep
TRVFSDFSSLGTGKETEDPMLLQQLSDACLVVDALEPSVREELVKNFCSKELTSYRQIFEGAELAKLDKTERRYAWIKRRLRSNEDTWKIFPLSWHVDYLLCIQFCKITRAQLVDILNNLKEKPDVATLLLAFQRTLEFEEELAEKFSGGTTNARNKETASDDQDE

SEQ ID NO: 37827 - protein, 152 aa, Sorghum bicolor
  Clone ID: SORBI-28MAY03-C38936_1.pep
MASSAAAPSGAPPAGKRPASSGREGDQMVITPLGAGSEVGRSCVHMTFKGRTVLFDCGIHPAYSGMAALPYFDEIDPSTIDVLLITHFHLDHAASLPYFLEKTTFKGRVFMTHATKAIYRLLLSDYVKVSKVSVEDMLYDENDIARSMEKSR

SEQ ID NO: 37828 - protein, 214 aa, Sorghum bicolor
  Clone ID: SORBI-28MAY03-C38340_1.pep
SSVALHLEGEGLHWWWSKSNSRGRGGRFGARAAHRMAGSGEGGNGGVPAGGEVAMAPGVVTGGEEDAYGEDRATEDQPVTPWAVCIASGHSLLRDPRHNKGLSFTEKEREAHYLRGLLPPVVLSQDLQEKRMLQNVRQFQVPLQRYSALMDLQERNERLFYKLLIDNVEELLPVVYTPTVGEACQKYGSIFRRPQGLYVSLKDKGRILEVLRNW

SEQ ID NO: 37829 - protein, 77 aa, Sorghum bicolor
  Clone ID: SORBI-28MAY03-C38360_1.pep
GIRAMPPLTANGSLPLLGCLDDLLGKKSNCTFWLVGGLGARGLLYHGLVGKLTAKAVISCDENIIPSEFTCWNTIKP

SEQ ID NO: 37830 - protein, 109 aa, Sorghum bicolor
  Clone ID: SORBI-28MAY03-C38369_1.pep
SFWVVPFQNQAFLFHITNSRFSSHQHRSFIIRPKFLSVMRWNPTNIAVVCRTSQLHLSWQIFFSFLQCGSLGSFIQHGSAQGNDNLSENRSCAVFFFLWGGGGGGVPKV

SEQ ID NO: 37831 - protein, 121 aa, Sorghum bicolor
  Clone ID: SORBI-28MAY03-C38413_1.pep
AGLLAVESAQDAVIRTLLYEHGTARVSSYGVGVAEVTAHISDLRNTLGRRGVKDEGLVVAPELGPEGLTVGNVIAGDHLSLAYDRTPEEILGIVYGTGNPAQHGGFFPQGADGRIARGLLA

SEQ ID NO: 37832 - protein, 204 aa, Sorghum bicolor
  Clone ID: SORBI-28MAY03-C3845_1.pep
MEEEQGRLTTMTPGVLRLFGVDVRWGDGGEPEELPMDLKKSSSMPNLTIHQPLLPPGEAGDGKGYASDDAELASGQQKRRRRKAQERKKGIPWTEEEHKKFLEGLRNLGKGDWRGISKGFVTTRTATQVASHAQKYFLRQTNPGKKKRRASLFDVGIADFNYMDDQVPSPQRSIVTKPAPTQEIIHTDRGDVPYRGDFGEILGN

SEQ ID NO: 37833 - protein, 280 aa, Sorghum bicolor
  unsure (1)..(280): unsure at all Xaa locations
  Clone ID: SORBI-28MAY03-C38446_1.pep
AGILSLVESARGPSAGPGPPPPATCIGEVARPRAVDRLVRLAVPPGPEGVSPTDAVLNAPRGEVRLVLVATLPAVTPSAVPARHARAAGPPGFPRPLVRALLALALTRAFQLRPPFCLSTAPALRVVPVPPPQSSLSVPVGAAAVRCLSNGLGIVTARQLVWKGENDWLEITDGVVGKRGEMHSLNPSITVKESGDILSLEEKFQGGTGINXTPPPATTMGEDALXRCKKSIEMMASALGLEGFSRIDAFVNVRSGEVLLIEVNTVPGMTPSIVLIHQAS

SEQ ID NO: 37834 - protein, 134 aa, Sorghum bicolor
  Clone ID: SORBI-28MAY03-C39001_1.pep
TYRALLPEGTPLEFQRILDLKGLKKADQQTILEDFNKHAPAPAPAIKHPVVAPTVAPPVATASVQIVPSVATPAVSMTPSMASLKGALANQEDVLARAAALGRGAATTGFKRFLALTEAAKDRKDGPFRKLFNA

SEQ ID NO: 37835 - protein, 132 aa, Sorghum bicolor
  unsure (1)..(132): unsure at all Xaa locations
  Clone ID: SORBI-28MAY03-C39017_1.pep
XIGSCEWIGAIELSFVLDKLLGVSCKVINVRSGDELPEKCRELARHFDTQGTPVMIGGGVLAYTLIGVDYNEASGDCAFLILDPHYTGTDDLKKIVNGGWCGWKKSVDSKGRSFFLKDKFYNLLLPQRPNMV

SEQ ID NO: 37836 - protein, 135 aa, Sorghum bicolor
  Clone ID: SORBI-28MAY03-C39027_1.pep
RNYSSTPIILKKKSTGSSVLEESTIGACQQLGSSSDDLSEDEPNINPDIDGTYVFNEHLDSFRREIQELLVCYACPVPLGNFESLYEQRYKKIIDYESFGVTGLEELVEKVKDVVDLHEDQASKSKFLIANYTTG

SEQ ID NO: 37837 - protein, 86 aa, Sorghum bicolor
  Clone ID: SORBI-28MAY03-C39038_1.pep
LTPTRLCLILCFWSCLPASWDLALLAEEESVHGLHLRYLMIPCLPVPDGRHRPHRVRWRPPHAADAQSRKRFSAFLGSTSIYHRSI

SEQ ID NO: 37838 - protein, 151 aa, Sorghum bicolor
  Clone ID: SORBI-28MAY03-C39044_1.pep
EAECRDPPVAFRHMDCSSEGQSSSSPAEILEYGGQDQYSSEEETMYSAETMESRNIPSPREKHVGRSQSCVTYRRWSSPRTSSVQNGTLRKQHTLIPVRKTHSQNTALPQRSHDYLSPTVSSAMKKRNSMEQQQPAKPRRSTVQSSPKWMF

SEQ ID NO: 37839 - protein, 167 aa, Sorghum bicolor
  Clone ID: SORBI-28MAY03-C42814_1.pep
LLHEGPRDSESQSGVARHRRLAGYRGPVPAMEPSPTSSSSSPAVARRLLPEVRRVRKRALEEVLEQVQRAVEMLRDADADLGVSLSEDTAAAPPEGEEDRKGHVGVDGDDVATSASVASDSDYETAQMCDLLKSKVGSLEFLHKLNGIQKSVHQNSAVEPDTSWDII

SEQ ID NO: 37840 - protein, 113 aa, Sorghum bicolor
  unsure (1)..(113): unsure at all Xaa locations
  Clone ID: SORBI-28MAY03-C42960_1.pep
GLFTSSPGTPSPDPKTWSAFPEEPKAQAAVKSVHXRSVRTLRASNSNKASSLGQSNISSSTDPFAFGQDSFKAAPSGTVLPQLSSMGNTSQVNNLNVEEKKDGSYQPAGWTGF

SEQ ID NO: 37841 - protein, 125 aa, Sorghum bicolor
  Clone ID: SORBI-28MAY03-C43093_1.pep
MQVSLPDASLPQWPPRLEHEPSPMLSAGLGLGLPYDSTGAQVCLPELMMGQSSLFSGKPATLDFLGLGMSPTGAPASRGIPAFIQPIGGAVGMAGTGAGAAETFGAGRGPQATPWERNPSSSPIL

SEQ ID NO: 37842 - protein, 251 aa, Sorghum bicolor
  unsure (1)..(251): unsure at all Xaa locations
  Clone ID: SORBI-28MAY03-C42910_1.pep
ACTMCIEAQHRLAXERLNGRGSFTFKAKVPAEPKKTCYRTGVWNREDGAHVEEVLLVIAAKGGVLTQRVPNNIKLPIDGFFTINMDDIGGYQMMRIIYAHGPIIGSLWAANGYYDSITGDHVYRRVREKFRKSEDGGQHAVVCFGYKFNKRAKESHIHIMDNHTEDGPLRWIDFSAFDYFFVPLVTPVELHQLHRKKRKENQTIEACVTRCLSAWEKRIMLWLIAREIERYYRHPRRKDHYVQIARVTPMR

SEQ ID NO: 37843 - protein, 112 aa, Sorghum bicolor
  Clone ID: SORBI-28MAY03-C43096_1.pep
WTDDEEKLFQRVVFLAPLSPGMISWERLPEPCPGDPCLGRLCSLLVAAVLCQSARLRRPVRWPLHKMFMAKIMELSVKSFTCHCRMILKTILGIKVHLCRRCVKWIAETYSV

SEQ ID NO: 37844 - protein, 92 aa, Sorghum bicolor
  Clone ID: SORBI-28MAY03-C39245_1.pep
MGRSRGVPNSGDDDTGHRSKRRRVSGSGGDATDSISAAIGGAGEGGGKKALYHCNYCNKDISGKIRIKCSKCPDFDLCVECFSVGAEVTPHR

SEQ ID NO: 37845 - protein, 161 aa, Sorghum bicolor
  Clone ID: SORBI-28MAY03-C39264_1.pep
MASYLAAFHPTLSPDPITHPHRCPARPNPTTGLLRLLPSRHRARPPAAVRLAVSASSTSAPPPSADRSEAASSLERCLSATVSGAGMGTGAAPPASAPPRAPPAMKGGRKQYGAFGAVTLEKAKLDLSQRRKKIMPELATGGGGGDIGKRIGHGGGDGGDD

SEQ ID NO: 37846 - protein, 290 aa, Sorghum bicolor
  unsure (1)..(290): unsure at all Xaa locations
  Clone ID: SORBI-28MAY03-C39292_1.pep
MAAALLLRGLRSSASRAHIHSLSHASSPSALGSSLLRRLYSSAAASTAASPAFTPAGVMDPSRIRNVAVIAHVDHGKTTLMDRLLRQCGADIPHERAMDSISLERERGITSASMVTSVSWKENELNMVDTPGHADFGGEVERVVGMVEGAVLVVDAGEGPLAQTKFVLSKALKYGLRPILLLNKVDRPSVSEETCNEVESLVFDLFANLGATEEQVHFPVLYASAKEGWASLTFTKSPPDNAKNMSSLLDSIVQHVPSPKADLEAPFLMLVSMMERDFYLXRILTGRVRS

SEQ ID NO: 37847 - protein, 61 aa, Sorghum bicolor
  Clone ID: SORBI-28MAY03-C39320_1.pep
MIVIQVTTYVWPLTVDSGVPAKVQSCFTRFSLVLLTGPVIARLLLLLRFNLCKFYSRDGTG

SEQ ID NO: 37848 - protein, 177 aa, Sorghum bicolor
  Clone ID: SORBI-28MAY03-C39296_1.pep
GEIDWVSPEPEKSVLRPNYFRYFRRGQNEKAKEGDFVIEKPKKVKIAEHDKLLRKFRHKDALVSALAKNNPRSVVAVMEELVARRKLMRCIGNLDNEELGLLLEFLHRNATLPRYAKLLLCLANKVVEMREADIRSDEKLRVHMRNLKRMVAEEIQIQHTLQGVQGMISPMLALATR

SEQ ID NO: 37849 - protein, 66 aa, Sorghum bicolor
  unsure (1)..(66): unsure at all Xaa locations
  Clone ID: SORBI-28MAY03-C39485_1.pep
SGQHPPAYAGGYXGGYQPTPHGPQQWQQRPYGGGAPPTRPNSHQSQNRYGSLDRSSNKRSSGHGRH

SEQ ID NO: 37850 - protein, 128 aa, Sorghum bicolor
  Clone ID: SORBI-28MAY03-C38955_1.pep
MTSVVQSVSGDHRAEDQHHQKKQAEPGDQQEAPVTSSDSQPTVGTPSTDYVAPYAPHDMSHAMGQYAYPNIDPYYGSLYAAYGGQPLMHPPLVGMHPAGLPLPTDAIEEPVYVNAKQYNAILRRRQSR

SEQ ID NO: 37851 - protein, 193 aa, Sorghum bicolor
  Clone ID: SORBI-28MAY03-C38969_1.pep
MKKWHGGFAVVSLFIILMLRYVILDSPLAGTSLQYVFQQNRTVELHWLDVPNPPAIQNPQNSSEVISTRLLASNLSITRNLSDRELQSLLCWNHLRHLLSHAHILPDGVEAIKEAGVAWRELNTALAYDDSVVSVNASIQQKDKGKQCPYSIRRMNATRLGDRFALKLPCGLIQGSSITIIGTPGGLLGNFKI

SEQ ID NO: 37852 - protein, 259 aa, Sorghum bicolor
  unsure (1)..(259): unsure at all Xaa locations
  Clone ID: SORBI-28MAY03-C38978_1.pep
MASAKTKLQLQLQERVPLPRTAWKLADLAVLFLLLALLAHRVSSLMVAVGGGGGAAWCCVAALICEAWFTVVWLLNMNAKWNPVRFDTHPERLAERMSDGELPAVDMFVTTADPKLEPPLVTVNTVLSLLALDYPAGKLSCYVSDDGCSAATCYALREAAEFAKLWVPFCMKHGVKVRAPFVYFSERGGAAADDDDAXFLRAWTSMKNEYEELVRRIENAEESLVRRGDGKFAEFVGADRRNHPTIIKVLMWDNSSNDD

SEQ ID NO: 37853 - protein, 132 aa, Sorghum bicolor
  Clone ID: SORBI-28MAY03-C38994_1.pep
TRNLLATGGGGSDRCIKFWNTHTGACLNSVDTGSQVCALLWNKNERELLSSHGFTQNQLTLWKYPSMVKMAELTGHTSRVLFMAQSPDGCTVASAAADETLRFWNVFGAPEAPKPAAKASHTGMFNSFNHIR

SEQ ID NO: 37854 - protein, 137 aa, Sorghum bicolor
  Clone ID: SORBI-28MAY03-C390_1.pep
NLPKHSVASKVALWTTVINPFTKYALLLNPLARSLEELRPEGFLNETSCSIILRTALVASTVCIAFLLPFFGLVMALIGSLLSILVAVIMPALCFLKIAQNKATCSQVIASIGIIILGVISAALGTYSSVKRIAENY

SEQ ID NO: 37855 - protein, 187 aa, Sorghum bicolor
  Clone ID: SORBI-28MAY03-C39396_1.pep
ELTMDDILEANIGPDTPKENWDLSKLIAKLQQYCYLLDDLTPELLEGKSSSYEDLREYLRKRGREAYFQKTEIVEKQAPGLMKEPERFLILSNIDRLWKEHLQALKFVQQAVGLRGYAQRDPLIEYKLEGYNLFLDMMAQIRRNVIYSVYQFKPVVKNQEEEASQKKVSKKKLDKGANKLGAAQAAS

SEQ ID NO: 37856 - protein, 102 aa, Sorghum bicolor
  Clone ID: SORBI-28MAY03-C39418_1.pep
MKCLPFLHGDAKEKDPVTKSASVRSMSTTSTERDVRSGSDFTSLNVSDMSAESIRRTQYPSFTDRPPNLRVFSFAELKSATRNFSRSLMVGEGGFGCVYRGV

SEQ ID NO: 37857 - protein, 172 aa, Sorghum bicolor
  Clone ID: SORBI-28MAY03-C39409_1.pep
MSAPAPAPAPPMAAPRVGLLYDDRMRAHATPDGEEHPENPERLRAIWRKLNAEGVAPRCVALKAKEAEDKYIASVHSKSHIKLMKEISSKKYDATRNKIARKFNSIYFNKGSSESAVLAAGSVIEVAEKVAAGELSSAIALVRPPGHHAEHDEAMGFCLFNNVAVAANYLLN

SEQ ID NO: 37858 - protein, 100 aa, Sorghum bicolor
  Clone ID: SORBI-28MAY03-C39434_1.pep
MVMVSVASPSPSPSPMVRSEEDLGPPWLRPLLGTSFFVPCRLHPELSKNECNLFCLGCTGDALCAYCLPAHRDHHVVQIRRSSYHNVIRVSEVGKLIDIS

SEQ ID NO: 37859 - protein, 107 aa, Sorghum bicolor
  unsure (1)..(107): unsure at all Xaa locations
  Clone ID: SORBI-28MAY03-C39045_1.pep
TESTPVSAASPDFFQFSXPAQSPSMGSGEQALEPKHESAASPHPENLRPDALFSGNTADPSIFNNAIAMLMGNGINAEYKHVLGDGVVLDSSSWNNMPHAFQMTEFK

SEQ ID NO: 37860 - protein, 163 aa, Sorghum bicolor
  Clone ID: SORBI-28MAY03-C39056_1.pep
AMLAMPRMSFYNASKAAVLNFFETLRIELHDEVGITIATPGWIESEMTKGKHLSKEGTVEVDQDTRDAQVGLFPVLHAARCAEAIVDAICRGRRHLTVPLWYRALFLWRTLTPEVTDLSQRLFYGRTAGGHSNQAKAKRLLEFTGAKGVLQPASLHNSDIKRE

SEQ ID NO: 37861 - protein, 114 aa, Sorghum bicolor
  Clone ID: SORBI-28MAY03-C3917_1.pep
GRLEDEKASRNIFEARNKHITNTITIDLVRQHVQQAMNLLKLNMMVCICMPSVLLRVITGCGSEGTGKGKIKRSVIELAEKEHIEWREENSGTVALRLGGPREYRFLEHENDSD

SEQ ID NO: 37862 - protein, 100 aa, Sorghum bicolor
  Clone ID: SORBI-28MAY03-C39184_1.pep
RLCNLQAPPKTDIMLSPFENYPEMVLGDSTSDILNGNSSPQTSVKVVSPNKKRISPPRMGTRLSPICTIGRKLILKSIPSFPSLGGDVNNEDPKAKLPAP

SEQ ID NO: 37863 - protein, 54 aa, Sorghum bicolor
  Clone ID: SORBI-28MAY03-C39197_1.pep
STSMSDTAPQSRLTSAPSPRVPPSPGARDQSGFSRLTDSRTLHSSPSQRKINGY

SEQ ID NO: 37864 - protein, 202 aa, Sorghum bicolor
  Clone ID: SORBI-28MAY03-C39212_1.pep
MAADTSKPFFPAAPHSALLPSRSAASRATPEGSYWRAFRSSELVSDAGFPVTDLAFAPAVADGASPTLAASWSTSLHVFSGDPLEKLRRISVAGDLAFSPSFRCDGALLAAGDKKGVVRVLRADKAAAGALRTLRAHAAETRVVRYPVAGGDKLHLLTAGDDALLAYWDVPSETPVFSVPAAHRDYIRGGAASPADHNIFAT

SEQ ID NO: 37865 - protein, 244 aa, Sorghum bicolor
  Clone ID: SORBI-28MAY03-C39597_1.pep
MGSHDGEDEELPPPPPVPPDVVPIKAEHVVGEPPANKPIKPKRLLMDRPGIGRKGHLAQLYSNHFKVAVKSTEDFFFHYYVNLKYEDDQPVEGKGIGRKVIDKLQQTYRAELSNKDFAYDGGTSLFTVGGLPQKNNEFTVVLEDASTGKTAANGSPGGNDSPGGGDRKRVRRPYQTKTFKVEINFAAKVPMSAIGQVIRGEETENSLEALRVLDIILRQHSAEQGCLLVKQSFFYNNPCNFVDL

SEQ ID NO: 37866 - protein, 201 aa, Sorghum bicolor
  Clone ID: SORBI-28MAY03-C39716_1.pep
MEAALGALCRAGGWSYAAVWRARGQDPRLLTLGDCYSEDEAKTMVQKMLNLVEIVGEGILGEALVSGECQWIYDDTCHVLNQTSHADNRDLYLDYTWWQHQFLNGIKTIAVLPLQLQGLVQFGSTRKVPRSSILLNQVRDIFDRMKNASSDGPMEYTHNSLAYGQQPILASLISANDMLVHNKVNPLQTEKPEENIEITES

SEQ ID NO: 37867 - protein, 287 aa, Sorghum bicolor
  Clone ID: SORBI-28MAY03-C39721_1.pep
TRRRCPPPPPPPPPARRRRRPPPGPGPPPPRPRRALAAPPLPRRRRLPRRGARGAVPPPGRALGGGHLLRSLRGPGDDARLRSPPASPPLPALDLAGSAPASNVFPCRPSPRPSSATRPSPLALPQAAHGDSTVPTRPARSNSVSRSSIQSALMNGNNRTSALVAGAAPVSPRPTPPRRRGRSVIAPKQSVPAARPVPARSSTPVKTRPSTPAKTRPSTPTRTRPTAPNSSTDSAAAKTTSTHSVRPSTPNSRSRIVPNSSSSATHAISRPSASSGTTSRPGSSSGN

SEQ ID NO: 37868 - protein, 352 aa, Sorghum bicolor
  unsure (1)..(352): unsure at all Xaa locations
  Clone ID: SORBI-28MAY03-C39840_1.pep
MATRPGPLTEWPWQWMGNFKYLVLVPAVLHTAHRVATKGWGDLDPAYATMLPALLLRMIHNQIWISLSRYQTARRKNVIVDRSIEFEQVDRERSWDDQIIFNGLEFYLAYAMIPNVRLLPIWRTDGAIVTVLLHVGPVEFLYYWFHRALHHHFLYSRYHSHHHASIVTEPITSVIHPFAEHVVYFMLFSIPTLTPIFMGCGSVLGIVLYIAYIDFMNNMGHCNFELVPKWIFKAFPPLKYLMYTPSFHSLHHTQFRTNYSLFMPFYDYMYNTMDKSSDELYEKSLKVTDETPDLVHLTHMTTLQSTYHLRIGIASIASKPSXKPVWYSWMIWPVAFLSMVLAWVYGSSAFVI

SEQ ID NO: 37869 - protein, 184 aa, Sorghum bicolor
  Clone ID: SORBI-28MAY03-C39850_1.pep
MAGEGEEVYVAAIDQGTTSTRFIVYDRHAKPVASHQLEFAQHYPEAGWVEHDPMEIIETVMVCMNEAVGKAKDGKYNVVAGLKAIGITNQRETTVMWSKSTGHPLYNAIVWMDARTSPVCRRLESELSGGRTHFVERCGLPISTYFSALKLLWLMENVDAVKDAIKTGDALFGTIDTWLIWNLT

SEQ ID NO: 37870 - protein, 279 aa, Sorghum bicolor
  unsure (1)..(279): unsure at all Xaa locations
  Clone ID: SORBI-28MAY03-C39329_1.pep
TRAEHVGTKSKLQCIDHYTTAYMNSPCYPLPDMSHVNGKNRKELLAMAKVQGESKKGTSLLSGELTPKAESPFSPSRVKVEDALGEGPAGRSPSHIAVGANKKASNVGQIKDGANVSKIEDGHVDRSVGVKKPRYSADEGPSLTELSGYNAKRHEFDPEYDNDAEQALAEMEFKETDSETDRELKLRVLRIYLSRLEERKRRKEFILERNLLFPNPLEKDLTNEDREVYHRYKVFMRFLSKEEHEALIRSVIEERKIGGEFKNXQECRPAGCRTRLKQR

SEQ ID NO: 37871 - protein, 91 aa, Sorghum bicolor
  Clone ID: SORBI-28MAY03-C39335_1.pep
ISPGAPFLPISKKPVKRKGFDAAVCLVQFIGCQHMAQPPYPLLRLCCWLLLNTSLLLVEMTPKVCFHLYLCTLGNNLLFQSSLSYLLCAKV

SEQ ID NO: 37872 - protein, 119 aa, Sorghum bicolor
  unsure (1)..(119): unsure at all Xaa locations
  Clone ID: SORBI-28MAY03-C39357_1.pep
GLYMAXALDKFGILYCHMVEPRMVKLGEKFETPYSLRPMRDAFKGTFIVAGGYTREDGNDAISTGYADLIAYGRLFLSNPDLPRRLEIDGPLNKYNRDTFYIPDPVIGYTDYPFLSSDV

SEQ ID NO: 37873 - protein, 95 aa, Sorghum bicolor
  Clone ID: SORBI-28MAY03-C3936_1.pep
QTHPIKCPAPKIQAAVVSSDHTFDGRDAWATETAKTPLPLARSNISEPRTLPKLHLFYYYMLQKDDEAVSICSSLPFRASLQALSKRHLDQILTT

SEQ ID NO: 37874 - protein, 78 aa, Sorghum bicolor
  Clone ID: SORBI-28MAY03-C39373_1.pep
LSKVLLRECDNELSRNFMKILRTLREKDPSYHQLCRVVRQGEQPREGYLLLSNLVEDQMAGTSSYVDWILQIHRQTQS

SEQ ID NO: 37875 - protein, 120 aa, Sorghum bicolor
  Clone ID: SORBI-28MAY03-C4008_1.pep
KSLSIILVRDVDGKTFASALNDVIARQIKNPNAEEESSLSTLQNTFLGRNLKQGTNIYLTWLEPKRMLISISENQDPRQVDAEIESATVNYALYDGFFGKSPVSPSLRSSTARLLEALLQ

SEQ ID NO: 37876 - protein, 123 aa, Sorghum bicolor
  Clone ID: SORBI-28MAY03-C40090_1.pep
LNYTCMAQDTDLCSGNKTLTYDIYGQLVLAANVSYALYHYAPFLLNLQDCKFVRATFSAIASQYCPPLEHDLGLVSAGLALIASGFVLYLIWMLFADRPQRREEVSDLASGSRITPVDSCSPS

SEQ ID NO: 37877 - protein, 65 aa, Sorghum bicolor
  Clone ID: SORBI-28MAY03-C40193_1.pep
GNTVEESELETLIDMQLVALRKVFRIPHKPFDETQGPTSKKLLTLFRSGKLGPFILDDLPDASEN

SEQ ID NO: 37878 - protein, 133 aa, Sorghum bicolor
  Clone ID: SORBI-28MAY03-C40157_1.pep
MLKSRLPEGRTVYLKFSNKDIPKIWIGDNIDDKQQQRAPKGTTFIPTSQFPLKKIRRDCTYLSTPAMKIPETMENVHTCENWLPRRVMSAWRIAGILHALEGWDMHESGDDMMDIDKTWSAAIKHGFAPLTKY

SEQ ID NO: 37879 - protein, 180 aa, Sorghum bicolor
  Clone ID: SORBI-28MAY03-C40441_1.pep
MDAKLLLPFPSLPAALHPAAGRAPKSLFLGASLPLHPPPPPFPLRLRPRRAAAVVAQAAVKRRKELPFDNVIQRDKKLKLVLKLRNILVAQPDRVMSLRDLGRFRRDLGLTRKRRLIALLKRFPGVFEIVEEGVYSLRFRLTPPAERLYLDELRLKNESEGLAVTKLRKLLMMSQERRIL

SEQ ID NO: 37880 - protein, 138 aa, Sorghum bicolor
  Clone ID: SORBI-28MAY03-C39487_1.pep
QGFISQTDLVWQRLDEVNGDGVFLTSNFTPFKAETPRNDSWNEQQAMTSTADYLAQFDNTSGNSDLELAIALQQQEFERQPQRFQAPPPQQQQQQQQPPQTQNHPTQSGRSGLVVGPRRSNVPPPSRSESKKERCIVM

SEQ ID NO: 37881 - protein, 123 aa, Sorghum bicolor
  Clone ID: SORBI-28MAY03-C39516_1.pep
ERSPQENELADAKFAWLCAKHVKSNAIVIAKNNCMLGMGSGQPNRRESVRIAFRKAGEEAKGAALASDAFFPFAWNDAVEEACQNGIGIIAQPGGSKKDEDAIACCNKYGVSLVLTGVRHFKH

SEQ ID NO: 37882 - protein, 152 aa, Sorghum bicolor
  Clone ID: SORBI-28MAY03-C39529_1.pep
FIFGNSIALMEHCHIHCKAAGFITAHSRKSTSESTGYVFLRCTITGNGDGGYMFLGRPWGPFGRVVFAYTFMDRCIKPSGWHNWDKSENERTACFYEYRCSGPGSQPSNRVTWCRQLLDVEAEQFLAHTFIDPDVDRPWLLQMMAIRVPASA

SEQ ID NO: 37883 - protein, 283 aa, Sorghum bicolor
  Clone ID: SORBI-28MAY03-C39539_1.pep
MATATATSSSSLTTPLLRPNPNTNPAPRSLQLLRSRRCARAVTAAVAGGPVPYGAAPRRGIWSIRDDLVVPRSPYFPVESAAGHERGPSPMVMERFQSVVSQLFQHRIIRCGGPVEDDMANIIVAQLLYLDAIDPTKDIIMYVNSPGGSVTAGMAIFDTMKHIRPDVSTVCIGLAASMGAFLLSAGTKGKRYSLPNSRIMIHQPLGGAQGQETDLEIQPNEMLHHKANLNGYLAYHTGQPLDKINVDTDRDYFMSAKEAKEYGLIDGVIMNPLKALQPLPASS

SEQ ID NO: 37884 - protein, 235 aa, Sorghum bicolor
  Clone ID: SORBI-28MAY03-C39580_1.pep
SFMFGRCLTSTVWGIAADRIGRKPVVMFGISSVVVLNTLFGLSVNYWMAITTRLHEGALNGLLGPIKAYAIEVCRPEHEALALSLVSTAWGIGLIIGPALGGYLALPAENFPTVFSTDSIFGRFPYFLPCLCTSIFAAVVLISCIWMPETLHKHKVHENRSQNIEALEAHLIDSKEKVEESGSLDTKKSLFRNWPLMSSIIVYCIFSFHDMAYTEVFSLWAESDKKYGGLSLSSE

SEQ ID NO: 37885 - protein, 158 aa, Sorghum bicolor
  Clone ID: SORBI-28MAY03-C40384_1.pep
FLLPYYHPAFVPVPCYGYVPFFYGPPGVAQAPHEVVKPVAVHSTPPLNVKDLYNMSELSLKGDSDANGGVPASPLPPKTELVDQRGNLLSMENGTSGSSGGLSPPVTWLWFCSETCPHAYVPLRVDCPRGFARAGYTAPWCPPQFRCRALWVSPVWKS

SEQ ID NO: 37886 - protein, 113 aa, Sorghum bicolor
  Clone ID: SORBI-28MAY03-C40408_1.pep
MELQGNVDFSLPQRSVHTSVKVSNPAGGPSNISFSEDPVVKTAKKIHNQKFQELTGNNIFKEDVPTSAEKSLSSAKLKEMSGSDIFADGTPAPREYLGGIRKPPGGESSIALI

SEQ ID NO: 37887 - protein, 147 aa, Sorghum bicolor
  Clone ID: SORBI-28MAY03-C40426_1.pep
ARGLDLSPDSDRRRRLLRPQRPSVLARLCCPRPGLPFSSSLSPRLPLSRGHRGGSGGGGPLPSGQHHSRVGAPLPWPSPSLPPSLLVSFSPEGVARVAVAAHFPSVSTTSREVVTVPSARATGNPSRRFCSGQFSLIHSRLVGLCLL

SEQ ID NO: 37888 - protein, 237 aa, Sorghum bicolor
  unsure (1)..(237): unsure at all Xaa locations
  Clone ID: SORBI-28MAY03-C40436_1.pep
TRTRKADKGLEVIWRGSPTFGSSSQSFTNAFPVHYSPPDGFGFEVLAENVIPVQDDLSLFDYNVQERVNDFVAAALAQANVTRTDHIMWTMGDDFNYQYAESWFRNMDKLIQHVNKDGRVHALYSTPSIYTDAKHASNESWPVKYDDYFPYADSTNAYWTGYFTSRPTFKRYVRVHSGYYLAARQIEFLIGRSSLGLFTSSLEDAMGIAQHHDAISGTAKQHTTDDYSKRIAIGASX

SEQ ID NO: 37889 - protein, 142 aa, Sorghum bicolor
  Clone ID: SORBI-28MAY03-C39885_1.pep
DTGTKGSDSSSSTDDEFSSVSDIDVMVHQYGMLLLEILTGKVAYSEEEDRVSLEQLASLYFDGNMPLAELIDPSLGSFPQEAAHAMCEVARSCVDPDPKKRPRMVQVAARMKEITALGPEGATPKVSPLWWAELEIMSSEAS

SEQ ID NO: 37890 - protein, 106 aa, Sorghum bicolor
  Clone ID: SORBI-28MAY03-C3990_1.pep
ASYSRFFVCGIASSVRHPVYSKPTCCRAVAGRRKMYSYLPACIPAAQRKLFQLPNLVLEQMLEATCLSCQLFCSKFKVFTAFWMKLKDESHVVAVRGLSDTLSYLS

SEQ ID NO: 37891 - protein, 184 aa, Sorghum bicolor
  Clone ID: SORBI-28MAY03-C3993_1.pep
SGFGFIHSQGIVHRDVKPENILFDEDFCVKIADFGIACEETLCDMLVEDEGTYRWMAPEMIKQKAYNRKVDVYSFGLLMWEMVSGRIPYENLTPFQVAYAVANRNLRPTISPECPSALRPLIEQCCALQPDKRPDFWQIVKVLEQFHSIVSQGGCLETPKSGTCQDPKKRLMQWIQKLKPTHST

SEQ ID NO: 37892 - protein, 99 aa, Sorghum bicolor
  Clone ID: SORBI-28MAY03-C39958_1.pep
YEGEGERAEDNHLLGYFKITGIPAAPKGTVEISVCMDIDATNVLRVFAGVVKPQGPATPPFIEVRMPTLDDGHGWCGQALAKMYGKTLDLAVLPKKLQP

SEQ ID NO: 37893 - protein, 136 aa, Sorghum bicolor
  Clone ID: SORBI-28MAY03-C40039_1.pep
QNLGGIRGASLFPQSIRSAAAKVRPARASDPGHGITNSDHHYIDNASSVNGHLSGDSNGALSRNGGSSTDSPDRGSIGTKETLSELDIYGSSRYEAMLLREDVRNTSWLHGFDDKPDQSPLFDHRFEPLPEPFSPL

SEQ ID NO: 37894 - protein, 133 aa, Sorghum bicolor
  Clone ID: SORBI-28MAY03-C40079_1.pep
AGAVLHRSPRKENDDEASPCVTPHPNIRPVGESRVSVTYLVDQDPGVNRSGSRPDDQQQSPEREELDSPNKRHLRKKAVHMVKHAGKTAHNLKSMFSKKGLDKSKEEEHSDEEGDVVAMQKTGMEVDPSLPSI

SEQ ID NO: 37895 - protein, 170 aa, Sorghum bicolor
  unsure (1)..(170): unsure at all Xaa locations
  Clone ID: SORBI-28MAY03-C40550_1.pep
MSLSHRLPHAAAAAVDPYYVYAPHPDPQRQGVLTLFVAGLPDDVKPREIHNLFSHRPAFDHCLLEYTGRANQVVAFVTFFTHEAALSAMTSLNGTIFDPETGXRLHIELANPTSRRPRGGGEVYRVIDKRTNKTEGNADENVGDEVDEEVWGGDEDGANDDNGDGESYEP

SEQ ID NO: 37896 - protein, 251 aa, Sorghum bicolor
  Clone ID: SORBI-28MAY03-C40561_1.pep
TRAGYVCLQYAGGDAAGAAWRLVETREEDGDGRGRRSFLLPLYPKPRRGGATKLASGGDWPHNSTANLFPEGMYYTTVSLGNPPRPYFLDVDTGSHTTWIQCDAPCTSCAEGAHPLYRPAPANLVPASDPLCQRVQHDNPNQCDYDISFADGSSSMGVHVRDNMQFISEDGERENADIVFGCGYDQQGILLNRLENTDGILGLSNRALSLPTQLASRGIISNVFGHCMTRDPSGGGYLFLGDDYLPRWGMT

SEQ ID NO: 37897 - protein, 194 aa, Sorghum bicolor
  Clone ID: SORBI-28MAY03-C40579_1.pep
MDQLVNAVMDLVVPPASMVMLAFAWPTLSFLRGVEWALKTLTKEDMLGKVVVITGASSAIGEQIAYEYARRNANLVLVARREQRLFGIRDNARQLGAGQVLVIAADVVKEEDCRRLVADTVSYFGQLNHLVNTVSLSHDFSFEEAGDTTAFPHLMDINFWGNVYPTYAALPYLRRSHGRVVVNASVESWLPMPR

SEQ ID NO: 37898 - protein, 222 aa, Sorghum bicolor
  Clone ID: SORBI-28MAY03-C40647_1.pep
IWDWFFRSCELNGRILLSEGLITAEDMEEYITKGKCKKLGTKLPSWCIFQCLLRSANSDSDGLLISDNVEVTNLNWPKDRVFDWLLGPLLVIKDQMRKLEITEDEETCLRKLIMTNKNEKPSDWDDAGFPSDDNIKRGQLQAIIRRLQGIVANMSRVPSFRRRFINLVKAMYLEAIEAGTIDGSRDIKRKVKADVGTEKFGDRGAEDIAGSSTHPQSNIDIV

SEQ ID NO: 37899 - protein, 143 aa, Sorghum bicolor
  Clone ID: SORBI-28MAY03-C40673_1.pep
RSWELSVSFISIILIPIVGNAAEHAGAVIFAFKNKLDITLGVSLGSATQISMFVVPLSVLVAWIMGVPMDLDFNLLETGSLFLAVLVTAFTLQDGSSHYLKGLLLLFCYIVIAVCFFVLRQRGNGSNNDVHHQLGVASKPWRI

SEQ ID NO: 37900 - protein, 110 aa, Sorghum bicolor
  Clone ID: SORBI-28MAY03-C40214_1.pep
LRSPVLSSNQYNMRRLIPMRSLMNQNESFREQPQTRKQRKPLPNKERGQLHKRESDETVVFLSMASFDEKRRHKGELIRILCCHSEFASACLQECIGIVLIVKMGSSCSA

SEQ ID NO: 37901 - protein, 82 aa, Sorghum bicolor
  Clone ID: SORBI-28MAY03-C40264_1.pep
ELTVHGTPKSRMKAHVLLDLLRNSPYSRSKLQADTLENLVTNIASQIDGEDRGGKAKKMLAEMVKVSMEQSLRHLQRRASFA

SEQ ID NO: 37902 - protein, 50 aa, Sorghum bicolor
  Clone ID: SORBI-28MAY03-C40268_1.pep
PASCKCPGSSQNPKSTPSVEIRASRNGNDVWSTGQQYPVISCNQGVQNTV

SEQ ID NO: 37903 - protein, 172 aa, Sorghum bicolor
  Clone ID: SORBI-28MAY03-C40310_1.pep
NSVNDDKLKTAELVFGRKKSTATKSRPKVVKLDTEDFLSSMMPSANVPKEDPLSGALRDVLLGSDAKALSSQRTSDINLEGMLNKTSSNESSTPRIENLGSHPASHSSRTSKQQNHDKEKGANPAESDGKEQRKPRSSGRSGHRQGKHKHREKSSTQPDTVPQAPVIQDFLL

SEQ ID NO: 37904 - protein, 54 aa, Sorghum bicolor
  Clone ID: SORBI-28MAY03-C40302_1.pep
AGFNIKALSRKIAAALPGMETLSSAKQEDMVDVNLRSGNANSSQSQAQAGGCSC

SEQ ID NO: 37905 - protein, 84 aa, Sorghum bicolor
  Clone ID: SORBI-28MAY03-C40392_1.pep
AVEAAGGPVRLVFFNKLGFRALLKPEWFEKKGRLLPKAARPPPKQRDKVDSIGRLPAPTKPLPFTPEELEFAAKRDAARMTVTA

SEQ ID NO: 37906 - protein, 98 aa, Sorghum bicolor
  Clone ID: SORBI-28MAY03-C40840_1.pep
TRATDNRAIGELAGLAVGATVLLNVLFAGPVSGASMNPARTLGPAIVVGRYAGIWVYFAGPICGTVAGAWAYNLIRFTDKPLREITQTSSFLRSVRRT

SEQ ID NO: 37907 - protein, 128 aa, Sorghum bicolor
  Clone ID: SORBI-28MAY03-C40891_1.pep
ARGVRDNAAGAIARMIMVQPQSIPLNQVLPVFIKALPLKEDHEESMTVYGCICSLLLSSHPQILPLVPDVIHVFAQVVVSPDESDEVKTNIGKAVSHLISVYGQQMQPILSALPPAHASALASFASRR

SEQ ID NO: 37908 - protein, 117 aa, Sorghum bicolor
  Clone ID: SORBI-28MAY03-C40878_1.pep
SKKSSKGAELGDGSCNQSQAKRIHLDYTMGGHTAAVSCVAFSVFGEKGKFLVSGGNDASVKLWDWSKGFSSETNSKVELVLNIDVKKKVNWLCTAPTDSDNLIVCDTSKVVKVYNFR

SEQ ID NO: 37909 - protein, 162 aa, Sorghum bicolor
  Clone ID: SORBI-28MAY03-C40900_1.pep
MSNPGSSPASGHHDHEHTPLCRSCGAPTTAPTPAPWSGTTDSPPPAYRPIRLPAINAPTNTAAIVLSPVPQPLPVPPAAPPHAFQVPAKRIASPDDIARFHASVHGRHFLGFVAALSASIHGRKLSDPLPSPPSPAVAALLDLVSALAALVESIPPLPHSSR

SEQ ID NO: 37910 - protein, 175 aa, Sorghum bicolor
  Clone ID: SORBI-28MAY03-C40483_1.pep
MSKKGGRAKKAAGGGELSRFLESHLQTISDTFQMMAESAPVSLERTEWSEVVKLGDQVSRQATVAGMLWSGDLPDVETLKENVDAYFNILQGFLLVCHGSMVGAGPTLHKSIYGSAKNVVDSSFSLFKHAVSACESRSPDRNTTIPQVTGTVWEACAALKKVPTSNCIAIGRAMT

SEQ ID NO: 37911 - protein, 148 aa, Sorghum bicolor
  unsure (1)..(148): unsure at all Xaa locations
  Clone ID: SORBI-28MAY03-C40518_1.pep
MESPEACSSGETSPLSPAAAAAAAAERPSEAAALRALVDRVRAGEVDAAREVRRPTRASARHRRKLAAAVDPLVAMLRSAAPEAGEAALLALLNLAVRDERNKTKIVDAGALEPLLCYLQSSDLXLQEYATAALLTLSASSTNKPIIS

SEQ ID NO: 37912 - protein, 309 aa, Sorghum bicolor
  Clone ID: SORBI-28MAY03-C40488_1.pep
ARGNGSRQIKWEQPTLSIGDMGRPFLTRSQSALESPQCTRRDDNKDPTSDSTSESFSEACLSMSLGIASNGNRMEATSTAERPMLSPTTAIAEGRELATTLSPYQHAQRARHFLTRPPRVGEGAAFDPTRDMFPHLRVARPPAEGRGRNQLLPRYWPRITDQELQQISGDSNSTIVPLFEKVLSSSDAGRIGRLVLPKACAEAYFPPISQPEGRPLTIQDARGKEWHFQFRFWPNNNSRMYVLEGVTPCIQSLQLQAGDTVTFSRIDPGGKLVMGFRKATNTVSLPDSQISAIANGSILSETLFSTANE

SEQ ID NO: 37913 - protein, 343 aa, Sorghum bicolor
  Clone ID: SORBI-28MAY03-C40535_1.pep
ARGFDENSVKIVASNTGSGVYKDQDLYDKYIDIKEIPELSVINRSSKGVELGSVVSISKAIEVLSDGNVVFKKIADHLTKVASPFVRNTATIGGNIIMAQRLQFPSDIVTVLLAASTTVTIQVASKTHCLALEEFLQQPPCDSRTLLLSIFIPDWSSDGITFETFRAAPRPLGNAVSYVNSPFLARTSVDAGSRDHLIEDICLAFGAYGADHAIRARKVARGLKGKTVSSSVILEAVRLLKETVKPSEGTTHPEYRISLAVSFLFTFLSSLANSLNESARVNDPNGSYNNGDTNGTIEHSPEKQLKLDSNDLPIRSRQEIFFTDEYKPVGKPIKKAGAEIQAS

SEQ ID NO: 37914 - protein, 250 aa, Sorghum bicolor
  Clone ID: SORBI-28MAY03-C40545_1.pep
ARGFIFVPFFAFQAYGYLNICVHGSSEELRPWCKAKVPLLYGFIQSHYWGVGFLRYFQVKQLPNFLLASPVLSLAVYSIVHYTKLLHRLFQTSSIHKQIITALEERSVVSYRRSDDVTILSELSAGLTKKAQGNSTVKQRKSVAAETASATFHDTMSAKQNMEENQDACSILLLPFVLHLVFMTFTAFFVMHVQVSTRFLSASPPIYWAAAHILASPSRSSKRWGYLICVYFIAYILLGSLLFSNFYPFT

SEQ ID NO: 37915 - protein, 305 aa, Sorghum bicolor
  Clone ID: SORBI-28MAY03-C41045_1.pep
MDGHAAVHEPLLPSPPLQGKAASAESKRLMRLAGPIVASCVLQNVVNMASVMFVGHLGELPLAGASLATSLANVTGYSLLTGMATALDTLCGQAFGARHHRLLGVYKQRAMVVLGLACVPIALVWACAGRILLFLGQDPEIAAEAGAYARWLIPSLAAYVPLQCHVRFLQTQSVVLPVTASSGATALCHLLVCWALVYRAGMGSKGAALSNAVSYAINLVILALYVRLSDACKETWNGFSWEAFKDLWRFTELAWPSAIMICLEWWSFEVLVLLSGLLPNPQLETSVLSICLNTGALLYMIPLGL

SEQ ID NO: 37916 - protein, 85 aa, Sorghum bicolor
  unsure (1)..(85): unsure at all Xaa locations
  Clone ID: SORBI-28MAY03-C41061_1.pep
XKSIHNPDILENFSKEYMYLACVAYVKKVKKGPFVEHSPMLDDISGVANWKKVNSGLLKMYKAEVLEKVPIMQHFLFGSLIKWED

SEQ ID NO: 37917 - protein, 124 aa, Sorghum bicolor
  unsure (1)..(124): unsure at all Xaa locations
  Clone ID: SORBI-28MAY03-C41097_1.pep
EEEERKERAEEERKRREEEEERRGREXRREEERARKEEEKQRRREEEERARREQEEEERARRREEEEEREREEEDXRREEEEEGGGGRGDEPEREDEEEGGDEPPYSLSNKLNKRYRAGMFRSG

SEQ ID NO: 37918 - protein, 180 aa, Sorghum bicolor
  unsure (1)..(180): unsure at all Xaa locations
  Clone ID: SORBI-28MAY03-C41125_1.pep
HLLDDDADMAAMHLSEKAAFQAASQSSRFDIGTELVEIDGEGDEDEAGTEQEEQGSMTFMPKIDELESLLEVYFVQIDGTLNKLSTXLREYVDDTEDYINIMLDDKQNQLLQMGVVLSTVTLLVTSAVVVTAIFGMNIHIALYRITDLNVFWEAVGGTLAGVAMLFLGAMLYYWKNGILR

SEQ ID NO: 37919 - protein, 162 aa, Sorghum bicolor
  Clone ID: SORBI-28MAY03-C41149_1.pep
MSPAAAWCAQHRLRFLLPSLFLAPVLFFLLSPPSPPPFVSLPAPGELPPSGSRLIWAQRRLVEWRPCGWWRTAPVQAPSRRNGYIRIDCYGGLNQLRRDLCDGIGVARLLNATMILPKFEVAAYWNESSGFADVFDVDYFIEQTRGYVEVMKDLPVEIASKE

SEQ ID NO: 37920 - protein, 134 aa, Sorghum bicolor
  unsure (1)..(134): unsure at all Xaa locations
  Clone ID: SORBI-28MAY03-C45514_1.pep
GRSIAVKRLDDLSQADEVFRSELSVMXRINHMNLVRMWGFCSEHSNRLLVSEFVENGSLDNALFVSDGGESTLGWRSRCKIAAGVAKGLAHLHHECLEWIVHCDMKPENILGEAVQPGRLLFLRVSSFSLTVNQ

SEQ ID NO: 37921 - protein, 117 aa, Sorghum bicolor
  Clone ID: SORBI-28MAY03-C45537_1.pep
KNEKEKGKRADTVEVILSWQLTTIKRALWPWIVEERLKRCMCLTKLPCFILSRGFRKTNSLISMQSILLLRVQHFQLVDSAQGDKSWILHTQQRCWTCRFEQVILIHLCFLYRHLDV

SEQ ID NO: 37922 - protein, 129 aa, Sorghum bicolor
  Clone ID: SORBI-28MAY03-C45529_1.pep
RKDMEIDQLLKDKVKSPSSLTYRNDSNQQIRRQSGAGGSCEAECEDNISDDGCSVAGTECSVGGASEATPERMQKAPSRIARLFLTKNGQPANPKPKPRESALKPPGRTTSTGSQATGGASSVKPPKRR

SEQ ID NO: 37923 - protein, 146 aa, Sorghum bicolor
  Clone ID: SORBI-28MAY03-C45589_1.pep
SILKIKVVELCKDDVAVLAGLPVLSRLILDVRNNNVSGQQGIVFSADTSFRLLGYLRIPYHAESGITFEAGSMPQVETLRFLLRANDVKRWGVRFSGIEHLPSLKQVLVDLRYGDCDESEKPVIRAAVRSAFYAHSSPSSVQFEFY

SEQ ID NO: 37924 - protein, 146 aa, Sorghum bicolor
  Clone ID: SORBI-28MAY03-C45601_1.pep
LSELDEDSRLQCMEFASPVLTNFESKDCGETPAPQNLNEIAEDSRLQCIEFTSPAHTVLRDKAGVENFASPSFAVVAKDSKPPSSEFTSPAHTVATFQPYADDMPTPKFTASERNFLLSVIELTSPGSRPETSQHPSCKRALLNSL

SEQ ID NO: 37925 - protein, 220 aa, Sorghum bicolor
  Clone ID: SORBI-28MAY03-C41217_1.pep
MTSAFLSLRLPTPSPSHAASSPSLPSPLLRQARGGVASSALVARAAGPAGAAGAPSPLFNPRGDPFLSTLAAASPEDLAAAAGGERRGEDHLPFLEIFQNAKLMASPAQVERHEGSYSQHRPRRPPPDLPSLLLHGRIVYIGMPLVPAVTELVVAQLMYLEWMNSKEPVYIYINSTGTARDDGEPVGMESEGFAIYDAMMRMNTEVLCLTFTICGSVVQC

SEQ ID NO: 37926 - protein, 164 aa, Sorghum bicolor
  unsure (1)..(164): unsure at all Xaa locations
  Clone ID: SORBI-28MAY03-C41260_1.pep
MGNHSSRDGSKHGRRQPSFQQQSSAQWGAGGGYYAQDPRADYYGAPGSQQGGGYAAPYPAPAYQPTAAAAPAPQAAKPRQLDRRYSRIADDYHSVDQVTDALAQAGLESSNLIVGIDFTKSNEWTGKFSFHGRSLHHISNTPXPYEQAISIIGRTLSKFDEDNL

SEQ ID NO: 37927 - protein, 77 aa, Sorghum bicolor
  Clone ID: SORBI-28MAY03-C41259_1.pep
MYKNQLQELAQRSCFNLPSYSCIREGPDHAPRFKATVNFNGEMFESPAFCSTLRQAEHAAAEVALNELSKRGPSSTL

SEQ ID NO: 37928 - protein, 53 aa, Sorghum bicolor
  Clone ID: SORBI-28MAY03-C41295_1.pep
DPLRGGRDPLVEDVLSIIHADDAIARQKIALAPTPKRLVYEWQLKLARQISPF

SEQ ID NO: 37929 - protein, 201 aa, Sorghum bicolor
  unsure (1)..(201): unsure at all Xaa locations
  Clone ID: SORBI-28MAY03-C40938_1.pep
HEALQQANDELQQNIYTLTEQSQQAKAEMQDELKAIQEHEDAVLTQLKQSETSVQNLENEVTRXKEELSEQLENNSTLDKQFEEARSNLHAQISDLGAEKDTALLELQTSQASVRNLETVVEKQTENISTLQQANDELQKNIYTLTEQSQQAKAEMQDELKAIQEEKDAVLTQLKQSETSVQNLENDVTRLKEELSVQLVN

SEQ ID NO: 37930 - protein, 131 aa, Sorghum bicolor
  Clone ID: SORBI-28MAY03-C4095_1.pep
RPGPPTGRLLPVTLGQVFQRIDVVSRDLDNIVELELGAPWPLPPLEATATLAHKFEVVGTSGVKITFEKTTVKTKGSLAQLPPLEVPRVPDNLRPPSNAGSGEGEFEVTYLDDDTRVTRGDRGELRVFVIA

SEQ ID NO: 37931 - protein, 291 aa, Sorghum bicolor
  Clone ID: SORBI-28MAY03-C40988_1.pep
MPEATSNTKLWIAHLSCARTSPRSRVPPTRDASHSHVVHALAQSRSPSAHTPPRRLAPLFRPHRRLTSHDSRARHRRFARPRPASPLHRCSLARTHGTRAPAKSQFESPRFSARPPAAAPGPAASPRPGSLRRPPASFREDVGHAASETYLVSRLTFTLLQYLGLGYRWMAQLLSLTIYAILLMPGFLQVGYYYFFSSQVRRSVVYGDQPRNRLDLYIPEDNSRPCPVMAFVTGGAWIIGYKAWGALLGRRLAERGIIVACIDYRNFPQGTIGDMVHDASQGISFVCNNIA

SEQ ID NO: 37932 - protein, 119 aa, Sorghum bicolor
  Clone ID: SORBI-28MAY03-C40963_1.pep
MATATATPPRRRHAATGAAAGEWAALSASGEWRAEAIGKHQLVRRTGLSARDLRALDPALSHPSSVMARDRAVVVNLDRVRAVITATEDGEVGKDGGVSPPSGGGGGKALPFEFRALEV

SEQ ID NO: 37933 - protein, 135 aa, Sorghum bicolor
  Clone ID: SORBI-28MAY03-C40998_1.pep
MASEGNKDVPNETLSVDQSSISGVKRKRGRPRKYEYPVYELPQKVQPLQSAPPLLHCTQDGSSMASHTSGGSVHGNWSAQPRNSANVSLQGNSGKDNVLGKHFVGKLTKKVPGFSLITVKVKDNQVLKGWVPDEI

SEQ ID NO: 37934 - protein, 252 aa, Sorghum bicolor
  Clone ID: SORBI-28MAY03-C41025_1.pep
ARGFGTGAFRSEGAPDGGLAVTELATSFAAARSLVCLSGFREVDPQCTRAIYPVCAKLTSLNFSFASLTAAELKPVIRNCTNLRTFWVLDTVGDEGLRAVADTCSDLRELRVFPLDASEDSEGSVSDVGLQAISEGCRKLESILYFCQRMTNEAVIAMSKNCPELVAFRLCIMGRHRPDRVTGDPMDEGFGAIVMNCKKLTRLSVSGLLTDKAFAYIGKYGKLIKTLSVAFAGNSDMSLQYVFEGCTKLQKL

SEQ ID NO: 37935 - protein, 243 aa, Sorghum bicolor
  Clone ID: SORBI-28MAY03-C41425_1.pep
HEARTDLVLTPTKRTVLGEKWEAFKNKIQGHPVYKRVDEYTKPVVTKGQEVAEDVRERWETSDNPVVQKIQDLNESLLEETSAAVTFREIRQRDPSFSLSDFVADVQETIKPVLTAYSKGDVETLKKYCTKEVIERCKGEREAYASQGIFFDHKILHISEADVLETKMFGSSPIIILRFQSQQIYCVRDREGQVTEGGQDTIQSVFYSWAMQLMDSDEVPEEESYYPVWRLREMQQAGIKALI

SEQ ID NO: 37936 - protein, 103 aa, Sorghum bicolor
  Clone ID: SORBI-28MAY03-C41428_1.pep
HVFRGVVKMRRGLTARIIDETNSMADVYTSFYEFSSLIESKIDDNDPNAALTRRRVDSIKQTCKSSGLVKRRGYHLDKSPYRPMLIMIVLLLVAILFGVLYTK

SEQ ID NO: 37937 - protein, 184 aa, Sorghum bicolor
  Clone ID: SORBI-28MAY03-C41445_1.pep
SKSMDSIEAARGEGRKVLTGDAARLWRNRGKCPLTPSETAFILQALDIPTNTNIYLAAGDGLMELEGFTSVYKNIYTKSSLLAHEDFENMHGNTKAALDYYVSVNSDAYIATFFGNMDKMVTAMRTMQGLQKTLVLSRRDFANYTAAGLAGEQLAKAMWDVHREEYIRGRGSALPEYCFCEFKL

SEQ ID NO: 37938 - protein, 118 aa, Sorghum bicolor
  Clone ID: SORBI-28MAY03-C41438_1.pep
LPDGKLNFCVMLNGQQLRCYETVKVLEISCSSSLDVTFGSQALHNLELLKVSCCSGSGSVMKLSGLEKLSESELKEVQIKGSHDDKLKKDVEEQLGRHQKKPVLKMGTRLSSTGDCEL

SEQ ID NO: 37939 - protein, 162 aa, Sorghum bicolor
  Clone ID: SORBI-28MAY03-C4112_1.pep
ASDLEEDEIANYALNLEKVLAELPAPVLNGTTLTVEDFHQELKCSINIKHRDEFDEEKEPDGMVLAGWSGPVDKQITSNGENRSVPSSSNTEDVDGTAEDISAKPGMKRKLNEILEAKENFDALENPSDVGSSSAQVVEDDDDDELVMFDEDPRQSKKKRLQ

SEQ ID NO: 37940 - protein, 136 aa, Sorghum bicolor
  Clone ID: SORBI-28MAY03-C41151_1.pep
MADGGDEYKREESVTLLVIVSLAALSLLSLIAAFAYYCYITRKVSRRLHSLHLPKRSSSPPPPPARAPPRQQQQGKDSPSSNSASDGAGATAAAMSVVVAGERGVQVFGCRQLHAATGGFGRAHMVGQGSFGAVYR

SEQ ID NO: 37941 - protein, 299 aa, Sorghum bicolor
  unsure (1)..(299): unsure at all Xaa locations
  Clone ID: SORBI-28MAY03-C41159_1.pep
LSVQAIQALLENKGYPVIVGIGGPSGSGKTSLAQKMANIIGCEVVSLESYYKPEQVRDYKYDDYSSLDIALLTKNIMEIRNSHKVEVPCFDFENFSRKGFKELQVSEESGVVIFEGVYTLHPAIRKFLDLWIAVVGGVHSHLIARIQRDKNRAGFSISQTEIMTTVFPLFQQYIEPHLVHAHLKIQNDFDPVLSPESSLSVFLRLXRVPYLGVLMLRDASTGCAAVQSFPVRSCALPGVPAVGQLTEGECIRVRICEGRFALLIREPIREGNFIIQPKVDFDISASTVAGLLKLGYQAV

SEQ ID NO: 37942 - protein, 49 aa, Sorghum bicolor
  Clone ID: SORBI-28MAY03-C41167_1.pep
SSHQGSITGRAKILMIDHRDGCFQAISYREPIKRRKEECYFAVTAALGT

SEQ ID NO: 37943 - protein, 175 aa, Sorghum bicolor
  Clone ID: SORBI-28MAY03-C41242_1.pep
MGSEGRAWNGAAGSSGHGGGGGGVEAKAITAALSAAEVPRMAVSVDISLPLPEMSPDIIYLCKQLVIGWCKIDSSRFSIETVSGGITNLLLKVSVKEDDGNESAVTVRLYGPNTDLVIDRKRELKAIPYLSAAGFGAQLLGIFGNGVVQSFIYARTLSPADMRDPKIAAEIAKEL

SEQ ID NO: 37944 - protein, 192 aa, Sorghum bicolor
  Clone ID: SORBI-28MAY03-C41246_1.pep
MSYNKAPSITAETINPRVKIFSYAPCGEILKHAERLEQEMEENPGSLPFQEIIYCNLGNPQVLGQPPLTFFREVLSLCDNPTLLNRDETCALFSPYSIRRARRIINKIPNKDTGGYTDSQGIKWLRQVVADGITGRDGFPSNADDIFLTDGASSAINLMMQILIRSHEDGILSPLPEYPLYSASIILNGGTM

SEQ ID NO: 37945 - protein, 135 aa, Sorghum bicolor
  Clone ID: SORBI-28MAY03-C41607_1.pep
MQRAWDTFEGPDGRVIHRDRILIYCMKHPIVKKLKTPKWDHIIFPDVKKIRVPKMIVGTHNEDDIRQEEELLEPDDIREEEEPLEPEPSQSPPSESPPPDASDWNQCSCSSPIDSFAPGSLFMHPHPGTCGWLGD

SEQ ID NO: 37946 - protein, 221 aa, Sorghum bicolor
  Clone ID: SORBI-28MAY03-C41625_1.pep
SGGKESSQEPLDEDEFEIEDVKPNSDSTKNGANDQVSETRTLQAGRIPGDTVLKMLMQKVQSLDVSFSVLEKYLVELNSRYGQIFKDFDADIDSKDVLLERIKSELKNLESSKDSITNEIEGILSWKLVASSQLNQLVLDNALLRSEFETFRQKQTDMENRSLAVIFLSFVFACLALAKLSIGIMSKFCRFYDFEKIHNVRSGWVVLLLSSCIISTILIIQ

SEQ ID NO: 37947 - protein, 120 aa, Sorghum bicolor
  Clone ID: SORBI-28MAY03-C41630_1.pep
PLRRMDSRSQLDCLKRCVDLVGKAASVFFFPEGTRSRDGKLGVFKRGAFSVAAKTGAPVIPITLIGTGKLMPSGMEGILNSGSVKVIIRRPIQGNDAETLCSKARNVIADTLVLHGYGVH

SEQ ID NO: 37948 - protein, 206 aa, Sorghum bicolor
  Clone ID: SORBI-28MAY03-C41677_1.pep
MKQEPCSTPQQFKYPYWDERERWIWNSISESQLAYRNDIQIGYLEKFELINNYLPHYLPPLFEQHDEAYSPQFAVGPGSNILCIMEDEISSIIARALAISDERHHLIDLKFENGMDYSKGEHVKAMEKSYSFLSESSFSSSPWSSTDSEASLSSLSSFSSDDFSGYDSSSLLSPMHPEMTVNGKVTLKGKYSVTVVYDNQFFALRK

SEQ ID NO: 37949 - protein, 64 aa, Sorghum bicolor
  Clone ID: SORBI-28MAY03-C41315_1.pep
LPIATAVVAVTLKNGLQNLNVICIHNITLVHQLGSQTYKILLYMSHYVTIHDEPNLLINGHISS

SEQ ID NO: 37950 - protein, 83 aa, Sorghum bicolor
  Clone ID: SORBI-28MAY03-C41326_1.pep
EATRAMLCLIRVETDPQDRTQLRLTVASGDQYLTFELKEFVKEHLIDIPRTQAAPPRAPVQPQLPAAAPATYNDPGAMLAGLL

SEQ ID NO: 37951 - protein, 89 aa, Sorghum bicolor
  Clone ID: SORBI-28MAY03-C41346_1.pep
TSGRCGPTRLVSPLSITTCDQYCSSMCTMPIQHTLAWFVELQSKRPIQIAPTWIQGQVAKKKFTRCFSYVTMHSLGSEFSLRLLTASPD

SEQ ID NO: 37952 - protein, 121 aa, Sorghum bicolor
  Clone ID: SORBI-28MAY03-C41423_1.pep
CCLSCKLKEDSSQTIYIRKTSSCCSLCPKLIGSQSSICIHPVALFGHLSSQSQDRVSQMPPHTLLARGLAGPCAHKLWRVFLVLRVCRGLAVPSTGFSGCCRCLSPRETMRDRQVLQNVTI

SEQ ID NO: 37953 - protein, 283 aa, Sorghum bicolor
  Clone ID: SORBI-28MAY03-C4137_1.pep
TRIGYCVEDDQRLLVYEFMPRGSLDNHLFRRSLPLPWAIRMKVALGAAKGLAFLHEEAERPVIYRDFKTSNILLDAEYNAKLSDFGLAKDGPVGDKTHVSTRVMGTYGYAAPEYVMTGHLTSKSDVYSFGVRLLEMMSGRRSMDKNRPNGEHNLVEWARPLLGERQRFYKLIDPRLEGNFSVKGAQKAAQLARACLSRDPKARPLMSQVVEVLKPLQNLKDMASASYFFQTMQAERSSSMNGRSSHGLKTQSPFGRNGQPPMRSLSDGPRASPFRYSPKPNVK

SEQ ID NO: 37954 - protein, 186 aa, Sorghum bicolor
  Clone ID: SORBI-28MAY03-C41352_1.pep
MDMDDYPEAENGDDENGFGESLKPFYHLNALSDLLMLPKDVLMDTSSRKELCPAFSSSIIKNILDVFVPDEFCPDPIQGSLLQALELEDHLEVNKGIRSIPCSASPILYNAPASGAILSVIGDPRKSGSTILRKSNTSDDELDELSSPLTFISNTSSNPLAKLKRISNSSTARYRLLHEVWKLDDQ

SEQ ID NO: 37955 - protein, 109 aa, Sorghum bicolor
  Clone ID: SORBI-28MAY03-C41807_1.pep
MGTCVSKAACCCRKPNNGVTHEKTDTVTEDEEAYDLPAFQEFTFEQLRLATSGFAVENIVSEHGEKAPNVVYKGKLDAQRRIAVKRFNRSAWPDPRQFMEEARSVGLLR

SEQ ID NO: 37956 - protein, 141 aa, Sorghum bicolor
  Clone ID: SORBI-28MAY03-C41762_1.pep
KAQTECSRWVMLIHYLHYGQLINQSLQIQMWNSCLLRCMICHLCSRMNFRSLINPSITRNPEVTTAKIVFCYYQPGKVVVGSPTFWVLDELHPIFLSGENLLVPTVCLLSEHWSAEDCICFLLLLRCIDHQSQVGSLTVPE

SEQ ID NO: 37957 - protein, 82 aa, Sorghum bicolor
  Clone ID: SORBI-28MAY03-C41773_1.pep
SQNAVDFARRKLQDHNDLRLCCREIVEEAIRRGARGNLTAVMVSFHQDAPPQSRWNRTREGSVARSISAEGLHNLRVLLEGQ

SEQ ID NO: 37958 - protein, 118 aa, Sorghum bicolor
  Clone ID: SORBI-28MAY03-C41836_1.pep
MAPVESPQHDLRRLRRGGGIERKNSTPKRRTDGDDLCAICDDGGDVICCDGVCQRSFHLADGNSERSRCREILRLSAEQAKMILAADKDFICKNCKYQEHQCFACGKLGSSDLSSEAK

SEQ ID NO: 37959 - protein, 139 aa, Sorghum bicolor
  Clone ID: SORBI-28MAY03-C41862_1.pep
MGTLIRPGPAASPLPIASSSSSGHVAAVGGGEGARSLRHRVSVAVFRSPSTHVLATRWRRRRGTVVRSDAIAGAAAAGDSTPALSGLQLAPRVRGVCFYLVTAVAAIFVCVAMVVVHPLVLLFDRYRRRVQHYIAKIWA

SEQ ID NO: 37960 - protein, 107 aa, Sorghum bicolor
  Clone ID: SORBI-28MAY03-C41455_1.pep
AGSALSLDGSYTTKSYLQIILESLPADGNVSIGIHNQQAARLQELVEFILSQGGSFNSDSSSPMREISSTDSMEYDKHGFVDYIIVCSCWIFTIPEKTSLGDSLTLG

SEQ ID NO: 37961 - protein, 85 aa, Sorghum bicolor
  Clone ID: SORBI-28MAY03-C41482_1.pep
SLLQNNAVPQEQRGAANGIATTAMSLSKAFAPAGAGILFSWAQKRQHAAFFPGDQMIFLLLNLTEVIGLVLTFKPFLAVPQQYKQ

SEQ ID NO: 37962 - protein, 242 aa, Sorghum bicolor
  Clone ID: SORBI-28MAY03-C41496_1.pep
HEAQPEEPQASAQSHTIGSRSEGRRSRSGKKGKKRPARRRSQQKMDELSTVEGGSNYSSRRDDDNQVLSSSSRFASPEDSKNKHKSSVESPMEIISENKLPAGLGRKPPEKLKEGFVIALKTRDNSGFYVSRERVAGGGWYLDVIPNATKRDPAAQFLVTFRNKDTMGLRSFVAGGKLLQANNKMEFVFTSQSFDVCESWMLEGSLSECCKLVNRKNSLAVLEVYIEVLGAPSEDGVVRWLD

SEQ ID NO: 37963 - protein, 129 aa, Sorghum bicolor
  Clone ID: SORBI-28MAY03-C41569_1.pep
EGITELLHHKTLPLPLIKCRNVIALGATNMVELDTEWDCLLDTQESGLMPTKPFVSKHLSTTVSDVQIAPVLAKLCLEFSDVYIGCHRISRAGPLVVNLTGKDNQRVDAAAEKLTSSFEGQFSQVDSCK

SEQ ID NO: 37964 - protein, 83 aa, Sorghum bicolor
  Clone ID: SORBI-28MAY03-C41538_1.pep
QAAAHPTAFIPFGLGARMCIGQNLALLESKLTVAIILQRFDFRLSPSYLHAPTVLMLLHPQYGAPVIFRPRSCEPSDRDNRDM

SEQ ID NO: 37965 - protein, 156 aa, Sorghum bicolor
  Clone ID: SORBI-28MAY03-C41594_1.pep
HSSGESDPHVPSPVSRMHTSSAGAGDSLSSRDVTGSTSCAESPPLPQMQSCTDPRTKVSEIDVNMEPAVTETGLSRDQPVEEPPHAATGVNDGFWQQFLTEQPGSDAHQEAQSERRDGDDKGDQTRIGDREKFWWGKKNVEQMTEKLGHLTSVEKT

SEQ ID NO: 37966 - protein, 159 aa, Sorghum bicolor
  Clone ID: SORBI-28MAY03-C42100_1.pep
DEDSILNKLSIINKCFSAETVEDIIKAFESEASIDGNQWIAPVLKGLRRSSPTALKITLRSIREGRRQSLPECLTKEFRLTMNILRSVVNGDVYEGIRALSIDKDNAPKWNPTTLEEVKNEDIDRVFQPFSSERELQVPSDDSNRWSGKYENTVYGRAS

SEQ ID NO: 37967 - protein, 128 aa, Sorghum bicolor
  Clone ID: SORBI-28MAY03-C42062_1.pep
PFFFLFSLTRAALQLNTKVFKRSSNSFKCDRSMKQLSHQIKIHDTNSSGLQWPHCGMSESEITFFVEPCSGGHSSFDDREELENEALEIPTGEFFAFSTVEMDLLCGMATVTDVARDDTFPTGLGDSD

SEQ ID NO: 37968 - protein, 363 aa, Sorghum bicolor
  Clone ID: SORBI-28MAY03-C4212_1.pep
RRARGRTPEPTPGRTRGLAQSKAPSRLSLSLRRCCAFCSCARSQQSNGGANGNGTGNGNGNGAPLVVFDFDKTIVDCYSDNWVVDALGATRRFDDLLRHLPWNHAIDAMMGELHSDGKTAEDTLGSLRTAPLSPHVAAAIKAAYALGCELRVLSDANAFFIDTILAHHGLAAYFSGTDTNPAHVDAAGRLRIRPYHDFGAAGHGCTLPTCPPNMCKGKVMERILRQEEEEEEEEAVSAAAGTEKRRRRRRAVVYLGDGRGDYCPSLKLREGDYVMPRAGHPVCDLIAASPPAAAVRGWAGFEDLARVLLRIVDGEIARAAAAAEEEDAGAGAGVGVGAVVVVPADCRAPRQEALMPQAVRVPN

SEQ ID NO: 37969 - protein, 159 aa, Sorghum bicolor
  Clone ID: SORBI-28MAY03-C42218_1.pep
HEGHVQDAKHELSQDVTNKLKSPHSENFDADKNCWAAAAQYVAHGILESEEQIDTSSNAMPECVGYAGTYQVSEEEQVILAPESSEGSAVMYSTTTVSGSYLDVKMQFPKLSPGETSMKKSIIRKGIEKLPTAYLPQRNTLSGQKLGPYKVPVADGSVS

SEQ ID NO: 37970 - protein, 140 aa, Sorghum bicolor
  Clone ID: SORBI-28MAY03-C42807_1.pep
MKWLCCNCHVDDEEDGHDMEQAKTQSNKIDPKQKSSKPPVSQPEPEFSPPTIDVPELSLDDLKQKTDDFGSSALIGEGSYGRVYHATLDDGRQAAVKKLDASENEPNDEFLKQVSLASKLKHENLVEMLGYCVDGNYRIL

SEQ ID NO: 37971 - protein, 136 aa, Sorghum bicolor
  Clone ID: SORBI-28MAY03-C4167_1.pep
ELDNASVRRHNGCQRASMLSEGHPVMSFIDNNQQTFKLDADAQDDSCTSFEAHQVGVEGGTHTDIADGSHYRSDGFGGGAEHGFLGDHCDTKEWDFGFSTGWEKHDFLSTNNVIEEVFGKGSSEDGSDTATGQGLL

SEQ ID NO: 37972 - protein, 139 aa, Sorghum bicolor
  Clone ID: SORBI-28MAY03-C41689_1.pep
MVRPITVNDIVEECKTFFFAGKQTTSNLLTWTTVLLAMHPEWQELARQEVLQVCGARDIPSREQLAKLKTLGMILNETLRLYPPAVATVRRAKTDVELGGCLIPRDTELLIPIMAVHHDARLWGADATQFNPARFAKGV

SEQ ID NO: 37973 - protein, 187 aa, Sorghum bicolor
  Clone ID: SORBI-28MAY03-C41697_1.pep
MSAADPSAAPVAAAVADPDGPDAVRLTWNTWPRSKVEASRCVVPLAATISPARVPDPSAASPPPLPYPPLRCKPPCSALLNPFARVDFAAKIWICPLCFSRNHFPPHYAAISESNVPAELFPQCSTVEYIVGGAGVPGVGSAPAPPPPVFLFVIDTCVIEEELEYVKMAMRKAVALLPEHALVGLVT

SEQ ID NO: 37974 - protein, 137 aa, Sorghum bicolor
  Clone ID: SORBI-28MAY03-C41709_1.pep
MSARDRETAEALVRLAASLDGAVLGLGTAAVAVASWVKYLAVSGQLRLVASAATASIGDARSLLRGDGNEPRIAAVRGYVRTHGSFLRAPFSSEAGVVVKHTQMCLFTEWRGIFGWTFDLHALLFRSWKEQIVTSFR

SEQ ID NO: 37975 - protein, 130 aa, Sorghum bicolor
  Clone ID: SORBI-28MAY03-C41742_1.pep
TTLQKSASVTAAIAGAQAAATQFSKKDLKDATSSETGTQEQSWASHGDSSSVDGNVPSIVHGSTAYLQNQNQPSSFQSTPAYSQNPNSKPRRSPRLEFGGASNRLVAVALSELKQLSLSKNRAGQAVPRS

SEQ ID NO: 37976 - protein, 172 aa, Sorghum bicolor
  unsure (1)..(172): unsure at all Xaa locations
  Clone ID: SORBI-28MAY03-C41745_1.pep
GRNDVGKVSKPGSVKVEKLMNIERYSXHVMHISSTVSGQLDDHLQSWDALRAALPVGTVSGAPKVKAMELIDKLEVTRRGPYSGGLGGISFDGDMQIALSLRTMVFSTAPSHNTMYSYKDADRRREWVAHLQAGAGIVADSCPDDEQRECENKAAALARAIDLAESAFVDKE

SEQ ID NO: 37977 - protein, 56 aa, Sorghum bicolor
  Clone ID: SORBI-28MAY03-C42704_1.pep
SRIRQYRSSHWPLVMAMTSEQNVWEKCAQSGINGVLKKPLVLQEVKEELTRILQNT

SEQ ID NO: 37978 - protein, 277 aa, Sorghum bicolor
  unsure (1)..(277): unsure at all Xaa locations
  Clone ID: SORBI-28MAY03-C42729_1.pep
ARGLGPPAPRGRRLLPPSPPPLPPLPPPPPPRPLPARAACPSRRPPAPSPSSASPAASAAPPSFAAPGPSYLPARLLRLGHTLGRDPSFRRSPPFCPSSMADRLLCKLPTAASGVQMGPFVPSELAFAVCSDGSSFGLLGLIVRLGXAYALIDGIEDILCCLKKNNYEMHAFTNYPVWYQLIEDKLKLSKYLSWTFCSCKTGKRKPSPEFYLQALDQLNVDPASCIFIDDRMLNVEAALSVGMIGLQFKSAKALQEDLCALGVELPPLVCEGEAQVQ

SEQ ID NO: 37979 - protein, 124 aa, Sorghum bicolor
  Clone ID: SORBI-28MAY03-C42767_1.pep
ITIPGALVSGNWNEYNLNPLTRIHWRASLEPPDLTRCASAARISLSPQEAEDFEPKIRQVVDWFGQLQAVDLESIEPSLRAGTTADSSLREDKPETFDNRDAIVEAIPSYDDPYIKVPRVLNKE

SEQ ID NO: 37980 - protein, 147 aa, Sorghum bicolor
  Clone ID: SORBI-28MAY03-C42768_1.pep
VAPWGSLLPYFGFLVCHGRLVPTPLFSKAPIGRPLSVSGGICAGLLLDSLGQPPLVPVCGLLHCLKLCEFSGSAVTPSLGLAVGALGALVLSFCAELLWCVPPPLRILVGLVLDGSPAALSGIKGGDLISTLDGVALSNAQEVLYIL

SEQ ID NO: 37981 - protein, 187 aa, Sorghum bicolor
  Clone ID: SORBI-28MAY03-C41939_1.pep
MDGPRWTEEVDDLVDAGDVDGAIALLESVVSNLSTSAAAAPPAADLRLATALGDLAGLHASRGNTLRADELRARAIVLRSRAAAPGALGDKEPSEKCSSQESLMGLKDSEGSANTDDKNNEDEEDDWESIADCGALDDTLARSLEQEARVPSCSSSERSGTPSSGPKRRGRGSFLYNKSVLYSDQCG

SEQ ID NO: 37982 - protein, 181 aa, Sorghum bicolor
  Clone ID: SORBI-28MAY03-C41966_1.pep
MRGGYSGRGGFAFAGGRHSSSRSNDGSGYHGNPCLTMHQPWASLLVHGIKRVEGRSWPSPITGRLWIHAASKVPDPDTIKAMEDFYREIYAVNGITDIKFPDHYPVSRLLGCVEVVGCLRSEELVCWEHVPESVRLEGLTDFCWLCENPQKLVVPFEMRGYQGVYNLERRIYDGAVKGLSP

SEQ ID NO: 37983 - protein, 272 aa, Sorghum bicolor
  Clone ID: SORBI-28MAY03-C42007_1.pep
MTMDPAPAANGAAAVAGGGMKRQGGRWWYAAAGALIVALLAVAVSFYSFRGIPSSPPGGCGCPAARHDAGMVEDCCCDYETVDAINEEVLHPILQELVKLPFFRYFKVKLWCDCPFWPDDGMCKLRDCSVCECPENEIPEPFKKPYSGLSPDSMICQEGKPQAAVDKTLDSKVFKGWVETDNPWTSDDEADSNEMAYVNLQLNPERYTGYTGDSARRIWDAIYKESCPKFPSVVLCPLWRAVYKLISGLHSSISVHIAYDYLLDESTNSWGQ

SEQ ID NO: 37984 - protein, 84 aa, Sorghum bicolor
  Clone ID: SORBI-28MAY03-C42034_1.pep
GLFIINLVSRSSSVREMVVSRLKAVFEHLYSLQLEEDINEVLFASPSERYLEINNLDAGASKLQELLKIPVDVESDIQKLQKLQ

SEQ ID NO: 37985 - protein, 115 aa, Sorghum bicolor
  Clone ID: SORBI-28MAY03-C42059_1.pep
LPGCCETRRLLPFVLALVRRFVLASLVPRRGGCGALTGPLSTPLDVMKTRLMIQGQANQYRGFIDCAQTIMREEGAGAFLKGIEPRVLWIGIGGSIFFGVLEKTKSVLAQRNIRR

SEQ ID NO: 37986 - protein, 192 aa, Sorghum bicolor
  unsure (1)..(192): unsure at all Xaa locations
  Clone ID: SORBI-28MAY03-C421_1.pep
RPQTRGQTLVRKRLHLSLGSAMAVGCFNPVLSPLVPSPPGRRVRAALRSQSHQPTAVSLRLLPCGVAAGRGTRRLVAAAAAESQAVQEQPARTEESGEAGGGGAAEASSKLVLVVGGAYRVRGSWLSSHGWKHTTCQVNIKVLGTWTETXXHXFHIPYYSTWVTLNISSPNRPHVIQALFFLNISSHLCMRI

SEQ ID NO: 37987 - protein, 146 aa, Sorghum bicolor
  Clone ID: SORBI-28MAY03-C431_1.pep
IMVSNPAIQFMLYETLLKKLKKRRASNLKGADGLTALEIFLLGAVAKLGATVVTYPLLVVKARLQAKQMINDDKRHRYKGTFDAFTKLVQYEGLTGMYKGMGTKIVQSVFASALLFMIKEELVKGARLLVTGNTSLVKKLPSKPSR

SEQ ID NO: 37988 - protein, 276 aa, Sorghum bicolor
  Clone ID: SORBI-28MAY03-C43117_1.pep
TRLRSCWTEFSSIESDKLENLVVCNCIKQPVDVFAIRARRLASLSVNLSIPFSLYAGNSLVRASLSWYWKPEKFSPRSGAMLLGSLFNVTSFEWKGFQATAVLDEVFDEVPIFHNLRNLSLNSCFINTTKSGVCQLKALGRFLHKSPNLEELTLKSFKVVPVVEHVDFPILKNLRTLCLHFCILNDNFQILLHCLRNSPNLEKLKIAGCKLSDDSMGGKGKAKSKKTYSRNLACFQCLKLEYAEISGCEKDASVPELVSFLLAFAAPTITIKVSSL

SEQ ID NO: 37989 - protein, 192 aa, Sorghum bicolor
  Clone ID: SORBI-28MAY03-C43134_1.pep
MLSATIPAHPAAATPLRRRYPLRPRQPLCAPIGTAATRQWMATARLSATNALANLSVESAPAAPPKFSFPILVNSCTGKMGKAVAEAAVSAGLQLVPVSFSAMEVPDGKIEVCDREVCIHDPSESEKILPSIVKEYPDLIVVDYTVPDAVNANAELYCKLGLPFVMGTTGGNRQLLHKTVHDANIYAVISPQ

SEQ ID NO: 37990 - protein, 115 aa, Sorghum bicolor
  Clone ID: SORBI-28MAY03-C43248_1.pep
HEPRPPAYAIFLSLGSPVPPRAFSLSRAISLVATSGRPPPPPPPTPKSSLGPYPGVFGGLRRRRAHIRFLVACSGSDLCFIRNYCSIYRSMLCSGASSLDNSDGFVSEISMWLKI

SEQ ID NO: 37991 - protein, 144 aa, Sorghum bicolor
  Clone ID: SORBI-28MAY03-C43152_1.pep
MATAAQVAATFLSFLSSSSSSTHHPAPSSSVSLVTNPVLPVSLRAAGPRLASRLRGRRVGAAVAQLPTAHPEVASGEKKIRWSSRAVRSFAMAELEARKMRYPTTGTEGLLMGILVEGTSGAAKLLRANGTTLLKVRDEAANVL

SEQ ID NO: 37992 - protein, 204 aa, Sorghum bicolor
  Clone ID: SORBI-28MAY03-C42266_1.pep
HEAQACLPLINAALDDIVKGTFLRGCLLNIGIPSAPSANKGFKLTKQSGYSPAQSWQAVSASRPSSATHFMGMHQSLGIQLAQLGKDASAAGAARRVSAQRKTVEVESVAASGKQEIREVVKKLFRAEFVEKQHEGLDEDIDLRALENGFISVTPLNVHGQVEPEMGAPASDWLSAAVSLDKEKDAAPAAAEQQDVAAEEKEAP

SEQ ID NO: 37993 - protein, 239 aa, Sorghum bicolor
  Clone ID: SORBI-28MAY03-C42293_1.pep
SLIMLRLFSLVLYYPWELWDSRQSINPPVSDEVLCKEKHCERIKFFCLDSRNDQGQTTQEKDNLIRSCPVILLKHAREGMPALGWSIILPLSWVKPFWLFLVSHGARAIGLRERRWIASKFRMPCFPYDYPDSKAYAARASKEAADFDKVSERCPVAKRPPRVPVPPLWHCIMTSFHKDDVILGFPEVDDLVRANMILPKSLSVHSKSGDAEPLQANVASLQLHVPRTAQMLRPICGRI

SEQ ID NO: 37994 - protein, 285 aa, Sorghum bicolor
  Clone ID: SORBI-28MAY03-C42320_1.pep
ARGAGADGSASPAYLAPPSPAAPAAPPAAATGARSRAQGEIDFGVVVDKRRRLSPEEDGSAGCSNSAVADGDNNHVVSVQRARSSEEEEEERPRKGASSSTTPSCQVDGCHADLSGARDYHKRHKARGAHTRTTVVCIKNVEHRFCQQCSRFHLLQEFDEGKKSCRSRLAKHNGRRRKVQPQAAVNGNSMNENQSLSSALFLLLKQLSGLESGSSSEQINHPNSLVNILKNLTAIASTQSYQDILKNANSNSIPSNAANNAANGSIMHEQTIRSTPIGRESLAEE

SEQ ID NO: 37995 - protein, 136 aa, Sorghum bicolor
  Clone ID: SORBI-28MAY03-C42460_1.pep
MDAARARAPLPSSLAWLAVLLLLVVATTTPGRVGAASSAATSASEAAAGCDCGGAAEAEAAIIKEEDARGALRLKLIAVASILASGAAGVLVPLLGRSASALRPDGDVFFAVKAFAAGVILATGMVHILPAGFDAL

SEQ ID NO: 37996 - protein, 161 aa, Sorghum bicolor
  Clone ID: SORBI-28MAY03-C42352_1.pep
MDSRSGHGAAVAAVVLVSWLCFAAAGVGGTRANWGTQASHPLPPETVVRMLKDNGFQKVKLFDAEEGTMNALRKSGLEVMVGIPNDLLLTMATSMKAAQGCVAPIASGRRTPGRPGPVVAVGFGPFVEADKGTLPRTSVPPCGIFPGARLPAGLRNLGTSN

SEQ ID NO: 37997 - protein, 212 aa, Sorghum bicolor
  Clone ID: SORBI-28MAY03-C42652_1.pep
RIEESMSVVNNEILRRHFLELTTNFLAPFGPYLRTTTPSEGSSPFVDPPLLPPFHADEFINGLAARGPGKFLSKRMRSNWLDLYRRFLEGPNFMPWFRQRRAAAEQEQQRLWRQARMNVDIEKLMSNMSELERIDSFNAVERYLLREMENPGKGTDPIGACQKLKVDLQAAFNVLPKDMQQLLLSNPKRAVLLQGSQEKALGPNGIVTQTSL

SEQ ID NO: 37998 - protein, 162 aa, Sorghum bicolor
  Clone ID: SORBI-28MAY03-C43398_1.pep
DPDEHPKLASLGMQLATELKGSFLGANILGEMLRSNPSAQFWHAILSSVRALVQEHMFSLGVHPEDLLERNVPVGFTNVSLVGAQSQGCLVYDLREADPGQEELPLPTSREVLTGVKVPAEEKFDVLVDGWNWKFSYDGMLDVPAWKSLHASLLSATISLPH

SEQ ID NO: 37999 - protein, 182 aa, Sorghum bicolor
  Clone ID: SORBI-28MAY03-C43393_1.pep
QDLYTPPNSRFHSVDGAFFGTTFGCLFFMTFPDLDIGPRLDESITPALQQRYPGLTASAASRENVNQQFEINGMRTANFSPGLGPGKIYESRMYGFRVSERSRVGPRMKWLRMKPTDIRELDEMAFVETLRRRNKQIAEEEGDEEEDSDTEMQAAPASNTIEGRKKAPIRRRRKVWGSRGNK

SEQ ID NO: 38000 - protein, 123 aa, Sorghum bicolor
  Clone ID: SORBI-28MAY03-C43537_1.pep
ELEMLLEAYFVQIDGTLNKLSHLREYVDDTEDYINIMLDDKQNQLLQMGVMLSTATVVITAGVAVVGLFGMNIGISLYTDPTTEEETRAANRKFWETTFGTVAGCVILYIIAMGWGKRSGLLQ

SEQ ID NO: 38001 - protein, 153 aa, Sorghum bicolor
  Clone ID: SORBI-28MAY03-C43514_1.pep
SPSGDPLPKSLEELEQVLMLGLEKQLPMVVANPDYVTVEARDLRVMPGTLAAKYESLGGEVKWMGKPDKMIYTSAMSLPGVDAHECIMVGDSLHHDIKGANVSGIASAFITGGIHADELGLGEFGETAGKDAINSLCSKHGSYPSYVLPSFTW

SEQ ID NO: 38002 - protein, 117 aa, Sorghum bicolor
  Clone ID: SORBI-28MAY03-C43531_1.pep
VDRIDAHNRFTHRLYRPSTVTTEYREHVKDLSCLSKDFQRIVLVDNNPYSFLLQPLNGIPCITFSAGQPVDDQLMGTIFPLLEHLALQKDVRPGTRETFHMPEWFQRQGIPQTEQAV

SEQ ID NO: 38003 - protein, 94 aa, Sorghum bicolor
  Clone ID: SORBI-28MAY03-C48234_1.pep
EFPVNTLYRRGGGDPRALEQFCRDTVMTIWHYHGGCQVGRVVDRNYKVLGVEALRVIDGSTFNASPGTNPQATVMMLGRYMGVKLLKERMLLEP

SEQ ID NO: 38004 - protein, 149 aa, Sorghum bicolor
  Clone ID: SORBI-28MAY03-C48236_1.pep
HSIGQGHCSSFRGRLSEPSSQITPAYRDLLNYKCSQGSNPPVDNNVRDEDYDVVAKFAAGFTSRVRKIPDFLDNSFYHNNLAKIVTFHSDWTLLTHKEALGHVVEYAENGTLWDEDFSESLLKLSKLPMPAGSKGEIRKKCSVVNHRLY

SEQ ID NO: 38005 - protein, 193 aa, Sorghum bicolor
  Clone ID: SORBI-28MAY03-C48250_1.pep
ARGTSFASLPGMWERTLTVNGFSKAFAMTGWRLGYLAAPKHFVAACGKIQSQYTSGASSISQKAGLAALNLGYAGGEAVSTMVKAFQERRDYLVRSFRELPGVKISEPQGAFYLFIDFSSYYGSEVEGFGTIKDSESLCLFLLEKAQVALVPGDAFGDDKGVRISYAAAMSTLQAAMGKIKEAMALLKPPVAV

SEQ ID NO: 38006 - protein, 186 aa, Sorghum bicolor
  Clone ID: SORBI-28MAY03-C48279_1.pep
TRYPWRNFDNYFFGQHDPDSLLSCRHDGFYHQAACSCLHCCHQEFLPVQGNHMGFNDQRAPYLLNGYGAYPVDSPLLGQQRYSRRAINTTLQQNHMRVNVSKKPAQTCEPVAGGAPFTICCNCYEVLQIPRKQSLSGNEYKLRCGSCSHAILVKLDGNRLNVSEIALGTHLSDGQENDMGTDGQTP

SEQ ID NO: 38007 - protein, 290 aa, Sorghum bicolor
  Clone ID: SORBI-28MAY03-C48298_1.pep
TRPLSSFEYGTILALIESDAEGIGGSGFVECIREHIHSGWQCRLTDEQFIAVKELLKMPVALANSRNDLATIRDALEVSAEMYRKDPNNVQDYVQRHLLSLSVWEELRFWDGYFEYLMENCSNKSANYVTLVTAQLILMATHMAGLGLPDIDSWNMIEKIAERNNLGYKQLIKLRALLTHLQQLRIGYWGVATGKSQPLQSYGMASPHAIDVSDESQQPAEASGLGRSWVQSMFSRDRSLRATSFNRASDANAVATTGKTDISAAQKKTQTNMRTLRGHTGAITALHCVT

SEQ ID NO: 38008 - protein, 183 aa, Sorghum bicolor
  Clone ID: SORBI-28MAY03-C48335_1.pep
MASTSGDTSAAEALRRGRILSSRLYLDGVPSSKAPVVYSPAYDIEFNGIEKQHPFDSAKWGRVRNFLVDAGLLQNDRIIEPLEASEDDLLVVHSESYLNSLKSSAKVARIVEVPAVALLPNLLVQQKLLYPFRKQVGGSILSAKLALERGCAINIGGGFHHCSAEEGGGFCAYADISLCIHFA

SEQ ID NO: 38009 - protein, 260 aa, Sorghum bicolor
  Clone ID: SORBI-28MAY03-C43717_1.pep
MASPPPPEAAPAEAGLESMEGLVLDTVISRAGARPAAALACASTRLRTAVADDSLWRRFCAEDLGLDAPVDPEGQPLPSFQVAYKVWLESFGMYPLPMVKRVKQFWTSMKTWLSENFPEAYKTLCKGVSEAQLKSAEDDLGFKLPMPTKLLYRFCNAQLPFSEDHDANKSISTHGLIGGYAFYDHWVNVHLSPLEQIVEETKDFYREFPDVFNGRNFIVVATSWFRPKTFLLDCSNGELYVGTYNLPIGGMLPCVPKALI

SEQ ID NO: 38010 - protein, 134 aa, Sorghum bicolor
  Clone ID: SORBI-28MAY03-C43786_1.pep
APIGSKESQIHTSTQLPVPGTNAASNICTKPVFFPNQQSRTQPSTQKLRTQASTQKLRRHQAARTAWNHRPAWLSHQTSRQPPDSLSILTYEIIGTGVCVSPTEAEERTGELGDKDRRSEGGKTGEGIKGDPRA

SEQ ID NO: 38011 - protein, 234 aa, Sorghum bicolor
  Clone ID: SORBI-28MAY03-C43889_1.pep
MASASRALLLSRALQAGAASRRVPTLLRPLAAAASLLPAAAAAAAPGAGVRCFATQPATSSLRDSSPNCTRRPPKETILLDGCDFEHWLVVMEPPPGDASNPDITRDEIIDSYIKTLAQIVGSEEEARQKIYSVSTRHYFAFGALVSEELSYKLKEMPKVRWVLPDSYLDVKNKDYGGEPFINGEAVPYDPKYHEEWVRNNARANERSRRNDRPRNFDRSRNFERRRENMQNFQ

SEQ ID NO: 38012 - protein, 256 aa, Sorghum bicolor
  Clone ID: SORBI-28MAY03-C43893_1.pep
LPVRPLPLPPPRPPPAPTTAAPAPGPRPRPARARSPPGPPRTPRCRSGPSGGPGGLAPPGLAGVRRGLAPGGRAPLALLLGPGVISLSQGSSLPRTSLHDYLPAGVTGLGKRSSSEHADGNSSGAVVGEELSQGGREPLVEQNGQGGDANSSQTSAVTGKLDDNEPDPVASSDATAIPDESQKAEQDTCDLYRGEWVTDSSGPRYPIDSRPCIPRARSCPANPRPHKDSQVARRVPEQCDLPRFDARKFLELMRGK

SEQ ID NO: 38013 - protein, 84 aa, Sorghum bicolor
  Clone ID: SORBI-28MAY03-C43927_1.pep
NKNASMQHGICQQMNLRYSYAHVLHYLPVQTNKSCFRKTHGIYKDFTLCCIAVECSTPVTVSKVTAFAHVLGLQEIMVIPCLLL

SEQ ID NO: 38014 - protein, 360 aa, Sorghum bicolor
  Clone ID: SORBI-28MAY03-C43135_1.pep
MCLQHSRARLSPDEQLAAERSFALYCKPIELYNIIQRRAVKNPPFIQRSLLYKIQARRKKRIQITVSLSASANTQAPNIFPLHVLLARPTSNISLEGHSPIYRFSRVCLLTNFSEFGNKGKTEATFIIPDVKNLSTSRACNLNIILISCGQVGQIIGEDSCSGSTRERSSLQKLEGKCSWGKIPTNVLASSLEKCVTLSTGDAVDLASTVTMSPSFLEPKFLERDRCLTFCSHKVDATGSYQLEVCISAEEAGARELLLSPYYCNYSYDNVPPSLLPEIIRLRAGNVLFNYKYYNNTMQKTEVTEDFSCPFCLVPCGSFKGLGCHLNSSHDLFHYEFWISEECQAVNVSLKADAWKTESV

SEQ ID NO: 38015 - protein, 148 aa, Sorghum bicolor
  Clone ID: SORBI-28MAY03-C43260_1.pep
MQPDQPVISLRPGGGGGGPRAGRLFSPAFATSGSGDFLRPHGGGASGISKIGESHFEPRERVRYTRDQLLELREIGDVSEDILRIKQEIDVELHGEDQSWVRNDSAIQGQAQAQAQAQAQAQNRYAETDNRDWRARSAQPPPANEEKS

SEQ ID NO: 38016 - protein, 275 aa, Sorghum bicolor
  unsure (1)..(275): unsure at all Xaa locations
  Clone ID: SORBI-28MAY03-C43294_1.pep
RSPPLALGRPFCESEDSGMEVEATPTTAVSSSGGAAQLPPPGPPAKKKRALPGMPDPDAEVIALSPKTLLATNRFVCEICNKGFQRDQNLQLHRRGHNLPWKLRQRSGKEARKRVYVCPGPSCVHHDPSRALGDLTGIKKHFCRKHGEKKWKCDKCSKKYAVQSDWKAHVKTCGSREYRCDCGTLFSRRDSFITHRAFCDALAEESAKGAGGGASRGGRELGSRRSSXPVPPPPPAPAPLRQQPPPPAPHHAEQRNEPEANATEPVQFAPPPPQV

SEQ ID NO: 38017 - protein, 198 aa, Sorghum bicolor
  unsure (1)..(198): unsure at all Xaa locations
  Clone ID: SORBI-28MAY03-C43319_1.pep
MEAAAASARVLRVAAICGSLRKASFNRGLLRAAAEVCEDSIPGLRVDELDISDLPLINTDLETGGGTGFPPAVEAFRAKVCQADCFLFGAPEYNYSIATPLKNALDWASRGKNCWADXPAAIVSAGGGFGRGGSQYHLRQVGVFLDLHFINKPELCVQAFQQPPKFDSDGNLIDAEIRERLKQVLLSLQAFTLRLQKD

SEQ ID NO: 38018 - protein, 151 aa, Sorghum bicolor
  Clone ID: SORBI-28MAY03-C43380_1.pep
DFAAPSSQMGIQDRTHPGPFFPPSNQNPNQGFQRPFDGRPMNMMGQPRMHPPPPHFHGAFSRNPSPLEFPAGFQGVWPAVQAPHMPAPSNPSNFLPSRTFQLRPPPQQDMSGAGGNRQGGNQIYNPFAPTAAQRTETDPEYEDLMASVGVK

SEQ ID NO: 38019 - protein, 76 aa, Sorghum bicolor
  Clone ID: SORBI-28MAY03-C4334_1.pep
RRVRQMKVLRQDRNTVCFIEFEDVGAATSVHQTLQGAVIPSSGRGGMRIQFSKNPFGRRKDSAGGLASVLNGAPVN

SEQ ID NO: 38020 - protein, 189 aa, Sorghum bicolor
  Clone ID: SORBI-28MAY03-C44069_1.pep
PRPRASALAPSGPGAAATRSPPWTTAETAAMDDRRDRGHKRLRSHCLSLERPRPDRFVLAPSPAIALALTPPLRILVLTLVPQSPAIALVDSDVAMVDCNAEWAALAAMATTVPAPAPIQAITIQQREGMETFWMELPRLILLFRITNLSSLCRSRPRLQLLQRRTMVSPWWTCCHCATTTTLMAFELR

SEQ ID NO: 38021 - protein, 157 aa, Sorghum bicolor
  Clone ID: SORBI-28MAY03-C44087_1.pep
SRLTAFELVHEKIPATLIADSAAAALMKQGHVKAVIVGADRIAANGDTANKIGTYNLAISAKHHSVQFYVAAPVTSIDLSLPSGDEIVIEERSPKELLNSEGGLGKQVAASGISVWNPAFDVTPANLITAIITEKGVITKTDADGSFDIKGFLQPAK

SEQ ID NO: 38022 - protein, 89 aa, Sorghum bicolor
  Clone ID: SORBI-28MAY03-C44225_1.pep
MHTWFIIYKPSLYSSSHASTPHHTGTPRSAREGRCGCEVGEGKERQGGAAGKMFDDQDLGFFANFLGIFIFVLVIAYHFVMADPKYEGN

SEQ ID NO: 38023 - protein, 114 aa, Sorghum bicolor
  Clone ID: SORBI-28MAY03-C44175_1.pep
MATATALSLSGGGGGTPLLRGHAALASGRCCAFPRSRWRPPRLSASRADDSSPAPFEMTVEGALKLLGVAEGASFDEILRAKNSVLASCKDDQDAVAQVEAAYDMLLMQSLSQR

SEQ ID NO: 38024 - protein, 156 aa, Sorghum bicolor
  Clone ID: SORBI-28MAY03-C4427_1.pep
ACAEPSAVPATDSDKASPSNATGAGAAHPKVKKEKRSVDVDRSLPFKKRCKVVQVQQDHAAAVAAPAAATDRPAVVVQQAATAAEVGDDDSCPSRDLLVDHIGGLISWSRSPPAAPASADAASCSFRTSPALPVQQDEITDAAMLLMTLSCGLVQS

SEQ ID NO: 38025 - protein, 122 aa, Sorghum bicolor
  Clone ID: SORBI-28MAY03-C43556_1.pep
EHPGGPGEKFMFTYSIRMSVPEACMLGGVYYSCCQLSSRHWTIRSCDRVVSDVSGGGVIGQYPVLLPGEDEFVYESCTPLPKVPGSVEGSFSFVPGKLIRPEGKPFEVMVAPFPLEVPEYIF

SEQ ID NO: 38026 - protein, 232 aa, Sorghum bicolor
  unsure (1)..(232): unsure at all Xaa locations
  Clone ID: SORBI-28MAY03-C4363_1.pep
CADAWVGKEKPVEESSPEYEKLGNXIFELENHLXXAQKQAYRLVKRHRELGQSLADFGKAIKLLGACEGDLMEKVFSEVGSKSEMLSIKLQREADNLLFNFEEPLKDYVRAVQSIKATMLDRANAFRQHFDLDQERKYKELNLEKLKFMNPEKYAEAESEFRELKADSEEATKKFEHIVRLMNEELARFQEQKTADIGLAFHEFAKGQAKLAKDIADAWRSILPKLEACSTS

SEQ ID NO: 38027 - protein, 343 aa, Sorghum bicolor
  unsure (1)..(343): unsure at all Xaa locations
  Clone ID: SORBI-28MAY03-C43700_1.pep
HEAGVKGSGVNGVVYASEPLDACSPLTIKAVKGPPSPFALIVRGGCTFDEKVKNAQDAGFKAAIVYDNENSGVLVSXNVAVAGSSSGIHIYAVFVSKASXEVLKNFSGHTDVEVWILPTARGSAWSIMGISFISLLAMSAVLATCFFVRRHRIRRDHPRIPEAREFHGMSSQLVKAMPSLIFTKVQEHDGTSSMCAICLEDYSVGEKLRVLPCRHKFHAACVDLWLTSWRTFCPVCKRDAMSGVSEFPATEATPLLSSAVRLPSRPSSFRSSVAASPPRPISRHPSSHSVSRAYSVSSTPQSPNPFRSRTNLPGIHTSRSTADLANMSSPHPRISHLSSAHSL

SEQ ID NO: 38028 - protein, 315 aa, Sorghum bicolor
  unsure (1)..(315): unsure at all Xaa locations
  Clone ID: SORBI-28MAY03-C43697_1.pep
FTVLSYXILADTYATSDTYSYCPTWALTWAYRRQNLLREIIGYHADIICLQEVQSNHFEEFFSPELDKHGYQALYKKRTTEVYTGSPQATGGCATFFRRDRFSHVKKYEVEFNKAAQSLTDAIIPAAQKKLALTRLVKDNIALIAVLEAKFGNHGTENPSKRQLLCVANTHINIHHDLKDVKLWQIHTLLKGLEKIAVSADIPMLVCGDFNSTPGSTSHWLLARGKVDHLHPDLAIDPLGILRPLSKLTHQLPLVSAYSSFVSMAGVGYDLDHQRRRMDPATNEPLFTNCTRDFTGTIDYIFYTADSLTVESLLE

SEQ ID NO: 38029 - protein, 96 aa, Sorghum bicolor
  Clone ID: SORBI-28MAY03-C4367_1.pep
KGWGYAYCDIRGYLAALDIMQSYYPERLGRVFLIHVPYVFMAAWKIVYPFIDDNTKKKFVFVADKDLDRTLREAIDDSQLAEIYGGKLKLVAPPAN

SEQ ID NO: 38030 - protein, 111 aa, Sorghum bicolor
  Clone ID: SORBI-28MAY03-C44421_1.pep
LKKLYRKTFKQEEIGNIPTLLIGSAAGAISSTATFPLEVARKQMQVGAVGGRQIYKNVFHALYCIMEKEGVSGLYKGLGPSCIKLMPAAGISFMCYEACKKILVEDNEDSE

SEQ ID NO: 38031 - protein, 81 aa, Sorghum bicolor
  Clone ID: SORBI-28MAY03-C44379_1.pep
HEGIAICALTFWIGDIIVTYTLPVMLNAIGLAGVFGIYAVVCILALVFVFIKVPETKGMPLEVITEFFSVGAKQAKEARED

SEQ ID NO: 38032 - protein, 175 aa, Sorghum bicolor
  Clone ID: SORBI-28MAY03-C44422_1.pep
MDRTYKGGIKAYWKRRGYYRIDAAAAQRRPPLPTAELGGGGVAQAPEDGSGRRHRRRRGWRVRRGQVLGRRLLSALSPRRWLMRLRDAYVSAMLRLASSAAVVGYGAAGGPYCANATHGAVVARPAQLKEYDEKVLVEIYRSILARGGPLPIAAVTTDGGDGAPAAATLRLPTAV

SEQ ID NO: 38033 - protein, 122 aa, Sorghum bicolor
  Clone ID: SORBI-28MAY03-C44597_1.pep
MVAEAEVMHQTPVPVLEVQYHRCVTTKGVEDVVGMSAAAAAAVAAPAEVGVEVEVEVEVEVEVAVEVPLMGLEQPDAAPSVSMDVLQFVPTIRSGSFADIGPRRYMEDEHIRIDDLSAHLGS

SEQ ID NO: 38034 - protein, 159 aa, Sorghum bicolor
  Clone ID: SORBI-28MAY03-C43899_1.pep
MSKKKAVTTMTLKDFHGGSIPSELPLPSAPGVTPRPADRTVASPSPVAAAVARPRVPVASPTAAAAAAAMPSFLTNPSRIGRHFDEDERTPFEPAAPRRPAPSPTSFAPAPVVALTRSGPGNAWGPRKEASPASSPVGPAPASAGGQIWSATRIAQASA

SEQ ID NO: 38035 - protein, 114 aa, Sorghum bicolor
  Clone ID: SORBI-28MAY03-C44019_1.pep
MEPPSSPAPLFLVVLFLLGSLLLQARADDPYRFYTWNVTFGDIYPLGVKQEGILINGQFPGPQIDAVTNDNIIVNVFNNLPVPFLLSWQGIQQRRSSWQDGVYGTNCPIPPGGN

SEQ ID NO: 38036 - protein, 169 aa, Sorghum bicolor
  unsure (1)..(169): unsure at all Xaa locations
  Clone ID: SORBI-28MAY03-C44048_1.pep
MNQPVQKNTLYVGGLAEEVDEKILHAAFVPFGEVKDVKTPLDQSTQKHRSFGFVTFLEREDAAAAMDNMDGAELFGRVLTVNYAFPERIKGGEQGWAAQPIWADADTWFERQQQEEEMQRLQAEHRAAMQAAEKLHQGEXLAAEREGEKEEETADPMAAAEAQAVKQSS

SEQ ID NO: 38037 - protein, 65 aa, Sorghum bicolor
  Clone ID: SORBI-28MAY03-C44031_1.pep
RLPAATSSAGTSTTSPLNTANILTGLDRSATSHHLHPPTPYGSDPIALLKAPAGGSSSSSTGRSP

SEQ ID NO: 38038 - protein, 47 aa, Sorghum bicolor
  Clone ID: SORBI-28MAY03-C44068_1.pep
TPPAAAAAAAGAGSVVPSHCQFFPAAVDRTSQSTWSTAAPLVTRELF

SEQ ID NO: 38039 - protein, 153 aa, Sorghum bicolor
  Clone ID: SORBI-28MAY03-C44072_1.pep
PTGPTPTSQYEHSSIPATVKKIFNLPQGFLTKRDAWAGTFEGVVQKRTEPRTDCPEQLPTPTRIRQTEADEEAKLSEFQQEIIQLASVLNGDHQLASLQDRIRDEMNVREGIDYMKAAVKRYFEAGASARRMGVDGEQIVKMRPSLTTRIQRP

SEQ ID NO: 38040 - protein, 119 aa, Sorghum bicolor
  Clone ID: SORBI-28MAY03-C44891_1.pep
DNLSLQCRHINSGKQKGKLISLSLLEEIITFTGVILTGTKIHRNHNPQREQGAKVTSGRSAARAGGCGLREEKQFGPQRAGRASGGGRKTEGATTRERPDVGTTRPENAATHTRQKARS

SEQ ID NO: 38041 - protein, 308 aa, Sorghum bicolor
  Clone ID: SORBI-28MAY03-C44893_1.pep
PESMPCPVVDKKSPNYAWFVRLGDRFMDATGIIANTADELEPGPLAAVAGGRCVPGRPAPPVYPIGPVLSLGDRSPSHECVAWLDAQPPGSVVFLCFGSLGWFDPSQVVEITAALERCGHRFLWVLRGPPSDASGSGAGAPDGAEHPTDANLDELLPEGFLERTKGKGLVWPTLVPQKDILAHPAVGGFVTHGGWNSVLESLWHGVPVVPWPLYAEQHLNALELVADMGVAVPLKVDRKRDNFVEAAELERAVRSLMDADGEQGRRAREKTADMKAVCRKAVEEGGSSHAALQRLAEALHHGAVIAKK

SEQ ID NO: 38042 - protein, 261 aa, Sorghum bicolor
  Clone ID: SORBI-28MAY03-C44903_1.pep
MVARRFVVRHGPAAAAGGSVEREEEEEHEVEYDTEHGLDVLRLQIFSLTARPPDLQKIVVEADGLVVDDGTDLETVSERLRLLAIGEEEEDAAAAARAQEKSDEEFARMLQAEEEALLLQQYSIQNDGGDVFRQRVEPYMHQVLMYEDPVGQEAARKTVPICELEEKALVSLAKEGNFNPSNDEEKHGFLLQLLFWFKQSFRWVNAAPCDSCGRETSNVGMGTPLTSEIKFGASRVEIYRCNHCSSITRFPRYNDPRKLIQ

SEQ ID NO: 38043 - protein, 257 aa, Sorghum bicolor
  Clone ID: SORBI-28MAY03-C44304_1.pep
HEGELGIIHTDLKPENVLLDSTINPAKDPVRSGFTPILDRPVGNQYGGTVISFSEKMLKMRARRAVAKISQRRVSIGGVGAQLEKERCLDGISLKCKIVDFGNACWADQQLAGEIQTRQYRAPEVIIGSGYSYSADMWSFACIAFELATGDLLFAPKNCQGCSEDEDHLALMMETLGKMPREIATSGTRSKDYFDRHGDLKRIRRLKFWPLDRVLVERYNFTEPDAKGFSDFLRPMLDFTPENRPSAAQCLKHPWLN

SEQ ID NO: 38044 - protein, 114 aa, Sorghum bicolor
  Clone ID: SORBI-28MAY03-C44315_1.pep
ARGWHRHRHRRGDHDPRGPEPTVRRHGRLRPVRSRQHRLQRRRQAARRRAARRCRPCPRHRRRRRTSPPLGGAPRGTVPTGLAGGHVTSAVATPPGSVHACLPCWVLIDQASSV

SEQ ID NO: 38045 - protein, 100 aa, Sorghum bicolor
  Clone ID: SORBI-28MAY03-C4432_1.pep
RPATRITIPEIRNHPWFLKNLPADLMDDSTMSKQYEEPEQPMQSMDEIMQILAEATIPAAGSRGLNQFLNDGLDLDDDMEDLDSDADLDLESSGEIVYAM

SEQ ID NO: 38046 - protein, 109 aa, Sorghum bicolor
  Clone ID: SORBI-28MAY03-C44338_1.pep
CLERPCTVAAEVCGHELCVKCALDLCSVIKSYDVPGIAGTIPCPLCRSGIASFRRRAADEDEPDVNAGGGRRRGAGGDHQASSSPEKKRSMDSDQEILPLFFTPPAVLS

SEQ ID NO: 38047 - protein, 247 aa, Sorghum bicolor
  Clone ID: SORBI-28MAY03-C44344_1.pep
TRRAIVFNRLEGIKDKVYPEGTHLMIPWIERPIIYDVRARPNLVESTSGSRDLQMVRIGLRVLTRPMPDQLPKIYRNLGENFNERVLPSIIHETLKAVVAQYNASQLITQREAVSREIRKILTERANNFNIALDDVSITSLSFGKEFTHAIEAKQVAAQEAERAKFIVEKAEQDKRSAVIRAQGEAKSAELIGQAIANNPAFLALRQIEAAREISHTIAASSNKVFLDSRDLLLGLQQLNVGGKQKK

SEQ ID NO: 38048 - protein, 102 aa, Sorghum bicolor
  Clone ID: SORBI-28MAY03-C44988_1.pep
LARLVLHELFMSHDTPAKFHVHRGSLSHNPSHSFCHCLYGFLLRFLSSLIPPRFHLPLSSFAKLIISNDIRCTNVWNFADFPQEVRHTMFVCTASNINLPSC

SEQ ID NO: 38049 - protein, 184 aa, Sorghum bicolor
  Clone ID: SORBI-28MAY03-C45066_1.pep
ARGSLPTGPQPATSPRSHLLLVAAISAPRPRLSPSRVSLSVSSPIESELPRGSSRSRKRTRQAYDYDAAPPPEREVVARGGVSPPWREDDRDGHYVFDLGENLTRRYKILSKMGEGTFGRVLECWDRETREYVAIKVVRSIRKYRDAAMIEIDVLNRLAEDEKYSSLCVQIQPDHLKYNPILFL

SEQ ID NO: 38050 - protein, 125 aa, Sorghum bicolor
  Clone ID: SORBI-28MAY03-C45107_1.pep
ARQRGNDAYLNLVQKKIDKHLGKGHVVLGVPSSICSVITDGVKPGDVSLEICRPMSAAVPSCLLCSRQARVYPNSTTKTFLYRPAMLTVMGVAVVCVCVGILLHTFPRVYAAPTFRWESLERGAM

SEQ ID NO: 38051 - protein, 200 aa, Sorghum bicolor
  Clone ID: SORBI-28MAY03-C45194_1.pep
MAQRSRSRSRARRDPDLDEDGSPPSRQPRPGAGDEDDEDDELGNEDLSLEIVARAQRKQRGASGAGVPGFADLLSVSSGDEEVDEDAVVELAEADEPRRKQKKKKERRKQRKKHRKEATEVAAAAVAVEEEEKEVCSTQEGPIGTADSVLTEDGADVPASDNMVLRKLLRIPRYFDPGETLLDTCFNCSEEGHVAANCPM

SEQ ID NO: 38052 - protein, 160 aa, Sorghum bicolor
  Clone ID: SORBI-28MAY03-C45111_1.pep
CGEEGHFARGCTKNAKSNRSKGKSSSHSQRKEKWKKDASARSAPHDARKTSKRKSPHFEERMDTPRHKSKSRGGWTGGDDDDLPLKKYKSNGWGSPSTPKKSYTNHQFLSGGDYFTPQSSRRHNHGTTSPSSNYSPSARKHGFSSSRFATSNTHVRFGKI

SEQ ID NO: 38053 - protein, 298 aa, Sorghum bicolor
  Clone ID: SORBI-28MAY03-C44654_1.pep
MAAAAGRKVAVAAVQFACTDVEAENVATAERLIREAHKKGAKIVLIQELFEGHYFCQAQRMDFFRRAKPYKGNPTIIRMQQLAKELEVVIPVSFFEEANNAHYNSVAIIDADGTDLGLYRKSHIPDGPGYQEKFYFNPGDTGFKAFKTKYATIGVGICWDQWFPECARAMALQGAEILFYPTAIGSEPQDGNLDSREHWKRVMQGHAGANLVPLVASNRIGRETVETEHGKSTITFYGNSFIAGPTGEIVKLANDKDEEVLVAEFDLDEIKSTRHGWGIFRDRRPELYKVLLTLDGEK

SEQ ID NO: 38054 - protein, 193 aa, Sorghum bicolor
  Clone ID: SORBI-28MAY03-C44655_1.pep
TCLALTDDQLIVGGSTFGSVAIADQTSGQKLGVLKSAYAPLAIRSLSFCTNSHMIFAGSSAGYAHCWHEGTLRPLWENRVSPNVIYSTRHLPGDTATLAVGGIDGVLRIICQKTGETIRCLVVDADRPAEAASRSRPQIEKKPVRRIDPDAQVDSIPRRLRPQITSLSVGMKKIVTTHGENYIRVWKFRPKSS

SEQ ID NO: 38055 - protein, 150 aa, Sorghum bicolor
  Clone ID: SORBI-28MAY03-C44732_1.pep
FLTDDSRLSLIMDSRIKGRFPTKAARIVADIILKCLHNDPSERPTMRDVVEALARVQEIKVPCRYPLQEPSAAPRKVMLKSTSLNGIVPHHPVITFSPSPPSHNQHLISPRSSTSALFHPRTCSSTLDDPGVSSIKKTPPIMRRSSVEGF

SEQ ID NO: 38056 - protein, 153 aa, Sorghum bicolor
  Clone ID: SORBI-28MAY03-C4477_1.pep
NCGDSRAVLCRGGDGAPPVPLSSDHKPDRPDELARIEAAGGRVIFWEGARVLGVLAMSRAIGDGYLKPYVSSVPEVTVTDRSDGDECLILASDGLWDVVSNEAACEVARPCLRRGRAKWCAEAAALLTKLALARRSSDNVSVVVVDLRRRNHH

SEQ ID NO: 38057 - protein, 150 aa, Sorghum bicolor
  Clone ID: SORBI-28MAY03-C44802_1.pep
MIKYPASLSVTAYSYFFATIFMVLTGVSATNGLHEWALTKTEVIAVLYAGIVASCLSYSIMTWANKILGPSLVALYNPLQPAFSTVLSTIFLGDPVYIGSIIGGVSIIVGLYLVIWARYNEEQRAPMDGYLDPLIVDNPRIPKTEEISFI

SEQ ID NO: 38058 - protein, 84 aa, Sorghum bicolor
  Clone ID: SORBI-28MAY03-C4481_1.pep
TLPSQSHSHAHTQPWFVASTVEARRCDPPRSGRCRSSCSFQLLIQARREHRPGAGASSSSNQGHRLRNAIPHHGRVLLFLLQIS

SEQ ID NO: 38059 - protein, 461 aa, Sorghum bicolor
  Clone ID: SORBI-28MAY03-C44871_1.pep
GGGLIVIGSMKWPLSRLLVYGSLNSDGESRRGTSENSNGTFKGGVGGGSGGSILLFLQWLLLEKNSSLSASGGNGGVYGGGGGGGGRIHFHWSNIATGDEYVQIASINGTIASSGGSGKNDGHLREDGTVTGKKCPMGLYGTFCTECPVGTYKNVVGSNSSLCSPCSVDNLPNRAECIYVRGGVTEPPCPYRCISDKYKMPNCYTPLEELMYTFGGPWSFSIILCLTIILLALVLSALRIKIGESDITYRATNAIHNDGCSSFPSWLSLAEVPGASRAEETQSHVHRMYFMGPNTFREPWHLPYSPPDAIIGIVYEDAFNRFIDEINLVAAYEWWEGSIHSILSVLAYPCAWSWKQWRRRKKIHRLQEYVKSEYDHSCLRSCRSRALYKGLKVGSTPDLMVAYIDFFLGGDEKRLDVASTIQKRFPMCLIFGGDGSYMSPYYLHSDTLLSNLLGQYVSTAI

SEQ ID NO: 38060 - protein, 185 aa, Sorghum bicolor
  Clone ID: SORBI-28MAY03-C44857_1.pep
SNVTLLILILLQITEEDSYFSYLPLAHIFDQVIENYCISKGASIGFWQGDIRYLMEDVQVMKPAIFCGVPRVYDRIYTGINMKIQSGGMIAKHLFQYAYNYKLTNMKKGLKQHEASPFFDKIVFSKIKEGLGGRIRLMIAGAAPLPGQIEEFMRVTSCSVVVQGYGLTESCAGCFTSIANVFSMI

SEQ ID NO: 38061 - protein, 215 aa, Sorghum bicolor
  Clone ID: SORBI-28MAY03-C45396_1.pep
MVLGKVAIVIGSGIVGSVLTGGESGLPDFRDAISGAFKFLTEGAKQGKDGPSTSSPHTAQLLTQVNHLREELQMLSKSNHVAIVTVDGRPGPGAYGITAVVIGAIGYLFIRWKGWKLSDMMFVTKRGLSDACNVVGKQVDQVSESVNVAKRHLAGRIDRVDCSLDECREITEATREEVTIIHGDLSAFQKEMETVHLVVRSLETKLGRLAYTQDR

SEQ ID NO: 38062 - protein, 232 aa, Sorghum bicolor
  Clone ID: SORBI-28MAY03-C45407_1.pep
ARGEKPAAEDEVKESLTDNQEHGIGESNVNSVEQVTEECQQEKPAAADEVKESPLVNSMAPLYYAASLEDCTRLKQYTASTHQNLYAESPASTEDINISALTASVESEVATEKDGPVDSQVHETAALENVELKDDVSCAENEHNLSGSPVHLEDPLVPLKDVEKHDLTPAKDFVVSNTEDQQEARDIRLQVQDVDSMEDSGKVPDGTIEASTDDDLELGTADVEKHDQPNLL

SEQ ID NO: 38063 - protein, 87 aa, Sorghum bicolor
  Clone ID: SORBI-28MAY03-C45469_1.pep
EQRPELQSISLLLDYFIRELALRNNFEFVQAVLKLFLKIHGETIRRHSMLQNKVKKLLEVQSLVWQKIDKIFQGARCMVTFLSNSQF

SEQ ID NO: 38064 - protein, 65 aa, Sorghum bicolor
  Clone ID: SORBI-28MAY03-C45511_1.pep
VLVKKRRHINGSASVPQSPIGVLDATCFSFRSEDATLGSSQSNNISSSDNNNQASKRRRLSISPI

SEQ ID NO: 38065 - protein, 170 aa, Sorghum bicolor
  Clone ID: SORBI-28MAY03-C44915_1.pep
MASTGKGKVCVTGASGFIASWLIKRLLESGYHVLGTVRDPGNHKKVGHLWVLEGAKERLQLVRADLLEEGSFDDAVMACEGVFHTASPVITKSDSKEEMLNSAINGTLNVLRSCKKNPSLRRVVLTSSSATVRIKDEADLPPNVLLDETSWSSIEYCESLQIWYAVAKIL

SEQ ID NO: 38066 - protein, 252 aa, Sorghum bicolor
  Clone ID: SORBI-28MAY03-C44918_1.pep
MGKKKKRVDKVFCYYCDREFDDEKILVQHQKAKHFKCHVCHKKLSTASGMSIHVLQVHKESVTKVPNAKPDRESTEIEIFGMQGIPAHVLAARTREEEDPSAKMAKVEVPQVRPVIMPNSLGMAFPPRPAYGVAPPIYNPALNPLMARPPIWPGPPAQAWYPQQAAYPQQPAVSVPPVVAGLPPQQPLFPIQNVPTPMTSAPANVLQTSFPMAPPGVPSPVAPQVSQPLFPVNTSAVNGAASSPFLASVVPG

SEQ ID NO: 38067 - protein, 140 aa, Sorghum bicolor
  Clone ID: SORBI-28MAY03-C4496_1.pep
TLQALKGEILGDKIAFVEAYDESLAHLIYAGSDIILCSSFEDPSLQTAMKAIKYGSVPVQLNFPSDESRELEGHDCPNTAMSQYIISTYGDLSLSQTLDDFNNDPSHWDRQIKDGMARGSSWDMKCYNPSGDAYSSIRKL

SEQ ID NO: 38068 - protein, 158 aa, Sorghum bicolor
  unsure (1)..(158): unsure at all Xaa locations
  Clone ID: SORBI-28MAY03-C44976_1.pep
RNSKQRLAYFSKLRLRLLAVLVTATAGNVPNKLVAITHQLFKYHFSTGPQAGHSWYLTLIGYVIRHYCMAHDIASMPLQASIEDVXGSSHVPAKSDDWMSHGRPSICLAVQLFRHNLPCCFPDRRSTPLSHWNNIYLSKQSQYIWQLWGDLSLEMACH

SEQ ID NO: 38069 - protein, 230 aa, Sorghum bicolor
  Clone ID: SORBI-28MAY03-C44985_1.pep
FAVNRMFFPYAQAACFLVDHGLDVYHTDHVITQFGMPMGPFRLADLVGFGVAIATRKQYYQSYPGRCYKSMILQILVEDNRTGESSRKGFYVYDNKRKASRDPDLGKYIEKSRNMAGVMQDPKLMKLTDNDIVEMIFFPVVNEACRVLDEGIALKASDLDVASIMGMGFPSYRGGLMFWADSLGAKYVYDRLDAWSKDYGEFFRPCEYLAVRARQGVSLAAKVDGVKSRL

SEQ ID NO: 38070 - protein, 198 aa, Sorghum bicolor
  Clone ID: SORBI-28MAY03-C4499_1.pep
SDMLPPRITAKILELETVTQSEAIRKRYRFLSHFSLTTTFQFCEIDLSDIVSPSSLAPFLDEIKKREKQRRRTAKKEESERAKAEVAAAVQASAMRCQYANSPQSHNDVMFSLDDFEALGNNAGPSTSPRVSERKLFSDVTRLGFASAQDSPPLRLGTGDANGQSENSRDQGPLATPALSFASIISSSRAVAAADNSE

SEQ ID NO: 38071 - protein, 152 aa, Sorghum bicolor
  Clone ID: SORBI-28MAY03-C45641_1.pep
QVERKELEKQKQREEERMEMEKKRQQEREEERQRGREQYGRKGRNDVERDNKRKLIDDRYDPNSSGVREEGYKDRQNRDDNRWQEERVREEGYKDRQNRDDNRWQEEHGRHSRYMDSHDSKRSRRDDDLHYHSRRDYEQRYSRDEHRDRRRH

SEQ ID NO: 38072 - protein, 273 aa, Sorghum bicolor
  Clone ID: SORBI-28MAY03-C45651_1.pep
TRGSLGIHRLIESLKHYMAVKMNLGDPDFVNDNEVVSDMISPKFAAELKKTIYDNMTFAPKHYGGRWNILQDHGTSHLSIVDSERNAVSMTSTVNSYFGSLIHSPRTGILLNNEMDDFSMPANTTENSPPPAPANFVSPMKRPLSSMTPTIVVKDGKLVSAVGASGGSMIPAGTIEVFINHFVKNMDPLASVMAPRVYHQLIPNEVKYENWTTVTGDHFELDAATRADLQKRGHVLKPLAGGTISQLVVHNVGRQGDLTAVSDPRKGGVPAGY

SEQ ID NO: 38073 - protein, 117 aa, Sorghum bicolor
  Clone ID: SORBI-28MAY03-C45707_1.pep
DSSQEFQPRRISLLAPFSLGWRDKNKGKQNGTDESTNGKLNNNTDQGVETPKKDDEKKGDSPKEDSPKEGEQMIQTPQRDSEPRLETPKMDSEPPSVETTTSNMNGQEDQLEEIKLD

SEQ ID NO: 38074 - protein, 114 aa, Sorghum bicolor
  Clone ID: SORBI-28MAY03-C45733_1.pep
SEPFAQSLQLFQLFGHFGNQGISSCAVRDREPDPPFLPHILFPWHFALCVATASEGFWPGFSHLGCSKFSGEIFASTRFLAFLVILAALVTSPRKEFGGHGGPLRPVLVDFSGC

SEQ ID NO: 38075 - protein, 261 aa, Sorghum bicolor
  Clone ID: SORBI-28MAY03-C45774_1.pep
MPPAAATLLRRAPAVPFTARRTAVSRSGMARRLVTASAGAGGRAPAYGGLLLDAGGTLLQVAQPVAETYASIGRRYGVMKPEKRIMEGFKRAFSAPWPKTLRYQGDGRPFWRIVVAEATDCTDDDYFEEVYQYYAHGDAWRLPVGADTALRELKDAGVKLAVVSNFDTRLRKLLKDLNVSDMFDAIVVSSEVGYEKPAPEIFKIALDNIGVEASKAVHVGDDEAADKAGANAIGLECWLWGDDVKTFSEIQDRILTTDDPQ

SEQ ID NO: 38076 - protein, 176 aa, Sorghum bicolor
  Clone ID: SORBI-28MAY03-C4502_1.pep
MAAVMKALAVASPVSARAAQQPRRYVAGGASQLQSSFHGVSVQCPGRPRQATPRRGVQVVMMAARPSIQFIQGTDEQTIPDVRLTKSRDGTNGVAIFTFEQPSVFDSSAELGDITGLYMIDDEGVLQSVDVSAKFVNGKPARIEGKYVMRTPRDWDRFMRFMERYSQANALQFVKN

SEQ ID NO: 38077 - protein, 167 aa, Sorghum bicolor
  Clone ID: SORBI-28MAY03-C45252_1.pep
HEAGSYDSAGVAIFALLLTFYLFVRAVNTGSLAWALASAFGYFYMVSAWGGYVFIINLIPLYVLVLLVTGRYSQRLYVAYNCMYVLGMLLAMQIRFVGFQHVQSGEHMAAMGVFFLLQVFFFLDWVKYLLNDARLFKSFLRTTLTCVITVGTLALGIGTASGYISPW

SEQ ID NO: 38078 - protein, 101 aa, Sorghum bicolor
  Clone ID: SORBI-28MAY03-C453_1.pep
RPATDLITEHPAAPDYFAPNRALWQASFNAFFGLLTKYCVSKFDSMVHTMHKHPAAATVIHKELPVELLRASLPHTDEQQRRLLLEFAQRTLPVAGHSSDG

SEQ ID NO: 38079 - protein, 127 aa, Sorghum bicolor
  unsure (1)..(127): unsure at all Xaa locations
  Clone ID: SORBI-28MAY03-C45313_1.pep
RPRRPRAAAATRCSPTGSPPCSTQIVLSLFCHPPPTPPASXEPDGRPARGGAHPHGAAPRPQQQPPAPPPAPPXSAAPRAAGSPAPRPAPAPSPARAPAPAASPAPPAWRASSSTPSWCPATTPATR

SEQ ID NO: 38080 - protein, 143 aa, Sorghum bicolor
  Clone ID: SORBI-28MAY03-C45325_1.pep
TVLFMSVSPVHMQSEGWGSPNAIKCFSETQPAINYTKKLEVGTDWDLFVTAQRVTRSMKKVPVHFINITALSEIRKDAHTSVHTLRQGKLLTAEQKANPRKFADCIHWCLPGVPDTWNEFVYGHIVSSPPQQQQQITEDQPHR

SEQ ID NO: 38081 - protein, 301 aa, Sorghum bicolor
  Clone ID: SORBI-28MAY03-C45365_1.pep
MASRLSHQLSNGLYVSGRPEQPKEKAPTICSTAMPYTGGASKKSGELGKMFDLHVEKSRKSGPLGNAPSRNTSFGGAASNSGPVSNAGGRSNYSGSLSSSVPGAGGSARAKSNSGPLNKHGEPTKRSSGPQSGGVTPMARQNSGPLPPVLPTTGLITSGPISSGPLNSSGAPRKVSGPLDSAASLKMRATSFAHNQAVSNLNTEDGYSIQGSFPKPILWAVILLFVMGFIAGGFILGAVHNAILLIVVVVIFGFVAALLIWNACWGRRGAIGFVNRYPDTDLRTAKDGQYVKVTGVCTILV

SEQ ID NO: 38082 - protein, 316 aa, Sorghum bicolor
  Clone ID: SORBI-28MAY03-C45919_1.pep
HEEDIDEVVVVDRSFLHGDLVASASDPTGQMGLVLDVNLVVDLQGANGDTIKGVSSKDLRRIREFNVGDYVVSGLWLGRVDEVLDNVNVLFDDGSVCKVNRADPMRLKPAFGPIHPDTACPFYPGQRVKAVSSSVFKTSRWLNGLWRACRLEGTVTKVESAAVIVYWMASAHFATDQQPVPPEEQNPKDLTLLSCFSYANWQLTDWCLPHRHTSCTNDTMVNSDKHTRQICTCSQSSAPLSDIPESQVDVQAEQDQMTDTDAGHKQTDVDSTADGLSMSDGDNSCIAKESETGTSVSSIPKLGPQDNATSRKKFRK

SEQ ID NO: 38083 - protein, 133 aa, Sorghum bicolor
  Clone ID: SORBI-28MAY03-C45920_1.pep
SPPIPSPSPNLLRSCRPLVSPGFHLPRSLPRLPGLRPQCCYAAARGNPVARRTRQLADGLVSVPAPCPPISSDNRGRDCRKVHAVVHALPAIPWSCAPPTDQIDGGSQSARISLTPPVRAPALLQACVIIVFG

SEQ ID NO: 38084 - protein, 183 aa, Sorghum bicolor
  Clone ID: SORBI-28MAY03-C45951_1.pep
MSSLSRELVFLILQFLDEEKFKETVHKLEQESGFYFNMKYFEDEVINGNWDEVERYLGGFTKVDDNRYSMKIFFEIRKQKYLEALDKHDRSKAVEILVKDLKVFASFNEELFKEITQLLTLENFRENEQLSKYGDTKSARAIMLVELNKLIEANPLFRDKLQFPNLKNSKLRTLINQSLNWQH

SEQ ID NO: 38085 - protein, 143 aa, Sorghum bicolor
  unsure (1)..(143): unsure at all Xaa locations
  Clone ID: SORBI-28MAY03-C45998_1.pep
MFYSQFILAKKGPLGTIWIAAHLERKLRKNQVADTDIGVSVDSIIFPDVPIALRLSSHLMLGVVRIYSRKVNYLFHDCSEALLKIKQAFRSTAVDLPPEESTAPYHSITLPETFDLDDFELPEAAFQGDTDHHVSTXEQITLQ

SEQ ID NO: 38086 - protein, 99 aa, Sorghum bicolor
  Clone ID: SORBI-28MAY03-C51219_1.pep
TGYKAATTDYSLMATAKSYFRTLEPKGIHVQILNITELSDYRKDGHPTVFRKQFAPLTKEQIADPASYADCTHWCLPGVPDVWNEFLYGYLVHQMMSKL

SEQ ID NO: 38087 - protein, 79 aa, Sorghum bicolor
  Clone ID: SORBI-28MAY03-C51248_1.pep
FVPRILCLYMFNNFVFLQVLISMIALVIQYIQYRLMPYLVVCNYQDRIIVQEILLTTPQWTPQTMTIKVENPTTTAMFH

SEQ ID NO: 38088 - protein, 134 aa, Sorghum bicolor
  Clone ID: SORBI-28MAY03-C51316_1.pep
GIAVCCCLPCIIAILYAVSDQEGASEDDIRQIPRYKFRRTDEPEKQDVDPMGPFGGIMTECGTNQPIEKVLAAEDAECCICLSAYDDGAELRELPCGHHFHCTCIDKWLHINATCPLCKYNIRKSSSSSGSEEV

SEQ ID NO: 38089 - protein, 271 aa, Sorghum bicolor
  Clone ID: SORBI-28MAY03-C51339_1.pep
TRVVKESFMDLKVDELILQVMKDKSKTNVQSLYDAIRVLLTPDDNRVVASQVYGYSRRFAEIGVAEVLVNALREQVAPSSLPSACAALKSIAVNDEICRSISESGGIDVLLQCIDEAGEQKNKVIARSCCSLLSKLAASDANKSAIIQRGGFDRFLKLTSRFSEDPAIVQEVMSMVTVLTLRSPENAARAVELGFGTLAIQSMQRFPSSGQTQKQACLMIRNLVVRNPENRTKLLNDGAEKLIRKAKALHGSCKDAASSALRDLGLDNYNA

SEQ ID NO: 38090 - protein, 128 aa, Sorghum bicolor
  Clone ID: SORBI-28MAY03-C51322_1.pep
GCKCPDGFKGDGKHKCEDIDECKEKTACQCKECKCKNTWGSYECGCSGGLLYMREHDTCISKNGGSEAGWGFLWVVFFGLVAAGIAGYAVYKYRIRRYMDSEIRAIMAQYMPLDNQGDVQSHSHHIEM

SEQ ID NO: 38091 - protein, 342 aa, Sorghum bicolor
  Clone ID: SORBI-28MAY03-C46279_1.pep
FGLYQGASNHEELHNLMKATVMIRRLKKDVLSQLPVKRRQQVFLDLSEKDVKNVRALFIELETLKIKIESSDSKETIDSLRFAYQNIVNKIYTDSAVAKIPAVLDFLGTMIEAGCKFLIFAHHQPMIDAIEQHLSKKKVKCIKIDGKTPLTTRQTLVTSFQENDDIKAAVLSIKAGGYGITLTAASTVIFAELSWTPGDIIQAEDRAHRIGQVSSVNVYYLLANGTADDLMWDSVQGKLENLGQMLDGQEKTLDVSQIDSRPSPSKSKQQKTLDGLGPSPSKQQKTLDGFLKRPNTSTSMELDRLGPSPSKQQKTLDGFLKRPNTSTSMEEGMPSPSTKRRI

SEQ ID NO: 38092 - protein, 69 aa, Sorghum bicolor
  Clone ID: SORBI-28MAY03-C46280_1.pep
LESFDLANGGSKTTAKKKKEASHKHHKKPQRKKDRSWRVGNDGGDGTAVVRVYQKPAVNLSTVSASGRV

SEQ ID NO: 38093 - protein, 126 aa, Sorghum bicolor
  Clone ID: SORBI-28MAY03-C46296_1.pep
SSTHCVPLFTTTQIGSASSILASSWAPPTIHASASKPPVKHVLANSPGWVGNAAFPHVPNFSRPTKTTHSVALVYPHNIGFVLRRSCPSTIFFARPVQLQGGGGFMRSPPGKSPCSLHHRAPASGA

SEQ ID NO: 38094 - protein, 96 aa, Sorghum bicolor
  Clone ID: SORBI-28MAY03-C46322_1.pep
MAESKVVSVDARTTKIRNVPIAVTPEGFWCCPSQAVLQKTAKNQNQQAKAKTKGGASPLASKASSIQRAPTISSERRTHSTPTRAKINSEEQRCLL

SEQ ID NO: 38095 - protein, 195 aa, Sorghum bicolor
  Clone ID: SORBI-28MAY03-C45793_1.pep
MVDRSSRAVLIGVTAGVGAALLASACVLLAIWLYRRRASVATARTRSLESPSATLRDNGNGCASLDSSVSVSVVSESVADWGHPPPAKRAAFWAWRGGGGAGHNGREPPPLSVSGIPKYHYKDLQKATSNFTTILGQGSFGPVYKAVMATGEVVAVKVLASDSRQGEREFQTEVLQSFLGAPFFGFCSKQLICIG

SEQ ID NO: 38096 - protein, 149 aa, Sorghum bicolor
  Clone ID: SORBI-28MAY03-C45801_1.pep
HEEGILCTHALTVLRQELVPMIPQKYIIHRWCKDCKQTCASISQPVSAGNQELGSYDDLYKLGHQYFAEVVEFGSMNSQSKEYALSIMREIRDKVISYEKSLTDQRVDSHVSTANFAYNPVNEDFTDDALPISLSTKGWDLTQGQSKRS

SEQ ID NO: 38097 - protein, 367 aa, Sorghum bicolor
  Clone ID: SORBI-28MAY03-C45818_1.pep
KGHWDPKSQQRSILHSGQKVHDAFQLKRGSYTDLPPAKVSEMMHPRSLDNAPTQSLLRVVNGILDESIERKRGEIPHRVVYLLRNVVQEIEHRIAIQADHIRNQNSIIKTREDKYRSKIKALETLVNGTNEENEMTVNRLELVEVEKSKLDEKRKLGEQDMVRLMQEKENAENTIASLQQEIQILSRMHEQYRERKETEARQMEEHMAMRLKDAEFLLMQSKKKVEEIESASQLKSQLWSRKANILQSFMDNQKLSIKDIRISSQSIKQEMFTLQMKWRDEISNIGHDLNGLVDAADNYHKVLAENQKLFNEVQELKGNIRVYCRVRPFLPGQDGKTTVIDYIGENGEILITNPFKQGKDVCRMFKF

SEQ ID NO: 38098 - protein, 118 aa, Sorghum bicolor
  Clone ID: SORBI-28MAY03-C45821_1.pep
MEWASAAYTAAALVCATAACVVALAHIYRHLLHYAEPIYQRFIVRMIFMVPVYSVMSFLSLILPDNAIYFNSIREIYDAWVIYNFLSLCLAWVGGPGAVVVSLSGRSLKPSWILMTCC

SEQ ID NO: 38099 - protein, 179 aa, Sorghum bicolor
  Clone ID: SORBI-28MAY03-C45825_1.pep
MRPNENMIYAECRSVDRALLESAQTGISSEQKAMNCGISDNLTRIWRKCIENCHSKTLRQLLYDHGKLASVKECEGTIVAFIAFEDNDIKFRAQRFISSIRNSMETVLKCNVEVRICLMQEFLAGGLKHETYPDETAESDVLSCSTNSERRKGSLNLSGAGAVQSSNVPMIISDENSGM

SEQ ID NO: 38100 - protein, 130 aa, Sorghum bicolor
  Clone ID: SORBI-28MAY03-C45885_1.pep
MATGPDLSSSSSGAAAAAAVPDAAAAARKDRHIVSWSAEEDGVLRAQIALHGTDNWTIIAAQFKDKTARQCRRRWYNYLNSECKKGGWSREEDMLLCEAQKVLGNKWTEIAKVVSGRTDNAVKNRFSTLC

SEQ ID NO: 38101 - protein, 289 aa, Sorghum bicolor
  unsure (1)..(289): unsure at all Xaa locations
  Clone ID: SORBI-28MAY03-C46768_1.pep
MGSMEASTAPENGSAAGGGAGGTACNGAGASSNGGGMERRLRSSAASASWAAHLPLEVGTRVMCRWRDQKLHPVKVIERRKGSASSSPADYEYYVHYTEFNRRLDEWVKLEQLDLDTVETDVDEKVEDKATSLKMTRHQKRKIDETHVEQGHEELDAASLREHEEFTKVKNIAKIELGRYEIDTWYFSPFPPEYNDCPKLFFCEFCLNFMKRKEQLQRHMKKCDLKHPPGDEIYRSGTLSMFEVDGKKNXVYGQNLCYLAKLFLDHKTLYYDVDLFLFYVLCECDDRGC

SEQ ID NO: 38102 - protein, 109 aa, Sorghum bicolor
  Clone ID: SORBI-28MAY03-C46791_1.pep
CHCGHVKLYTGKNSSSYTCVYIDLNKRVRLLMKRDIIVACECRCWIDEVCIVFCFLCIFFCVRLFLALLFQSANAHVDMCYSYRVEGDHFCVHESVCDQLIVCTVSESE

SEQ ID NO: 38103 - protein, 132 aa, Sorghum bicolor
  Clone ID: SORBI-28MAY03-C46831_1.pep
EEFKKALSHVDSQVKNAPATAQVAAQQGQYLAECFNKMEKCKEDPEGPLRMTGGSGRHFFRPFRYKHFGQFAPLGGEQAAAELPGDWVSMGHSTQWLWYSVYASKQVSWRTRVLVVSDWTRRFIFGRDSSRI

SEQ ID NO: 38104 - protein, 60 aa, Sorghum bicolor
  Clone ID: SORBI-28MAY03-C46877_1.pep
VIRPQSKIDPEQIRARAKQAVQDQRRLKMNKKLQQLKAPKKKNLQASKLSVEGRGMIKYL

SEQ ID NO: 38105 - protein, 95 aa, Sorghum bicolor
  Clone ID: SORBI-28MAY03-C46017_1.pep
FSSPPQPFFLRNGRCYFRKLFPPSALKAWCARELWLYGSHSKASCLSTMLRCSRELHSHLEVGRQGGFLIRQPRLTPTQSRKASPGQSWTTLGLT

SEQ ID NO: 38106 - protein, 129 aa, Sorghum bicolor
  Clone ID: SORBI-28MAY03-C46039_1.pep
DPIAELIDANTKLLKKAEEFTSAGGDGGGDVDLRSRSQRKILERVRKMSEKAGRLELELQRFQHALLRHEEERAARRAAKAAVATTVQVQRRSRVQLVEYLYGRRRDSRRPKQKARGPSCCMRAKAIDD

SEQ ID NO: 38107 - protein, 137 aa, Sorghum bicolor
  Clone ID: SORBI-28MAY03-C46052_1.pep
ARGSAGVKIEDKLIVNKQLRVLISGGAMSGRGDVAYGGRLEATMRDKDYPIGRMLSTIALSVVDWHGDLAIGCNIQSQIPAGRASNLVGHANLSNKGTGQFGIRLNSSEHLEIALVALVPIFQNIMKLLQNYYSESG

SEQ ID NO: 38108 - protein, 222 aa, Sorghum bicolor
  unsure (1)..(222): unsure at all Xaa locations
  Clone ID: SORBI-28MAY03-C461_1.pep
MATVSLTPQAVFSTESGGALPSATILRFPPNFVRQLSTKARRACSNIGVAQIVAAAWSDCPAARXAATEVSAVPNAASAQPSAVVWAERNLLVCDASLXGTGGERLGRRIATDAITTPVVNTSAYWFNNSQELIDFKEGRHASFEYGRYGNPSPRAWVQLWRALVRAAPPVGAASPPQAAAARLGALVPAGGHIVTTTDCYRKTRIYMETELPKRGISMTVI

SEQ ID NO: 38109 - protein, 126 aa, Sorghum bicolor
  Clone ID: SORBI-28MAY03-C46199_1.pep
TPLFQRKKTNGDHGASSSSSQPFAQQQQLAVQQDSYMQSRAEALQNVESTIHELSNIFTQLATMVSQQGELAIRIDDNMDDTLTNVEGAQGQLLKYLNSISSNRWLMMKIFFVLMVFLMIFIFFVA

SEQ ID NO: 38110 - protein, 68 aa, Sorghum bicolor
  Clone ID: SORBI-28MAY03-C46227_1.pep
ARGSDVRPAGRERSVFPSNSMTMQNMSREMEQLRRANGRLEQENHEKDNALQQNKVLVDLVLKLCEDT

SEQ ID NO: 38111 - protein, 68 aa, Sorghum bicolor
  Clone ID: SORBI-28MAY03-C46247_1.pep
HEARESNPDAPSSSASVPRPNVNNLTAHLGGMRLHGSASSTGTVELNHHDVIQNGSPSPVAEESSGQQ

SEQ ID NO: 38112 - protein, 263 aa, Sorghum bicolor
  Clone ID: SORBI-28MAY03-C47120_1.pep
TRLDRMTTSEAIRKLVGSYSRSQYYYAAREKVNDISRMKGTVLDSGGSQASFLMQACTLTKRSFINMSRDFGYYWLGLLIYLLVTVCIGTIYLDVGTKYTSILARASCSAFVFGFVTFMSIGGFPSFVEEMKVFQRERLNGHYGVAAFVISNTISATPFLILICFLSGTICYFMVRLHPGFEHYIFFVLNLYASVTVVESLMMAIASVIPNFLMGIIIGAGIQGIFMLVSGYFRLPYDIPKPFWRYPMQYISFHYWALQGQCQ

SEQ ID NO: 38113 - protein, 134 aa, Sorghum bicolor
  Clone ID: SORBI-28MAY03-C47146_1.pep
MAIILVRAASPAGLSDAAGIISHHGSLQCSSLPLLNKRPAPARRWMLCSLRYGCLGLDPGRPSPPAVYSSLAVNPAGEAVVSSEQKVYDVVLKQSALLKRQLRKPVLDVVRPQEDLAEMPRNGLNQAYDRCGEI

SEQ ID NO: 38114 - protein, 221 aa, Sorghum bicolor
  Clone ID: SORBI-28MAY03-C47169_1.pep
TRTSEPPSPDGLHHLAVAGAAAVAVAWAFAAATCVKLLLVPTYRSTDFDVHRYWLALTHALPARQWYTDASSQWTLDYPPFFAYFSRILSLPAPLVDAALVSVPVPDAPPFAHLLYLRLTVAFSDLLLLGSVLLLARDARRKQRPFLALALVLWSPALLAVDHVHFQYNGFLMGLLLLSLHFLEQGWDLAGGVVFASLLCSKHLFLVAAPVYFMYLFRHYC

SEQ ID NO: 38115 - protein, 340 aa, Sorghum bicolor
  Clone ID: SORBI-28MAY03-C46328_1.pep
TREHTDLLTTYKSSCVTFFHAGRFDKVKIVRESMNRMIEAWKEIPGAEEDECSSAPPPASQSQRRSSLTGSASDGRYPAASLGSNSVPSSTRRSRLPVSRSSPPDVSPSVTKTNSPSSIRNKKLSPPSYRKVRQANNCDYKVEIAVAPDATPIKVVTEEKLLKGARVRDRLEARRTLFQGSEDRSAKLAGHKAGSRVVPYEGGGNLEEISEVEGGSERYTVHKDESLSEIRTQLLQIENQQSSLLDLLQKFMGKSENGMNSLETRVHGLEMALDEISRDLAFSSGRMSNREPDVKTCCILSPKFWRRHNGGRSSSRFSASDPANSSDESRTSYKWERQKF

SEQ ID NO: 38116 - protein, 368 aa, Sorghum bicolor
  Clone ID: SORBI-28MAY03-C46330_1.pep
MAAAADSAAGQNPKDDERHVLTADSDARFSEEEYEEDGEEEYEEEEEEELDGPAAEAAERERVQSVFRRLSSNPVGIRVHDVLIKGNTKTRDELIEAEVADLLRAAPTVQDLLRAASVATARLHSLDVFDTVKITLDAGPPELPGTTNVVIEVVEAANPLTGTAGVYSKPEARSWSLEGSLKLKNLFGYGDIWDASGSFGWDQTTEVGVGVYLPRFKSIPTPLMARASLSSQDWLKFSSYKERLLGLSFGLLSTRNHDLSYNLTWRTLTDPSHVSSKAIRRQLGHNLLSALKYIYKIDKRDSHLRPTKGYAFQSTSQVGGLWNSKGLRYFRQEFDVRGAVPLGFYNAALNVGVGAGVILPLGGGFMNS

SEQ ID NO: 38117 - protein, 148 aa, Sorghum bicolor
  Clone ID: SORBI-28MAY03-C46344_1.pep
MVVVDASEFGAEGFDPKRWINAALDARHPSEPLDRFLADAEERLRSAADDAAAALERDSGDALRRVPLACRDALRLRDDAVALRSHLASVLQSLSLAEGSSAESIAALARIDTVKQRMEAAYTTLQDAAGLAQLSQSVEDVFSSGNLP

SEQ ID NO: 38118 - protein, 213 aa, Sorghum bicolor
  Clone ID: SORBI-28MAY03-C46503_1.pep
MAEFKIGRLDGQPPRIRNVPIAVTPEGFWCCPSQAALQKTAKSPNQQGRTRGGASPAPSKASSVQRAPTISSEKRAQSTPTRSRTNSDEQVCPPADAVAAPDPPKVVPVPAPEKRPKQHKISVGFGQLGTSDLKVVLHGKEGVAVKMIVHKNILAENSTFFADRISRQSPVACIEVPDCEDVEIYVETVGLMYCKDVKQRLIKQNVPRVLRIL

SEQ ID NO: 38119 - protein, 145 aa, Sorghum bicolor
  Clone ID: SORBI-28MAY03-C46672_1.pep
TASPIVTLTVPPPARLPRILARRRLPLCMRSPPHTPSILPAPLLCRSPCDPHHIGVCICVPDPARPHLDPFTGDEDLRQQKLGGRPHVPPPDPARSTTRCSNPFSSPPPCRTRRLTRARPVAPAWPSASLLLPYNVKLMVDLVMN

SEQ ID NO: 38120 - protein, 131 aa, Sorghum bicolor
  unsure (1)..(131): unsure at all Xaa locations
  Clone ID: SORBI-28MAY03-C4658_1.pep
PNSFVGMRNQWVCVCATSSSSHSLRGGDGLEVANTELGVLKKTEFQISILSPVNLRGSIIANCGSGDWCRQRLSTPQPPSPGPSRSNGAHSNNAARSGVACSDALLLNYMVXPQYDVCFPIDLVINDVFQF

SEQ ID NO: 38121 - protein, 306 aa, Sorghum bicolor
  Clone ID: SORBI-28MAY03-C473_1.pep
KSWVSVLSFFGTYYKNPLKILSKCFHDVVSPKQTTSGQMTTAIAIEDVRREVRILSSLTGHSNLVQFYDAFEDEENVLCKGGELLDRILARGGKYSEEDAKVVIHQILSVASFCHLQGVVHRDLKPENFLFMSKDENSALKVIDFGLSDFVKPDERLNDIVGSAYYVAPEVLHRSYSTEADMWSIGVIAYILLCGSRPFWARTESGIFRAVLKAEPSFDEIPWPTLSAEAKDFVRRLLNKDYRKRMTAAQALCHPWIRGTQEVKINLDMIIYRLMRAYLSSSSLRKSALRALAKTLTTDQIFYLRR

SEQ ID NO: 38122 - protein, 153 aa, Sorghum bicolor
  Clone ID: SORBI-28MAY03-C47309_1.pep
MGSRRYDIDTRRCGIHSAPTKSMYLDAQQVVNCQATVRDHDVGSCAVKHHFPSPIVSWIEDLSSFGNASFGPDSEYVDEQARASVGQSSTSSNLHDMQISVRLTDEFMELAKENTSKNLETCGILGASFRDGTYFVTMLIIPKQEGTAHSGRV

SEQ ID NO: 38123 - protein, 130 aa, Sorghum bicolor
  Clone ID: SORBI-28MAY03-C47390_1.pep
KKSALTPSDTCGFHYGLPSASSPIHSNSCLVRPSGNPRRAAFQLSVNSSGASFALQMNFMSRSKSFVKGWVPLERPRSKYWKGACPCFLAPDVTLLGIRISASLGAYPCACLIPLAAHARGTQHGTAKEY

SEQ ID NO: 38124 - protein, 126 aa, Sorghum bicolor
  Clone ID: SORBI-28MAY03-C47427_1.pep
SEIADWDLGAGIYIDFYVLKNSMQERNAMDDSDSLEEISESCRNFFGRLNDSLLVWGSKLPVESRACYSKMAEELCALLVDTPSETLNLPMGCLQTMLNAPVPDEIRSSYLQDALSVFTEILCSDS

SEQ ID NO: 38125 - protein, 346 aa, Sorghum bicolor
  Clone ID: SORBI-28MAY03-C47336_1.pep
IPESTSFTQPGDPAALPPRLAAGDRPHVCPAMSSSVSIAAEWDLLSDRFYRRLTLYSPLPWSAPAAAGATSSSSGVGGAVIGRLDLSTHIVAAAPFGGPIAAVRDDSKIVQLHSEPSRRRLLLFSSSAHPIASAPCPPLLPRLHSLAFSSSLSLLALLSDGSLLRFRLPDLQPSPSSSPVPLLPPDSGGVADAQFWGGGVAILTEDNRVVVATDIEADDPHPRDLADPDIGDEEHVLCMAVVEPQFVMSGSPGVLLAVGDRVIAVDEDGVQVLGVELEIGPVQKMAVSPNGKLLAAFAHDGRLLVIPTDFSRIIFEYECDSALPPEQIAWCGLDSVLVYWPEVLLM

SEQ ID NO: 38126 - protein, 116 aa, Sorghum bicolor
  Clone ID: SORBI-28MAY03-C46891_1.pep
ALRRMQAPQDTMEQGIHNTERVRDSASGRYKDLKIPWEWMLDSGVISQLKKASLKLAKEYMNRIVNTLKSDPFANDEELLLQGVRFAFRIHQLAGGFDEGCRKAFQELKTYASKSE

SEQ ID NO: 38127 - protein, 90 aa, Sorghum bicolor
  Clone ID: SORBI-28MAY03-C46953_1.pep
LDMFVCNQKFIYQFQGTYGIAKKNNQQDIMDTLVISSLVIHCDSSVLTVVVCYRGFSSSLGSCIIAFQISSNIASQPDLALHSIVLRERL

SEQ ID NO: 38128 - protein, 95 aa, Sorghum bicolor
  Clone ID: SORBI-28MAY03-C4701_1.pep
RSPGMEAYEGMIVGEHSRDSDLEVNPVRTKELTNIRAPGKDENVRLSPPRLMSLEEAIGYVAADELIEVTPKVIRLRKKYLDSTKRKMMKNKPMD

SEQ ID NO: 38129 - protein, 138 aa, Sorghum bicolor
  unsure (1)..(138): unsure at all Xaa locations
  Clone ID: SORBI-28MAY03-C47027_1.pep
AMGNERAALKVKSEFKVXDKRWYWLKTCALATVGNWDALEKFSREKRPPGGYKPFVEACIDAGQKNEAVKYIPKLADPRERSEAYARMGMAREAEEAASQAKDSDELFGRLKITLAQSSAAASIFDTLRDRLSFQGAY

SEQ ID NO: 38130 - protein, 157 aa, Sorghum bicolor
  Clone ID: SORBI-28MAY03-C47030_1.pep
SKFMTPSAFIFLYENNLFLTFRNRTVAVWNFRGELVTSFEDHLLWHHDCSTNNIYITSDQDLIISYCKSEAVAEDGTVIPVGSINMSEIMTGKCIAKITANDPALSVAPHRNDRSKRSLGWSTVPEALEDVTALFYDEDRNEIYTGNSHGLVHVWSN

SEQ ID NO: 38131 - protein, 260 aa, Sorghum bicolor
  unsure (1)..(260): unsure at all Xaa locations
  Clone ID: SORBI-28MAY03-C4712_1.pep
STQRSCHCPNLFHCGGVVNAYSXNSDYEKAELLMKDLRSSGLTPNKVILTTLLKVFFKGGLFEKAGELLTELEASGFAQDEMPYCILIDGLVKGGKIQEAKILFNEMKEKGVKSDGYAFSIMISALHRGGHHEESKQLAKEFESENASYDLVMLNTSLRTYCSTNDMESVMRMLKKMDELNISPDNITFNTLIRYFCNSKVYHLAYKTVEDMHTKGHQLNEELCSHVMVQLGKGGFPSEAFSLYNMLRYSKRTVHKSLHE

SEQ ID NO: 38132 - protein, 123 aa, Sorghum bicolor
  Clone ID: SORBI-28MAY03-C47062_1.pep
ATVMMKRKKGRIINIASVSGIIGNVGQANYCAAKAGVIGLTKAMAREYGGRNINVNAVAPGWVASDMTNKLGDDVERKALETIPLGRFGRPEEVAGLVGFLAVHPAASYITGQVLTIDGGLSI

SEQ ID NO: 38133 - protein, 212 aa, Sorghum bicolor
  Clone ID: SORBI-28MAY03-C47835_1.pep
MNIRAPTNSSGINMKTLQPPQTTAPHVSAAPAVPVPSMLLKDIAVNPTLLMHLIQMEHQKKSASETQGGMSSGMSNNGIAGMVFTPGNAPKTTEAAQVPSVRPQVPAQTPSLNSQNDGGILRMKPRDPRRILHNNVAQKSDAMVLEQVKTNGITQPDSQGTKDQTSSMPSQPTLPSSVARPFTNTKHVDPVSNSQLAATAIMAPTQQALGSI

SEQ ID NO: 38134 - protein, 186 aa, Sorghum bicolor
  Clone ID: SORBI-28MAY03-C47881_1.pep
VMEPRRRRPPRLPLHVLFLVAAAWPLGSSGTGSFGVGAESNGASSSFRNSRRLQQIGDRNEDGLFHLPHPRTLTHKSRSHRRVPAPAPAPASAPAPSPSMSSPEGSPSPSPHGSQSMPRQSTSHRHPSVAPPHLVRPEPRQDENDPIVDTPPHSRHKNSWTTYGLVAAGIAVFLLVSAASILCFRA

SEQ ID NO: 38135 - protein, 307 aa, Sorghum bicolor
  Clone ID: SORBI-28MAY03-C47897_1.pep
MDAGGGGVLAAVLCMLLVFAIFPLLLWRRRSDAATADNHRHPPQPLQEDQVLHGRAAARRMRRRPGAPGAGSSAASTSRNVVEDDAESDEEEVPEGRNVPRSSKKEKKRQEREAQRQAEEAARDSRRSKQDRYDEMRRKKDEEREAQERQLEEEARARKTKEEEAAALEFEKWKGAFSVDAEGTTESETQDDGQGLLHNFVEYIKKQKCVPLEDLAAEFRMRTQDCINRIVTLESMDRLSGVMDDRGKFIYISTEEMKAVAEYIRKQGRVSISHLANNSNQFIDLEPKAQYEEERQQDDSAAAGTEP

SEQ ID NO: 38136 - protein, 156 aa, Sorghum bicolor
  Clone ID: SORBI-28MAY03-C47898_1.pep
MVQLAAMKRVKGRAPLSVVVAIIGGLALAGIIFTEDLRSLTEIMEKKKGKDKEQKRTTTSVHARTRTTLTRPGETKVTRPPPAKTAFDPSRCSVTEGYWAYNRSRKLLYTDQTCPFIDRQVSCQRNGRPDSDYLYWDWHLDECSLPRFDPAAVLEK

SEQ ID NO: 38137 - protein, 100 aa, Sorghum bicolor
  Clone ID: SORBI-28MAY03-C4717_1.pep
GLFMGGGGKLLAAQIIQILVIAGWVSCTMGPLFYALKKLDLLRISADDEMSGMDLTRHGGFAYVYHDEDPGDKSGVGGFMLKSAQHRVEPAAATATSNQV

SEQ ID NO: 38138 - protein, 191 aa, Sorghum bicolor
  Clone ID: SORBI-28MAY03-C47183_1.pep
LPSVAAGAAASSSGWPEAAHRHLHRSLPHPRVLSLPLSPRDHDCVWPEETLGAMGASDLAAANRPGPAGGRRRGCAPSLAGGNQKLLSSSVLFPMLPPGATKTAMGARRGMADGHPLSLPRTRPRPRGPPPSPAQAGQRCSTAWRPRVPLVGAGAACCHPSTGVASCGRVLISLPWLLMIKAPGSLTLNLI

SEQ ID NO: 38139 - protein, 147 aa, Sorghum bicolor
  Clone ID: SORBI-28MAY03-C47197_1.pep
MDGPVDDPVENNLTGGPSILGNEEEANTYADVQVKEEPEKLYDEESKDLMQDELGNQEHANMNNEDVGGQNKEDQATPTDHGVEAGVKQQDATVPDDKKWPGWPGESVFRILVPTTKVGAVIGRKGDFIKKMCEESRARIKVLEGPP

SEQ ID NO: 38140 - protein, 114 aa, Sorghum bicolor
  unsure (1)..(114): unsure at all Xaa locations
  Clone ID: SORBI-28MAY03-C47198_1.pep
MMREGDACVTLLRSKLHGLVERNRALEEENKQLRHQVSRLKGQISSLEGQDTDKKMLWKKLENSATSISYSKEKQFVQSNDDAKEAMDLNSSLXEGCMAPPPPPPPPLPSKLQR

SEQ ID NO: 38141 - protein, 113 aa, Sorghum bicolor
  unsure (1)..(113): unsure at all Xaa locations
  Clone ID: SORBI-28MAY03-C47211_1.pep
MGNCWFKGNPYFNRVSSNATKSESPKIQSPSERTEKEDCQLPSNPKEVEALRKDTACNPLIAFTFEELKRITKNFRQDSLLXGGGGFGRVYKGFITKDLREGLEIEEPLRVAV

SEQ ID NO: 38142 - protein, 206 aa, Sorghum bicolor
  Clone ID: SORBI-28MAY03-C47262_1.pep
TRPGFRCGHSLTAAPPTKGHGPRLILFGGATAIEAGASSGLPGIRLAGVTNSVHSYDVEKRKWTRLHPAGEPPSPRAAHAAAAVGTMVVFQGGIGPAGHSTDDLYVLDLTNDKFKWHRVVVQGAGPGPRYGHCMDLVAQRYLVTVSGNDGKRVLSDAWALDTAQKPYRWQKLNPEGDKPSARMYATASARSDGMLLLCGGRDASGT

SEQ ID NO: 38143 - protein, 125 aa, Sorghum bicolor
  Clone ID: SORBI-28MAY03-C48126_1.pep
ADLASLRAGMHKFEAYYIDNLVGNKQAYLERSPINSVENFSCPVILFQGLEDTVVSPDQATKIYKAIKDKGLPVALVEYEGEQHGFRKAENIKFTLEQEMVFLARLVGKFKVADDITPIKIENFD

SEQ ID NO: 38144 - protein, 133 aa, Sorghum bicolor
  unsure (1)..(133): unsure at all Xaa locations
  Clone ID: SORBI-28MAY03-C48162_1.pep
XDQRNLHIILVVECQIISWVTIIVKPNWRPKIRLGAQQRPLYIHVILATLATNLSTRNTHTHRQKTWAHSHAMEIEESAIYIHQTYSILMPLDASQAKPISTKGRQQMKRSPLQLCKVXQCPXLLLFASHPVV

SEQ ID NO: 38145 - protein, 69 aa, Sorghum bicolor
  Clone ID: SORBI-28MAY03-C48095_1.pep
PRGLVHYQKNNGGSPAAVLSAFDSQLPGTQPVAEALFGAAPPVPTDVLARSFQIDGGLVEAIKSKFPPK

SEQ ID NO: 38146 - protein, 166 aa, Sorghum bicolor
  Clone ID: SORBI-28MAY03-C48199_1.pep
DMFISFIHNLEIDTELSRPCTVEGGTAGISSESTFPNDPQPNNGSSVTTPGRCTENSETEAYDTVNTRASQASTPTSIAVSEGDLLQPESIADGILLNIVKRDALQAQNDSVTELAESSCTETYAETCDTISGSGTAEDNKDTADSSNHSLDIDAFVVSHQPSADD

SEQ ID NO: 38147 - protein, 407 aa, Sorghum bicolor
  Clone ID: SORBI-28MAY03-C4743_1.pep
FIPAPPRLSQVDKAALPSSEQTHTSPATNSEAQGATTSRKVTVSSVLEVSAASRPSSAPVLPTPRSTAPAASHIQTSTLLSRSMSEAAGRRSVNDPSFSAPSYTPQTYRNAIVGKTGLATTSASLAYQSSSLGQDNAPSQPLSAYASSTAVMMPPAGSAEQLSARHGFRSGSGKLEGHDSWQQWKGDSNVDMHLWRDHAPYQQMTNSQAYDQSLRDDTYHQACSRGTEKFSMHAGLQARQFQTGTPASHVWHQPQGPVAEEFPHLDIINDLLEEDQINGSIPESFRQDYNVFGLPFSPRGNLSDMEVASVRSPARFNPTKYDGGFSGAYDINAVNGLRERQFPSLDSYSNGLSDVSASKPWLNGSASPSVSLGVNANGYHPQVGDYPNLGSGVNGVSLWRRHANGRW

SEQ ID NO: 38148 - protein, 96 aa, Sorghum bicolor
  Clone ID: SORBI-28MAY03-C47452_1.pep
YKVNSCMNMGNNTPNFMAPVHPGDLMQSISRSAQPPALAPIPPLTESDVAQPPLPPARSNSSTVPTQSPASRTHACAAHIPVLVTLAILCTWRSLV

SEQ ID NO: 38149 - protein, 169 aa, Sorghum bicolor
  Clone ID: SORBI-28MAY03-C47500_1.pep
RILGYPHNHTNLFELNQSDRFGAMKFAFQTDTLSYFLSVLKGMYPDGIRVLSIYSGIGGAEVTLHRLGIPLKCVISVEESEVNRKILRRWWSKTEQTGVLRQHPGIWKLKTHVIEDLVKEFGGFDLIIGGNYTSCKGGNTVNTTMGLDSNRFYEYARVVKRVRTAVGLS

SEQ ID NO: 38150 - protein, 140 aa, Sorghum bicolor
  Clone ID: SORBI-28MAY03-C47716_1.pep
MQRDTGAGDRTPGTPSPTHGGRLRHRKRSNEVPSDVNTANGANLLLNDQNKYKSMLVRTYSSLWMMAGVVFLIYMGHLYIWAMVVVVQIFMAKELFNLLRKANEDRQLPGFRMLNWHFFFTAMLFTYGRFLSRQLVNTVT

SEQ ID NO: 38151 - protein, 157 aa, Sorghum bicolor
  Clone ID: SORBI-28MAY03-C47741_1.pep
MDRIVGSKYKLGRKIGSGSFGEIYLATHVDTYEIVAVKIENSKTNHPQLLYEAKLYNALQGGTGIANIKWCGIDGDENILVIDLLGPSLEDLFVYCGRRFSLKTVLMLADQMITRIEFMHSKGYLHRDIKPDNFLMGLGRKANQVYVIDFGLAKRYR

SEQ ID NO: 38152 - protein, 86 aa, Sorghum bicolor
  Clone ID: SORBI-28MAY03-C47727_1.pep
MKAKALPFIAFEHKRDAYGFAVRPQHLQRYREYANIYKEEEEERSDRWKNFLDRQAEDGESSGEDAKVAPSNEDEGAAGKNARTEP

SEQ ID NO: 38153 - protein, 115 aa, Sorghum bicolor
  Clone ID: SORBI-28MAY03-C48356_1.pep
MNRPSNFMPTPEQDVLDVKPLRTLAPMFPAPLGVNTFNQSTTPPLVFVTPAGQFQGGFDAWSNSAAKSFFAFGGEDASGGKAHKFGDQNTGGGKAPTFGDQDAFGSQNIATGVDA

SEQ ID NO: 38154 - protein, 288 aa, Sorghum bicolor
  Clone ID: SORBI-28MAY03-C4834_1.pep
ARGLLGVETRSTGFIFSIGKEPLKTRPSVFALGERINILKEIDQPALIPHIAEAKSQKYSYEVLFRSLQKLLIDTATSEYLFTDDFFGEESIFHDIFAGPIQVVDEHFNAVLLNCYDAIGIMLMIRIIHQHQLIMFKRRIPCLDSYLDKVNMSLWPRFKMVFDLHLNSLRNANIKTLWEDDVHPHYVTRRYAEFTASLAHLNVEHGDGQLDLNLERLRMAIEDLLVKLAKMFAKPKLQTIFLINNYDLTISILKEAGTEGGKAQQHFEEVLKSNIAIYVEELLLEQFS

SEQ ID NO: 38155 - protein, 186 aa, Sorghum bicolor
  Clone ID: SORBI-28MAY03-C4840_1.pep
MAAAPHQTGPAADSMIPLQSEPVLENNPSKSANAKDQILSGAENVSAGNARGASSLKSPKGPPEKPSSVGKAGEQPFVYQQNVYAPQPQPLYPGGYMNPSGQWEEYPHYVNMEGLHSVSPGIYNDNQSLMLSPGYASNPQMMYGAYSPVSTVGDGQQYFPVHYPFSSPYYQPPASPSMGYSSSATG

SEQ ID NO: 38156 - protein, 186 aa, Sorghum bicolor
  Clone ID: SORBI-28MAY03-C48444_1.pep
MGEAEEAPGVSNGEALELLMSMASSSLACSVSQFPAKWQSIKDKLHQLCCSLNSLCSGVGGNSDVNDDDEEEHPLLAELLRLASATVRSIQVVASQCSDGSYTGGRLRLRSDLDNLSCKLDAHMKQLKEMASSGAPSPSKAIVAVRPSAEASVGEKAFYLKDLFSRIRIGGTVQRSQALATIRELL

SEQ ID NO: 38157 - protein, 249 aa, Sorghum bicolor
  unsure (1)..(249): unsure at all Xaa locations
  Clone ID: SORBI-28MAY03-C48458_1.pep
ARGNPQGPIEDGQYIMLFGTVISSRGIKVKSTLGFLEVVAGCSIVESELSSSVEGTHSGAEQKRIHLHLKKFFSGTRFSSQYFLNCMSAKHKEGDLVYVSXKKALANGHYELKEHTIDALEGEGEQSTMFDRKPHPIYPSKAGLKPSLLGLSISRALKILNPDVDPMPPDVLVEFNLLNLFDAYMGIHKPKDRSEADLARRRLIFDDFFYLQLGRLFQMLEAVGTRVEKEELLYKCKNHELNTVGVDDW

SEQ ID NO: 38158 - protein, 128 aa, Sorghum bicolor
  Clone ID: SORBI-28MAY03-C47934_1.pep
MNGTHPWTSMSGGACSNLGYARDMNGNVPISTTNSSGPSIGVSSLVTDANSSLSGGAQLQPSTSMNGDSLMRVPASPMSFSSNNISGSSVIDGSIMQQSPPQEPGRYRAASAVSAPPPCAAGAALHAQ

SEQ ID NO: 38159 - protein, 162 aa, Sorghum bicolor
  Clone ID: SORBI-28MAY03-C4794_1.pep
ETGAKIVIRGKGSVKEGKLLQKRDLKPDPSENEDLHVLVEADTQEALDAAAGMVEKLLTPVDEVLNEHKRQQLRELAALNGTIRDDEFCRTCGEAGHRQYACPNKMNTFKSDVQCKICGDGGHPTIDCPVKGTSGKKMDDEYQNFLAELGGGSAPESMNKSG

SEQ ID NO: 38160 - protein, 93 aa, Sorghum bicolor
  Clone ID: SORBI-28MAY03-C47979_1.pep
EKRGFVEAHSDDGLLEIFGLKEGWHASFVMAELIKAKHIAQAAAIKFEMRGGEWDRAYIQMDGEPWKQPLLQEHSTIVEINKVPYHSLMINGE

SEQ ID NO: 38161 - protein, 146 aa, Sorghum bicolor
  Clone ID: SORBI-28MAY03-C48012_1.pep
EVSGALTDNPIGWFSTRYLYTDLYSSLMWTGTETPEGSGNYTSAVKPVSCSKTSPIACESTTGSTDPLLGYIFSFGEDNSRDVFVLASKGVYRVVRPSLCGYTCPAEKLPTGNGTTPGGPSSFAPATRLARSVAVALALILCVLLL

SEQ ID NO: 38162 - protein, 65 aa, Sorghum bicolor
  Clone ID: SORBI-28MAY03-C48037_1.pep
NSERWLFCQHYHVQIGGDPFACCAPLLLILCRTLSRCLGFLGYLTSSISFKHLFITICTYSFFSF

SEQ ID NO: 38163 - protein, 77 aa, Sorghum bicolor
  Clone ID: SORBI-28MAY03-C48093_1.pep
MASSEHTGCRIPFKDISNTNNESGPMTSNLQPDDSSSKLKEGEHYMLVNGVGTNAGLLCGGLPSFSAADVAPEIEPT

SEQ ID NO: 38164 - protein, 127 aa, Sorghum bicolor
  Clone ID: SORBI-28MAY03-C48978_1.pep
QSKTWSVIENMSGGLNGVSGAPPLVAVVKNQLYAADYSEKDVKKYAKQNNRWITLGKLPERSVSMNGWGLAFRACGERLIVIGGPRTPVGGMIELTSWIPDDKPPVWNLMDRRPSGNFVYNCAVMGC

SEQ ID NO: 38165 - protein, 61 aa, Sorghum bicolor
  Clone ID: SORBI-28MAY03-C49014_1.pep
NERWRIPQLLKHPFLNPPVPKDLPPSDNDPCRLLMERIRVHWDNPVVQKFHSLIQELDGDQ

SEQ ID NO: 38166 - protein, 146 aa, Sorghum bicolor
  Clone ID: SORBI-28MAY03-C48990_1.pep
YFVMNTNYMHKRIKILLRLHLYLYLSCLKMLLYLSAGSATVYNSIKLLFQRRFSKVPTQVPTPIRPTLPQAIAQAFEEFGSFWSPKPDMAKAVQFAEEICKVLKDVPEEVAIAKASGLVAELSRVLNVSTFETRLSQAELTIKTYM

SEQ ID NO: 38167 - protein, 83 aa, Sorghum bicolor
  Clone ID: SORBI-28MAY03-C4894_1.pep
MRVLEEDLFPSTPGKVKIERAGAMNRQLHRCFASTSTMFLWALFLVAMTASYLSFQSFVDTSSKYFAASWGGLHWERQIRASA

SEQ ID NO: 38168 - protein, 154 aa, Sorghum bicolor
  Clone ID: LIB3476-001-Q6-K2-E5.pep
RNMVLVDAKQRWSCRFMAPARSIFTLPGVEGKRSSSSTRIFNAAVLPCDGRPRDPMDASRAPPSRRRFCSLPRRNASTAKGVAAEQGRGDAKDQPARGAGRLIDYSLLSLAGRIDGSAAGMIDRFPSFGSEESAPRVQEILFGRRAEEKEGRSW

SEQ ID NO: 38169 - protein, 55 aa, Sorghum bicolor
  Clone ID: SORBI-28MAY03-C54103_1.pep
FNIDIIREHGRKDRYYVIDINYFPGYGKMPGYEHMLAGRLLPLGLSKYKRHLSGS

SEQ ID NO: 38170 - protein, 239 aa, Sorghum bicolor
  Clone ID: SORBI-28MAY03-C54230_1.pep
HEVPVSQRTKDASDTQQTKSSSVLVDKTSEVQNVAEKQHDAKVIKPQEPCVSEKQASEAEKENGVQESHCSGNHNQSHDDAAKNVTNHPPASSLKAGAEGKQQYWKKVENPKQHADSSAAAQGSLRAPEKRLNGVSGSVRAVPEGGEEQRVTAKLGSLKISSKAVEADHKTSTVGVEKRLNGVSSSVSTVPEGGEEQRVTAKLGSLKVGSKAVEADRKTNTVGVVTIGSMPVRVDSCDV

SEQ ID NO: 38171 - protein, 202 aa, Sorghum bicolor
  Clone ID: SORBI-28MAY03-C5435_1.pep
FIKDNGKCWYTAQLIIQRSGSGSSTSDEDFERGQEEVQKCLNGFSDVPAEAVYTDTKLSANINEKTFMNSQGDGKMESPKCLNGASELPQEATNSKGELPPNQNGNCCMKSGMDNHIAKGGDSPEAFLDDQSGPISLNRQKTSSEPATEVPPDTLDDAITKLEKVANKIRNLESLMQFVGSPPSKVAKSSWKFLDDTLAKHK

SEQ ID NO: 38172 - protein, 262 aa, Sorghum bicolor
  Clone ID: SORBI-28MAY03-C54379_1.pep
HGARTTWSNLAHEMTAEFRSLCAEEAYLQQELEKLQDMRNKAKLEGELWDEQLSGSSGQNSHLVSKATRLWESILARKGQHEVLASGPIEDLIAHREHRYRISGSQLLAAMDMSSSVPHSELLSSRAGETSPILGKQEQISQLFQGKEEALSRSDDRNGRTQQTVDVAEILRRWTHALQRIHKQSLHLAKANDGEGPDLLRSALDGEASTHSDSLTATLAEHRQHLVSIQGLINQLKEAIPAMQQSIDELSEEVNSVSINSM

SEQ ID NO: 38173 - protein, 70 aa, Sorghum bicolor
  Clone ID: SORBI-28MAY03-C54467_1.pep
ISLSHTHTHIYIYIYIYIYIYIYIYIYIYSLCFIPWLDGVVRWVHFLMVVVTTLYITCYASARVGFVVRE

SEQ ID NO: 38174 - protein, 166 aa, Sorghum bicolor
  Clone ID: SORBI-28MAY03-C49355_1.pep
QLSTGAGEEVERTARGLAVPASWGVFPAVGDATVGTRETAQFGFGFGGGSRDGGRHLSRMFSWNDEQQQVGDAIWTEFNESEDHIMPYPKGAEDSTTRKNNEKEVASIDGITEHSEGVQTGLQRMEKQTANQTSAHFSATRIDMESWPDLPSLNPTLDRNYSDDNI

SEQ ID NO: 38175 - protein, 245 aa, Sorghum bicolor
  Clone ID: SORBI-28MAY03-C4937_1.pep
MNAAAAAARKAAGGGMARAPALVLALVAAGAFLISYNFFAMLFRGGGGGIGGAAASSGTRDPVVAMPAWMREAADTEARRRPFHVALTATDAPYSRWQCRVMYFWYKRMQARPGGEAMGGFTRVLHSGKPDGLMDEIPTFVVDPLPAGKDHGYVVLNRPWAFVQWLQKAKIEEEYILMAEPDHIFVKPLPNLAHDDDPAAFPFFYITPSEHEQIIRKYYAKERGPVTDIDPIGNSPVIIKKTLLE

SEQ ID NO: 38176 - protein, 165 aa, Sorghum bicolor
  Clone ID: SORBI-28MAY03-C49377_1.pep
ARGSPESKAVIGKAGDGNRMVFFEGPSLAHEVEDLLRASAEVLGKGAFGTAYRAVLEDATTVVVKRLKEVNAGRRDFEQQMELVGRIRHDNVVELRAYYYSKDEKLLVYDYYSRGSVSNMLHGKRGEDRMPLDWETRLKIAVGAARGVAHIHTENNGRFVHGNIK

SEQ ID NO: 38177 - protein, 215 aa, Sorghum bicolor
  unsure (1)..(215): unsure at all Xaa locations
  Clone ID: SORBI-28MAY03-C49431_1.pep
SQEGIPAAARGGGGAGGKGAAAPVPPGSRKLVQSLKEIVNRPEAEIYAALRECGMDPDEAVSRLLSQDTFQEVKSKRDKKKEIKEVPETRYRSANSSTNRGLRSGADRGGRSNSVHSSSTDNMTSRPPVSGSGTASVNSSQRQTMASSSANKHMVTDGPAVSLQSSSGFQHGGWSGTPGQLSMADIVKMGRPQGKASSXPVVTADRGYAGQYPSL

SEQ ID NO: 38178 - protein, 111 aa, Sorghum bicolor
  Clone ID: SORBI-28MAY03-C4946_1.pep
GMIPSHLDVKTPSTLSFPCLTDCSCMICPLLDRVIQVRKLRTDRRRAAGSFSEKLKALASLPCSSACWNVVCFSRAGHGARRSWRLSRQGTRPRRPRTSGTGRGAGKGAAA

SEQ ID NO: 38179 - protein, 250 aa, Sorghum bicolor
  Clone ID: SORBI-28MAY03-C48527_1.pep
ARGLGRGGCINAGFFTRAGAGYVRAAGWDPREVRAAYRWVEDVVAFRPALGPWQTAVRRGLLETGVLPDNGFTYDHIPGTKVGGSIFDADGTRHTAADLLQYANQDGIDLYLRARVSRILFRYKGTKPVAEGVVYHDSRGNAHTAYLSPGAASEVILSAGALGSPQQLMLSGIGPADHLRSLGIDVVLDLPGVGQGMSDNPMNAIYVPSPSPVEVSLIQVVGITQFGSYIEGASGANWNSHPSGTQTQPP

SEQ ID NO: 38180 - protein, 235 aa, Sorghum bicolor
  Clone ID: SORBI-28MAY03-C48593_1.pep
TRHAVDGNRIERSNVHKSDAAHGTGDRLPKHTRIVVLKPTSVITSTEQSEQNYHADLDDSEAPGLSRHLSDEIDWSVHGICRHHTESLQGCIQSNLFSADRPYHRYAEEESDSDIGTPTSHHSWEYIYQFSNPYFGSLSHASCSPESHVTREAKKHASDRWAIVPSSEISQQKVPVRRSLSTLGEMLAMPDMKKEEVADQASPDANTHQLCEPTGGVSSNSAVDEGEGERSLRKI

SEQ ID NO: 38181 - protein, 139 aa, Sorghum bicolor
  Clone ID: SORBI-28MAY03-C48596_1.pep
MESEDDMHDANDSAEDDFYSGGEAGLAASDDGDADYDFADHDSDDSAELLSHRQQQNYSILSEVDIKRPRGDDINRVSTVLSISKPEACVLLRNYNWSVSKVHDEWFADEERVRKVVGLPEKHNEMPNDREVTWGICFK

SEQ ID NO: 38182 - protein, 147 aa, Sorghum bicolor
  Clone ID: SORBI-28MAY03-C48679_1.pep
MATVHPPSPAGPTAPLPPQEEEEEEVERHVGDAVPDPPAVVSGEPDAAGAEASGGGGEIAALDKQLAVVVGGGGGSGDERRLAGAGAVAGAVAASAAAAGGGGKLVAEAMRKYAAPRSSKFHGVTRLKWSGKYEAHLWDNTSQVKGR

SEQ ID NO: 38183 - protein, 267 aa, Sorghum bicolor
  unsure (1)..(267): unsure at all Xaa locations
  Clone ID: SORBI-28MAY03-C48663_1.pep
MLVPHPKPYLLFLPRLAAAVTGASPGLDXXLSSAAAPRPSGGNDTFAALPAALRRALSARTSLLPSFLLNLSATVPVHVRLAGSSFPASSGRSLPSLVNAAVSSAHFLSSRRPHRLAVSHTLHLDVTGPVAASKLASSAGAAVRAHLDKSPAPFHHNALSAVPYSLVDDLVAEDYRALAGSGPAEAVYIYLLDLGKQPRQYAYTAASSGADASSPGYSRCLGPVWAGKDRYIWIDLXAGPVNYGPALSGDGVLPRGEFHPLATLHGR

SEQ ID NO: 38184 - protein, 126 aa, Sorghum bicolor
  Clone ID: SORBI-28MAY03-C48957_1.pep
ISICTSQDSSLFATGSTSGIVNVYKRDDFLGGKRKPLKTIENLTTDIGEMKFNHDAQILAISSRKERNGMRLVHVPSFSVFQNWPGPRFSLHYPRCLDFSPGSGFLSVGHAGGKVLLYKLHHYKNA

SEQ ID NO: 38185 - protein, 175 aa, Sorghum bicolor
  Clone ID: SORBI-28MAY03-C49673_1.pep
KLKESIHKWPGIEYNVSRCKSIFIPITQLGGAFILIILNQETKTVYILDPNPPNPIYKYNPNAKYVKILQCISENLQKAMAKACPEPKWKEDIFLWRQIILTDIPIYNRELSGYLVSMFMTAWKNEALEITEIKDAYSIRKHFLGQLLTINENECEDNLPTGVQDLIRCIKYTQI

SEQ ID NO: 38186 - protein, 52 aa, Sorghum bicolor
  Clone ID: SORBI-28MAY03-C49684_1.pep
GYAIIRESTYFLDSVAPIAKGMRWSCEKHNTENKADKDKILICQKKLWAGKQ

SEQ ID NO: 38187 - protein, 144 aa, Sorghum bicolor
  Clone ID: SORBI-28MAY03-C49690_1.pep
DRIQPDTWSGAYQCWGKENREAPLRTACPPGVPLDLVSNFEIKSFDGCANPHLGLAAIVAAGIDGLRRDLKLPEPIESNPSDHASKLKRLPQNLQESVESLSADKVFHELIGDKLVTAAIAIRKAEIDHFAKNPGAFNDLIYRY

SEQ ID NO: 38188 - protein, 110 aa, Sorghum bicolor
  Clone ID: SORBI-28MAY03-C49731_1.pep
IIGLSLFLGISIPQYFNEYTSSADGRGPARTNAGWFNDIINTVFASGPTVALIVASVLDNTLEFRGYESDRGLSWFQPFLRRHKGYSDPRNEEFYSFPIRVHDFIPSRFL

SEQ ID NO: 38189 - protein, 98 aa, Sorghum bicolor
  Clone ID: SORBI-28MAY03-C49142_1.pep
EIGDLPIEKCPAPDIGQEMKQKVDDSIKIVDMSIKEAAYHAWLGYYNSIADIGRDKTMLADLANRFGASIGLEKPPAIYRKTALKMGLKDVPGIRIRK

SEQ ID NO: 38190 - protein, 259 aa, Sorghum bicolor
  unsure (1)..(259): unsure at all Xaa locations
  Clone ID: SORBI-28MAY03-C49207_1.pep
HEAGSRQKSTSPFDSSVLLVKKKDNTXXRFCVDYRQLNSITLKSKYPVPLIDDLLDELGQASWFSKLDLRSGFHQILLQPGEEFKTTYQTHFGQFDFRVMPFGLTGAPGTFQEAMNSTLAPFLRKFVLVFFDDILIYSKSYEEHLIHLQQVFELLQAHDWKLKLSKCAFAQRTINYLGHIISGEGVATDPEKISAVSNWPVPSSVRVLRGXLPLAGLLRKNSIFQWTFAHEQSFQALKSALVTAPVLALPNFSQPFCIE

SEQ ID NO: 38191 - protein, 398 aa, Sorghum bicolor
  Clone ID: SORBI-28MAY03-C49227_1.pep
MERKEVTKEPLSAPKALVKRSSRFFPASFFSSKVDGEFTPTSVFRGLMKSVQKQVPKLVVGILLLGSGAFFLNRAEKSQLFQQQGIATSIGKVTSTTKPIVREIRQIPQRLEELIELLPHQEVNEEEASLFDILYLLLASVIFVPLFQKIPGGSPVLGYLAAGVLIGPYGLSIIRNVHGTKAIAEFGVVFLLFNIGLEPPGERLSSMKKYVFGLGSAQVLATTAAVGMIAHRFAALPGPAAIVVGSGLALSSTAVVLQVLQERGESTSRHGRATFSVLLFQDLAVVVLLILIPLISPNSSKGGVGFQAIAEAMGMAAVKAVAAITAIIAGGRLLLRPIYKIIAENRNAEIFSANTLLVIFGTSLLTARAGLSMALGAFLAGLLLAETEFSLQVESDIA

SEQ ID NO: 38192 - protein, 106 aa, Sorghum bicolor
  Clone ID: SORBI-28MAY03-C49270_1.pep
HEGPSTVPRRNLAAARRPSPPSTSTNAIRKGQSTAGRCGAAAPPASWPGRPAPKPGAATSAQRGPPASRPRPFTPAVHPVGNGRKEYGRGKPHPATDSDLPLVNPR

SEQ ID NO: 38193 - protein, 143 aa, Sorghum bicolor
  Clone ID: SORBI-28MAY03-C4928_1.pep
MGKSGAKKKKPAAAAAAAAKPPPASAEQKATPPPSSSLPGGSGGASPHQAVDAGVLLRRAHELKEEGNRLFQSRDYAGALRQYELALRLAPRGHPDRAVFHSNRAACLLQLRPVDHEAVAQECSLALQAEPRFPRALLRRARA

SEQ ID NO: 38194 - protein, 140 aa, Sorghum bicolor
  Clone ID: SORBI-28MAY03-C4933_1.pep
HLVHVLSANIYRTTSEALESFDYIAKHGNFSFTERFAVKYAGAVAMYMVSKKLKKKYNITDERASLYDAANTWIEALNGRDFLGGSKPNLADLAVFGVLRPIRYLRAGKDMVENTEIGDWYQRMEVAVGEPSRIQDAEGN

SEQ ID NO: 38195 - protein, 170 aa, Sorghum bicolor
  Clone ID: SORBI-28MAY03-C4998_1.pep
MISPERSSSQSPRSPAAAAGAPFLSISVTDPVKMGTGVQAYISYRVITRTNLPEFEGPEKIVIRRYSDFEWLHDRLAERYKGVFIPPLPEKNAVEKFRFSKEFIELRRQALDLFVNRIASHPELKQSDVLRTFLQADEEIMDRARSYETGIFKKPADFLQMFKDVQSKVS

SEQ ID NO: 38196 - protein, 442 aa, Sorghum bicolor
  Clone ID: SORBI-28MAY03-C5_1.pep
MAGSSSMDTEAAGQQLKHGSGYSIPATAHAVDTDSWQQVSLLMVIGFNCAYVLSFSNLMMVPLGWAWGVACLLLVGAAAWYANWLLAGLHFVDGQRFIRYRDLMGFVFGRNMYYITWFLQFTTLLLCNMGFILLGARALKAINSEFTHTPARLQWFVTATGFIYFAFAYFVPTISAMRNWLATSAALTLAYDVALLAILIRDGKSNKQKDYNVHGTQAEKVFNALGAVAAILVCNTSGLLPEIQSTVREPAVRGMRRALLLQYTAGAAGYYGISVAGYWAYGSAVSEYLPNELGGPRWAAVLINATAFLQSIVSQHLFTVPIHEAMDTRLQRLDEGMFSRYNLTRRLCARGLVFGFNVFVTALFPFMGDFVNLVGSFALVPLTFTFPSMAILKIKGKSGGRCNRLWHWGIIVFSSVLCVATTAAAVRLIFNNARIYHFFADM

SEQ ID NO: 38197 - protein, 100 aa, Sorghum bicolor
  Clone ID: SORBI-28MAY03-C50048_1.pep
KIRVVKRFDSPRARTVSSKGECLVKNQLWASKGKMDVVAGKENKVQNPNSKTCLIVSHPQGHIETKVFDGNDEYGIQSSEHHEDVENERNGDSSSDESSP

SEQ ID NO: 38198 - protein, 79 aa, Sorghum bicolor
  Clone ID: SORBI-28MAY03-C50052_1.pep
FWVLFHLYPFAKGLLGRHGKTPVVVLVWWAFTFVITAVLYINIPHIHGPGGKHGGAIGKHGAAHHGKKFDLDNLSYNWP

SEQ ID NO: 38199 - protein, 150 aa, Sorghum bicolor
  Clone ID: SORBI-28MAY03-C50090_1.pep
CHDHEHGQHKHDHGEIEEPEKDCHDHSHHCCHEPHDKDKTPAEPVEEVTISIAALPKDEGHHHSEEHKGEPCGKAKDCGVPAPTDCAASKNCCSVKGGDTCSSSQAACAKETSPCCRSYVKCPKTTATVTRSSCCGHSHTMLKLPEIVVE

SEQ ID NO: 38200 - protein, 179 aa, Sorghum bicolor
  Clone ID: SORBI-28MAY03-C4953_1.pep
MVVIHLLMLFSYYAAAVVSDPVARQELSNNTNRRSTALQLRPEYFPNERLYQAYLVIQQFKGTITSDPKNITSTWIGHDICGETTYLGFYCATPPGLDDKVTVTEVLFNGFGLRAPSLHGFIDQLPDIAIFHAASNHFGGDIPQLDSLRYLYEFNVAKYDLQPLHPSNYNGGMFAGAVD

SEQ ID NO: 38201 - protein, 149 aa, Sorghum bicolor
  Clone ID: SORBI-28MAY03-C4952_1.pep
ATSGCSRHDSPSSQSVHAGSGSPVSLEDSHSGSTNGNGSPVSASCVTEDPTDLKQKLKDLEAAMLGTDPEIVNSLEISIADQLSLEPEEWKHMMSMPGGNLKELLIACARAVEYNNSYAIDLMIPELRKKVSVSGEPLERLGAYMGEGL

SEQ ID NO: 38202 - protein, 67 aa, Sorghum bicolor
  Clone ID: SORBI-28MAY03-C49567_1.pep
LEMDRILRPEGTAIIRDTVDVLTKVQAITKRMRWESRIMDHEDGPFNPEKVLMAVKTYWTAKTEEEH

SEQ ID NO: 38203 - protein, 86 aa, Sorghum bicolor
  Clone ID: SORBI-28MAY03-C49597_1.pep
PEAIDLASRLLQYSPNLRCTALEACAHPFFDKLREPHARLPNGRPFPPLFNFKQELANASPELINRLIPDHARRHLGLTLLPTTGP

SEQ ID NO: 38204 - protein, 161 aa, Sorghum bicolor
  Clone ID: SORBI-28MAY03-C49617_1.pep
KGERHGTPAERLLVANNPGSQKNRPHTMFASGPPTQGLPNGGPPVPRPYGNGTIPGQIQHMRQPPPPPVGQFPPPMQMHGQPAWPAQQPMPPPMASQLQYRLPMRPPPPNMMPPPVSMVRPPPPPTGMSAPPMWIPPPPPPQQGGMPPPPMSMPPPPPPSG

SEQ ID NO: 38205 - protein, 66 aa, Sorghum bicolor
  Clone ID: SORBI-28MAY03-C49661_1.pep
TESYRLRFNFHLWCYLFIADNPSLLCSYCWPWHPDLLLLMPLIQPVLHAEVKQLAALRVARDGTPM

SEQ ID NO: 38206 - protein, 188 aa, Sorghum bicolor
  Clone ID: SORBI-28MAY03-C50320_1.pep
MGGLCSKVSAVDKSPSDTALGRNQVADHEPGASLGLEKPPVSGEAAALAKRLDEQQQQSFSFRASVVPGVAFHAGASGETGSRTSPQLTRSLSQRAGVGKAKAGAGKVSEVSSILGRASTVGLEKAVEVLDTLGSSMTGLNSSSGFVSSSAAKGNKIAMLAFEVANTIVKGSNLMRSLSEPSIKHLKE

SEQ ID NO: 38207 - protein, 111 aa, Sorghum bicolor
  Clone ID: SORBI-28MAY03-C50348_1.pep
CTFRNMWAEFEWENKVAVNTVIQDEKEFLNHIIKSTNMKCLTPPSALDGECGFLAANLYAKSVFGEDALVNISIEKQHDGKLSGYIRIRSKTQGIALSLGDKITLKQKGGS

SEQ ID NO: 38208 - protein, 167 aa, Sorghum bicolor
  Clone ID: SORBI-28MAY03-C50393_1.pep
TDLVVRFTGYDRWFKTWSSALLLPKLRRLLIADVPSSWDVSWPRLLIEAAPCLESLHIHISRWEEDPCDDIVWQSPKFCHNQLKELVITGFEGTERQIYFVSFVMKVATKLQSVSLLKNGLVQGRGHWDWDMVKQQHQWGNEERINILNQIAKDVPCSTTPVQVVLE

SEQ ID NO: 38209 - protein, 115 aa, Sorghum bicolor
  Clone ID: SORBI-28MAY03-C50410_1.pep
QGDTARFSSYGRMGYVHIDDVASSHILVYETPHATGRYLCSSVVLDNDELVSLLAKRYPVFPIPRRLNSPYGKQSYQLNTSKLQGLGFKFRGVQEMFDDCVQSLKDQGHLLECPL

SEQ ID NO: 38210 - protein, 127 aa, Sorghum bicolor
  Clone ID: SORBI-28MAY03-C50507_1.pep
KAISINFFYPKCWHVRGLLLEAQFLHKEALMAFSFALSIDPDYVPSMVCMAGILRDIGGNSLSIARTYLRNALRLEPTNHRAWLSLGLVLKAEGSLQEAADCFQAAYELRELSPIQDFSEQLPIMLH

SEQ ID NO: 38211 - protein, 174 aa, Sorghum bicolor
  Clone ID: SORBI-28MAY03-C49692_1.pep
KNFKSSNILLDGELNPHLSDSGFAGLLSNQEFQESDENSGYRAPEVILSGQYSLKSDVYSFGVVMLELLTGRKPFDRSRPRPEQSLVRWATPQLHDIDALDQMVDPALQGLYPSKSLSRFADAIALCVQPEPEFRPPMSEVVQSLVRLVQRANMTRMHESQSRRHGESGGDYEF

SEQ ID NO: 38212 - protein, 113 aa, Sorghum bicolor
  Clone ID: SORBI-28MAY03-C49734_1.pep
LPWEEGDYSPSNTLLVDDSPYKALRNPPYTAIFPRSYSYLNWNDNSLGPGGDLRVYLQNLAAADDVERFVRNNPFGQPFITKSDPHWNFYAQIADRQCAPFTCCASTPKDHCF

SEQ ID NO: 38213 - protein, 177 aa, Sorghum bicolor
  unsure (1)..(177): unsure at all Xaa locations
  Clone ID: SORBI-28MAY03-C49839_1.pep
MGSGEEPSQMRRALVDSLAGAISGGISRTVTSPLDVIKIRFQVQLEPTTSWGILRRDVYGPSKYTGLLQATKDILREEGLPGFWRGNVPALMMYMPYTAIQFTVLHKLKTFASGSAWPVGLAPSGPSVSRLRGAPAGCPAPXGPAPVLLRWSLLASPAGPYVVPSMRSAFVDIIKTR

SEQ ID NO: 38214 - protein, 159 aa, Sorghum bicolor
  Clone ID: SORBI-28MAY03-C4988_1.pep
KKMKISREIADASGKTIPVEEILTIDVKPGWKKGTKITFPEKGNETPNTIPADLVFIIDEKPHPVFTRDGNDLVVTQKIPLAEALTGYTAHVTTLDGRSLTVPISSVIHPGYEEVVRGEGMPIPKDPSRKGNLRIKFDIKFPARLTSDQKAGVKRLLGQ

SEQ ID NO: 38215 - protein, 158 aa, Sorghum bicolor
  Clone ID: SORBI-28MAY03-C4994_1.pep
TLPAEALDVLRRVLEAVLAHISERIIELFLNDSVKRFNANAVTGIDTDLKMFETFAEGMSSLFVDSGQESAKNEMKAALVEARQLVNLLLSNSPENFLNPVIREKNYNKLDYRKVAIISEKFRDTSESYFSTFGTRGARQNPKKKSLDTLIKRLREAS

SEQ ID NO: 38216 - protein, 99 aa, Sorghum bicolor
  Clone ID: SORBI-28MAY03-C49930_1.pep
VERHFYVFFSPFSFYHLFLDFVITSHHISFLYMPRDLVHMIYDVSCSCPFIIFLQRSGDNMSHILPFYYFASGYRNMFLQWHLLVCPHICVSSTNECLN

SEQ ID NO: 38217 - protein, 120 aa, Sorghum bicolor
  Clone ID: SORBI-28MAY03-C50855_1.pep
IVILQPFVFVSKESYPPDENHSASHSLDGNEETCTSCISDFLQTSTRGVSVSREVCLYVFLKVGASSTTASSSPSRSLASHRHEEGRAREVVSPPLLSPPSFFPTIARVILLRHHPVRVV

SEQ ID NO: 38218 - protein, 65 aa, Sorghum bicolor
  Clone ID: SORBI-28MAY03-C50873_1.pep
HEACISKRLIHSELPPSNGFLIVEANGGLNQQRISICDAIAVAKILNATLVTPAFHLNSVWRDSR

SEQ ID NO: 38219 - protein, 302 aa, Sorghum bicolor
  Clone ID: SORBI-28MAY03-C50892_1.pep
RAAGIRHEDPVVASAALVSGIYLLQTSPEVVKRCTREVQEAVQSRAALVQFHALALLHQIRQNDRLAVSKLVTSLTRGSVRSPLAQCLLIRYTSQVIRESGVNQGGDRPFFDFLESCLRNKAEMVILEAARAITELNGVTSRELTPAITVLQLFLSSSKPVLRFAAVRTRTRVASTHPLAVTNCNIDMESLISDQNRSIATLAITTLLKTGNESSVDRLMKQMTNFMSDIADEFKIVVVEAIRSLCLKFPLKYRSLMNFLSNILREEGGFEYKKAIVDSIIILIRDIPDAKESGLFHLCEFI

SEQ ID NO: 38220 - protein, 184 aa, Sorghum bicolor
  Clone ID: SORBI-28MAY03-C50899_1.pep
SSGNPLEPVSDTAAKDSSEPRSDMHEEKTAESQNNADQSVEQSPEPQSDKSTEKPEVHQSSTPSDELSRLQSDAGADKLSVPSSDPESNASVSKPSESQTDVITMEAPELQIDALPDKATDQPVKPQDDASAKKPMGTESDAACDKPSESSSDTETLPVCHQNSSITTDEPVQGDISYETPHQR

SEQ ID NO: 38221 - protein, 50 aa, Sorghum bicolor
  Clone ID: SORBI-28MAY03-C50114_1.pep
AIGMTIKEAKKLEHFFCQTCTAENGKMVENSHEATAQSEEKPVESKRRRR

SEQ ID NO: 38222 - protein, 96 aa, Sorghum bicolor
  Clone ID: SORBI-28MAY03-C50187_1.pep
TTQGGNFPHFLIGHRRYLYGGHAKTIKPDKRRLAILFDSPRIGWKSLKRQLFNMRAHSDVKGIEIKRANESVYTFPCPDCMCRSNKQEHSKSIVAR

SEQ ID NO: 38223 - protein, 166 aa, Sorghum bicolor
  Clone ID: SORBI-28MAY03-C50209_1.pep
EATKRFCRAYNGKQEFIVSNPQVYVFFSVATRTQQTTEHRVKVQEFCLCCIKDKSIIRQTDPMLPSSKKLSSMCKCKVKRTQPRPGISPSLWLRAQALYSRRNGEARKKKGRAHNLKTKDTCRDFFPPLFIYMSISIIYKQCHQHLLYLRHLVHQLARRAGTHGSL

SEQ ID NO: 38224 - protein, 151 aa, Sorghum bicolor
  Clone ID: SORBI-28MAY03-C50294_1.pep
MASANAISTASLISPLSQGRARRARNGRSQRFVVRAEAKDIAFDQKSRAALQAGVEKLANAVGVTLGPRGRNVVLDEYGSPKVVNDGVTIARAIELYDPMENAGAALIREVASKTNDSAGDGTTTASVLAREIIKLGLLSVTSGANPVSLK

SEQ ID NO: 38225 - protein, 144 aa, Sorghum bicolor
  Clone ID: SORBI-28MAY03-C50302_1.pep
LSLCLSRSPSQRRPPYSSAQKPPHPAATPSCSSSIGHHLHIWRPPRRMLPLGAPPLLSGAPLSQPGVQIYWSEHNRIRKWQLRAQFNLSVRDEPVFRPPKSWSGPLQATSSHNNGHVCLFLLFPSFCAKLRIPNLGYLVIHIRN

SEQ ID NO: 38226 - protein, 161 aa, Sorghum bicolor
  Clone ID: SORBI-28MAY03-C5030_1.pep
ARVPVVVRPGHIRFEPAGGEPNKSPAKELQGTFQWSATMSKKKGQKWGMNSSNKKSADIGYHAGIAGSDTEVNNHVMDIKVTKNDFCAVSNRRNNEGSNIEMSSVKSVANEEKSSGEPFDFESLYPLTRLPKEGDLIAYRLVELSSMLCPELSSYRVGKVL

SEQ ID NO: 38227 - protein, 188 aa, Sorghum bicolor
  Clone ID: SORBI-28MAY03-C51060_1.pep
MVSMSTTPHPLDPSVPAVAGGGKEEEEEAGRAREEAAAAAAAPAAVPVPTVGNDDDDDGPRRVRKPYTITKSRESWTDPEHDKFLEALQLFDRDWKKIEAYVGSKTVIQIRSHAQKYFLKVQKNGTGEHVPPPRPKRKAAHPYPQKASKNEPNYGLKTDSSSIHRNSGMNVSVSSWAHSSIPQAVAST

SEQ ID NO: 38228 - protein, 223 aa, Sorghum bicolor
  Clone ID: SORBI-28MAY03-C51061_1.pep
HEASMPYVQNSESDFTGVSCFSHMDKSFRTGPDRVNLSSVTQSEASLYPTDPLQQGDFAPVIKQNFQPLHSSDKVPFFKEHSSCGNDVLRNKTEASFVEPLVYSNRQEVYTNSTEQIGAEQFQSGCGQQDNDARVQTASHERHQSSTLCENQNSHSEVLQGVAAGSTHKFIDIQKGPPEAQQNGSKAKKVRGRPTKTYDWDSLRKEVLSNGGDKQRSHDARDT

SEQ ID NO: 38229 - protein, 135 aa, Sorghum bicolor
  Clone ID: SORBI-28MAY03-C51102_1.pep
MGNICGGKDRVAEDFRPSSPGTTMTSKTSGSLTTSQSTTGKLSSVSSGFMASAGSRSTSGGFVDEGAKYPDGQILEAPNLRTFTFMELKTATKNFRPDSVLGEGGFGRVYKGWVDEKTMAPTRNGTGMVVAVKKL

SEQ ID NO: 38230 - protein, 203 aa, Sorghum bicolor
  Clone ID: SORBI-28MAY03-C51196_1.pep
VPAAWAPAPAAAAAAATEASAPPAAAGADAVGDVRPAVVAAIHVLGLVNDHRELHGVLRRAADEPPGLDALTLSATRHRPPATTSAKAAASPMWGESERASADAMLVCQELHPLPAHPARQKSGSSPDEAMIGFGQAGRQGYASFDHTTALRCMVPYQPILVHQSIIHVRVIFFSSSSSSVLLVAVHETFEILLCAYYSDRER

SEQ ID NO: 38231 - protein, 138 aa, Sorghum bicolor
  Clone ID: SORBI-28MAY03-C51200_1.pep
RVEDVQRLLQVNESRGFPGMLGSIDCMHWRWENCPVAWKGQFTRGDYGVPTIILEAVADKDLRIWHAFFGVPGSNNDINVLNQSPLFIEALKGQAPQVQFSVNGRQYNTGYYLADGIYPEWAAFVKSIKAPQMEKLLN

SEQ ID NO: 38232 - protein, 134 aa, Sorghum bicolor
  Clone ID: SORBI-28MAY03-C50618_1.pep
LCFRKLHTYPYLLLYIAYITDNTQLPICPTIYSLYHRQYTNEATLIIHNPVTPKSRDSFIMPTDNYGDFICVVRQNMIKPSLGCGSTSSSTTRPAPSSSPCTSTTSSTAPGGSALAAGTRTSLAKKGLSGKNSD

SEQ ID NO: 38233 - protein, 123 aa, Sorghum bicolor
  Clone ID: SORBI-28MAY03-C50660_1.pep
HRLTESSHKKLLVNAEKTVGAQINDAETKIAEVQKVGQKRFSKLTYALLTKCSSLSDTPAESTQEDEWPEIRAQGADYRNCRLTDRSSFALSKYISQVQRLGSTGCALQTRLRVPFERGTGES

SEQ ID NO: 38234 - protein, 93 aa, Sorghum bicolor
  Clone ID: SORBI-28MAY03-C50662_1.pep
YLLEGLKRLCEYTIAKDVNLDNVSDMYDLSEAFHAVSLRHTCILYILEHFNKICTRAGSPQLIQRVIPELRNFLTKALSSSRSPSPSDRNSQI

SEQ ID NO: 38235 - protein, 141 aa, Sorghum bicolor
  Clone ID: SORBI-28MAY03-C50682_1.pep
GNLCYVFGALRGFWGHSNQDMRIKVNGGEWGTVHKVTALCIGNAKYFGGGMKITPTADPFSGTLEVVILQDFKWYDFLLKLHRLYGGTHLSVNGVSSMRVQSIEVEEVTGSGGIFVQFDGEHFGFLPTKFSVLPGAVDFFC

SEQ ID NO: 38236 - protein, 128 aa, Sorghum bicolor
  unsure (1)..(128): unsure at all Xaa locations
  Clone ID: SORBI-28MAY03-C50734_1.pep
ARGLVPLVLGAAAVFFEHIRKIGCMYSXHRLERSTVSDAFFEDPNSLKKVPCPSDFYPPRKYISLIVPAYNEKHRLPEALMETLKCTFRNGTNKRDKGHERISEAVNSAGHDDMEMNFTLGQLTEWIH

SEQ ID NO: 38237 - protein, 390 aa, Sorghum bicolor
  unsure (1)..(390): unsure at all Xaa locations
  Clone ID: SORBI-28MAY03-C51485_1.pep
VAAVAEGFTEKPGAEPVEERPEAPAESAGAEGWCDHACGWSGGPSGGVQGGAGGEACGGCHAGGATSESGDGGPDGVAVPRQVAYPAGAATRLARPLVLLNVVDIGGGVPRSSPLPALPHAPQAVLPQVSGPRAGSCPAPAAVPTLGSQGPAASKSAGEAPGSSSCPRGGGPSTDYIPCLDNEKASTRLRTTKHYEHRERHCPEEPPTCLVPLPEGYKRPIEWPRSRDKVWYSNVPHTRLAEYKGHQNWVKVSGDYLLFPGGGTQFKNGALHYIDTIQQALPDIAWGKRSRVILDVGCGVASFGGYMFDRDVLTMSFAPKDEHEAQVQFALERGIPAISAVMGTKRLPYPSRVFDVIHCARCRVPWHIEGGMLLLELXRLLRPGGYFVWS

SEQ ID NO: 38238 - protein, 89 aa, Sorghum bicolor
  Clone ID: SORBI-28MAY03-C51518_1.pep
MSCLPCSGSSGKEAKSLAALSPTPRPAAKAAPVRSNSRASGSKKEDSVPVRRGGNIPHGPAQIFTFRELAIATKNFRKDCLLGEGGFGR

SEQ ID NO: 38239 - protein, 74 aa, Sorghum bicolor
  Clone ID: SORBI-28MAY03-C51477_1.pep
MGSRSAASAALRIWLLVSVALLLGCCQGRFVVEKNSLKVTAPDDLKGTYECAIGNFGVPQYGGTMVGFVAYPKA

SEQ ID NO: 38240 - protein, 156 aa, Sorghum bicolor
  Clone ID: SORBI-28MAY03-C51555_1.pep
HEGSPELCARGLLFLRCGTIVSGDSTGSVQFWDSHHGTLLQAHSYHKGDVNALTTVPSENRVFSAGSDGQVILYKMSKDEFGATKNVVKEQVHKWVYVGYVRAHTHDVRALTMAVPICREDTLPEEKVVKIRRREKHEFSYHKWAHLGVPMLISGG

SEQ ID NO: 38241 - protein, 162 aa, Sorghum bicolor
  Clone ID: SORBI-28MAY03-C51580_1.pep
MAQIPNLDNAPLNLAALREQSQKDLLGILKNIRGKKCLVIDPKLAGTLSLIVQTSLLKEYGAELRILSPDPLQTECPKIIYLVRSQLSFMKFIASQIKNDEPKGLQREYFLYLVPRRTVACEKILEEEKVHQRLTFGEYPLYLVPLDDDVLSLELDHSLQEC

SEQ ID NO: 38242 - protein, 104 aa, Sorghum bicolor
  Clone ID: SORBI-28MAY03-C50935_1.pep
MGNAGTNGGGAAAGHRRRSSSHRQGHHHQAPPPPQPQETAPNRYVFAAATPYPPQYPNPNPPQYYPQYGNYYPPPPPSVPVPLPAPYDHHHRPPTAAPGEFPPP

SEQ ID NO: 38243 - protein, 174 aa, Sorghum bicolor
  Clone ID: SORBI-28MAY03-C50940_1.pep
MGSLKMTEKAPGAALPESSCAYLLQELKMIWDEVGQNQNERERILEELEQECQEVYRRKVNSANMSRIQLHQALAESEAEFTNLLLSLGERSFPGRPEKMAGTLKEQLNSITPALQEMQMRKEARVKQFMEVQTEIHRIASEIAGRLGNEAVTVNEEDLSLKKLEEFQSELQRL

SEQ ID NO: 38244 - protein, 129 aa, Sorghum bicolor
  Clone ID: SORBI-28MAY03-C5098_1.pep
MPRSSSTSSNSNPGSKRILGRAMATILALPLTPISKAKLGLLLFKKRASSAARRRCCYNYKPFRHYNYAYVGEYQFSPSHSPLLPAPPGPPGVTAWRRARAAAKRRRSRARVILASLFCGGDELHVAVL

SEQ ID NO: 38245 - protein, 64 aa, Sorghum bicolor
  Clone ID: SORBI-28MAY03-C5101_1.pep
MPLTRVAADAFGVLTIALFALFAALGLFCIFQSVYFRCRIRRGPPFLSLGYFNGPWVTRIALIL

SEQ ID NO: 38246 - protein, 118 aa, Sorghum bicolor
  Clone ID: SORBI-28MAY03-C5090_1.pep
LCYYGPHLQRVIYAQKPHLLELVEEGSVPEASADVEMEEVDVSGWLEAFAAHPAIGTTWGGVSKWSKEEQSAALSTATDSTAQELAEWNARYREKFGFVFMICASRRTAPEVLAELKR

SEQ ID NO: 38247 - protein, 200 aa, Sorghum bicolor
  Clone ID: SORBI-28MAY03-C51051_1.pep
HEDIQPPRVDENVSFKDIGGLSEYIDALKEMVFFPLLYPDFFANYHITPPRGVLLCGPPGTGKTLIARALACAASKAGQKVSFYMRKGADVLSKWVGEAERQLKLLFEEAQKNQPSIIFFDEIDGLAPVRSSKQEQIHNSIVSTLLALMDGLDSRGQVVLIGATNRIDAIDGALRRPGRFDREFYFPLPGYEARSEILDI

SEQ ID NO: 38248 - protein, 160 aa, Sorghum bicolor
  unsure (1)..(160): unsure at all Xaa locations
  Clone ID: SORBI-28MAY03-C51813_1.pep
GPGPGTRARRKYRGGQRAGLLHTPPLTTPLSALLTSGFRLPHDLLSELLRWPGRWRYAQAARGAAPVGRALEDFYVRRLYLRIQDCFGRPIXKCTRCLNLGSYNYLGFAAADEYCTPRVIESLKTYSASTCSVRVDGGTTKLHAELEELAARFVGKPAAI

SEQ ID NO: 38249 - protein, 178 aa, Sorghum bicolor
  Clone ID: SORBI-28MAY03-C51775_1.pep
MADAGAELVLLLCPRAPPRPSLPHSSVYPLRPRSLLRAPPRLRPPICLRCRALDASRPVAVERERERDEEDGLEDEEESYFSVTSSGLSDVDYLGESTRGDLNVRRERLEALGGNGKSTLHGPTEEIAWKEAGEAETLLHDLGIAAPFSVRHSSRGIFCTRTLNLRSISVVGYDMDIH

SEQ ID NO: 38250 - protein, 165 aa, Sorghum bicolor
  Clone ID: SORBI-28MAY03-C51816_1.pep
MVSSNKGKVCVTGASGFIASWLIKRLLESGYHVVGTVRDPGNHQKTAHLWKLPGAKERLQIVRADLLEEGSFDNAVMDCDGVFHTASPVLAKSDSSSKEETLVPAVNGTLNVLRSCKKNPFLKRVVLTSSSSAVRIRDDDQPNISLDETTWSSVPLCEKMQLWYA

SEQ ID NO: 38251 - protein, 107 aa, Sorghum bicolor
  Clone ID: SORBI-28MAY03-C51818_1.pep
MEESFVPLRGIKDDLHGRLACYKQDWTGGFRAGIRILAPTTYIFFASAIPAISFGERAAPAAPGGRPALRALAPTPVRRRLHSIVGGQPLLILGVAEPTVLMYTFMF

SEQ ID NO: 38252 - protein, 61 aa, Sorghum bicolor
  Clone ID: SORBI-28MAY03-C57752_1.pep
SIYRGSWFKRPRRLSLINRDSCFKLTKSVNRLIKAVGFGQPPRLININQGERIRLSVSIND

SEQ ID NO: 38253 - protein, 237 aa, Sorghum bicolor
  Clone ID: SORBI-28MAY03-C5776_1.pep
MTMESPTTAAGDELESYLSLGLTVSCSGKDSAEFPKVLLLLSAYLDKKVQENEELLDSSKTKESTTIFHGQRVPELSIKLYAERIFKYAKCSPSCFVLGLIYIERYLQQPNIYMTSFSVHRLLIASVVVAAKFIDDAFFNNAYYGRVGGITTREMNMLELDLLFSLDFRLKVDIETFGSYCLQLEKEALVLVLERPIQVQAANVTKHLICNSSADETCKHELVRERYSSQAVHGCSW

SEQ ID NO: 38254 - protein, 131 aa, Sorghum bicolor
  Clone ID: SORBI-28MAY03-C5793_1.pep
MAAVARVFRGSLFLMSPAAGTGKAAGAKAAAAAATKKRTKAPSTEPRVPTGISKPIPVSAELSRFAGGAPEVARSQAVKLIWAHIKAHGLQDPAKKTEINCDATLKSLFGGRDRIGMLEIMKLLRPHFLEN

SEQ ID NO: 38255 - protein, 161 aa, Sorghum bicolor
  Clone ID: SORBI-28MAY03-C57856_1.pep
MAAALAPGVSRKLKKVLETRTDNPDLLASLGALSTFYVQNTPQARRNLKSSIEQRALAINRHFLDASLPAHKALDRVEGEVHALNDSWKKIEEALSSCSASTGDIISTTERLQQELEVITQRQEIVSCFLRDYQLSNEEINALREEEIDDKFFKALLHVQE

SEQ ID NO: 38256 - protein, 107 aa, Sorghum bicolor
  Clone ID: SORBI-28MAY03-C52133_1.pep
TVDDNVGTKRDKATLDDTTNRINKLLYKIRSIQMCGSLALNMCGVACGRLDLCYEMGFGGLWYGSTKYMRHGFIVPFLIRECILDYINYHMQLSETINYEKYIVVFI

SEQ ID NO: 38257 - protein, 204 aa, Sorghum bicolor
  Clone ID: SORBI-28MAY03-C5234_1.pep
ARGASGLPMFNGGRSDEFARYSSLMWLRDGNRGAQSLNFQGLGASPWLQPRIDYPLMGLKPDTYQQMAAAALEEIRAGDHLKQTSSLLPVQQRQNRPGGLDPWYGNPVLQQMQFQSQQSSLQAVQQGYGQNASESGFLQNQLQQLQLQKQQEAAQQQQQQTQVLQQQSHQEMQQHLSASCHDIANVASGVTESGSARQSQSCLL

SEQ ID NO: 38258 - protein, 186 aa, Sorghum bicolor
  Clone ID: SORBI-28MAY03-C52339_1.pep
TRPLQSMITEKVESVAATLKPSQSDTAPQEILERNMDTEKILQSAMAVEKPPPTNLITEKPSIKDASEEPVQTNEQSEQPLKTEEVEKPHQSEKIAAETKGRHEAIENMLELESNATKLNKDHSEPEGLSSGTNPPDFQSNPNAGQQLESKGIVAEKEADNIMEAKNDAVAEHSSQSQHVAPAEVP

SEQ ID NO: 38259 - protein, 178 aa, Sorghum bicolor
  Clone ID: SORBI-28MAY03-C52379_1.pep
MIRLCPLLLLLLTAAAAASASGADEAHVSIAVAEKGLAFAKDVLIGEAVRSLTPLRLPGVEKAVRVPFLGGVRVAASNITLFHLDVGDNSTIFPGDSGLLVVPSGITANISMHWSYCYDSWLFPIEIADSGTASILVQGMEVGITMVIKNNNGSLALSASQCGCYVKDLVISLDGGAS

SEQ ID NO: 38260 - protein, 248 aa, Sorghum bicolor
  Clone ID: SORBI-28MAY03-C51583_1.pep
MASKLSFKRTDSLAESMPDALRQSRYQMKKCFQRYVSKGRRLLKNQQLIEELEKSLDDKVEKEKLVEGFLGYIICSTQEAVVLPPYVAFAVRMNPGIWEYVKVHSEDLSVEGITPSEYLKFKETLYDENWAKDDNSLEVDFGALDLSTPHLTLPSSIGNGLQFVSKFMSSKLGDKPEISMKPLLDYLLSLNYRGEKLMVNDTIDTVNKLQTALLLAEVFVSGLPRYTPFLKFEQRFQEWGLEKRWGDT

SEQ ID NO: 38261 - protein, 182 aa, Sorghum bicolor
  Clone ID: SORBI-28MAY03-C51593_1.pep
IHHQPERMGYGMSRLEDEYYEPEGQNTDGSGSVQVNNEFAELHNDIFHMTRMRSRLTESYKSMGTNRGIISTAKLLSQREIDCSGKRMFSSGDRAFVLGRYVPMNGPQLLDRMDSRAYVSQFSADGTLFVAGFQGSHIRIYDADRGWSIHKDIHARWLRWTISDVSLSPDQRYLAYSSLAPI

SEQ ID NO: 38262 - protein, 412 aa, Sorghum bicolor
  unsure (1)..(412): unsure at all Xaa locations
  Clone ID: SORBI-28MAY03-C51614_1.pep
TRATKTEMGRNMLAQQRMQQAMMANNAANNLPDGSARTSNHAGGNMPSDNQSHQASQSVGAAGSHDGGNVQGQDPDRSTAEGGTNTSHDQGQQSSTGAHGAQVPLRRNSGHGWATSAASAFDAAKDIMEALRSKHTNLANELELLLSEIGSRFVTLPEERLLAVVNALLHRCYKYPTATTGEVPQSLKKELSGVCRACFSQDAVNKHVDFVKEYKQDFERDLDPESATTFPATLAGPTERLKHWKNILQSNVEDRVPAVLKLEEESKTLRDFHVVDIELPGQYFTDQEIAPDHTVKLDRVGPDIPIVRRHGSSFRRLTLIGSDGSQRHFIVQTSLTPNARSDERMLQLFRVLNKMFDKHKESRRRHLAIHTPIIIPVWSQVRMVEDDLMYSTFLEVYXINCARHNREADSPI

SEQ ID NO: 38263 - protein, 199 aa, Sorghum bicolor
  Clone ID: SORBI-28MAY03-C51722_1.pep
MPRTTVVESPGCPPLRALTTDIIGLVKVVEAHTKPAGAAKVVETWGDPDASRAIVAASLADRAADPVLAVARKNGVVELLNPLNGDALAAVKTVGPSPNDGGAEGDPLAALHLFTRQASDSILGTFLACTEQGKASIRSITKENAASGSDVGPSATWDVCSGANVQFCSVDHGESYAMFGGKGIEVNLWDITSCSKIWS

SEQ ID NO: 38264 - protein, 149 aa, Sorghum bicolor
  Clone ID: SORBI-28MAY03-C517_1.pep
TGLGESGLRPQIRASTTSVSNRPPIRPRLEPAQHRVDALQAELEASRVEQQRMAERLEAQERQREADQLAHQQQMAEMIAFLQSVGAQTGVALPATLLAPRQPSHPPSAGSNVAPVISPTPGISPTPPDGGSPAVRGLGVPHINWGPSQ

SEQ ID NO: 38265 - protein, 70 aa, Sorghum bicolor
  Clone ID: SORBI-28MAY03-C51731_1.pep
DNDMIRTSSLLQNLKEVSTEAARDDDQLARSPLGKNKEREIRAHRVLLLHLDDEIQSYLTAIELRLLIVT

SEQ ID NO: 38266 - protein, 193 aa, Sorghum bicolor
  Clone ID: SORBI-28MAY03-C52552_1.pep
TRAFRTRLTSSSVWFNLPCATALIVLFRYISLDYDLRRKSTTSTDHASHSLVKTKITEVKKVLHQTEKDGKLDWRSKVNSPPVEAAFEQFTRHLITEWVTDLWYSRVTPDKEGPEELITIVNTVLGEISVRARNVNLINLLIRDLVDLVCNNLELYHFCQAKIGKEKFVNLPSERRDAELKMILLAENKLHPA

SEQ ID NO: 38267 - protein, 82 aa, Sorghum bicolor
  unsure (1)..(82): unsure at all Xaa locations
  Clone ID: SORBI-28MAY03-C5258_1.pep
ARGFPLPTHEAIVKNGCPLAFERNLVPWRPKQFSLNXNSPLIQKLLCKSFXVENGEKREEMLYMKGPQTEFQRYIRSFNSGV

SEQ ID NO: 38268 - protein, 164 aa, Sorghum bicolor
  Clone ID: SORBI-28MAY03-C5262_1.pep
SRDSTIHGDESDLMSTDNEEKMAVEREIHVNYEEPIKGAAVTETSGQPQHPNLDHELDAVGILDTSSALPVSNTRPLSPAGQNQQMLKMTTTALDNCLLVPSLNDLMAKHEQVEYHEADDYPATYDPQVGSDSREEINHHLGDDNRTLCIPPNESESPANSNKD

SEQ ID NO: 38269 - protein, 220 aa, Sorghum bicolor
  Clone ID: SORBI-28MAY03-C52594_1.pep
ARGDYPRESCSSAFRLELESVRPEPQAPLEDYRLHLEILPLQLHLDQEQLNFLINFFKNDSCNNDAHLHCENETVHEENTSNGNNTVVDEALLPFFQKFDVKPLVLHINYIPRQFDPIALGKGNYAELLNILPWKGIDLKLKHVSAMGVYGWNSIGDTVAAEWLEDISKNQVHKLLKGLPPIRSLVAVGSGTRKLVSLPIKSYKKDRKLLKGVQRGAVAF

SEQ ID NO: 38270 - protein, 171 aa, Sorghum bicolor
  Clone ID: SORBI-28MAY03-C51865_1.pep
ARGSYAVFWKAIGAADPVHLVWEDGCCGHASCSAGSEAPEEAGCEPGTSVCTLVKKVMASQIHVVGEGAIGRAAFTGNHQWIVHDPAANDHNLRPEVAAEMNHQFAAGIQTIAIIPVLPRGVLQLGSTSVVAENTNLVLQYKKLCSHLDVRSSLAPPASVDIHAFPTGITI

SEQ ID NO: 38271 - protein, 162 aa, Sorghum bicolor
  Clone ID: SORBI-28MAY03-C51881_1.pep
MSAIMLCACSRDQSKFEDLPRSPESLATRDFSANCSSSKMASRETTPDDSQVNEVESDLKETLSLNYEEARALLGRLEHQRGNFDAALQVLQGIDIRSLRPRMTSAIAESIKPRTPPRSSRRKSSQVNGMLMHMSMHSVSLLLEAILLKAKSLDTLGRVADA

SEQ ID NO: 38272 - protein, 177 aa, Sorghum bicolor
  Clone ID: SORBI-28MAY03-C51895_1.pep
MDRARHRSSLSSERFLGSFVRPAAAGEQSASTAFELDEDDLFSAGSGSPEPPQPVRRPLILSSVRPANPSPLPRLRRPPEGILDALPERRRSPPPSSSSTSSSPASPAAAPARMIPAVPRPAPYMPQSLPVNVPVARLRKPPVVMVMGEAEDEDDEMLPPHEMVARARARESPMTTF

SEQ ID NO: 38273 - protein, 219 aa, Sorghum bicolor
  unsure (1)..(219): unsure at all Xaa locations
  Clone ID: SORBI-28MAY03-C51967_1.pep
MSAAVACAERATNDMLIGPDWAVNIELCDIINMDPGQAKDTLKLLKKRLGSKNSKVQILTLYVLETLSKNCGDIVHQQIVERDILSEMVKIVARGPDLNVREKILSLIDTWQVAFGGPXGKYKQYHVAYQELRAAGVDFPPREENSVPLFTPPQTQPLRHPHLYPPPGQSYEDAAIQASLQSAPPAPPLSLSEIQSARGIVDVLDEMLNALDHRHPEGV

SEQ ID NO: 38274 - protein, 92 aa, Sorghum bicolor
  Clone ID: SORBI-28MAY03-C52131_1.pep
KGNTMLDSNNHIFPTTKSHAKLSCCSLMGTLGRNANFMLIQITPPKMFQLKTFNLQLLKPKLVTESKSKKEKEKIRKFVAIDESLTDEASWC

SEQ ID NO: 38275 - protein, 93 aa, Sorghum bicolor
  Clone ID: SORBI-28MAY03-C52103_1.pep
QAKGAGSVLSFLTGSWALSKHVVETTKHFSVTVSFGSVKSLISLPCFMSHAAIPAAVREERGLTDDLVRISVGIEDVEDLIADLDRALRTSPA

SEQ ID NO: 38276 - protein, 232 aa, Sorghum bicolor
  Clone ID: SORBI-28MAY03-C5213_1.pep
NLVGYCAEGGGHMLLYAYMPNGSLASHLYGENSAPLKWDLRVNIALDVARGLEYLHDGAGPPVVHRDIKSPNILLDQAMHARVADFGLSREEMVTRNGANIRGTYGYLDPEYVSTRSFTKKSDVYSYGVLLFELIAGRNPQQGLMEYVELAAINADAKTGWEEIADSRLEGAFDMEELNDMSAVAYRCVSRVSRKRPAMRDVVQALTRVLKRSRSRKHHSNRHSQARPDDES

SEQ ID NO: 38277 - protein, 94 aa, Sorghum bicolor
  Clone ID: SORBI-28MAY03-C52745_1.pep
IIYLHVGGRTRNNDWTLSQELWVESFWMVQLRVTSRLLSSRCWERNRDSNKKNYVLETCEPASGSHNFFRMIKIISFSSDSGLGSASTTVIASQ

SEQ ID NO: 38278 - protein, 133 aa, Sorghum bicolor
  Clone ID: SORBI-28MAY03-C52778_1.pep
YDGDMYLESAERYDPREGFWVRLPSMSTRRGCHTLTVLGDTLYAMGGYDGDKMVSSVEIYDPRLNAWRMGDPMNPPRGYAAAVYLDDSLFVIGGMQSSVQILDTVEVYNANSGWSVLGFSSIGKRSFASAVVM

SEQ ID NO: 38279 - protein, 60 aa, Sorghum bicolor
  Clone ID: SORBI-28MAY03-C52899_1.pep
QTTLLQTCLFRGRGGSGRSYGATATSRDPINLNWLLGGGAPLKLLRFGTRDLLIHLNFGF

SEQ ID NO: 38280 - protein, 75 aa, Sorghum bicolor
  Clone ID: SORBI-28MAY03-C52816_1.pep
TLGHLVEHDSKAHSRRQNNLTRHIPFSRNHNPKMRCHFYTLGNLSAAANHDCSSQNTGSHNLVTKIHLYLANQVV

SEQ ID NO: 38281 - protein, 91 aa, Sorghum bicolor
  Clone ID: SORBI-28MAY03-C52903_1.pep
FDAKTWQAFPDTKTQARPKVDHATNGSQNINKNITSGASPDAWGFGSDNFRTSAAVSATQINRAAAQGSSSQRFNAGVAKKVEQPSGWAGF

SEQ ID NO: 38282 - protein, 270 aa, Sorghum bicolor
  unsure (1)..(270): unsure at all Xaa locations
  Clone ID: SORBI-28MAY03-C52387_1.pep
MAGQTAKAKEAGKDDRQEPGARATKEKLLPSHKQQEPPASVVDKDSSGVSSVPGDESPPVLDGDSGELKEEENLDGNGNKEKKTSQKSSTSDGFASAKVSDGTSSLRKTSGSATMSTRADFTESGKSSMCRASTXSDISDESSCSSMSSATTKPHKXNDSRWEAIHVVKSRDNALGLNHFRLLKKLGSGDIGSVYLSELSGTRSYFAMKVMDKTSLASRKKLLRAQTEREILQSLDHPFLPTLYTHFETDKFSCLVMEFCPGGDLHTLRQ

SEQ ID NO: 38283 - protein, 119 aa, Sorghum bicolor
  Clone ID: SORBI-28MAY03-C52235_1.pep
DGFNVPVRVAPSGGGGDCRPAACAGDVNAMCPADLRVVASSSSGGGGVVACKSACGAYGGARYCCTGQYGTPATCGPTNYSQVFKSVCPSAYSYAYDDASSTFTCSGASTYDVTFCPGS

SEQ ID NO: 38284 - protein, 344 aa, Sorghum bicolor
  Clone ID: SORBI-28MAY03-C52428_1.pep
KDSDDEVALEACEFWSAYCDVSMPPEGLREFLPRLIPTLLSNMVYADDDESLDDAEEDESFPDRDQDLKPRFHASRLHGSETGDDDDDDAVNVWNLRKCSAAGLARRSNVFGDSILPTLMPLIEQNLARTDDDSWKERETAVLCLGAIAEGCISGLYPHLPQIVAFLIPLLDDKFPLIRSITCWTLSRYSKFIVQSLDHPNGREQFDKILMGLLRRILDTNKRVQEAACSAFATLEEEASEELVPHLEVILQHLMCAYGKYQRRNLRILYDALGTLADAVGAELNQAKYLDIFMPPLITKWQQLSNSDKDLFPLLECFTSVAQALGPGFAQFAEPVFQRCINLI

SEQ ID NO: 38285 - protein, 287 aa, Sorghum bicolor
  unsure (1)..(287): unsure at all Xaa locations
  Clone ID: SORBI-28MAY03-C52527_1.pep
MARSKNGCLKILVCAGSGSDPAAGSDADADDHPDENKAISDKSRWSFRRRSTRHRVLKNSDISEPETLSSSKAKADITPSNNVYTSTYSYASEKPLQHDKPEEKILHQEPEEKPLHQENSDEKLMEKPIEKPINKLMEEPADQIFEKSIELPNSKDXESPTDEPAEKINDAPTEEPAEKITETAYENTAEGKIENATEETPERAVEELIEEPDETISVSSTGPKQGENTSLVEGSSADPEEDHLDSAATNLQPVSGTCIATEELLNQKDLVKLQAVIRGHLVRKQAS

SEQ ID NO: 38286 - protein, 138 aa, Sorghum bicolor
  Clone ID: SORBI-28MAY03-C52509_1.pep
MEGLIKGLVHVAIDAVEDAVRERDHGRGGDDDGEAPRRRREPQRADPDADGDEEEERDERSRSTWAEVVSEQKGSDPDERRDHRSSGRDNRHERMEDEGWKRADGRNQPQHPAGRHNKCEGQERWDGGSRRPQQQQQA

SEQ ID NO: 38287 - protein, 299 aa, Sorghum bicolor
  Clone ID: SORBI-28MAY03-C52546_1.pep
MVEDWVFSALIVAFLAFITPCESFYLPGSYMHTYQQGEVIRAKVNSLTSIETELPFSYYSLPYCRPQDGVKKSAENLGELLMGDQIDNSPYRFHVNVNESLYLCTTNPLEGAAAELLPRPRRVRRQVGRSRARRPRCRSPAPAASTIQWTGYPVGYIPEGTSDVYIINHLKFKVLVHKYEQGKVKVVGTGEGMEFISEADSDAKSGYEIVGFEVVPCSVKRPEAMSKFNMYDKVDSVNCPVELEKSQLVREKEKITFTYEVEFVNSDIRWPSRWDAYLKMEGSKIHWFSIMNSLMGILF

SEQ ID NO: 38288 - protein, 77 aa, Sorghum bicolor
  Clone ID: SORBI-28MAY03-C53356_1.pep
SATIAGFFLIRGLNAEPDQFDADADESETPRAPLPLHSKVGSAVKTGFWTMVDMASGRYLWRTLVAQPAKSESDKAR

SEQ ID NO: 38289 - protein, 105 aa, Sorghum bicolor
  Clone ID: SORBI-28MAY03-C53363_1.pep
IHPLNCRFNFIQTSSSLQSCISYSCPYLILFNGVLDSVDSRILYRTRTKISRNSLCTEAEDDLFMGHGRCNVVPGAPYSLFLNNLTQTFLTNRNTESLRHFSRTI

SEQ ID NO: 38290 - protein, 79 aa, Sorghum bicolor
  Clone ID: SORBI-28MAY03-C53408_1.pep
RFLGFRRSVVLDRRKLVELLDLYTNKTISWDNFASSVHEAHKDRVAQPSCRRKLENRPKEEDYFYANPHECLANSTLCS

SEQ ID NO: 38291 - protein, 87 aa, Sorghum bicolor
  Clone ID: SORBI-28MAY03-C53477_1.pep
LVKLEESDHIRHGRYTCSICRYPIIGSRFKETKHSFSLCNRCYSEGKVPSAYKLEEYRFKEYGNESEALIDKCMCFNLHSKKLESDA

SEQ ID NO: 38292 - protein, 190 aa, Sorghum bicolor
  Clone ID: SORBI-28MAY03-C52642_1.pep
SPYQMARTHYHATSPLMLHWNRGPRSDKELLTEVPQSGAIKTLYLHIVWHLQQSTEEHPWYMCANMLQLEPKIPEFQPSDLLIQRPPAATRSPPPLRRRCTLLLFLSRPIPRAAARLPIRWDPCPRAAPRGPSGEQATGGGAGGAGRGIRAPGGRRLGFWSGEERSGAERGREGGRDAKVLRGFEMEPRA

SEQ ID NO: 38293 - protein, 318 aa, Sorghum bicolor
  Clone ID: SORBI-28MAY03-C52657_1.pep
NNALQPNMPFSYGSSCGSFGSHGSFNDNAGISYGSYDFNSVNIYNSPMDPSGFNLRSQLGGSFLGSSPDIRRRPHLSHGGGIRLSPGGPGHMSLGASPSQFTPPNSQMQIPPRPNGKYGASPSRGGHGSSLGKVAAVGQYNRRRNQGYPPMPVPPHEHTSQLIQGHQGDGVSTARVDAHGRGNSSYLHNALPNSSHYSWRSQRGFGSGLPLDPSSSHGSFPPTNYNGFPLHSDASADALPSTSSVPDPADWDPNYSDESLLQEDRSLSAGLSGLHLRDASGQTNRSSRLAPIQSHDILSSNPSPLNQRSGHLFHASSL

SEQ ID NO: 38294 - protein, 62 aa, Sorghum bicolor
  Clone ID: SORBI-28MAY03-C52652_1.pep
MWKLNPFGGKAQSGLDGRTIDVGSVKITVRNAIAQGGFSCVYLACDTVHPSKMYALKHIICN

SEQ ID NO: 38295 - protein, 164 aa, Sorghum bicolor
  Clone ID: SORBI-28MAY03-C5268_1.pep
SKISLYISTYSCSFVHEIYVNKHMQMHTLYTQVQDPIKESDRRASKKLHSSGFLLLLFTPTTAAGISSHGTTIVAWQLSTRCFRGTVHVLCCCHGRLQWSRNISPQVPITRLLPRNQPGLPDGRRSLWHNDARWLRGNPAALEFCRNRCRVIHGIASMVIGRTP

SEQ ID NO: 38296 - protein, 194 aa, Sorghum bicolor
  Clone ID: SORBI-28MAY03-C5270_1.pep
SSSRPEPRPSQVTTSPPRALLSLSCRIRSRTAPAHPVPGGRRPDPRPFCRSVVLPSISGLHYLASFLSCFWIYHWISSSGRTTMGLLALQRLMSLQRDRQRRQQRTQALNGSIDSSMDIRKCSPCEQDTHGDSHAAKRMMCSIPTLPEDILQHIHSLLPLRDAARAACSSHAFLRFWRCHPNLTLNWHILGSNA

SEQ ID NO: 38297 - protein, 118 aa, Sorghum bicolor
  unsure (1)..(118): unsure at all Xaa locations
  Clone ID: SORBI-28MAY03-C5273_1.pep
MDMSPNPDSPSSGGGNGIGPSSGGASPSVGSMTAPQSPSRYEAQKRRDWNTFGQYLRNHRPPLSLAQCSGAHVLEFLRYLDQFGKTKVHGPACPFFGHPNPAAPGPWPLXQAWGSLDA

SEQ ID NO: 38298 - protein, 137 aa, Sorghum bicolor
  Clone ID: SORBI-28MAY03-C53762_1.pep
MTDGGEDGNAAAPRGPARRRGPVRASLDADEFIALMHGSDPVRVELTRLENELRDKERELGEAQTEIRALRLSERAREKAVEELTDELEKMAEKLKLTESLLESKNLEVKKINDEKKAALAAQFAAEATLRRVHAAQ

SEQ ID NO: 38299 - protein, 148 aa, Sorghum bicolor
  Clone ID: SORBI-28MAY03-C53800_1.pep
MAAAFTVISLLLSVCVQGAAPVLGFTRSDFPEDFVFGSATSAYQYEGAVAEDGRSPSIWDTFTHAGNMPDKSNGDIAADGYNKYKDDVKLVIDSNLEAYRFSISWSRLIPNGRGAINPKGLEYYNNLIDELATHGVQVHVMISQLDPP

SEQ ID NO: 38300 - protein, 213 aa, Sorghum bicolor
  unsure (1)..(213): unsure at all Xaa locations
  Clone ID: SORBI-28MAY03-C53809_1.pep
LLGPTPRPRSALLRPPASPGRSTPRPLGPPLPRPRPRGXSPPFPWVPPPPLPQRPGSWSPPPLPRPRRLLPSPQPSPPSRFRPPPPPPSPGLPWPIPQPSKANPSTPGSVKARPPLACPPTPPTGKATKFKKVKPSNVAEASPVVQTPKSTTFAEASPVAQTQKPATDAEGSVPAPMPAIAEASASSPKPKPKPKPKPAHANADAAAAISASK

SEQ ID NO: 38301 - protein, 84 aa, Sorghum bicolor
  Clone ID: SORBI-28MAY03-C53823_1.pep
DHRKALADREFEALQDRISGKMINFQRVSCINGTVPLSPSLMSAEELCSTCKVQIVIHHIVCFFGTVLFHFIQLDLLKLVDKMF

SEQ ID NO: 38302 - protein, 123 aa, Sorghum bicolor
  Clone ID: SORBI-28MAY03-C53061_1.pep
ILSSIWLGRFYYVFGFLFIVLFLLVIVCGEVSLVLTYMHLCVEDWKWWWKAFFASGSVAFYVFLYSINYLVFDLRSLSGPVSATLYLGYSLIMALAIMLSTGAIGFLLSFYFVHYLFSSVKID

SEQ ID NO: 38303 - protein, 151 aa, Sorghum bicolor
  Clone ID: SORBI-28MAY03-C53087_1.pep
GFPVVDEPPLSEAPELVGLVLRSHLLVLLKGMGFMKEKMKTSGSFVLQRFGAFDFAKPGSGKGLKIEDLPFTDEEMDMYVDLHPITNTSPYTVVETMSLAKPAVLFRALGLRHLLVVPKTPGRPPIVGILTRHDFMPEHIHGLFPNIHKSH

SEQ ID NO: 38304 - protein, 151 aa, Sorghum bicolor
  Clone ID: SORBI-28MAY03-C53227_1.pep
GGFVVAGRVNGSLNLSRAIGDMELKQNELLPAERQIVTAEPELKTVQLSEDDEFIVLACDGIWDCMSSQEVVDFVHKQLKTEDKLSSVCEKMLNRCVAPTSGGEGCDNMTVIVVQFKKPASAVATSSTEQSSATAEEMRPNELDGPDNPPK

SEQ ID NO: 38305 - protein, 102 aa, Sorghum bicolor
  Clone ID: SORBI-28MAY03-C53271_1.pep
LMEGKPNPEVDSYLLFDPRALRSGSGGQFKGPFREAIVFMIGGGNYIEYRSLMELAECSQPSKHVIYGATEIVNGVEFIEQLAELGQKAGLCGGVNNPPPLQ

SEQ ID NO: 38306 - protein, 100 aa, Sorghum bicolor
  Clone ID: SORBI-28MAY03-C53286_1.pep
AAASADDADLDPGVAELPPRPLLEILARELRRRLGLRLFNIDMIRQHGTRDRFYVIDMNYFPGYGKMPGYEHVFTDFLLSLGQKEYKRRPSYGSLSSGEG

SEQ ID NO: 38307 - protein, 137 aa, Sorghum bicolor
  Clone ID: SORBI-28MAY03-C53351_1.pep
CHFSWLYVQFVEDGEERVVVGSLDLNQCLWLPDELTGKKPGVNEDIQTRAYLSNVCVAKEVQKKGLGYTLVDKSKKLAREWGITDLYVHVAIDNIAGQKLYEKSGFVYEGEEPAWKARFLGRPRRLLLWLDMSKVPL

SEQ ID NO: 38308 - protein, 213 aa, Sorghum bicolor
  Clone ID: SORBI-28MAY03-C54056_1.pep
MWRGGATAASAARALRSRLLLDPIHHPATSLGPIASTRTSSSSTSSTAAANAIVEEAAAAAAAAVSVSQHTGSISDALRHYGNCYWELSKARLSALVVATSGAGYVLGSGNIVDIAGLCCTCAGTMMVAASANTLNQVFEIKNDAKMKRTMRRPLPSGRISPAHAAMWATSVGVAGTALLAWKANGLAAGLAASNLVLYAFVYTPLKQIHPVN

SEQ ID NO: 38309 - protein, 89 aa, Sorghum bicolor
  Clone ID: SORBI-28MAY03-C54064_1.pep
HEVKMLQLENICLQLRFKEHQIATMFPDLPWMVVKEKVAPSQEHNDGTRKKGRRPNRKGGLCNAVAFAVGVGLVGAGLLLGWTLGWLLP

SEQ ID NO: 38310 - protein, 135 aa, Sorghum bicolor
  Clone ID: SORBI-28MAY03-C5407_1.pep
DSWATMAPTLTRADRLVGQVLGEVGSLPDVYVELEINFFLLRRLLGVRTKGTEKAGKVSKLTKGEILMLNIGSMSTGARVLAVKNDLAKLQLTAPVCTSRGEKVALSRRVEKHWRLIGWGQIQAGTTLDVPPCPL

SEQ ID NO: 38311 - protein, 104 aa, Sorghum bicolor
  Clone ID: SORBI-28MAY03-C54090_1.pep
VWRRTRNILLAARSDCQIVIGKMCSEIFLSGHVGFKLSTSWIESTNLEAYQRICVAKIEEIFIPWHSMNGTSRFTSSTCGCNALVCRTQTDSELNACDPCDPVH

SEQ ID NO: 38312 - protein, 138 aa, Sorghum bicolor
  Clone ID: SORBI-28MAY03-C53424_1.pep
SEVAGSWAVETGPSVHGENESPRSLGDAADATEQDEDGGSEAADALLTLVNSEGQAAGSQNNVEHASSKITNDHRVLSAMIGIVDPEFRKQMSRSGVGNEEPMSDAETDEGVEEGDSDSDTGSDGSDSEEAMVEDSVG

SEQ ID NO: 38313 - protein, 135 aa, Sorghum bicolor
  Clone ID: SORBI-28MAY03-C53492_1.pep
YYTVILAGSITDNTKVTSPQPALPRKWRVLTDGACYMLQQKGNISDDRYMLQQLSVWLCSFVFRLWNSCLLRRSYRKNEICEMRAYFHLCPLGQVLADSKLGGRSERLSPVFSGWMTMISLFQSVLLCTMALRKL

SEQ ID NO: 38314 - protein, 111 aa, Sorghum bicolor
  Clone ID: SORBI-28MAY03-C5360_1.pep
VFGHQFCAFLCCTCFHFGTINVSVHIFSTIDDACLLLHKKKHCSSFSIQSCGCINNHSVLFRPVGCIFIWYVIWTSLLPYFPSVCMRLILGVMETAESRWSVVHWFVQQSQ

SEQ ID NO: 38315 - protein, 340 aa, Sorghum bicolor
  Clone ID: SORBI-28MAY03-C53752_1.pep
SVLEVVVKDKDLIKDDFVGFVRFDLNDVPIRVPPDSPLAPEWYRLVGKSGDKSMGELMLAVWVGTQADEAFPDAWHSDAATLEDPSAVTHMKSKVYHAPRLWYLRVNIVEAQDVAIFDKTRFPDVFVRAQVGHQLGRTKPVQARNFNPFWNEDLMFVAAEPFEDHLVLTLEDRVAPGKDELLGRVIIPLAMIDRRADDRIVHGKWFNLEKPVLVDVDQLKKEKFSTRLHLRLCLDGGYHVLDESTNYSSDLRPTAKQLWKPSIGLLELGVLGAQGIVPMKTRDGKGSSDTYCVAKYGSKWIRTRTIMNNPNPRFNEQYTWEVYDPATVLTVGVFDNGQLG

SEQ ID NO: 38316 - protein, 226 aa, Sorghum bicolor
  unsure (1)..(226): unsure at all Xaa locations
  Clone ID: SORBI-28MAY03-C53720_1.pep
TREEKEQEPFAVPTSGAFYMHHDGFQEENRGRRRRMFGGRKLWDAKDDQAWVHDRFEEMNLHDDRYEDQRMSRGRFRGRGGRGKARGGGRGFSRGGKQRNYNDHEDGNNQNRPPKVVRGRGPRRYEAVARNSREVVGSQRKQAARFREPAPNAAAARDSGQVSHAQPEAAPPKKNVISSSLNSASPPFYPSGAATQDFPVAAXRRDIQTGGSNKIPPSSMKMDDNS

SEQ ID NO: 38317 - protein, 176 aa, Sorghum bicolor
  Clone ID: SORBI-28MAY03-C53678_1.pep
TSESGANITISKEEFESLSRKVEESEKLSEMKVAAAMAQVEAIRASENEAIKKLEAARKEMEEMELATEEALKRAEMAEAAKKAVEGELKRWREKEQKKTAEAHPLAGAEELGSASPSVPQTSAGKASEKNDGHQRNSRTLLRRSFMLPNITSMFHKKKSHPGSSSPSYLPGEKSV

SEQ ID NO: 38318 - protein, 300 aa, Sorghum bicolor
  Clone ID: SORBI-28MAY03-C5438_1.pep
TRRLTNENRLPHLLLYGPPGTGKTSTILAVARKLYGSQYSNMILELNASDERGTGVVRQQIQDFAGARSLSFGARPSVKLVLLDEADAMTKDAQFALRRVIEKYTRSTRFALICNHVNKIIPALQSRCTRFRFAPLDGSHVRERLQHIIKSEGLSVDEGGLTALVRLSNGDMRKALNILQSTHMASQQITEEAVYLCTGNPMPNDIERIAFWLLNEPFSTSFKHISDMKMRKGLALVDIIREVTMFVFKIEMPSDVRVKLINNLADIEYRLSFACNDKLQLGALISAFTDTRTAMVAAAS

SEQ ID NO: 38319 - protein, 217 aa, Sorghum bicolor
  Clone ID: SORBI-28MAY03-C54496_1.pep
TRVKTMTKLSSSGILFEVHMAAEELQKKIDEKSYLLVNTERWDSSKQAQGIKEVLNGTRAVEKENKNKENKNDGTSAVEKENKAKENNNGGMEPTMVDQTLVHQSKSFLANSFLSRYDSASTIDGFKPLLSWPARRSFHPNIPLEDEDSQTYESASALSLATFASLLIEFVARLQNVVNAFEELSEKANFKDPVEEPSAVSTSDVRVFDKIRKLVGF

SEQ ID NO: 38320 - protein, 180 aa, Sorghum bicolor
  Clone ID: SORBI-28MAY03-C54637_1.pep
MENLLSSASHETLPDSFVFPAEQRPPASSAAVELPVIDLSGPRDEVRRAVLEAGKELGFFQVVNHGVPEQAVRDMEACCEEFFRLPAEDKAAFYSEDTGKPNRLFTSTTYGTGGERYWRDCLRLACAFPVAADAKTNWPDKPDGLREATERFVAPTRALGMELLRLLCEGVGLPPDYFEG

SEQ ID NO: 38321 - protein, 132 aa, Sorghum bicolor
  Clone ID: SORBI-28MAY03-C54657_1.pep
QKLFPASSVIAFNPAIMSRADMAIIPSFAYRTHAHQVRQQGEYESLHRDMMVGFGKWSWSPVELEDPFPGGEGKVHLWHGAEDLIVPVGMSRYIAESLPWVRYHELPTAGHLFPMAPGMADVIVKSLLLGDE

SEQ ID NO: 38322 - protein, 71 aa, Sorghum bicolor
  Clone ID: SORBI-28MAY03-C54666_1.pep
IALAIRSSVGWLRLCAADFAMEKLHHNHNSNSSQPIKMKTAKMLNQYRRLLPCTFHYFVLMYHSLCSRFNV

SEQ ID NO: 38323 - protein, 159 aa, Sorghum bicolor
  Clone ID: SORBI-28MAY03-C53834_1.pep
HEASISIPFARPTAAMSRRGAMSSTAAPRARLSPPAPASHPPPRKRGRSPSSAPGSTASSWRASAENAVPLDHHRRRWHNPERAPGRVWQRFRAPQLALPSSRLWVCSEDASTSPSGDACTIMSYNILADYNAQNHPDLYLDVPWDALRWDSRRRLIIR

SEQ ID NO: 38324 - protein, 145 aa, Sorghum bicolor
  Clone ID: SORBI-28MAY03-C53879_1.pep
MARSRPRVWLVAGCAAVLLWASVAQLVAVGRLLQPFGLAGDAVPSPPPSALPPPRIYRSNGYLKISCNGGLNQMRSEICDMVAVARLLNLTMVVPELDKRSFWADQSNFGDIFDVRHFIDSLRDEVHIIKQLPEKLGPTDSDIII

SEQ ID NO: 38325 - protein, 134 aa, Sorghum bicolor
  Clone ID: SORBI-28MAY03-C53962_1.pep
MAEETANEVQVAQDNEIVPGNEAIQGDEFVHGDELIQGEELAHGEELPQGDDLVQGNELVVSEVATPPTTGTRRRRKKSLVWEHFTIEAVAGGATRACCKLCKQTFAYSSGSKIAGTSHLKRHITLGSCPKIKN

SEQ ID NO: 38326 - protein, 245 aa, Sorghum bicolor
  Clone ID: SORBI-28MAY03-C53975_1.pep
MEDLLNTEIGKNDYDWLLTPPGTPRVPALDAAEKAPPSTVTKRTVNRSSSTTRASRLSTSETENGHSTFPTRPARSISVSRRAVQSTPMSSNSRSSVLSANISSVSSRPTTPSKRTATLTASKASVLSSRPVPTRSSTPVKARLSTPTNTRPSTPVKNRPSVSNSMTNSVVPKNMSAQSSRSSTPTSRSRTLSSSSSSSTSAVSRPSSSSGKVPAISRTSSSSSTVPSVSRSSSRSSTPTRQPVM

SEQ ID NO: 38327 - protein, 214 aa, Sorghum bicolor
  Clone ID: SORBI-28MAY03-C53984_1.pep
MRSDDIAAAAAPPRPAPAPEASPAGPPTIPTILRPPAAEMELLCPSAKRRRSEDLAADEPQPRATEATEAANLGPATQSEEPPPPPPSEAAAGGGGGGGEDDVDRISGLPDAVLGEIVSLLSTKEAARTQILASRWRHVWLASPLVLDGTDLSTEPMAYRRDDKKFNADNEALASAVSRILSAHPGPARRFCVPPHFLQDRPATVDAWLSSAAL

SEQ ID NO: 38328 - protein, 162 aa, Sorghum bicolor
  unsure (1)..(162): unsure at all Xaa locations
  Clone ID: SORBI-28MAY03-C5404_1.pep
MATTCSLLPMNNNSLPCLLVVVLLAVSLGAGSCSPTVHLVGGGGGYVDDSSSIDSATDDQMMERFQRWKVEYNRSYATASEERHRFQVYAGNMRYILARNGEDPSYELXETEYTDLTTDEFMAMYTTATLALDDGFDDDGDSNDGGDGDDDSDGDDGGDFDT

SEQ ID NO: 38329 - protein, 145 aa, Sorghum bicolor
  Clone ID: SORBI-28MAY03-C54018_1.pep
FLPCCQLDISQAFKVEKEAFCSIMALPTPAPVLFNENLQINGGKRADGLRAKGLKPSENPGKQGRRALQNLSNISRGTGLKDTSTLKEKSKQKPRSNVTNTIKGTALKDKPILKEKSTQKQRSEALKNPLKILTDEEIKMCHEWA

SEQ ID NO: 38330 - protein, 98 aa, Sorghum bicolor
  Clone ID: SORBI-28MAY03-C54847_1.pep
DWQMTKEKLFHKVRQRHMRASLTSMGTNRFCLVQCVKREEVGEGPALGDHDGCVLHLTIFGLKYNHKGELQTTDHHQSTRSFIVSRYRDHFAPIAFWM

SEQ ID NO: 38331 - protein, 166 aa, Sorghum bicolor
  Clone ID: SORBI-28MAY03-C5482_1.pep
GTDPRQITAATTGKTRTRTGAAPAPALACAGETTGPASVGPSHLDRIARRRPRPLRTKGGSNRVRLGFELPSGLLGFRVAEGGERGERGLRSGGRGSPRRCPRRSGEGRRRGRGRRRRPPWRAGRRASGVEERGQGLAPLVISGELVGEVARAPPDGGAGKAAGRI

SEQ ID NO: 38332 - protein, 80 aa, Sorghum bicolor
  Clone ID: SORBI-28MAY03-C54947_1.pep
HFETTTEAGEEEAASLEAARMTGVVHVRGKMRFYVGDDAGWFDKVMLGFYEFLHGICRSALPALGTPLQQRVEIGMLYKV

SEQ ID NO: 38333 - protein, 186 aa, Sorghum bicolor
  Clone ID: SORBI-28MAY03-C55035_1.pep
NRAYPATMHGALLSGLREASKIHRASESLVNSDQKKNSLPKRLKPPNGALLDLFLEPDLEFGRFSFVFSSLTPDDPEATGILRFSLDKRFFLQPNNPELDGDQKDYSSASGAFHLYATVSREQADQLQKSSEDDRTRLGVLCKDFSVKLMGYDNTCDVGSDLISSILSARKARKLLQHPKNFKISR

SEQ ID NO: 38334 - protein, 153 aa, Sorghum bicolor
  unsure (1)..(153): unsure at all Xaa locations
  Clone ID: SORBI-28MAY03-C5501_1.pep
MQTKSGARIQLIPQHPPEGVTLTERIVRITGNKKQIEIVKDLIKQAMNQTFSKHTNQSGGYGPQGYRPQGHGAGSQWGPRSQNHGYGYPPRGMPXPQNYNAPYGGYPPQGPPRGGMGWDQKQGPPPHSSYQGWGDYYKQGSQPYDSQATSYPS

SEQ ID NO: 38335 - protein, 77 aa, Sorghum bicolor
  Clone ID: LIB3476-027-P1-K1-A10.pep
FVVSVIYFPFWFLTCFLVQTFSKHTNQSGGYGPQGYRPQGHGAGSQWGPRSQNHGYGYPPRGMPPPQNYNAPYGGYP

SEQ ID NO: 38336 - protein, 78 aa, Sorghum bicolor
  Clone ID: SORBI-28MAY03-C60938_1.pep
PTCKFHTSDMIFFVSVRWLLPWHVIMVSEPLFYGTVIELPIVCMVCWLKTTYRYYVFDVKNIVWLSRFLLLINSNFLM

SEQ ID NO: 38337 - protein, 338 aa, Sorghum bicolor
  Clone ID: SORBI-28MAY03-C6102_1.pep
MGMKSSYTYTSMMKLYLETGQLERVHAMFQDMEEKGVKPDTFSVESMLAAYIAAEDVEGVGKVLDKANPHEKLVKWHGQALAASLFMKSGMQVRAVMALLEAERRISPKSSRIAYAFLLKTYTDLGMYPEVGRIWSVYKSKVPPSNTMYLSRISALLKMNDIDGAEATLKEWETVSLRYHDFRLINLMVDAYCREGLVEKAVALVDDAIKKGRTPYANTWYKLAGGFFKTGEVSKAVDMTRKALESATPPWKPDLTNVLMSLEHFMNQKDVEAAEEIASMLQKLGPLTKEVYHCLLKTYVRAGKPVSDLLERMKKDGLEADEETERMRVDLHPLSITK

SEQ ID NO: 38338 - protein, 133 aa, Sorghum bicolor
  Clone ID: SORBI-28MAY03-C61057_1.pep
FEPFSFLQQAGLTYLVYPGAFHTRFEHSLGVYSLAGKAINNLKTYLGVDLGIDHVDMQTVKLAGLLHDIGHGPFSHLFEHEFLPRVDPGSSWSHEDMSVLLLDSIVDKHAIDIENDYLKTIKDMITASSKHAI

SEQ ID NO: 38339 - protein, 122 aa, Sorghum bicolor
  Clone ID: SORBI-28MAY03-C61060_1.pep
QRRRPPATAGRPPNPRRRPRPGPPPPPPPARRVHAPPSGASTPRRRPSPGAPPTSPPPPPAPSPPPSGCSPRLQGASAARPGPPPPPSASAAPHPAPSSGDLPSPAPAAPPGARRPGDLEAY

SEQ ID NO: 38340 - protein, 207 aa, Sorghum bicolor
  Clone ID: SORBI-28MAY03-C61154_1.pep
ARGLLSLKAELSAYMVKKLTEEAEGVSKEHESEDSKHISNSVKEALASKQKELQEVKADIEKAKAEANVLRFAAMTLRSELDNEKASLVALQQGEAMASVAVSSLEAELNRTKQEIESVRSKEAEAEEKVVELPMVLQQATQEAEEARVAAHLAHEELRKAKEEFEQTKAAAAAAETRLSAVVKEAEASAASERLAREAVQALQESK

SEQ ID NO: 38341 - protein, 136 aa, Sorghum bicolor
  Clone ID: SORBI-28MAY03-C55421_1.pep
LKVGDFGLSKIIRAQHANDVYKMTGETGSYRYMAPEVFKHRKYDKKVDIFSFAMILYEMMEGDPPFSSYEPYEAAKYVADGHRPIFRKSHTNELKDLVELCWSGDISLRPSFLEILKRLEKLKEHYSHENHWHLFQ

SEQ ID NO: 38342 - protein, 137 aa, Sorghum bicolor
  Clone ID: SORBI-28MAY03-C55477_1.pep
GALPTVMRNGTNQAAMFSAKNTFDIVLWKKHEGDGKVLLPRQSMISGFLAGTAGPVCTGPFDVVKTRLMAQGRTGDIKYNGMVHAIRTIYSEEGLRALWKGLLPRLMRIPPGQAIMWAVADQVMGLYERTYLQPVHI

SEQ ID NO: 38343 - protein, 239 aa, Sorghum bicolor
  Clone ID: SORBI-28MAY03-C55531_1.pep
MRTNPTTSRPGVSTIEEKSVGRIDQIIGPVLDITFPPGKLPYIYNALIVKSRDTADKQINVTCEVQQLLGNNRVRAVAMSATDGLMRGMEVIDTGTPLSVPVGGATLGRIFNVLGEPIDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQM

SEQ ID NO: 38344 - protein, 161 aa, Sorghum bicolor
  Clone ID: SORBI-28MAY03-C5546_1.pep
HASAHASGKDVLDEATTMRLLESYGRVDELVYFAGLKEQYEIVVHHYIQQGEARKALEVLQRRNVPVDLVYKFAPDLIMLDAYETVESWMMVRNKLNPGKLIPAMMRYVSEPHAKNETHEVIKYLEFCVKDLNNEDPGVHNLLLSLYAKKEDESQLLQFLD

SEQ ID NO: 38345 - protein, 154 aa, Sorghum bicolor
  Clone ID: SORBI-28MAY03-C54710_1.pep
PSTTPSSPEPAQPEPNSARVPADPAAPHQHDPGQRPPADASLIGSPRSMGSPGSANGRRGEYVRIPEEVEVASKGEGDAAAAVKAAAAAECPRVLRCRAIRWWAKVAVLGIFLAGAGAAAVVFLGPLLIKKVVSPILYWESTTFSRPAIALICF

SEQ ID NO: 38346 - protein, 81 aa, Sorghum bicolor
  Clone ID: SORBI-28MAY03-C5467_1.pep
IVIHVFSKLLQRPFSCTVDGCPLSYSRKDHLNRHLLTHEGKLFVCPIEGCGRKFNIKGNMQRHVQEIHKDGSPCESKKEFV

SEQ ID NO: 38347 - protein, 93 aa, Sorghum bicolor
  Clone ID: LIB3478-003-P1-K1-A10.pep
MASNGLVSGSGDRPEKLHQECLVHALLQRPFSCTADGCPLSYSRKDHLNRHLLTHEGKLCVCPIEGCGRKFNIKGNMQRHVQEIHKDGSSCEQ

SEQ ID NO: 38348 - protein, 159 aa, Sorghum bicolor
  Clone ID: SORBI-28MAY03-C54670_1.pep
GGSSERSRSRWPRCGAACRRRSGGPSRCSRSSSRSRATRRCCAASSPAPPTSGPTTPPPPRSRRTPPTSRGRGCFWTPAAAVATAPSTSAGSVAPETKQTSGSPITCCSHRRTCSPSTAATDGGAVVACRRVRASSSLVAPHHQLLALDVATAGGGLAF

SEQ ID NO: 38349 - protein, 138 aa, Sorghum bicolor
  Clone ID: SORBI-28MAY03-C5479_1.pep
EQEKLFGSKSSPALSLRKVVGARTNGGGDAANGTPVSWLSALQSRGGRTVSQDGRRDASRPVAPVNYAAVAKEDVPRRRRHTAQVNLYYELALGALKKVQHPCIYKLSTKEHETTMRGFLSDRFMPEQFSCAHGPLIY

SEQ ID NO: 38350 - protein, 281 aa, Sorghum bicolor
  unsure (1)..(281): unsure at all Xaa locations
  Clone ID: SORBI-28MAY03-C54749_1.pep
HEEFVYVGGLRDDVPPAEHDEVAHELLEGFGCVPTFLPADLRSRFYHGFCKQQLWPLFHYMLPLSPELGGRFDRLLWQAYVSVNKIFADKILEVISPDEDFVWVHDYHLMVLPTFLRKRFNRVKLGFFLHSPFPSSASYKTLPVREELLRSLLNADLIGFHTFDYARHFLSCCSRMLGLKYESQRGYIALEHDGRTVTIKILPVGVHLEQLQSVLNLPELGVKVGELLKQFRHRNRLLLLGVDDMDIFKGISLKLLAFEQLLMQHPEWRXRVVLVQIANPA

SEQ ID NO: 38351 - protein, 312 aa, Sorghum bicolor
  Clone ID: SORBI-28MAY03-C54816_1.pep
ARGPGMHRPLRIRDMPSFLVEEKTQDGLSKMILQSMRGLFQQMDEEKPVVLVNTFAALEDDVVLRAVQPYMDVEVFAVGPAVPLLKKKDDGGASEERLAQIHLFQHDETAAYMEWLDEQPEKSVVYLSFGSLLGYTRRQAEEVLHGLQASGRPYLWVVRREGRAEEVDDLCRLSTAAEKKAAGMVVEWCDQQRVLAHPSVGCFVTHCGWNSTLEAVVSGVPMVAVPSWSDQPVNAWLVEEGWQVGVRAERDGEGTLTRGELARCVELVMGAGDKAVQVRANASGLKQRAREAVAAGGPLETSLRRFVEFMQK

SEQ ID NO: 38352 - protein, 253 aa, Sorghum bicolor
  Clone ID: SORBI-28MAY03-C55767_1.pep
HERRDAASARAPPPACSLFLRVAAAAPSSVTSSSVLTQRGSGLLPSPRPASPRRHLTAAWSSKAAASASVEIQDDYADEMDAVNIAQDVTQLIGKTPMVYLNSVADGCVANIAAKLEYMGPCRSVKDRIGLSMINDAEEKGLISPDKTILVEPTTGNTGVAIAAVAAARGYKLIATMPSSIDVGRRVLLRAFGAEVVLTDPTKGLKGAFDKAEEIVLRTPNAYMFQQFNNEANSEIHFQTTGPEIWEDTLGFC

SEQ ID NO: 38353 - protein, 116 aa, Sorghum bicolor
  Clone ID: SORBI-28MAY03-C55729_1.pep
MISFNNLFGSSLQPSLKFYRKCLTNNPYFALTMHSVTKPLGTAMMVKRARLKPHATDMKRNPQVHELYELVYRLPENLSWLLAPPEVPKRPTSKKKKQKDEIVTSNSFGVILEWEG

SEQ ID NO: 38354 - protein, 159 aa, Sorghum bicolor
  Clone ID: SORBI-28MAY03-C55875_1.pep
MRCAAAALAVALIAAVAGAAAAGSPAAGTCARRGAPPFLDAVGSRCPFVRIEPSPPLEVRGEAVDTELNLRRRGASYFILFYAAWCPFSSKFQPTFEALSTMYPQIHHFAVEESSATPSLFSRYGVRGFPAILFVNETTMVRYRGSKDLNSLVNFYKET

SEQ ID NO: 38355 - protein, 228 aa, Sorghum bicolor
  Clone ID: SORBI-28MAY03-C55932_1.pep
MSGGFFRGTSADQDTRFSNKQAKLLKARGFAPELDHLVDMSKVKMDVMKPWIAKRVTELLGFEDEVLINFIYGLLEEKEADGKKIQIQLTGFMEKNTVKFMKELWSLLLSAQQNASGVPQQFLDEKEAEIQQKKAEDDRIAQEIQKKREKEAKDSELEKNKMTDGDAGNSRSFGDPVGSALNSTNFNADEEKDNDFKRSLRPKNRGSRRSRSISLSPRGRQRSISPRN

SEQ ID NO: 38356 - protein, 130 aa, Sorghum bicolor
  Clone ID: SORBI-28MAY03-C55961_1.pep
MAAHPLLSSAALVCCRLAPAGAVGERSRVPRLCVTTSARPAARAGGRARSLSVRCEQGAKGGAGAGGLDVWLSRGAMLGFVGAVAVELTTGKGVLQNVGLTAPLPTLALALTGVVGVLTAFLIFQSGTRD

SEQ ID NO: 38357 - protein, 109 aa, Sorghum bicolor
  Clone ID: SORBI-28MAY03-C5516_1.pep
FSSVLAASAPPASSQQAGTGGGGGNVTEPAAWTPRLRKTFLDGGGIEHWRGRRLVGRFQVCAVCTCCGGQHGMCIPAPCCYAINCNIPNRPFGVCSFTPRTCNCFNCHL

SEQ ID NO: 38358 - protein, 58 aa, Sorghum bicolor
  Clone ID: SORBI-28MAY03-C55213_1.pep
WRLKPSFQPKGRNFCFRSCYVLMFLYFFSSIPNLSEYQFPCFRIFIVFTYSIHLRFCS

SEQ ID NO: 38359 - protein, 160 aa, Sorghum bicolor
  Clone ID: SORBI-28MAY03-C55227_1.pep
IYDVRGMVRQFNKNLKVGHTDTWTAWVDGRNDVVTKACDIAITNGFPYWQGVPIKEALQKKTFQNSYWSVQKHVKAVNSKAAVWVGETGWPTKGPNYQKAAATTASLQSYYNNIGCWLWKQKDASGFWFTAFDAPLATPEVEKYFGIANKDRKLKFTLTC

SEQ ID NO: 38360 - protein, 108 aa, Sorghum bicolor
  Clone ID: SORBI-28MAY03-C55297_1.pep
FFFFFFLNDDLILNFRKFFVLARACNSKGIRRVRASTEAIHTDYTYRQQRPCQELKGEESKTLQKSKAHKLRERHAPMPMPSASCCRWHIPVKRPREAPKQIKALVRL

SEQ ID NO: 38361 - protein, 73 aa, Sorghum bicolor
  Clone ID: SORBI-28MAY03-C55372_1.pep
MDILTEPLTTKQGNEYSIPKCLKVLHDMDDVSDEMKHLAFHILKDAPNREIFMSYESRLRGLWLKKEVTKLGT

SEQ ID NO: 38362 - protein, 127 aa, Sorghum bicolor
  Clone ID: SORBI-28MAY03-C55384_1.pep
EFRKSPQLYPTGPLGAPFVPVGIAPTALVVLGEAPRQVLGVSLGSPIAPSAPAPSPVLLSHASGNSNHVEALRVYLLSRSLSRLKNDFQSGNGMITVDSIEGYPPISLQLGKHVFLSAGDFYLATRS

SEQ ID NO: 38363 - protein, 122 aa, Sorghum bicolor
  Clone ID: SORBI-28MAY03-C56203_1.pep
SCRRWQIYGIPCAHAAAALLSCGEDPRLYAHDCFSVMKYRETYSQPIYPIPDRSHWNNSSPGLQGVVSKADVILSPPNIRRPPGRPKMKILKIESMKRPKRIIQCGRCHLLGHSQKKCSLRI

SEQ ID NO: 38364 - protein, 201 aa, Sorghum bicolor
  Clone ID: SORBI-28MAY03-C5619_1.pep
MDAQRALLDELMGTARNLTDEEKKGHKELKWDDPDVCGPYMVRFCPHDLFVNTKSNLGPCSRIHDLKLKESFEKSPRHDTYMRRFEAELAQQCEKLVMDLDRKIRRGRERLAHDSAVPMPFPGRSPARLAVRAVLAVWLLVPCGEPGRPGRGHEAEALMRRVDILNAEKTALANQADNKVAMLEKKMELCETCGSFLVSDD

SEQ ID NO: 38365 - protein, 96 aa, Sorghum bicolor
  Clone ID: SORBI-28MAY03-C56253_1.pep
PVTSGAKANAIALKNAVSSAVDVMQVLGSSVCCMLSKVTDSTSLVSELSAVAGQEKAMLDECRELLATAAKLQVQESSLRTHLVQQRQRQGLNLAT

SEQ ID NO: 38366 - protein, 178 aa, Sorghum bicolor
  Clone ID: SORBI-28MAY03-C56257_1.pep
WPHAPCEDLLPALDGSATEMINGVVVQTGMHAKVSFEQLGDITIPKAVDCLRRDVAATSYEIMWKSKHGRAYLQVGKTTWRATAQEDRGRKHHKRLTGKKLLGWASANNEFMCSWIRHAPVQLQSLVVHWFQKEIQLPQPLLLKTNSCFHYCPIMLFSLKDNRSLVIRTIKSSSKFNG

SEQ ID NO: 38367 - protein, 110 aa, Sorghum bicolor
  Clone ID: SORBI-28MAY03-C56329_1.pep
ADELRTKVADEFIKRRAETEWFVEGDFDTYVSQIRKPHVWGGEPELFMASHVLQMPITVYMHDKEAGGLIAIAEYGQEYGTEAPIQVLYHGYGHYDALQIPGKGGPRSRL

SEQ ID NO: 38368 - protein, 271 aa, Sorghum bicolor
  Clone ID: SORBI-28MAY03-C55534_1.pep
MEVATATEASAPAASGGAARQTHPFPWLDAAISEPYYFLHLLAFFSYFAARSAALSADNGGELHDRLLRREIQAVLVFLVLFVVKIVKEETWETFIADSLLYAKGLLLAVTLVIDYWLVFAYFLGFLVIYAVAQQPPYDGLGHSNHLTPLQLESLLTEEPTSRFWLVEFRTSFSAKCIQASSVLPELSIMYSNKNISFGIIDLGHFPNAAAKFGISMWDHLPTYILFDKVTEVSRFPEITSESKVFVPKVTKKLLCQHFDLDRRLIGYLST

SEQ ID NO: 38369 - protein, 156 aa, Sorghum bicolor
  Clone ID: SORBI-28MAY03-C55551_1.pep
MATFTSPVLCNFMTIQQKSTPLLNNNSTKRPQHLSFPRTSRSVPTTLPGFRARQDLRVAAVYKVKLVGPEGQESVIDVPEDSYILDAAEEAGVELPYSCRAGACSTCAGKVLEGSVDQSDQSFLDDTQVGAGYALTCVAYPTSDCVIQTHREADLH

SEQ ID NO: 38370 - protein, 202 aa, Sorghum bicolor
  Clone ID: SORBI-28MAY03-C55663_1.pep
MAGDDGSIGSGSGGGGGGIRDREDEVHVQIAGSSKPETSSTNGTAPQNSHTRHWHWWLMVALNIFFLVAGQTASTLLGRFYYNQGGNSKWMSTFVQTAGFPVLFVALYLFRSKSPSTQTTTSNPETSVTRITLIYIGLGLIIAADDLMYSYGLLYLPVSTYSLICASQLAFNAVFSYVLNAQKFTALILNSVILLTFSAALL

SEQ ID NO: 38371 - protein, 99 aa, Sorghum bicolor
  Clone ID: SORBI-28MAY03-C5566_1.pep
PIHLEPDLTSLSEGDREALGYILEAAIVIDDIFYEQVWNSNKMLRDWLKAHSESSSFDKLKWAYHSINKSPWSCLDENKAFLSTADSAVKLLTDATKPV

SEQ ID NO: 38372 - protein, 286 aa, Sorghum bicolor
  unsure (1)..(286): unsure at all Xaa locations
  Clone ID: SORBI-28MAY03-C5571_1.pep
MSAMAAGRRLLHLPGLELCLRSRALTLLSSSRADGMARYWREPPRRKLVTCRQGAFEEGNAVRDKAVPISDELLGHCKDANGRALDLEPIGKSSANESVQLSFEEEESDDVVCEISESLVRDVEKAAIELLAARAFTVSELRKKLRSKKYPFDTIDAVIANFKSRGLLNDGFYAESFSRSRWLSSTWGPRRIKQALRQKGVPEAEVHKATRRVXQDVHGHGKEATFGISEASMDLWFAQASLQWQRGQSLTLENRRARIVRWLQYRGFNWAVTNSIIRRLEAQHPP

SEQ ID NO: 38373 - protein, 281 aa, Sorghum bicolor
  Clone ID: SORBI-28MAY03-C55698_1.pep
KKDTKPIQSRPERERTPESSPRGRQVLTEAKPKEEGGRGRRRRWRWDAPMRKFQDSVKALQADIDHANELASEFLRDYDGSVIQMRMAYSAVAHFLVQWTDCKLAGALGLLKVMLYKQAVKNCAAGTREASIREFYGIIFPSLLLLPSGITELDDRKQRKLCLKKFRSRDEQLSEVDTERELECGICLEVSRKIVLPDCAHTLCMRCFEDWNEKSKSCPFCRACLEEVKPGSLWMYTDDSDVVDMDTLTRENIRRLFMYINKLPLVVLHVVDLDIYEYRIK

SEQ ID NO: 38374 - protein, 255 aa, Sorghum bicolor
  Clone ID: SORBI-28MAY03-C56874_1.pep
MPVAPCSTRPSRGPPPWRARARAAPPSTPAAAPPAAAADRQGGELCSPVVCGGVNISFPFGIIADRATEANCGVLGFQVRCTNNTPYLGSYKGDYRFKILDIFYGDTSLLIADVHKLEDFNASASSSFKQPCYSPKNNCSAKLGYPFSISPANQNIIFYNCEETPTQAVRQSRGLVDTACGNKTLVGVAQRPDVPGSYFMEGCNATVVPMLVRSGEANPANYKELISDGFLLTWQEQPLPPPSPPSAAGVNGNGR

SEQ ID NO: 38375 - protein, 112 aa, Sorghum bicolor
  Clone ID: SORBI-28MAY03-C56986_1.pep
MDNLGRENGRQRPDQYKAVHTQWMMPQRQLKDHHSMNLLALMNEKDSAIRERDHALAEKKAAIAERDMAFAQRDPARAERFAAIVGRGNALAALELARTNGFNMNNGNGFHQ

SEQ ID NO: 38376 - protein, 226 aa, Sorghum bicolor
  Clone ID: SORBI-28MAY03-C5694_1.pep
FDAEESGGETGPRAAHRREALLASTGEPTSTQDRAATPTPTGTAHQASMRTLSCKRDALKPHGHGGPGRRGTRGRAGTRGRTSPGGGGAGTGQGRKAAQRDEGERSRSDHGADPATARGLEARQTEANGEAGDRRGGGRGRGRRRRPVDHSENLAPIWLPHWSRSRRGLHPNPRRGRSCTSAWRRCRRLLTHLVLSFKLPRGCSLSTAVAAAVAARVEMERRGGLS

SEQ ID NO: 38377 - protein, 108 aa, Sorghum bicolor
  Clone ID: LIB3476-009-P1-K1-F9.pep
DANTLEGAIFREHLGLNVHTRYFCLTFTNRFCSQSFHIDRDLQPRSTLSLLPLWDWPLGVQHPRVILMTDMTLSPLGEIWEGTLGSAAGRRREQPLCPRSTPGPGQRT

SEQ ID NO: 38378 - protein, 213 aa, Sorghum bicolor
  Clone ID: SORBI-28MAY03-C5706_1.pep
EDDPFRASDSYNVEGIGEDSGAFTSCVGTRWFRAPELLYGSTNYGLEIDLWSLGCILAELLKLEPLFPGMADIDQISRIINVLGDITEETFPGCSNLPDYNKIFFNKVGKPAGLEACLPNRSPTEVSIIKQLICYDTTKRASAADLLNHRYFMEEPLPAPIEGLQVPASKDDDDDSSMEEWGNYRDGVSDSDFDEFGSMDVTKTDNGFSIGFS

SEQ ID NO: 38379 - protein, 205 aa, Sorghum bicolor
  unsure (1)..(205): unsure at all Xaa locations
  Clone ID: SORBI-28MAY03-C57035_1.pep
TRIKTGGLVVWTKGDIHFVYKGSKYQQNAKHSHTFVTNVHKGSLVKQNVRGEADDAFQENDQSICGQKDEEPVKGTLYEREVNRLLDTLGPRFVDWWWDTPLPVDADLLPEFIPGFKTPFRQCPPGVRPTLADEELTYLRKLARPLPTHFALGRNTRLQGLAAAILKLWEKSLIAXIAVKVGIQNTNNEQMAWNLKHLTGGTVIL

SEQ ID NO: 38380 - protein, 129 aa, Sorghum bicolor
  Clone ID: SORBI-28MAY03-C56085_1.pep
VSGYMFGKGVYFADMFSKSANYCCASEACRSGVLLLCEVALGDMNELLNADYNANNLPKGKLSTKGVGQTAPDMVESKITDDGVVVPLGKPKQEPSKRGGLRYNEYIVYNVDQIRMRYVLLVNFNFKRR

SEQ ID NO: 38381 - protein, 78 aa, Sorghum bicolor
  Clone ID: SORBI-28MAY03-C56089_1.pep
MIHDILTDRDDDHDYYYHYRSGSGSRRSSERHRSHDSDGSRRRRGRSRSRSKSPWREGSEERRAKIEQWNREREAAQV

SEQ ID NO: 38382 - protein, 114 aa, Sorghum bicolor
  Clone ID: SORBI-28MAY03-C56165_1.pep
VALKATNGIVEEATEEELMNAMSLADRTGMFACPHTGVALAALFKLRDQRIIGPNDRTVVVSTAHGLKFSQSKIDYHDSKIEDMACKYSNPPVSVKADFGAVMDVLKKRLKGKL

SEQ ID NO: 38383 - protein, 167 aa, Sorghum bicolor
  Clone ID: SORBI-28MAY03-C56174_1.pep
LKVQASKAFQETYLMFQSFQTEQLPDFPNFSDTTPVNHVLGSGQLLRVRGRCTGDYRRIVQFRMERGLENWTVDCSCGAKDDDGERMLACDICGVWQHTRCSGISDFEEVPENFICRKCATRKGKGRGGGGSNGDGTMEVSAAGRCKDEIGSSVGGAGKFGRMATVG

SEQ ID NO: 38384 - protein, 173 aa, Sorghum bicolor
  Clone ID: SORBI-28MAY03-C56181_1.pep
AFVAGDSAGGNIAHHVAAELGKGGGRRLAPAVRIRGALLLAPAFAGEARTRAELECPRDAFLTTEMFDRYARLALPDGADRDDPVLSPAGPRAPALEAVEMAPVLVVAGGRDVLRDRNKQYARRMKEEWGKEVEYVEIAGADHGFFQVDPWSERADEVVRVVRRFVVEHMDSE

SEQ ID NO: 38385 - protein, 102 aa, Sorghum bicolor
  Clone ID: SORBI-28MAY03-C5726_1.pep
MAATAGGARRALAALRSGSQSTISATLSRQAAARSPELAAASLPRASPRRLTISRVPVAALGGVQGSLMPMHNATASALLTSMLGLKPGSWGWLSEGFATPL

SEQ ID NO: 38386 - protein, 165 aa, Sorghum bicolor
  Clone ID: SORBI-28MAY03-C57276_1.pep
MALWSAVGQVASIAQLAGVDAYGLISMIVEAAKMVKRNRETCQLLARRARMIGDLLQQLERTQLMHHMETRNPVEHLEETLRHAYVLITSCRDSSYLHNFCMGGKQADQLREVQNEITFYLQLFPLVSFVDNTRTWERLLSRACPLCTREITDELHAAHHVEHED

SEQ ID NO: 38387 - protein, 293 aa, Sorghum bicolor
  Clone ID: SORBI-28MAY03-C57284_1.pep
HDDSLETFLRSRRNKRRGLYGHVAGLGDSGSILYKTGPIIGPGGHINGRSPYNSQIRDMNPADKSASNKKPRLLYTSAELAAMEVRAMEWLGRLLRRSGEALFLLQLICQHNVARLAQTLGNDLRKRLVQLTFHQLVCSEDGDQLAMRLISALMEYYIGPEGRGTVEEISTKLREGCPSYFNESDYKYYLAVECLERASMTNNPDERDILARDAFNLLTKIPDSADLSAICKRFENLRFYEAVVRLPLQKAQALDSNADVINGQIDPRHHDTIMLQRQQCYEIVMNALRTLKG

SEQ ID NO: 38388 - protein, 75 aa, Sorghum bicolor
  Clone ID: SORBI-28MAY03-C57312_1.pep
RDPLTGDEPNDLDLFMMTHTKNGDGTSQESRDVYDNASNKLSERETNGDIIIISDVEQNHIFQVAYKETTNCKST

SEQ ID NO: 38389 - protein, 131 aa, Sorghum bicolor
  Clone ID: SORBI-28MAY03-C57285_1.pep
MATECAAAAADLATGRPRKRARFGWDVAPAAEAQIGTFCGQEVGDVASLLLSANPSDHTCSSLLPKGVARNASPPWREDDQGGRGVFAGALCLASRCCSYGRVGGPAVARVLGCCGRARCAMAALVCLPSP

SEQ ID NO: 38390 - protein, 135 aa, Sorghum bicolor
  Clone ID: SORBI-28MAY03-C84486_1.pep
GNVDPRVNFLLDQKTDTEKYAPVVNIDKAFESPNTHAECFTYLRQYAQNSSAKAACMVAPKSIISYPQVWKGQGSRKWKLDQSDGFFVQFESPALRKIWFVPSTKEKGRTMCRSPEALDIGIHEVLPRMFKEAAA

SEQ ID NO: 38391 - protein, 120 aa, Sorghum bicolor
  Clone ID: SORBI-28MAY03-C56316_1.pep
RTWVLYEQGRLEEIVDIDIGDDLDVEEACRFLKIGLLCTQDAMARRPNMTNVFRMLSGEKRINIDKITRPAMITDFADLKISNKEQRSGETRSPTTAPTTKSFTSTEPFSSSETPTQSSM

SEQ ID NO: 38392 - protein, 121 aa, Sorghum bicolor
  unsure (1)..(121): unsure at all Xaa locations
  Clone ID: SORBI-28MAY03-C56439_1.pep
FDHGLNARHLVEKKLGVXVARDEDDGSFTAEDVAAALRRVMVGDEAQELGAKAQELAQVVGNDEVNDQCVRDFLRCLSEYGTGSGRQQQGIKDDSSVQTATHDATVIVSEATLRAESSTSL

SEQ ID NO: 38393 - protein, 220 aa, Sorghum bicolor
  Clone ID: SORBI-28MAY03-C56618_1.pep
MEKSPELAQMILPRSVAKLLHHRLSSEFAGLQDKSTLLQPRQNETIKYKVFAGTWNGAGVAPPDDLDLKDWLDTTAGSCDIYVLGFQEIVPLNARNVLGPKKRSAAMKWDSLIADALNNTRRRRQQGGRGGAMSGCREAAHSERRQDQDVFRRVTSKQMVGIFVSVWARSALRQHVRRHLAVSCVGAGVLGLLGNKGAVTVRFVLQGTSFCFVCCHLASG

SEQ ID NO: 38394 - protein, 361 aa, Sorghum bicolor
  unsure (1)..(361): unsure at all Xaa locations
  Clone ID: SORBI-28MAY03-C56638_1.pep
RVPGWDGPGPRRAGRHAPRRGRGGRRAPRRPGGAGSAPAPVLRAGLRVRAPGRAARPPRPALGRLRRRPSPLAGAQAARVRAPASLLAQASGVGLLRTPGAAPGLRFAGLGAVPAPSRAYCLPASVRPLRCWCLVAGCGFPEHLGPRPGSASLEGEPSQRLRAPSSVRPPXRQFGARVLSKGGGCLLGCAPVSSPRRLAPGLLKAKALLALKDYPSGSSASGFVLSVVGVNLAALLLRGRAYYYLADHDVASRHYQKGLRLDPEHSELKKAYFGLKNLLKKTKSAEDNAAKGKLRVSVEDYKTALAMDPDHTAYNVHLYLGLCKTLVRLGRSKEAISSCTEALSIDSELVDALTQRGEAKL

SEQ ID NO: 38395 - protein, 151 aa, Sorghum bicolor
  unsure (1)..(151): unsure at all Xaa locations
  Clone ID: SORBI-28MAY03-C56734_1.pep
HEEEVPFNVVWLSVSVAFVMALTVSMHMRXSTSSQVKSLGSQVAFQAMVSIATLGLYIAYALPILFRVTTARRSFVAGPFHLGRFGVAVGSVAVLWVALVTVLFCLPVAYPVTKETLNYTPVAVGGVLVLSLAAWVLHARFWFRGPITNVG

SEQ ID NO: 38396 - protein, 335 aa, Sorghum bicolor
  Clone ID: SORBI-28MAY03-C5683_1.pep
TRVDTEGEDFHLPEGRLRELGFTFSFPVNQTSISSGTLIKWTKGFSINGTVGEDVVSELSRAMERQGLDMKVTALVNDTVGTLAGGRYMDNDVVAAVILGTGTNAAYVEHANAIPKWTGLLPKSGNMVINTEWGSFKSDKLPLSEYDKAMDFESLNPGEQIYEKMISGMYLGEIVRRILLKLAHDASLFGDVVPSKLEQPFILRTPDMSAMHHDSSHDLKTLGAKLKDIVGVADTSLEVRYITRHICDLVAERGARLAAAGIYSILKKIGRDKVPSSGGKMPRTVVALDGGLYEHYKKFSSCVEATLTDLLGEEASFSVVAKLANDGSGIGAAFL

SEQ ID NO: 38397 - protein, 225 aa, Sorghum bicolor
  Clone ID: SORBI-28MAY03-C57628_1.pep
MGPRFTVVGNPAESFDPQKMIPQAAYPSDQRLPLPRTGFPNSTTPRRGTVPNYQGISSYVGVPMTYPTSPVFQGQTLPGVLPPGRRNDSVGFQSPSRNITDSPGIQGQRERQKFDESKTCSFLEELKSNRARRVELSDITGRIVEYSADQHGSRFIQQKLENCTAEEKAAVFAEVLPHASSLMTDVFGNYVIQKFFEHGTREQRSDLATKLVGHVLPLSLQMYGC

SEQ ID NO: 38398 - protein, 205 aa, Sorghum bicolor
  Clone ID: SORBI-28MAY03-C57678_1.pep
MPALSTHHLQLRRLGRRRGAAFALALLAAALVLTLSRYATGPAASPPASPSYGHRLPALVDITLVYGATDKGAVCLDGTPPAYHFLPGFGDGSHNWLLHLEGGSWCRSFESCARRKKTNLGSSAHMDTRAEFVGILSDDQSQNPDFYNWNKVKIRYCDGASFSGHVQDEVKNGTGFFFRGQRIWEAVMAELLSKGLARAKQAFLT

SEQ ID NO: 38399 - protein, 212 aa, Sorghum bicolor
  Clone ID: SORBI-28MAY03-C57706_1.pep
ARGAFKNTFYFDFSPTYIGCGLICPHIVNCSTLLGAIISWGFLWPYISTKAGDWYPANLGSNDFKGLYGYKVFISVSVILGAGLYNLIKIIYATIKEILNARAKQGRLPLVQVQDGDEGSKLSAEEKHLNETFIRDSIPPWLAGSGYVGLAAISTATVPMIFPQIKWYLVLSAYVVAPLLAFCNSYGTGLTDWNLASTYGKIGLFIFASWVG

SEQ ID NO: 38400 - protein, 203 aa, Sorghum bicolor
  Clone ID: SORBI-28MAY03-C57700_1.pep
MAAPESECGGTDGYRDLRGVRVELDPGTARVGGGGGFAVSFWLYLSSSARPSSVILRQIAAGDDNKLPFLALGEGNKLLLFPLMRLHREAPGPASSYPWTHTTKLSSTSQCPLEKWFHIGCEVTENVMRLHLDGSLTAEASVCSLFDGPESQDDANQISLVGSDGKLEGYIYNIEVSSVLGNIKEQYTKNPPFKLSIDYSCSD

SEQ ID NO: 38401 - protein, 190 aa, Sorghum bicolor
  unsure (1)..(190): unsure at all Xaa locations
  Clone ID: SORBI-28MAY03-C57737_1.pep
MATVGQSGALRRVTVHYANSPTRSTVAEVSLDDFDDELLQFVLADLLPGQEGLHQSILEGAYSNQNHMRGAGPHAPYDYSQAQEYHGESSTAAAATATRNSGXSQQIASDFEYAKQLQQEMEDLSVEDDDGDDISCVPSPSDSDDDHDHHDEEEEADRQDGNGDDDDDVDPDNMTYEQRQALVESVGTED

SEQ ID NO: 38402 - protein, 177 aa, Sorghum bicolor
  Clone ID: SORBI-28MAY03-C57726_1.pep
MAAQVVAAAGTAVARPLGGGSGLDAAPRGGGVARMPRERWGGAVAARGRRDRESQVVSVISCAPRSQAEVLPVSPDDDAAVKEEANFQHLKAIQQLATAANGVWSKPNVRRKTKIVCTIGPSTNTREMIWKLAEAGMNVARLNMSHGDHASHQRVIDLVKEYNASHADNVIAIMLDT

SEQ ID NO: 38403 - protein, 192 aa, Sorghum bicolor
  unsure (1)..(192): unsure at all Xaa locations
  Clone ID: SORBI-28MAY03-C57151_1.pep
MGKRLLRAWFLRPIIDIDVINNRLNTITFFLCCEEVMSALRETLKSVRDVPHMLQKFNSPSSFCTSSDWTTFLKCICSLLHINKIFEVGISEHLAIKLQHMNIDLIGKANSSITAELDYVSDLVVGVIDVQRGKEKGYETVVKEGLCDELDELRMVYEGLPDFLEQIMKTXSLPFSFGCRIAPLVVYVHQIG

SEQ ID NO: 38404 - protein, 298 aa, Sorghum bicolor
  Clone ID: SORBI-28MAY03-C57179_1.pep
HEGTFNTLIKGYGIVGKPEESQRVFDMMGIEGSIKPNLTTYNILVKAWCDRRNLEEAWGVVARGRAGGVEPDIVTYNTIASAYANNDETWRAEELIVEIQTRVRTSERTWGIIIRGYCRESRLEEALRCVQQMKDAGIVPNVVIFNTLLKGFLDVNDMAAVNNILGLMEQFGIKPDIVTYSHQLNTFSSLGHMAKCMKVFDKMIEAGIEPDPQVYSILAKGFVRAKQPEKAEDLLLQMSHLGVCPNVVTFTTVISGWCSVADMESAMRVYEKMCKSGVYPNLRTFETLIWGYSEQKQP

SEQ ID NO: 38405 - protein, 88 aa, Sorghum bicolor
  unsure (1)..(88): unsure at all Xaa locations
  Clone ID: SORBI-28MAY03-C57253_1.pep
MAEIVGSAVVQESVSKILSGLLQKYEEKQNPIAFRNLERLEMAHIRLEAVLQTSDKWDITDTSLLRWRRKLKSAAQECDDTLHRCXQR

SEQ ID NO: 38406 - protein, 159 aa, Sorghum bicolor
  Clone ID: SORBI-28MAY03-C57230_1.pep
MAAELVGSVVAQEAVNQILSRIKEGYQDKSDAKEHIERMEMAHIKLEAALETSNKWNVTSAPLLRWRSKLKRASQDCDNTLRRCRQRLQEEEEVQQAVRSSSFPKRMAHTAMSFVSSIFSGGDDDLLKGSTVARRFERFAEGASEFLRYVELGGTPCRY

SEQ ID NO: 38407 - protein, 158 aa, Sorghum bicolor
  Clone ID: SORBI-28MAY03-C57249_1.pep
MAGGGDDAEEITLEHTPTWIVASVCSIIVVISLLFERLLHLLGKRLTKGRRKPLYEALLKVKEELMLLGFISLLLTVFQGTTQKICVQESVMRHLLPCSLPADDKVTAHFMIAGGGTRRLLAGGGASSDYCLKGKVPILSVEAIHQLHIFIFVLAVTH

SEQ ID NO: 38408 - protein, 179 aa, Sorghum bicolor
  Clone ID: SORBI-28MAY03-C5798_1.pep
MGDDAAAAGSSVLGRAVEEVRSALNEHADVVADLFGRVSSELRTGFAPAVDSFIGFFHAVDWKEPWLISILTFHAILLLVTIISRRNVNFQLILSALTFSGVFLAERLNTFLGQNWKSFSTQNYFDPQGLFISVIWSGPLLLITILILVNTLVTLCMLIVRWKRAELRHRARQARNKQD

SEQ ID NO: 38409 - protein, 228 aa, Sorghum bicolor
  Clone ID: SORBI-28MAY03-C58042_1.pep
SDVNDATLLEAFSSRYSSVKGAKVVIDANTGRSKGYGFVRFGDDSEKTHAMTEMNGVYCSSRPMRIGPATPRKSSGTSGSNGSSARSDGGDLTNTTVFVGGLDPNVSEEDLRQTFSQYGEISSVKIPVGKQCGFVQFAQRKNAEDALQGLNGSTIGKQTVRLSWGRNPANKQFRGDNGNQWNNGGMYYAASPFYNGYGYPAAPFPDPGMYAAPAYGAYPFYGNQQQVS

SEQ ID NO: 38410 - protein, 216 aa, Sorghum bicolor
  unsure (1)..(216): unsure at all Xaa locations
  Clone ID: SORBI-28MAY03-C58082_1.pep
MATPAPAPSLRLLLLLPLLTVAGAAVSHPAHEFCAVGGDAAGCGGGGDGTRILIKGGTVVNAHRAEEADVYIQDGVVVAVRSNIPVGADNVRVIDATGKYVMPGGIDPHTHLEMEFMGTVTIDDFFSGHAAALAGGTTMHIDFVIPVNGNLTAGLESYKHKAAKAAMDYGFHMAITKWNDEVAREMEVMVKEHGINSXQFFMAYKGSLMVTDDLLL

SEQ ID NO: 38411 - protein, 166 aa, Sorghum bicolor
  Clone ID: SORBI-28MAY03-C58159_1.pep
MAPGGEGKPNTGGGGAKGGGRKRKFLPHGKPVRKGAYPLRPGVQGFFITCDGGRERQATREALSLLDSFYEDLVDGKGSDDKPKNIPDKPLNKKIKFEDSDSSDDEDEDHSGEEADNGNGNDVEKDETAPSEKQQEVLDTSDTISKDNTTPSEKQQEVLETSDTTS

SEQ ID NO: 38412 - protein, 100 aa, Sorghum bicolor
  Clone ID: SORBI-28MAY03-C58206_1.pep
QCSWPEARLRRGSTMVNAEGVAGWVEKRVILPEGVISFEANVIGFAEGVEVFFISTVVGAFTFELKSGRVRKVSEHTGYCGITPFISFFTPDRGCSKWTK

SEQ ID NO: 38413 - protein, 247 aa, Sorghum bicolor
  Clone ID: SORBI-28MAY03-C57329_1.pep
MPPTPPETDTEPEFAEVDPTGRDGRYTEVLGKGAFKTVYKAFDQLEGLEVAWNQIKVGDLLRNNDDLERLRSEVRLLKTLKHKNIIKFYNSWLDRRNNNINFITEVFTSGTLRQYRIKHKKVDIRALKKWSRQILSGLVYLHSHDPPVIHRDLKCDNIFVNGNQGEVKIGDLGLATILDNARSAHSIIGTPEFMAPELYDEEYNELVDIYAFGMCLLELVTFEYPYCECSNAAQIYKKVSDGEKPGS

SEQ ID NO: 38414 - protein, 255 aa, Sorghum bicolor
  Clone ID: SORBI-28MAY03-C57347_1.pep
HEGYAPICLGLEDFYTRRLYLRIQDCFGRPIASAPDAWFDVVERYSNDCNKTLHRTTATTKCLNLGSYNYLGFAAADEYCTPRVIESLKKYSASTCSVRVDGGNTKLRTGLEELVARFVGKPAAILFGMGYVTNSAIIPALVGKGGLIISDSLNHNSIVNGARGSGATVRVFQHNNPAHLEEVLREQIAGGQPRTHRPWKKIIVIVEGIYSMEGELCKLPEVISVCKRYKAYTYLDEAHSIGAIGKTGRGVCELL

SEQ ID NO: 38415 - protein, 253 aa, Sorghum bicolor
  unsure (1)..(253): unsure at all Xaa locations
  Clone ID: SORBI-28MAY03-C5746_1.pep
MQSTVKLAVLALLLAAAAHHGLLPLPTALCYWLNPEIYDAGGLSRRAFPEGFVFGTAASAYQVEGMAKHGGRGPSIWDAFIEVPGTIPNNATADVTVDEYHRYKEDVNIMKNMGFDAYRFSISWSRIFPNGTGKVNQEGVDYYNRLIDYMLQQGITPYANLYHYDLPLALHEQYLGWLSPKIVEAFADYAEFCFQTFGDRVKNWFTFNEPRCVAALGYDNGLHAXPGRCSECAAGGNSTTEPYXAAHHLILSH

SEQ ID NO: 38416 - protein, 174 aa, Sorghum bicolor
  unsure (1)..(174): unsure at all Xaa locations
  Clone ID: SORBI-28MAY03-C57474_1.pep
SPGPSSSPFGAMASLFAPKLPSGFAANLSGEKSPATDKIKPMKRERQAVRPPVEHKWSLPGVAQDAKPPAIFQHELIQSFSINMFCKIPVSKVQTYKDLRSVLMKRIFLSALHFRINTRYKXSNPPFTSVELXDHSDSGREGCTVTTLTVTAEPQNWRSAIKVAVHEVRRLKEF

SEQ ID NO: 38417 - protein, 126 aa, Sorghum bicolor
  unsure (1)..(126): unsure at all Xaa locations
  Clone ID: SORBI-28MAY03-C57558_1.pep
LASMLGSIPAPPAMASEFPPSTGKSVGMLSAVSSSSIRVTAGIIQLDGLTFSSGSGTRASXGLEDAWMTXSLSTAKDVSSKLPVGLEDATRISTVPMVMRSGFYLFFMSAMILLLSYKVGSCIYSR

SEQ ID NO: 38418 - protein, 328 aa, Sorghum bicolor
  Clone ID: SORBI-28MAY03-C58308_1.pep
TRVQTLPKGVEVLDPLGLGVMDNKSLRLITDASVSSPVSREKSQGLDPSMRDKVIYSSPNFDPKVFLSWVHKDTSAADLEAGALTLKTDLKGRTQQKKQLVKENFDCFVSCKTTIDDIESKLRQIEEDPEGAGTAHLYSVTQKISGVANRAFEPLFERQAQAEKIRSVQGMLQRFRTLFNLPSAIRGNIRKGEYDLAVREYQKAKSIVLPSHVGILKRVLEEVEKVMQEFRGMLYKSMEDPHLDLAELENIVRLLLELEPETDPVWHYLNIQNSRIHGLFEKCTQDHESRMEVLQNKIHEKVLSDSKWRQLQQDSNKSLEVDSAIGDS

SEQ ID NO: 38419 - protein, 74 aa, Sorghum bicolor
  Clone ID: SORBI-28MAY03-C58374_1.pep
AARHCAIRKGGIYICSQRKPCGPNMLDELLKGFIVIPADLPWEWVKRLITSGERVNHDSWVKMYNLCRVLKLVY

SEQ ID NO: 38420 - protein, 254 aa, Sorghum bicolor
  unsure (1)..(254): unsure at all Xaa locations
  Clone ID: SORBI-28MAY03-C58378_1.pep
RCALRGWAPRRADTFEKLNKIGSGTYSNVYRARDTVSGPSVALKKVRFDNLEPESVKFMAREILILRTLDHPNVIKLEGLVTSRMSCSLYLVFEYMEHDLAGLAASPDVKFTLPQIKCYMQQLLSGLEHCHDNNVLHRDIKGSNLLLDNNGILKIADFGLATFFDPRHKRPMTSRVVTLWYRPPELLLGATDYSVGVDLWSAGCILAELLYGKPIMPXRTEVEQLHKIFKLCGSPSEEYWKKSKLPHATIFKPQ

SEQ ID NO: 38421 - protein, 417 aa, Sorghum bicolor
  unsure (1)..(417): unsure at all Xaa locations
  Clone ID: SORBI-28MAY03-C58486_1.pep
TRPLPLYNMSSLKHFSLGSNGLVGQLPSDIGNSLPNLQVLDLSNNSLHGRVPPLGSLAKLRQVLLGRNQLEAYDWQFLSSLTNCTQLTKLSLEGNMMNGSLPGSIANLSTSLEYLLLGSNQISGSIPVEISNLVNLTMLSMENNLLSGSIPPVVGKLQNLFVLNLSENKLSGQIPSSIGNINQLGELFLDGNDLNGNIPSSLGQCLGLLQLNLSARGLNGSIPEKLFSGPSPFLGLDLSHNNLXGKIPEASGKLEHIVLLDLSNNLLSGGLPAIFSYLFYLQYINLSRNDLSGNLPVFIEDFIMLDLSYNNFQGQVPTLGVFKNFSIIHLEGNKGLCSNFSMLALPPCPDNITDTTHVSDITDTKKKKHVPLLPVVVPTVTVAFLLLLFCLFSLWKKIQVQTAARHSKICSLLHLVT

SEQ ID NO: 38422 - protein, 147 aa, Sorghum bicolor
  Clone ID: SORBI-28MAY03-C64258_1.pep
VIVKEEEDKKTIALGRPPTKPDAHDLGKVFRPPNAPFSTSPKSDCDKTETSVRGFNLNEVSCAMDSDRTDITVKPAFGDRLSNESNVIQSPNRQPLPWQHKQGAPATTPSYSRLREQQSGLDLVAALKRIGKRSAGDGGDGRDREGK

SEQ ID NO: 38423 - protein, 112 aa, Sorghum bicolor
  Clone ID: SORBI-28MAY03-C64227_1.pep
SPDDHRLYHEVVGNRIIPRLNLLFQEATDGKLKSFTRFRRPILPVPVQRNATDSGFYAIKFMELWNGESFHLPILTENAAMYRDQLLYYAIYHEINTVEKLPAGLEALKPRR

SEQ ID NO: 38424 - protein, 212 aa, Sorghum bicolor
  unsure (1)..(212): unsure at all Xaa locations
  Clone ID: SORBI-28MAY03-C6430_1.pep
MGPARYDFSGTMVFLKHRSYEAKVAFLETPYTHSLTASAEDDVTGAQPLQSLWNKPRKIICRTNCSVCKEASTSGQNSEDVSDNSRTLCKNQKWVWSEGRFLSVGAAIISCRNERAPDGLVADAHLSDGFLHLLLIRDCPLPLYLWXSQFTKKGLDPLSFKFVEHHKTPAFTFISSHDESIWNLDGEMFQASEVSVQACRGLVNLFASGPEV

SEQ ID NO: 38425 - protein, 55 aa, Sorghum bicolor
  Clone ID: SORBI-28MAY03-C64369_1.pep
LSSRCQNGQEILSCCIQVTLHQKNKAYLEKSSLVQLTCVWGRVEVLSRRQWLLEP

SEQ ID NO: 38426 - protein, 82 aa, Sorghum bicolor
  Clone ID: SORBI-28MAY03-C64411_1.pep
GADDDGQEGAGKVHLWHGAEDLVVPVSLSRYISEKLPWVVYHELPKSGHLFLIGDGMADTIVKSLLLGDDHPSSASALTASS

SEQ ID NO: 38427 - protein, 216 aa, Sorghum bicolor
  Clone ID: SORBI-28MAY03-C71553_1.pep
MAAPLLPSSVSVLLSLHIALLLILCSSQVGDSCSSGSDCGTGLYCGSCPAAGRTKLSCIRDLAIQPTSIVKGLPFNRYSWLVTHNSFSILGEPSRTGVERVTFYNQEDSVTNQLRNGVRGLMLDMYDFNDDVWLCHSLQGQCYNFTAFVPAVETLKEVEAFLSENPTEIITIFIEDYVQSPMGLSKVSTAADLMKYWYPISEMPTGGKDWPSVTDM

SEQ ID NO: 38428 - protein, 148 aa, Sorghum bicolor
  unsure (1)..(148): unsure at all Xaa locations
  Clone ID: SORBI-28MAY03-C58651_1.pep
MGSYDSSSSSSNDSSARNEEDESCMFALKLLGGFAVPFTIKAVIELGVMDQLLTAERAMSAEELVAAAVAAQLPRPEVACTMVDRLLRFLASHSVVRCTTEGGGGHGXATTTTCCRRSYAASPVCKWFARNGVEDSVLPLGMMILNKT

SEQ ID NO: 38429 - protein, 179 aa, Sorghum bicolor
  Clone ID: SORBI-28MAY03-C58696_1.pep
MPEANAGAVAHAEQRKKNSPEMEFFSEYGDANRYRIQEIIGKGSYGVVCSAIDRHTGEKVAIKKIQNIFEHLSDAARILREIKLLRLLRHPDIVEIKHVMLPPSRRDYRDIYVVFELMDTDLHQVIKANDDLTKEHHQFFLYHMLRALKYIHTANVYHRDLEPKNILANANCKLKICDF

SEQ ID NO: 38430 - protein, 243 aa, Sorghum bicolor
  Clone ID: SORBI-28MAY03-C58832_1.pep
VRRSSIGSFVLPPAMRKPARLSLPQHKKRKAPAISSTNPPRRRLDESSSTQSAHLLLDESSSAPPRRILLHAERPPPPRRIGDRLLGAPLPDFGARANSGAHISVAASRCPRSDPPWESRRSPVAEQPVRTRADSGGHAARAPRTPVAAPLAPAAHSLPERPRRCPLPAPRTPVATATRASRALGRNPSRHRLTQGRCGARRRWQAMADYSVAMAGPCGDGAPPLPLPAGGYAHLRPTPGLLD

SEQ ID NO: 38431 - protein, 129 aa, Sorghum bicolor
  Clone ID: SORBI-28MAY03-C58792_1.pep
HEAQLQLLISKKIVSHLSSLPPDARGNASATAMTLAMSGAVWAPFSSSSFLLGRQCGGRQRRLSLQARSSPPQGKLYTSPQNLPLVHLSAASPLLLPLVHLNQHAFKLQVGRQMMSGIFLRLQNKSYLQ

SEQ ID NO: 38432 - protein, 158 aa, Sorghum bicolor
  Clone ID: SORBI-28MAY03-C58895_1.pep
TTLLPHPLSARSLPRSRSLSRCLCWRALLAGFSWAWSFIFLACLRLHRRGMPWGHLGSFARRSLVAAPPSAGRRERPFLPGRLLAAVRPPWRASHEADADVLTKLLTRPRTYSCSCLPSNGPSPPQITDVCQRPHRRYSFHRAHHLDGVKDQFWPVDT

SEQ ID NO: 38433 - protein, 223 aa, Sorghum bicolor
  unsure (1)..(223): unsure at all Xaa locations
  Clone ID: SORBI-28MAY03-C5871_1.pep
XGKTQSSLHELDDSPSIIRESRWANLPPELIRDIIRRLEADESTWPARKHVVCFAAVCRTWREMCKEIVLSPELCGKLTFPVSLKQPGPRDGNTMIQCFIKRNKSKSTYYLYLCLSNVVTSESGKFLLSAKRHRKTTCTEYTISMDSGNISRSSRTYIGKIRSNFLGTRFLIYDTQPPYNGAVVPPSGRTSRRFNSTKVFSKLPSVSYNIAQVSYELNVLGTR

SEQ ID NO: 38434 - protein, 330 aa, Sorghum bicolor
  Clone ID: SORBI-28MAY03-C58200_1.pep
HEGSNEDAESECGRLVGTVRPRGPIDTREPIGAIIHFYLGDLFDSNSSEANVLRKLQPRSTWYLTGLGSLATTQREYVALHAFRRLSGQMQNAILKPSPEHFPKYQEQPPAMPDCFTPNFADHLHRSFNGPQLSAIHWAATHTAAGTSNGVVKKQEPWPFTLVQGPPGTGKTHTVWGMLNVIHLVQYQHYYAALLKKLAPESYKQVSGSTSTSSETFAAGSIDELLQSMDQNLFRTLPKLCPKPRMLVCAPSNAATDELLARVLDRGFIDGEMKVYRPDVARVGVDSQSRAAQAVSVERRTDQLLMKGRDEVIGWLHQLKGREQQLSQEI

SEQ ID NO: 38435 - protein, 263 aa, Sorghum bicolor
  Clone ID: SORBI-28MAY03-C58208_1.pep
VTALSDMVQSLVSMYVDVQAKGLISQQGVYKHYVLGLLASLEGRSEAQSNCTDYEKLQAALCEVELNYDSCREYIQALPATDISYIVGRYCTLCFPSNLARSLPQEPSWRKPLATLLAFWSKLVDDIPGDSIDARSYERTDYLNSNRLSLCIGAFRQLLINDEIALHQGWDAISMYVKDCLRSGMMMETSCFCRAMILSGCSFESVVEVYYGGQGQLGSENADPSNYLDLLELYNAATEECLSDLSEESCEYRILLHHLLASL

SEQ ID NO: 38436 - protein, 283 aa, Sorghum bicolor
  Clone ID: SORBI-28MAY03-C58218_1.pep
MPELPEVEVARLALEEHCVGKRIVRCAAADDTKVIDGVAPERLEASLVGRTIAAARRKGKNMWLVLDSPPHPTFQFGMAGAIHIKGVELSKARGSAVNPTEEWPSKYSKLFVEMDDGLEFSFTDKRRFAKIRLLDNPEAAPPISELGPDALFEPIKLDEFVKTLSQKKGPIKALLLDQARIHPGQTASKISKDKCEILHQCIKEVIEESIKVGADSNQFPENWIFHSREKKPGKAFVDGKKIDFITVGGRTSAYVPELQKLDGTDSAASRSKPGKDKENDDNT

SEQ ID NO: 38437 - protein, 114 aa, Sorghum bicolor
  Clone ID: SORBI-28MAY03-C58224_1.pep
CLRGKKHLYLHQIHHVRRRTPPPPPSQLLPLPLPPSAPITRKTAAPGRPRPPSCPASSRPLLPYSRAPASSRPRRPRPRRATPCRPRRPRRPRPAPGRRGRPQAPARGRGFWAA

SEQ ID NO: 38438 - protein, 268 aa, Sorghum bicolor
  Clone ID: SORBI-28MAY03-C5824_1.pep
LIKQLEGSVDENKSRLICLDSRLQCMEQELKLKDDVCISLKGNLASSESEKNSLELMNKGHILEIEKLCQDNKDLNELLSSFMVKVTELDKEHASVSSHVSRLISSFERFYDMAQEEKLLMARSSKDKFEHLQSQYVDLMSENNALKTEIEELKSRLIELQRTQEIVMVQHVEECQVAEDKIRRLESEAEVSASNINQLEKLASELQGRIQKLLEDSTLAENHKQELLQKILKLESDNLELRGQVQSIMEEKSNNAESFAGEITKRDQ

SEQ ID NO: 38439 - protein, 304 aa, Sorghum bicolor
  unsure (1)..(304): unsure at all Xaa locations
  Clone ID: SORBI-28MAY03-C58254_1.pep
TRPSVTVSEESSSGDSTTAKDEILKDPAVEDASVANNVTNPASEEANEVNLTTEAPKEDNTSKGNKDTYGAAEDAADKAIEKVVVDSSNLGDFVGKPVFQAERIYEQTPVGVVMGLAWTAMGRAALYIETTKVEEGEGKGALVLTGQLGDVMKESAQIAHTVGRAVLLEKEPDNQFFANSKLHLHVPAGSTPKDGPSAGCTMITSMLSLAMGMPVKKDLAMTGEVTLTGRILPIGGVKEKTIAARRSAIKTLIFPAANKRDFDELASNVKEGLEVHFVDTYGEIYDLAFQXSDAGTETRLDDLA

SEQ ID NO: 38440 - protein, 250 aa, Sorghum bicolor
  Clone ID: SORBI-28MAY03-C59002_1.pep
MMTSWLLGRRGASGFSWSSTADQVTQGISAAGLTAIVTGASSGIGAETARTLALRGAHVVMPVGSLPAAQAVRDAVLAQAPEAKLDVMELDLSSMASVRAFASQFIDRGLPLNILINNAGVMAIPFELSKDGIEMQFATNHVGHFLLTHLLLDTMKKTSRESNVEGRIVNVSSEGHRFAYQEGIRFDKINDESVYSIFGAYGQSKLANILHANELARRFQEENVNITANSLHPGSIITNLLRHHSIIDVL

SEQ ID NO: 38441 - protein, 294 aa, Sorghum bicolor
  Clone ID: SORBI-28MAY03-C59003_1.pep
MAIPTAFASPLAVRSAVGAALAAVIAARAVRRRSLDASGGAAGFVVMAVHIACGYRYGALLLAFFFSSSKVTKIGEDRKRRVEEDFKEGGQRNWIQVLANSTIATVLVVIFALLTGGQDQCLDSNGSKLITGIIGGIIGHYCCCNGDTWSSEIGVLSNEQPRLITTLKPVRKGTNGGVPLQGLLAATGGGLIIGLTFVVVGLLTAECSSDMALLQLLVLPISAAAGLLGSLIDSLLGAPLQFSGYCSVRKKVVSKRGPPVTKISGMTILDNDAVNAVSVLLTTVLTAYGGIYIF

SEQ ID NO: 38442 - protein, 166 aa, Sorghum bicolor
  unsure (1)..(166): unsure at all Xaa locations
  Clone ID: SORBI-28MAY03-C5919_1.pep
MALEAVVFPKEHLVCTVKARSASLGCGFHTEELEDKGGEVLQGEAADALLPPGADAGAGTMWEWDAVLCPCSTAPGAVEECWDVQHQLSVSPPPPAVPSAVAASSSGRGKAAAASARRRRRRPKAVKNTEEMESQRRNHIAVERNRRRQMNEYLSVLRSAMPXXYA

SEQ ID NO: 38443 - protein, 210 aa, Sorghum bicolor
  Clone ID: SORBI-28MAY03-C59297_1.pep
TRLETRIMQVLRFKYGQIYSVNVAVFLGGNKPSRTGDVRGDISVNFSCDPDISSKLVDFVLEEISYLQVEGPSEEDVLTILEIEQRAHENGLQENYFWLDRILRSYQSRLFSGDIGSTFAFQEEGRIKVRDALTPQTMQSALQRVIPFPCRNQYTVVILMPKSSCWASVKSMLSWTSNGVSRDAKILAGMAGALVLAVSLWRYSRSALKS

SEQ ID NO: 38444 - protein, 206 aa, Sorghum bicolor
  Clone ID: SORBI-28MAY03-C58392_1.pep
ARGEGVEGAALVSAQEEIKDCRMALSRCEEELGRVQDKKMELQKEVDRLTELAEKAQLDASKAEEDVANIMVLAEQAVALEMEAAQRVNDAEMLLGKAEKAISSVDTVVELTSSAEEQKSTEEDSISEGYEYSSDATDDVSVRDEVSSIERLMVGDLTVEGIEQLEPSREIYDEASSDKTSVEPQKEAEPDSDKSKQGKKQEMERK

SEQ ID NO: 38445 - protein, 127 aa, Sorghum bicolor
  Clone ID: SORBI-28MAY03-C58526_1.pep
MDMLREGKKVQSAMYVPLLHGCVETGTLGGARALHGHMVKTGTSADMFVATSLVNAYMRCGACQDARSLFDQMPEKNVVTWTALITGYTLNSQLVEALEVFVEMLEAGRYPSHYTLGAMLNACSASH

SEQ ID NO: 38446 - protein, 323 aa, Sorghum bicolor
  Clone ID: SORBI-28MAY03-C58537_1.pep
ARGSMKGAGLRPTTVSYNAVIDACGKGGVDLRFTLGYFRQMLQDGLCPDRKTFNSLLAACSRAGHLEDARTVFDEMIHLGSGRDIYTYNTFVDAICKCGNMELATQVVLDMEANNIKPNVVTYSTLMDGFSKLEKYDEALKLREKMKSLGIQLDRVCYNTLLAIYVKTGKYDEIATVCEDMENLGIEKDTVTYNSLINGYGKQGRLDMVAFLVQDMRAQGVAPGVLTYSTLIDIYSKAGMHGDAFNVYLDFKESGLKADVVLFSSFIDTLAKNGLVECALSLLDEMIKMGIKPNVVTYNTIIDAFGKSKILTEEDPGNMGIVG

SEQ ID NO: 38447 - protein, 200 aa, Sorghum bicolor
  Clone ID: SORBI-28MAY03-C58632_1.pep
LTPIYGDDETITHYMGIQFFTDANVDLGPLPCSMHEEPVRSTRFAPDNSFRPISTGPEHSNFCREYSSLFQLTDEVLCQSILSRLSPRDIASVSSVCRRLYHLTRNEDLWRMVCQNAWGSETTRALETVPAARRLGWGRLARELTTLEAVAWRKLTVGGAVEPSRCNFSACAVGNRVVLFGGEGVNMQPMNDTFVLDLNA

SEQ ID NO: 38448 - protein, 182 aa, Sorghum bicolor
  Clone ID: SORBI-28MAY03-C58572_1.pep
MEGTGKDGNPLRNYRIGKTLGIGSFGKVKIAEHISTGHKVAIKILNRRKIRGMEMEEKVKREIKILRLFMHPHIIRLYEVIDTAADIYVVMEYVKSGELFDYIVEKGRLQEEEARRFFQQIISGVEYCHRNMVVHRDLKPENLLLDSKCNVKIADFGLSNVMRDGHFLKTSCGSPNYAAPEV

SEQ ID NO: 38449 - protein, 133 aa, Sorghum bicolor
  unsure (1)..(133): unsure at all Xaa locations
  Clone ID: SORBI-28MAY03-C58608_1.pep
VLVEKMGLPGGNNGLSLDLGXMLFAKGCCKWWKNVAKRIATLEFDRTRKSIGVIVKASSGSNTLLVKGAVETLLEHRSVLWVLLFGDLSWRRHVLYVPSPAWTMSPAPCTGQDERDGQEATKVSCEYIGLCFQ

SEQ ID NO: 38450 - protein, 143 aa, Sorghum bicolor
  unsure (1)..(143): unsure at all Xaa locations
  Clone ID: SORBI-28MAY03-C59450_1.pep
MAASTGSFPGSRPTAPPAVPPPAPAPPKAPPSSTPQAPAPLKAPPSSTQVPAPLKAPPSSTPQAPTPHSKPTPILHPESSSPSAPKAAPSPIDAPQPKAAPPPPPPKSTGPPPPAMPGSSXTRPPPLMKKSGNKMDDGASHEA

SEQ ID NO: 38451 - protein, 198 aa, Sorghum bicolor
  Clone ID: SORBI-28MAY03-C59502_1.pep
IATSSAPMAVASIWRRAWKRLRSRGSSEDDADGRGGRLRPTGGEGDADGGGGWQRPTGGYISSFGTTNTASTITPFNSHGEAQPRDIHASMAPSTAPMEENAEEELDIDVDQELEEDRVEKLEHLKGLAVQFRGDNRSALERWLLELDVPWVIHLAPGTHESSGSVVATHGFQFLVQSWILALHKIRGSILTSLDGWS

SEQ ID NO: 38452 - protein, 221 aa, Sorghum bicolor
  Clone ID: SORBI-28MAY03-C59624_1.pep
MATAAATMTMATHHPRARAPLRVCAAWDMNPGAATVATPKPSKAKAKPPPPATTTPARPPPPTHADLFARSSEGQGVVKKSTYMGFEKWWLPPPPEVKKPRSLYSAASLAYLGDCIYELYARRHFFFPPLSINEYNKRVMDVVKCESQDLLLNKLLGEDFLTEEERDILRWGRNIVSSKTRTRKRAGIAVYNRASSLETLIGYLYLTNFKRLEQLMFQLGF

SEQ ID NO: 38453 - protein, 165 aa, Sorghum bicolor
  Clone ID: SORBI-28MAY03-C59638_1.pep
MDAKDILGLPKTPFSSSQEKKSRPPKEPQRKPDGVSREVYALTGGVGMAPLMPTIEASHLKRRPAAEKEKVAWQWLPFTSSARTDNLQLYHWVRVVNGIQPTGDYQFAKYNKKADVVKYTDEEYEKYLVDPDWSKEETDQLFELCERFDLRFIVIADRFPTARSV

SEQ ID NO: 38454 - protein, 196 aa, Sorghum bicolor
  Clone ID: SORBI-28MAY03-C5892_1.pep
DAWARPDFRFIFDAMHAVTGAYAGPIFVEKLGADPDCILNGVPLEDFGNGHPDPNLTYAKELVFTMFGTHAPDFGAASDGDGDRNMILGKRFFITPSDSVAIIAANAQAAIPYFQFGTKGLARSMPTSGALDRVAKKLNVPFFEVPTGWKFFGNLMDAGKLSICGEESFGTGSDHIRKKDGIWAVLAWLSILAHRN

SEQ ID NO: 38455 - protein, 201 aa, Sorghum bicolor
  Clone ID: SORBI-28MAY03-C58948_1.pep
TRAKSEAKQGEARAGSGAGASGSGGGSIKVYHERQRLQFCLLHALNNLMPRGECFTRVELDEIAGNLVLNDPNKGQWTPLSFIFKPHHNVITGNYDVNVLITALEARKKKVVWHDRRKGASSIDLNAEALVGLMINVPVRRFRGLWTGRHWVAIRSIDGVWFNLDSDLSEPKQFKDKENVIGFLDSVLSQGGELMVVLQDE

SEQ ID NO: 38456 - protein, 290 aa, Sorghum bicolor
  Clone ID: SORBI-28MAY03-C58977_1.pep
ARGLGVALDGAGERVRNADTVRRVVAAFVERPQTQEGRRASLAGGPAAGELGALEKVAKTVDEVAAEMATEESLGISKFVGVAGAVPKDARASHDCLYRAVDMYLKTHPGLDEIEREKVCSVMDPLRLSYQARLHASQNKRLPLQAVLSALYYDQLKLRSADGGGGDGAEGGAGWEPQSAAGKARAQARADASLARENEALRSELARMRAYVSGMQQHSKGSGSRSSSASLVPASAAGKKASFLGSVSRTLSRLNPFKGGWAKDTASIADGRDRSAMHVVKPKRRRFSIG

SEQ ID NO: 38457 - protein, 185 aa, Sorghum bicolor
  Clone ID: SORBI-28MAY03-C58924_1.pep
TRLSRRTLLKYPQLYGPGQREENYNLRLFIFIMIDSVWQSLACFFIPYLAYRKSIIDGSSLGDLWTLSVVILVNIHLAMDVIRWNWITHAAIWGSIAATWICVMIIDSIPTMPGFWAIYKVMGTGLFWALLLAVTVVGMIPHFAAKAFSEYFIPSDIQIAREMEKLQDFHDVTHPEVQMSTVSRA

SEQ ID NO: 38458 - protein, 137 aa, Sorghum bicolor
  Clone ID: SORBI-28MAY03-C58994_1.pep
YSFLRYVFFIVCTIAYSYDIAMFLAHRTNKAGEVEVRVRFEGFGADEDEWVNVKKFIRQRSIPLESSQCKSIVEGDLVLCFREGNDEALHFDAHVLEVTRKQHDIRGCRCVFLIEYDHDQSQERVSLRRLSRRPKYF

SEQ ID NO: 38459 - protein, 134 aa, Sorghum bicolor
  Clone ID: SORBI-28MAY03-C59821_1.pep
MGSSGADTPSKTTKASAPQEQQPPATSGAATPAVYPDWSSFQAYPPIPPHGFFPSPVASSPQGHPYMWGAQPMIPPYGTPPPPYVMYPPGVYAHPSMPPGAHPFTPYAITSPNGNADATGTTAAAGDTDGKPSE

SEQ ID NO: 38460 - protein, 139 aa, Sorghum bicolor
  Clone ID: SORBI-28MAY03-C59835_1.pep
TGVPAFCYAQATSSAVRPTTRTNSEMLLRMHRPKRALLLPVVVGDAKLHRRIHADSVCLCFSFLPFPSLPSLCSIFFPWFLVQFRYPLLMKLFRWGPLSREPSAGAWWPQENWLPRQPVLLLHSSFLVTTPHKKAGLVG

SEQ ID NO: 38461 - protein, 203 aa, Sorghum bicolor
  unsure (1)..(203): unsure at all Xaa locations
  Clone ID: SORBI-28MAY03-C59906_1.pep
MSLLRSIYCSPLSFFLIALVITSSSRSATSTGSTSGTRRYNAMFSFGDSVAETGNICIVSSNNSTELNVLTCTHPPYGMTYFGKPSCRWSNGRTVVDLIAQSLGLPLLTPSKSKGKDFQKGANMAITGGTALNFSFYQSMGVENPVWNHGSLDMQVQWFKVLTASICGTKEKCTGFLAESLFQFGGFGGNDYXILLLELGLTV

SEQ ID NO: 38462 - protein, 182 aa, Sorghum bicolor
  Clone ID: SORBI-28MAY03-C59898_1.pep
MACRALALRSLLLPEPLHRLPAAVPPVGRAPRGGRRPHLRCCSGGGGGDPGQPPQEAVLEAISKIARSKGRVALTTNMVMGGTVTDDASDEWLVLDQKVNSYPTDRGFTAIGSGGDDFVQSMVVAVESVLQESIPKARVSQKLSSRGKYVSVNIGPIRVVSSEQVQAVYRAMRRDNRMKYFL

SEQ ID NO: 38463 - protein, 475 aa, Sorghum bicolor
  Clone ID: SORBI-28MAY03-C59905_1.pep
DVDAIGLQKYGRRDNYCKRQVQRWERQYLASTGEGKPARYQRMLDLARWLKEHVPKEDSSAGSGTGLVHGDYRPDNLVFHPTEDRVIGVIDWELSTLGNQMCDVAYSCLPYIIDASLSERTSYGGFQDNGIPERVPQLEEYLSVYCSFSARPWPAANWKFYIAFSLFRGASIYAGVYHRWTMGNASGGERAKFAGKVANAMVDCAWDFINRVNVLQEPPSKGFQVSPAPWQEFHREEESSTSEKNQGKFVPSEKVMQLRKKLIKFIEDHIYPMEGEFYKHAQSTSRWTIHPEEENLKALAKKEGLWNLFIPLDSAARARKLLLEDHSQISLGSSNDILLGAGLTNLEYGYLCEIMGRSVCAPQIFNCGAPDTGNMEVLLRYGTKEQQKQWLVPLLEGTIRSGFAMTEPQVASSDATNIECSISRQGDFYVINGRKWWTSGAMDPRCKILILMGKTDFSAPKHKQQSMILVDINTP

SEQ ID NO: 38464 - protein, 203 aa, Sorghum bicolor
  Clone ID: SORBI-28MAY03-C59358_1.pep
HEGFATLGDDSLEYPIGEYWDSDEYDDDDDVGYTRQPIEDETWFLAHEIDYPSDNEKATGHTRGTDRHDRPTKDEDDDQSFVEEDSYISGEQYFHGKNIAQIGTSEGPMGHGIPDNDMIAQYDGQLLDPEELNLMHSEPAWQGFVSQNSELGMLGNGKFLNDSERPHPDDPFVEDDQHGSVRSIGVGISSDAADIGSEVRESL

SEQ ID NO: 38465 - protein, 295 aa, Sorghum bicolor
  Clone ID: SORBI-28MAY03-C59372_1.pep
MAAAAASSSPPAAITCRAAVAWGPGQPLVMEEVEVAPPGPMEIRVKVVSTSVCRSDVTAWQSKAQPDLFPRVFGHEASGVVEARGEGVTEFQVGDHVLTVFIGECKSCKHCVSGKSNMCQKLGLERKGVMHSDQKTRFSVKGKPAYHYCAVSSFSEYTVVHSGCAVKVGLTVPMDRVCLLSCGVSAGLGAVWNVANVSKGSSVAIFGLGTVGLSVAQGAKLRGASKIIGVDTNAEKQEKGKLFGVTDFINPDELSEPVQQVIKRITDGGVDYSFECVGDTGVVSTALQSCSDGWG

SEQ ID NO: 38466 - protein, 183 aa, Sorghum bicolor
  Clone ID: SORBI-28MAY03-C59388_1.pep
TRHEGETLIFANMIFYFVNIPSSYNLEYFHKLVVENGGSFSMNLNDSVTHCIAAEKKGIKYQAALRQGRIIHYEWILDCCKEKHLLRLQPRYILFLADFARHKFPEEIDSYADYYYWDIEIADLKQIFSNIDKVAGDSNMVNQYKKKHCIDERFCFFQGCCVYLHNAPLVNADYNVISDLALK

SEQ ID NO: 38467 - protein, 188 aa, Sorghum bicolor
  Clone ID: SORBI-28MAY03-C59435_1.pep
SARGFAHVDKQRRVHGVLSDFRCNSGSTDHLSLDIKDFKHKSSHRSSVRCLPSAQRNETEISHMQPVARGAQVDKTFNDKGLCHASRTVSGMPIRPQYYLSSPNNNFKNPPTVKSCSEMSDFSYQLVRCAKRSASPKMGLTSTNCSLSEKMSLLRQPRHGDNHQNQNRISALNRRHKIVNPRGATDLL

SEQ ID NO: 38468 - protein, 247 aa, Sorghum bicolor
  unsure (1)..(247): unsure at all Xaa locations
  Clone ID: SORBI-28MAY03-C59431_1.pep
MRLLSGASASRLPSSLFSHPRARTRCVPASSFACRAASSSAAGTGDGGARKPWLFVGLGNPGKVYQGTRHNVGFEMIDVIAEAEGISLSSMQFKAMVGKGRIGDAPIMLAKPQTFMNASGESVGQLVSYFKIPLNQVVVMYDDLDLPFAKLRLLPKGGHGGHNGMRSIVNHLKQSRVGPPLXAGTGRPPGLMVPPVVARRPFGIDLLVQLDFALHRGLEAVRIMVLGGFNKSATYVNTAQSSEMLNR

SEQ ID NO: 38469 - protein, 310 aa, Sorghum bicolor
  unsure (1)..(310): unsure at all Xaa locations
  Clone ID: SORBI-28MAY03-C59443_1.pep
ARGLYEEAEQTFEKIEKAGLLSDEQTYVAMAQVHLNAGDYDRALEVLESMMMRNVKPSHFSYSAILRCYVAKEDIVAAEDTFRALSQHGLPDVFCCNDLLRLYMRLGHLEKARALVLKMREDDFRLDEDLSMTVMEFYCKSNMINDAEKLFKDIQRDNKTVKIPTMLLLIEMYARNRSSVILREHSSSKALDGTDSSAASVVLKSLLDMPGGLSSVSLLISKLAREGSTDEAKFIYDQLTELGFKPDHTAIATLIVQYGQAKQLEQAQELFESASAFFPEGANVYXAMVDAFCKCGKTEDAYHLFMXMAD

SEQ ID NO: 38470 - protein, 243 aa, Sorghum bicolor
  Clone ID: SORBI-28MAY03-C60159_1.pep
TRRPSGSNRTSESGNSIDDDSSRAAAAGTRALPRVSEELRAALSAFQQTFVVSDATRPDYPILYASAGFFNMTGYSSNEVVGRNCRFLQGSGTDPVEISKIRQALAAGSNYCGRILNYKKDGTPFWNLLTVAPIKDEDGRVLKFIGMQVEVSKYTEGSKDTALRPNGLPESLIKYDARQKDHARSSVSELLLALKDPRSLSESRNNTLKRKSQESGDVLLGEVPGKRSSESGSRRNSRSGMRN

SEQ ID NO: 38471 - protein, 196 aa, Sorghum bicolor
  Clone ID: SORBI-28MAY03-C60340_1.pep
ARGRSLPVTVYHLATRGADKERQDAVVECAVCLAELQDGEEARFLPRCGHGFHAECVDMWLVSHTTCPLCRLTVSKPDGVSPHPVSSLALPPVPPEPASYATASLPVSVLLGVSGHDVVTAVTTNPSTLVIEIPELAVPTPTLTPCDAAKSPGSARLRSIRRLWSFGRQGAGATSSSCSCAGAGASEGVDLEQGIS

SEQ ID NO: 38472 - protein, 130 aa, Sorghum bicolor
  Clone ID: SORBI-28MAY03-C6041_1.pep
MAGKSHTRKAFLLCNYILLGAASSCIFLTLSLRLLPSPCGLLLLFLHALTAVFSAAGCSGSFTAPATPAQWHNAHTAGAALTAIFQGAVALLAFTRTSDFLAELQSYVRDEDGAVIHKMVGGLGTAIFRP

SEQ ID NO: 38473 - protein, 196 aa, Sorghum bicolor
  Clone ID: SORBI-28MAY03-C60429_1.pep
MRSTVLVPRSLRKASVPPALLSDPTPGSLQPTRLAAHVNGAGSSCSVYLASGCRVYRIEISLGGAMLSKGKESLLIPDNAQVISSSVVDRCPHRSEIQSVSLAEGEDDCLILGTVDSYGHLIVSRLDIVADDIDRTSYSVPPRDCGVGEGSWAGICFSPMQQSMVAVARELCKTIDIYDQDIHVRSLRTLWYPSSF

SEQ ID NO: 38474 - protein, 191 aa, Sorghum bicolor
  unsure (1)..(191): unsure at all Xaa locations
  Clone ID: SORBI-28MAY03-C59646_1.pep
MLKESELMQMVHNPSSLQNPKSIHYRWMSKVGMKQLLRLLLADTXTPIASPPSTGAESRSEIRGELEEERRKDEEKRGTADSPARKKGKGRRVYGNLERGGVGGFGAAAAVPCDSGCPLALFVCLSVCLXWTRETGRRAEQQPAGAYRVRDPVRSGAVAVVVVVVAPTPMPTASEREGKETDGSCVDSVAL

SEQ ID NO: 38475 - protein, 235 aa, Sorghum bicolor
  Clone ID: SORBI-28MAY03-C59690_1.pep
LTLKYVQNSSNDIVHIRLNFRQNFSRREYYFESLTSSHEGKYFATGEMDFDPKLYGLAQCAPDLTLAQCQSCLGDLESRVTTQFLSGRPLGNNAFHVWCSLRYSVSPFYAGRAMLQLPAPPAPPPTATPTPHSSGRKMNAAGISAGITCVVVLMLILSVFFFIRFRLRIKVKKNDHSLKKIGRAQCTIFDLLTLEEATEHFSEKNKLGEGGFGIVYKGILSDGQEIAVKRLLGRA

SEQ ID NO: 38476 - protein, 149 aa, Sorghum bicolor
  Clone ID: SORBI-28MAY03-C5973_1.pep
GRAPFREVWKGGTSGSEDRNIMEHMCSSWLCDWLYLYCLCLSPHLMPCPSPGVHSPPWHLFTWKRPPRDRCLTFTINIASFFPGFSPFPRQSSRAGLAPGWRGQGCGGCTPNALCLRPGWGAGARLLCLRGVQRMPGLGLGLLGCVCTS

SEQ ID NO: 38477 - protein, 312 aa, Sorghum bicolor
  Clone ID: SORBI-28MAY03-C59743_1.pep
ARGSIIILPAKHERYEVGTGAFVSLLALQPCKQIAPIPIIVEASNSTTCELLKSITGLNVQPVEMVASKLFVQCSRQKGLLKIYKHLLNQHKNVFNLFSRPELGGMKYMDVRRKIHDAVVCGIFRSGKIYFHPSEEELLKETDKLLLIAPVHGMRRTKYRVLSVPRETQTSSHYPESREDQGSFNTATTMDNETRLKNIVKRPSKSLSKSSDYMLGPKERVLIIGWRPKVTEMIREYDSYLGPGSTVEILSGTPIKERSSIINPLLQSQLKNVEVTHRVGCPLNYDTLKETILNIQKSAPDKEVPLSIVVIS

SEQ ID NO: 38478 - protein, 117 aa, Sorghum bicolor
  Clone ID: SORBI-28MAY03-C59783_1.pep
MEHASCDDVHEHVISVAHGETASTSTSHQDMYSDSDEPHQEDRQSTSTQTPSSESSPSISPIAYSSRNLSFPRRDSIYGHGRSPWNSGLWISFEVVMYIAQVVAAIVILVFSRHEHP

SEQ ID NO: 38479 - protein, 99 aa, Sorghum bicolor
  Clone ID: SORBI-28MAY03-C59767_1.pep
FHIYDLCSFVKFYVGNTTFILVYQVMSALEKMTRGVAWGDLDILVVDMPPGTGDAQLSMSQRLRLSGALIVSTPQDIALIDARRGANMFRKVQVPVQSV

SEQ ID NO: 38480 - protein, 279 aa, Sorghum bicolor
  Clone ID: SORBI-28MAY03-C60632_1.pep
MSEHSTEEAFQSSNLDRDLQDNLASSSLNGRLPNSGQLDGECDNGVTRVPRDRTNYSSDASGEVTDGGGAPVASSVPQREHLIPPRLGPRGQFIRRQPSDRGFPRIISSSTMDARSDLSAIENQVRKLIDDLRSDSIDVQRSAASDLRSLAKHNMENRIVIANCGAVNLLVSLLHSPDAKTQEHAVTALLNLSINDNNKIAIANADAVDPLIHVLETGNPEAKENSAATLFSLSVIEENKVRIGRSGAIKPLVDLLGNGTPRGKKDAATALFNLSILHE

SEQ ID NO: 38481 - protein, 220 aa, Sorghum bicolor
  Clone ID: SORBI-28MAY03-C60719_1.pep
ARGPDALTKFMVVIHNAIGGQDYEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETCSACEKQMSKIVKDATLQSIEDGSLVLEKSEFSFGDVMNAVVSQAMLLLRERDLQLIRDIPDEIKDASAYGDQFRIQQVLADFLLSMVRSAPSEN

SEQ ID NO: 38482 - protein, 324 aa, Sorghum bicolor
  unsure (1)..(324): unsure at all Xaa locations
  Clone ID: SORBI-28MAY03-C60808_1.pep
HEASTKAPKRKHAQFCAATMPSSGNKRFRREDNESSAPGLLQKCGTSFFNWMSSLTNGLPMLDGATAAIPLDQKFSASTGEGSAAPSQPLQNNSSVPMQSVGFNSLFQSLYTHNVMITSRDNCHQPESNYAGHVFNRLTLELNDSNSMLDKQIGMGRETLDSGCKKNQCTAACSNDATQNKGGLRESLWVTRLLPKASVELMEATPCNVENAVNPQAVGDKLCCPPLQNFNLERGSSDGVTSSKCPATPPEEPKQSETMASVFAKRLDALRHANTSAVRLAIACDRGSPKLRNHKTNSFVVSYSSHDKVEAGHEXHKSSSRNGR

SEQ ID NO: 38483 - protein, 136 aa, Sorghum bicolor
  Clone ID: SORBI-28MAY03-C60883_1.pep
ARGKVPFLDICNTILDPTLPLTVLDYEEFGDPNIPAEFEAISSYSPYDNLAHGVCYPPVLVTASFNDTRVGVWEAAKWVAKVRDITCTSCSQSVILKTNMQSGHFGEGGRFMHCDETAFEYAFLMKALGLDDIAMP

SEQ ID NO: 38484 - protein, 257 aa, Sorghum bicolor
  Clone ID: SORBI-28MAY03-C6085_1.pep
ASSAAAMAAAAAAAPESYIGSLISLMSKSEIRYEGVLYTINTEESSIGLRNVRSFGTEGRKKDGQQIPASDKIYEYILFRGSDIKDLQVKSSPPSQSATLHNDPAIIQSHYPHPASLSTSLPSAASTTTANPTSHNAPSMIQMPPPFQGNLPPYQSGTSLQSWNSSPMPSSANGTGLTMPPMYWPGYYTPPTGFPHLQPPPFLRPPHSLAVPQALQLPIQYPGLGSLPTGFPSMPELPSFLQPGNSNSLSQTSGVPT

SEQ ID NO: 38485 - protein, 293 aa, Sorghum bicolor
  Clone ID: SORBI-28MAY03-C59971_1.pep
MGTSSGASSRQQPPSTQGMLPPRHGPRPSGLQTSLSLASSEQVGSPDMQEPGSNSAPGHDSATESASSKDTWPAEPNQSNGGVAASGVVSKAAEKEKEVANGVSKLQVIRGPSSRVGGMLLREVARARVDLVAEKMNVMPEEHLEEVKNELRSILEGTGGSHHIEEFLYLQKLVQDRDDLTPSMLSVAHHVQLEILVAIKTGIQAFLHPSVTIPHNRLVEVFLYKRCRNIACQSALPAEECRCNVCASRNGFCNLCMCVICNKFDFEVNTCRWIGCDFCSHWTHTDCAIHNGQ

SEQ ID NO: 38486 - protein, 203 aa, Sorghum bicolor
  Clone ID: SORBI-28MAY03-C6003_1.pep
METPPLSSLQEEGEEEPTVEDSSAFSAAAVPPRPATHSHSLHKYAPLDWSAYFDEERRVAIPDTDDVFNVYTAGSEGPVVFCLHGGGYSGLSFALAASRMKDKTRVVAMDLRGHGKSTTNDDLDLSIETLTNDVIAVIRTMYGDLPPAIILVGHSMGGSVAVHVAARKEIRNLHGLVVVDVVEGTAMASLVHMQKILANRAQH

SEQ ID NO: 38487 - protein, 171 aa, Sorghum bicolor
  Clone ID: SORBI-28MAY03-C60089_1.pep
ARARATRTDEKVLFLGPKQFPRITYSPVSRASSRLSRREVIAFAGQQPWDLGRFFKTLYFFNGPPNPLKIVESIISSFTGPASSEAPKKMETSDVVLVTGATGGVGRRVVDILRKKGIPVRVLARNGDKARSMLGPDVNLIIGDVTKEDTLDPKLFKGIKKVVNAVSVIVG

SEQ ID NO: 38488 - protein, 211 aa, Sorghum bicolor
  Clone ID: SORBI-28MAY03-C60078_1.pep
ARGSKRPLASLPPQFALPLHPPAVRRPPSPSPSSSSPPPPMALPLPNYRRGSPLPAAALIQKEAAAAAAAVSDSEDSDDADGNNNHNSPRSPSRSLSSLSGSNKKRSRDEASSSAEKGFRELARAIEAFAEMYERVESAKQKHAVEMERQRIEFLKQLEVKRMENFVDAHVKLARAKRTKKTTGGAADGAGAMELVATVAALPFVSTSTFL

SEQ ID NO: 38489 - protein, 59 aa, Sorghum bicolor
  Clone ID: SORBI-28MAY03-C6006_1.pep
MKIIKANKRQKLLTRTSNSAVVHSGQNKFSYELDQVLICAFLNNWENINGSTFFNGKEI

SEQ ID NO: 38490 - protein, 143 aa, Sorghum bicolor
  unsure (1)..(143): unsure at all Xaa locations
  Clone ID: LIB3476-017-P1-K1-G4.pep
ASRRTPSSLSXRLVPFETMIISRESINNSKSIFYSTCNGGYQNSNSLLEVGHGVTYVCGNQLKASIHIRVVARTSNSAVVHSGQNKFSYELDQVLICAFLNNWENINGSTFFNGKRKYEIYQRKATKAGRHHQIAHGMDTRIL

SEQ ID NO: 38491 - protein, 187 aa, Sorghum bicolor
  Clone ID: SORBI-28MAY03-C601_1.pep
MALAVFAKAAVAAGDASSSCPKLTLHNLCPYPVWPLVTANAGYPSVTGTDARLDGNGEGLVTMALPQGVWSGRVVARTGCADDDCPPKCETGDAPPATVAQVSVGGYGGLAAYSVSLVDGFNVPMVVTPHDFAAGAQCPTLGCAVDLTQDQECCPGTQAALFKAKCPVSRTTSTDLEATPLDCIAPR

SEQ ID NO: 38492 - protein, 201 aa, Sorghum bicolor
  Clone ID: SORBI-28MAY03-C61207_1.pep
MADESWRVPSLVQELAATVQEPPSRYLIPEQDRRDGQLAGAEMPEPVPTIDLQRLLASDDDYADEEATKLRSALQSWGFFLVTEHGIESSLMDSLVAASREFFRKPLQEKQAYSNLIEGKHWQLEGYGNEQVYTQDQILDWCDRLHLRVEPEDERNMDRWPGHPESFRGLLHEYSQSCKRVKDGILRATARLLELDDDDGI

SEQ ID NO: 38493 - protein, 314 aa, Sorghum bicolor
  Clone ID: SORBI-28MAY03-C61212_1.pep
HEAEDVVTGFRVHRTGWRSMYCRIEPDAFRGTAPINLTERLYQILRWSGGSLEMFFSHCPLLAGRRLNFMQRIAYTNMTAYPISSVFLVFYLLFPVIWIFRGEFYIQKPFPTYVLYLVIVIVMTELIGMVEIKWAGLTLLDWIRNEQFYIIGATAVYPLATLHIVLKLVLRGNGVSFKLTAKQATSTVNEKYAEMYVVQWAPLLIPTIVVIAVNVGAIGAAIGKAIVGGWSLLQMADASLGLVFNAWILVLIYPFALGIIGRWSKRPYILFILFMIGFVVVAAVVVAIHAARTGSFRFHFRHSGGASFPTSWGF

SEQ ID NO: 38494 - protein, 288 aa, Sorghum bicolor
  Clone ID: SORBI-28MAY03-C6122_1.pep
ENPYLMKCLMRVLGIANIAGQLVHEITARLVGILMEVCNNPKNPDFNHYLFEALAAVIGRTGEQDPALLPAFEASLFPVLQRILVEDISEFWPYAFQIFAQLVNLSQPPLSQNYMQLFGVLLSNATWDRPPCVPALVRLLRAFLRKIPNELNQEGRLPNILAISRSLLSRSSTEDSAFYMLNTIVENVGFDILNPYISEIWSALFTRLQGRQAVKFVNSLVVFMSLVLVKYGSSVLVSSVDAIQPNLFTQILQRFWIPNLKLIKGALEVKLTAVASTKLLCESAVLVD

SEQ ID NO: 38495 - protein, 65 aa, Sorghum bicolor
  Clone ID: SORBI-28MAY03-C61349_1.pep
PKNVSPTVISPKQYKKRFRKAMSAYFLVVPDQWSPLVIIPSKQAESGQDRDSDQVLLTESRVMHA

SEQ ID NO: 38496 - protein, 122 aa, Sorghum bicolor
  Clone ID: SORBI-28MAY03-C61229_1.pep
MVGDGINDSPALVSADVGLAIGAGTDVAIEAADIVLMKSNLEDVITAIDLSRKTFFRIRMNYVWALGYNVIGIPIAAGVLFPSTGFRLPPWVAGAAMAASSVSVVCWSLLLRYYKAPKIVGS

SEQ ID NO: 38497 - protein, 212 aa, Sorghum bicolor
  Clone ID: SORBI-28MAY03-C6042_1.pep
MAAAGPASSYFAGSAILPSQRAAAAPDNSAVVTSSPAKQSRDPRFSGCAPTTVRHIARSFAAADATGGGDPVIYIDGVDATNVWILGRVVSVVNMEAGVSFTLDDGTGRIPLVRWITDDIDAKEVSFVQNGLYLKVQVTLVGFRAKQHGFARSIRPVTNFNEVVLHFIESMYVHLVNVWPKTQGQFPRTVQANASTHEMQAQVAHTVQTNAP

SEQ ID NO: 38498 - protein, 70 aa, Sorghum bicolor
  Clone ID: LIB3476-014-P1-K1-C8.pep
RNGLYLKVQVTLVGFRAKQHGFARSIRPVTNFNEVVLHFIESMYVHLVNVWPKVIRANGKFLCQFHFDDL

SEQ ID NO: 38499 - protein, 203 aa, Sorghum bicolor
  unsure (1)..(203): unsure at all Xaa locations
  Clone ID: SORBI-28MAY03-C60433_1.pep
SWSCPVAPLSSARARARLLPARPAPALHFARRHVRSPGPPLPAPAHYTIIGAATTHQKDAPLGPRTLAPSNDDNQSKGWPGGVPDPLRSGLAAATARRPPSLPXSNLSPRIYFTPRIDSAGRHSFRRKSLHAINGTPNPYEQAISIIGRTLSPFDDDNLIPCFGFGDASTHDHSVFSFYPENRLCRGFEEVLARYRQIVPHLN

SEQ ID NO: 38500 - protein, 293 aa, Sorghum bicolor
  Clone ID: SORBI-28MAY03-C6051_1.pep
MDQYEKTEKIGEGTYGVVYKGKDRHTNETIALKKIRLEQEDEGVPSTAIREISLLKEMQHRNIVRLQDVVHNDKCIYLIFEYLDLAAKKHMDSSADFKNHRIVKSYLYQILRGLAYCHSHRVLHRDLKPQNLLLDRRNNILKLADFGLARAFGIPVRTFTHEVVTLWYRAPEILLGARHYSTPVDVWSVGCIFAEMVNQKPLFPGDSEIDELFKIFRILGTPTEGTWPGVATLPDYKSTFPKWPSMDLATVVPTLEPAGIDLLSKMVRLDPSKRITARAALEHEYFRDLEHAY

SEQ ID NO: 38501 - protein, 205 aa, Sorghum bicolor
  Clone ID: SORBI-28MAY03-C60547_1.pep
HEGKFRLGLKIASGFCEGVRIREAKTEAFMVKDHRGELYKKHYPPTLKDEVWRLEKIGKDGSFHKRLNKSGISTVEDFLRLVVRDPQKLRNILGSGMSNKMWETLVEHAKTCVLSGKYYIYYSDESRSIGAIFNNIYAFCGLISGEQFYSSESLDESQKLFADGLVKKSYDNWMYVIEYDGKGLLNPKPKKKAASTGQAETHAPV

SEQ ID NO: 38502 - protein, 192 aa, Sorghum bicolor
  Clone ID: SORBI-28MAY03-C6057_1.pep
DVASLHRKERRRACPPRVRKPHQYSDTDKACSGHSSASDSLVQDCGIPDQQDFTSWATDCLKDDGDVTQNLSLSISSPPLTDTNLNRSQSHRQFPGTLFGWSNDPHYSFYPSGLLHAHHKAENQDGTTSSYMATGGHNVFSHGTASGMRGGMAGPLLQQPIMSSRDGWTDGSRDSGTNCPQVDISYHMYSLF

SEQ ID NO: 38503 - protein, 254 aa, Sorghum bicolor
  Clone ID: SORBI-28MAY03-C60627_1.pep
MGYLPSLSSKAAHFVSDLTTVILNPVSEREPAHLPEVDEVQENLEDDKDSEHNSDSLDGPDTSSFRAFLISFLSSSSSNNDSMEIIPEQNGDMGYPTLTPMGKGSKGRTGLISRGKHSIGKIINKATRIGGFKQTTAEPKIDRETITHTEPVAPVLERQEPKEVVSFSSLPTMSEPSVLLSERMQSILYASLPVLAQGRNWVLLYSTWRHGISLSTLYRRSMLCPGFSLLVVGDKEGTIFGGLVEAPLQPSSSK

SEQ ID NO: 38504 - protein, 142 aa, Sorghum bicolor
  Clone ID: SORBI-28MAY03-C61502_1.pep
SDIIMRIVKDYNEYVMRNLARGYTRKDLGVSYVKEKRLRVNMGLKNLRDKVKQHQEKVGEKWNTVAKLQEEWVENADRWVAGFLEKFEEGCHSMGTAIKERIQERLIKAQSSDFGSLLQYDSYDSDEANGDDEDEVFEDVKE

SEQ ID NO: 38505 - protein, 158 aa, Sorghum bicolor
  Clone ID: SORBI-28MAY03-C61513_1.pep
HVHATIDWTNTALTASEVEAAENQIREQVSRSPNNTVLELNRRRQRYIAKPSEELVITVNSLQEWGKQIDPRKLVVVHFSAVWCRSSRKMSPVFADLAKKFRNVVFLKVDVDEMETVAKEFSVEGVPTFLFMKGGYVKDRVVGADKEELGEVLEEQLT

SEQ ID NO: 38506 - protein, 129 aa, Sorghum bicolor
  unsure (1)..(129): unsure at all Xaa locations
  Clone ID: SORBI-28MAY03-C61587_1.pep
EHIKCYTMSVLNPDGQTSNEDIIFLYRLVPGQALLSFGLHCAWLAGMYLDELVITWHDVVIXGVPNEVVQRADSVLGDIHSKKPARRVTSEKLTATDKQYQDAVTKLMAIDTQKDDLNSFFQELFPSEL

SEQ ID NO: 38507 - protein, 116 aa, Sorghum bicolor
  unsure (1)..(116): unsure at all Xaa locations
  Clone ID: SORBI-28MAY03-C61520_1.pep
DXIDVHNRFRLRLYRPSTVTTEYREHVKDLSCVSKDFGRIVIVDNNPFSFILQPLNGIPCVPFSAGQHSDDQLMTVIFPLLKHLSLQKDVRPVLHERFHMPEWFQKHGIPPTNQAV

SEQ ID NO: 38508 - protein, 208 aa, Sorghum bicolor
  Clone ID: SORBI-28MAY03-C6165_1.pep
SLSCNSTSPPISSEQGEESYLHIEPLSPSKALRIAMLKRRFAGTIVKAQQNALLDHGKEIDLAKLQLEKERLEKRQQEEKARIEAQVKAAEAAAQLKLEEEMRRKREQERKAARLALHMMKKTVDIDNSDFLKDLENLCQKWQLNPPSKLIVDFVHGIELTQGLGSPLEALGLFMKKDIEEEVEHEMEDSVSTSQNADVEEGEISCCQ

SEQ ID NO: 38509 - protein, 159 aa, Sorghum bicolor
  Clone ID: SORBI-28MAY03-C67824_1.pep
SRDVETDIIPTCRELGIGIVAYSPLGRGFLSSGPKLVDTLSDQDFRKDLPRFQPENMEKNAVIFEKVNAMAARKGCTPSQLALAWVHHQGPDVCPIPGTTKVENFNSNVAALSVKLTPEDMAELESYASADVQGDRYNESFLAAWKDFETPPLSSWKAE

SEQ ID NO: 38510 - protein, 154 aa, Sorghum bicolor
  Clone ID: SORBI-28MAY03-C67901_1.pep
MGSAATESNDTLLGNGVVGILAETCNMWERRAPLTPSHCARLLLGGGKNGARVNRITVQPSTKRIHHDAQYEDVGCEISEDLSECGLIIGIKQPKLQMILPDRAYAFFSHTHKAPTPSWPLSGLILEERVSLFDYELIVGDDGKRSLAFGKFAG

SEQ ID NO: 38511 - protein, 237 aa, Sorghum bicolor
  Clone ID: SORBI-28MAY03-C67951_1.pep
MPLASLSLDPAPFPLIRPAAGWSGRVLPVPGPAPRLCRPLRAAPVAPATTDEPSAAARGRLESLSQVAGVLGTQWGDEGKGKLVDILAQRFDVVARCQGGANAGHTIYNSEGKKFALHLVPSGILNENTQCVIGNGVVVHLPGFFKEIDGLESNGISCKGRLLVSDRAHLLFDLHQVVDGLREVELGNSLIGTTKRGIGPCYSNKVTRNGLRIGDLRHMDTFGAKLNNLLRDAALRF

SEQ ID NO: 38512 - protein, 146 aa, Sorghum bicolor
  Clone ID: SORBI-28MAY03-C68083_1.pep
HAARPEPIRSKTRAWAPDDIFRPQSLPSISKQASFPASIGNRWPEMGMSAAQQGILSLPLSCPICCDDLDPTDSSFCPCPCGFHMCLFCHNRIKLEDGRCPGCRKQYNTVSAAEGVGGGGGAKAAVGTGREMEKRLSRSCSMGPSY

SEQ ID NO: 38513 - protein, 170 aa, Sorghum bicolor
  Clone ID: SORBI-28MAY03-C67997_1.pep
YDTPLGKIGALICWENRMPLMRTAMYAKGSQIYCAPTVDCMPSWQSSMTHIALEGGCFVLSASQFCHRKNYPPPPEYTFGGLEEEPSPESAVCSGGSVIISPSGTVLAGPNYESEALLTADLDLGEIVRAKFDFDVVGHYSRPEVLSLVVKTDPKPAVSFTSASEKTNAG

SEQ ID NO: 38514 - protein, 149 aa, Sorghum bicolor
  Clone ID: SORBI-28MAY03-C61781_1.pep
YKSESDDENDDNDSWDARKPLCRASNTPEEAPGPIATNSASSHIYQKDTTVTSTEDLKPSSTSKSPDPSHDAQAAAASSQTAGIGISIKQEPVIGVSIKQEESSLTEGEVDGDLEECVEKLGTIKARLKYLMQGTRLERQSFRGYSSGK

SEQ ID NO: 38515 - protein, 122 aa, Sorghum bicolor
  Clone ID: SORBI-28MAY03-C61785_1.pep
VMVILSKMFFAGVSLFAALGFVLYGGRLFLMLQRFPVESKGRRKKLQEVGYVTTICFSCFLIRCVMMCLNAFDKAADLDVLNHPILNFLYYLLVEIVPSALVLFILRKLPPKRGITQYHPIH

SEQ ID NO: 38516 - protein, 147 aa, Sorghum bicolor
  Clone ID: SORBI-28MAY03-C61848_1.pep
MDDPDINDPISKDSRASEPSVDEASVQTLISFGFQEDVAIKALKASGGNIEKATDWIFSHPEASSSASADSSTSNANADDAYIPDGSGRYKLMAFVSHMGTSTHCGHYVAHVLKDGRWTIFNDSKVAASVDLPKEMGYLYFFQRISN

SEQ ID NO: 38517 - protein, 126 aa, Sorghum bicolor
  Clone ID: SORBI-28MAY03-C61877_1.pep
LQSTRIVAFKQASARREGKKLICQPTCQSAFEERLQPINKEPHGSAYHLSAKLSRERKNGPATCGIATMYYQDAAPVYCTMSCSYIVSVILDGGQYRRTDLPRMFLTGSGPQLCESKLLFLLSPST

SEQ ID NO: 38518 - protein, 162 aa, Sorghum bicolor
  Clone ID: SORBI-28MAY03-C61889_1.pep
PHCSSDMEPGQCFFPQEVAKSITTPMFILNPAYDVWQVEHVLSPEGSDPQNLWQNCRTDITKCSSKQLEVLQGFRKALLDAINEFKKRRDWGMFIDSCFIHCQSMKALAWHSPSAARINNKTAAEAVGDWFFDRREVKEIDCEYPCNPTCYNVVLDQPYKED

SEQ ID NO: 38519 - protein, 96 aa, Sorghum bicolor
  Clone ID: SORBI-28MAY03-C61350_1.pep
ELVEAVDRDLRKMLINSTAVDPLVLGVRVWPQAIPQFLVGHLDLLEVAKSALDQGGYDGLFLGGNYVAGVALGRCIEGAYESAAQIYDFLTKYAYK

SEQ ID NO: 38520 - protein, 105 aa, Sorghum bicolor
  Clone ID: SORBI-28MAY03-C61372_1.pep
TYLSLNRVCSANTLVLYEGCFPQLKTLVLKHMPDVCELKISDRALPQIEGLYVVTLQKLNKVPQGIESLRSLKKLRLLHLHQDFKAQWHMNGMQQKMHYVPELLI

SEQ ID NO: 38521 - protein, 77 aa, Sorghum bicolor
  Clone ID: SORBI-28MAY03-C61429_1.pep
AFETSCSSATAAPPLLRLCTPSVAPPLRLCAPTTTPPARNHEVQAHIAKLRRQLTMIEGMPQQSKAFSVPGQQFRHI

SEQ ID NO: 38522 - protein, 74 aa, Sorghum bicolor
  Clone ID: SORBI-28MAY03-C61433_1.pep
ALTQGLLASGSTINPLASVANCRCLCLTGKQLLTYQSSPADPQPGVVCNFISFCACKCPHPLYINVFAMGHYCL

SEQ ID NO: 38523 - protein, 246 aa, Sorghum bicolor
  Clone ID: SORBI-28MAY03-C61476_1.pep
MSSPPLPSQAKLPATGSSAACLPRPRDRHLLVRGWSAGAGAGATPLVAASSSSGPACCHHYSVATAPSLRAASTSSRRGGGAGLDALTVTASAVAVSVCLIFFSAIRSMLACKRDAEFLEKYFDSAREKLPETMASVRLVGREIGDLAADLSDLSQELTKGVKNSMNIVHTAEAQLRQSPRSTLPGPARRMSNQKNVTEEPLLASTVRDLRQLTADIRTGFGAAAGIAGLSMWALKFGSKGRKNRS

SEQ ID NO: 38524 - protein, 199 aa, Sorghum bicolor
  Clone ID: SORBI-28MAY03-C61440_1.pep
QMISRRRMSYLSHAKQHKHNTLIISLTWLYLDFMLQFQGRVAKRTLLIINQAGIPQFKHSTTRVHYKRRKVAVFTPTKTLDTAKASYKQFTRLVNCSCSTAIQQKVQQSMPSLCRLLVHLKNVSATNAEIDILYQCHLNNVELWTLTFTELQLQKLHHKKAPDSLLIRFISDRISREIPLVVIRDRAPNSLEACHLFHV

SEQ ID NO: 38525 - protein, 117 aa, Sorghum bicolor
  Clone ID: SORBI-28MAY03-C62059_1.pep
YGFDILATYKFGSLQLAHDANLLRVPDIRWLGVFTSDFEEYCLPDCCLLHLSPEDRRKAERILARCYLHREVPEWRSELEAMLQKGVKFEIEALSANSISFLSDEYIPQKIKQGMHL

SEQ ID NO: 38526 - protein, 118 aa, Sorghum bicolor
  Clone ID: SORBI-28MAY03-C62104_1.pep
SQIITKLAGQVVTMSQNKSASNVIERCFQHGDIAERDLLIRQIVEQTEGNDNLLAMMKDQYANYVVQKILETCNENQRELLLSRVKGHMQALRKYTYGKHIVSRVEQLCGDGTAESDS

SEQ ID NO: 38527 - protein, 98 aa, Sorghum bicolor
  Clone ID: SORBI-28MAY03-C62150_1.pep
SGGYRTLADHQQVYIHPSSALFHQQPQLVIYHEIVMTTKEYMREVTAVDPRWLVELAPRFYRSVDPMKISKRKRQERIEPLYDRYNEPNSWRLSKRRW

SEQ ID NO: 38528 - protein, 195 aa, Sorghum bicolor
  Clone ID: SORBI-28MAY03-C62256_1.pep
WPIEETETKWLQFLDKHKVTNKESWLCQMYDTREIWCASYHAGKCYLGLRSNQRSESLNSRIHMRLDRKMTLLDMVRHVDHCLSGLRANEAKLDTDALQSEVCTDPDASIIEIEAVKSFTPTVFAMVQFNIKAAKKCFLIEIEDGDNMSEYIVGRKDKGDMMYFVKCEFCDEGNLKEISCSCRKLQSIGTPCSHI

SEQ ID NO: 38529 - protein, 302 aa, Sorghum bicolor
  Clone ID: SORBI-28MAY03-C6159_1.pep
MATRVKDVARRSTKKYVEEALYRRLFRKGSTPQAVREEVDGFLDSRKRAFKWEVGVCVRRMRRNALYRPALKLSEVMTRRGMNPTVSDQAICLDLIAKSRGIAAAEKYFLDLPETSKTHLTYGALLNSYCKELMTEKAESLMAKMSELNFAFTAMPFNSLMTMYTKVNQPEKVPGIIQYMKADDVLPHVFTYNVWMRALAALNDIPGVERVIEEMKRDGRVAPDWTTYSNLASIYVDAGLFEKAEAALKELEKRNTSNDVEAYQFLITLYGRTQNLVEVHRVWRSLKRNNPRMANMSYLNMI

SEQ ID NO: 38530 - protein, 157 aa, Sorghum bicolor
  Clone ID: SORBI-28MAY03-C61698_1.pep
WGFAFQRDSPLAADLSTAILQLSESGQLQRIHDEWFSRSSCSSDDSEVGATRLGLGSFWGLFLVCALICLFALLVFFIRVCWQYNQYSSSESSGEPSAATPGPVIRQRRLSRLGSFKELIQFVDKKEEEIKKTMKRRSSDKDSQAAGFSYAQSVASA

SEQ ID NO: 38531 - protein, 105 aa, Sorghum bicolor
  Clone ID: SORBI-28MAY03-C61709_1.pep
EKADVYGFGIVLFETISGRLIHSYMNTEGTRRLPPPSYAHKYDRKKLHKLVDPLMCVNKHEWDQIVECVRVAQLCVHHLAKHRPTMSEVVTMLGSIKVSQRAHGK

SEQ ID NO: 38532 - protein, 87 aa, Sorghum bicolor
  Clone ID: SORBI-28MAY03-C61717_1.pep
LERADQHAEKYVRRGRLNWPEGAATKESIRAVLKLPRLQNLVMQHVDHSAGDFIDLLKRLLAYEPSARLTAQEALSHVFFTRHGKNQ

SEQ ID NO: 38533 - protein, 220 aa, Sorghum bicolor
  Clone ID: SORBI-28MAY03-C6177_1.pep
APRSLGSPAGPEPPPARPGAQPPPGAARSAPRRSAAAAPRAPEAARSPPLVRAAAASHAGSWYTNNARKLEEELNGWLGAAGLTKSPDVRAVIAPHAGYSYSGRCAAYAFGNIDPTNISRVFLLGPSHHYYTPKCALTRASVYCTPIGDLPVDQEVIEELSATGKFEFMDLSVDEAEHSMEMHLPYLAKVFQGHTVKVVPILVGALSSQSEAMYGQLLSK

SEQ ID NO: 38534 - protein, 114 aa, Sorghum bicolor
  Clone ID: SORBI-28MAY03-C6264_1.pep
MADAPASPGGGGGSHESGSPRGGGGGGGGSVREQDRFLPIANISRIMKKAIPANGKIAKDAKETVQECVSEFISFITSEASDKCQREKRKTINGDDLLWAMATFGFEDYIEPLK

SEQ ID NO: 38535 - protein, 155 aa, Sorghum bicolor
  unsure (1)..(155): unsure at all Xaa locations
  Clone ID: SORBI-28MAY03-C62662_1.pep
DNTKSGKGRNAPKPAKGRVKAAKGSSNKATNTSDDGDKEDYEVEEAKPAKRGRKQPARVSNTSSKNAGSIHGDEATDEVDARPAKRTKKQIEKTTKRSLKEANHEDSDEEAHDKIEAKPGNAPTEESARRPHXKSLPKKVDAGPAMRPQRKARQA

SEQ ID NO: 38536 - protein, 83 aa, Sorghum bicolor
  Clone ID: SORBI-28MAY03-C62682_1.pep
MNKNDNNKKCLNLNRRLWEKHVSYVIDHISTNEPNHINQIFSRLSQLRAWLQFQGGCQGQATGTSFYYFQFHKSYKRHLLLPW

SEQ ID NO: 38537 - protein, 179 aa, Sorghum bicolor
  Clone ID: SORBI-28MAY03-C62701_1.pep
GIREELAHIASLKASAAASNDMVFFESEETKDLVYLQAALFESLRLYPPGPFERKVVLADDVLPSGHRLCSGETILISIYSMGRMEALWGKDCYEYRPERWLSEDGGKLRYVPSHKFMAFNSGPRMCLGKDIAVTQMKTIVAAVTWNFDLEVLEGQSIQTKLSCILQMKNGLKMNVKKR

SEQ ID NO: 38538 - protein, 148 aa, Sorghum bicolor
  Clone ID: SORBI-28MAY03-C62719_1.pep
TRRRFEEALSERDGEISKLKQELADASENLQEEKYANGLQISELQQSVEYIGSKLEKVSEEKLLVENKVKELEATNAEADKYGQELTQAAEKLSEEKFRHEAEILTMQQNIEDLKSGIESLAREKSLLKSWFDDLEQVVGRGRSILVE

SEQ ID NO: 38539 - protein, 162 aa, Sorghum bicolor
  unsure (1)..(162): unsure at all Xaa locations
  Clone ID: SORBI-28MAY03-C61913_1.pep
GCVIAPLTFWLYWSAFDIGNPDGAFKAPYAVIFREMSILGVEGFSALPQHCLAICSFFFIASLVINLLRDITPKNVSRFIPIPMAMAIPFYIGAYFAIDMFVGTVILFVWERVNRKECDAFSGAVASGLICGDGIWTVPSAILSILRIDPXICMYFKPSVSS

SEQ ID NO: 38540 - protein, 65 aa, Sorghum bicolor
  Clone ID: SORBI-28MAY03-C61953_1.pep
CRLSVPVFPSLWRRAAVRTCFFSHLWGIVSSAVIGAHLLLLSPSFPCSYFRCKTSDICIAILFHL

SEQ ID NO: 38541 - protein, 100 aa, Sorghum bicolor
  Clone ID: SORBI-28MAY03-C61915_1.pep
CLQRLGIYGCPQLLQWCQSKENEMKLAHIKEREYQGEPLPEEVHKQQRRQRRLQKALALSRPRRRPGMGRRMRPAMQRHQEPFSSPNEGRSLVATKIPSS

SEQ ID NO: 38542 - protein, 96 aa, Sorghum bicolor
  Clone ID: SORBI-28MAY03-C61954_1.pep
VMRPMFGAFGKAGSSNSIAFVSKAAKEAGVAMEYKLEKRVEAVGGVRGLTKLDMKLNDALPRIEVDPETYTVTADGEVLTCQPAPTVPLSRNYFLF

SEQ ID NO: 38543 - protein, 127 aa, Sorghum bicolor
  Clone ID: SORBI-28MAY03-C61992_1.pep
PQLAVQDIWDNNGQRRVHLKLSLGSLSEIWTSVLNITGPLSNWSFADNMLPAPQTVSGGPPSYICRLSGKSDMDWSFWLEANSSDSLRIDVAVLDQYLVDSTKKLKSLFPSWADLTAFSTFFSTYHL

SEQ ID NO: 38544 - protein, 209 aa, Sorghum bicolor
  Clone ID: SORBI-28MAY03-C62022_1.pep
ARGNPDLIDQCAREDFVERVKTQQDEGCNVHGFLDVSKVAGNFHFAPGKGFYESNIDVPELSVLEGGFNITHKINKLSFGTEFPGVVNPLDGAQWIQPASDGTYQYFIKVVPTIYTDIRGHNIHSNQFSVTEHFRDGNILPKPQPGVFFFYDFSPIKVIFTEENRSLLHYLTNLCAIVGGVFTVSGIIDSFIYHGQKALKKKMELGKYR

SEQ ID NO: 38545 - protein, 171 aa, Sorghum bicolor
  Clone ID: SORBI-28MAY03-C63104_1.pep
ARGIIDAKLPQIEKHQLFAEHQEGARKGWAAFMKSITLPQIEKHQLFAEHQEGARKDVERAFGVLQSRFAIVRRPARLWKRKSIGRIMLACVILHNMIVEDEKEDVNIHIDLNENPGASFALPPEVNTSRNPRFADVMRRKAAIRDRPQHTQLKNDLIEHIWCKFRNRQHN

SEQ ID NO: 38546 - protein, 161 aa, Sorghum bicolor
  Clone ID: SORBI-28MAY03-C63103_1.pep
LVDVGGGNGTTLQMIRGQYKNMRGINYDLPHVIAQAAPVEGVEHVGGSMFDNIPRGNAVLLKWILHDWDDKACIKILKNCYTALHVRGKVIVLEYVVPDEPEPTLAAQGAFELDLTMLVTFGSGKERTQREFSELAMEAGFSREFKATYIFANVWALEFTK

SEQ ID NO: 38547 - protein, 182 aa, Sorghum bicolor
  Clone ID: SORBI-28MAY03-C6323_1.pep
GQEPENYWYRVCEGRAAKVIQRPWYAIWKSKRLMNIVTEIAGRMDWDYDGLHVVRGWKAQNKQMYPNLDSDTSPDALVDKVTKLVKPWRNLYIATNEPFYNYFDKLRSHFHIHLLDDYKELWSNTSEWYNETTTLSQGKPVPFDAYMRVIVDTEVFYRSKAQVETFNNLTRDCKDGINTCNL

SEQ ID NO: 38548 - protein, 130 aa, Sorghum bicolor
  Clone ID: SORBI-28MAY03-C63247_1.pep
HEGRILISKAPPVLTINLNRFSQDSHGRYKKLKGHVRFKEMLDIQPFMDPRCNENTTSTYRLVGVVEHLGTMTGGHYIAYVRACKIGGRQQQSSGSKSWFYASDGQVREASLEEVLNCEAYILFYERVGD

SEQ ID NO: 38549 - protein, 153 aa, Sorghum bicolor
  Clone ID: SORBI-28MAY03-C63256_1.pep
DCSLAKPPADKKDDTVSAPTAKGAPLLPSYAPLGYGLVGAYNPLGNGLAGAYNPLGSGLAGAYGVLSARAAQPMLYAPGAPPGSTMIPMVLPDGRLVYVPQTAGQQPVHVTSPPPQQGGRRFGGSGSSSGGGGSSSGGKRQRGDDRRGRHRPY

SEQ ID NO: 38550 - protein, 159 aa, Sorghum bicolor
  Clone ID: SORBI-28MAY03-C6233_1.pep
TRPTRAQQHRLDSGGRRRGEAGQRGALLLRSIAALDNLRVCSCSTTMDRMEKAERFVQLKKLAGSVISYWSIISVPVEEKLNFVPLLHYAKAESVDEIPEHIAVSEDFMKTVENESHRLEKIVAEMIVRKKSKLAQIYQRTRLESPFAGQEPSVTSVAF

SEQ ID NO: 38551 - protein, 115 aa, Sorghum bicolor
  Clone ID: SORBI-28MAY03-C62362_1.pep
ISLAYGNIKMQVGIKRMVTSNSESINQTMKFTHNSGRRLDLRTDVEHQKKNTNNVISAKQSDAAKTEGHSNQGYLKGFKRCSSAGFKSYIFVAFFVVGVAAAAAALHYHRSGANL

SEQ ID NO: 38552 - protein, 118 aa, Sorghum bicolor
  unsure (1)..(118): unsure at all Xaa locations
  Clone ID: SORBI-28MAY03-C62488_1.pep
RINTYALTIIPXAMSLEELLPPNQQKYSTIIMLRSSLVMSTLLIALSVPFFGLVMPLVGSLFAMLVTYILPCACFLAILKTKVGWHQIAACSFIIAVGVCCACVGTYSSLSKIIQNYT

SEQ ID NO: 38553 - protein, 129 aa, Sorghum bicolor
  unsure (1)..(129): unsure at all Xaa locations
  Clone ID: SORBI-28MAY03-C62496_1.pep
GHMAPXYVFPCGHAFHANCLIGHVTRCSNQVQAERILDLQKRLSLMDRKAAKENGASVNGESITSTTPVDKLRSQLDDAVASECPFCGDLMIKEISQPFILPQESDEKASWEIKPQPTPQKILPMTMSI

SEQ ID NO: 38554 - protein, 112 aa, Sorghum bicolor
  Clone ID: SORBI-28MAY03-C62546_1.pep
KRLAFVESMINAMTAEEREKPELLAESRERRIRVAEESGKTEQEVSQLVAQLFQMRAQMQKLMSMVQGQDAIAGMGDLMDSLKAEEKAPPGTARRRRRNSKPKQRELDAVLS

SEQ ID NO: 38555 - protein, 206 aa, Sorghum bicolor
  Clone ID: SORBI-28MAY03-C62630_1.pep
LCKHQRDNRESATRMQAGERLSEVTGAGIHRLVTPVGAARGITNMTGIFTAVIRGGVAQTTLGGLTIVMTMAVVVRQDPRQEGSPRGGYVNTTRMATAGRARNARTCTGDCHCRGSGTPNCLVALTFLYSSICFRGSKYRRTLINRVGTSKLVVVHILQGRSMAKLGFQSLSQVLMAFGAGMHPFCSVKARVYFFIYFAEWTTFFV

SEQ ID NO: 38556 - protein, 74 aa, Sorghum bicolor
  Clone ID: SORBI-28MAY03-C63428_1.pep
HHSIIDVLHRTLGKLVLKNAEQGAATTCYVALHPQVKGVSGKYFCDSNLYEPSAKAKDMELAKRLWDFSVELVT

SEQ ID NO: 38557 - protein, 112 aa, Sorghum bicolor
  Clone ID: SORBI-28MAY03-C63470_1.pep
VLSPAALNFFVNYADGAVESLWSIDQYFEFILVLMFSTGLSFQVPVIQLLLGQLGLVSSDQMLSIWRYVVVGAVVAAAVLTPSTDPLTQMLLAGPLLGLYLGGAWMVKLIGR

SEQ ID NO: 38558 - protein, 136 aa, Sorghum bicolor
  Clone ID: SORBI-28MAY03-C63658_1.pep
QTVSIKSNEDQELFDPKVQERDLNVVSPREASEAEENFVDVSKLWLIQSPEADAEQSPKADAEEKIYDEKIKAIEGTKNFPDEAAMKTEAPGAAQKALKKQSLLSGVGSKVKHQLAKVKKAIVGKPGRTKPESPKA

SEQ ID NO: 38559 - protein, 120 aa, Sorghum bicolor
  Clone ID: SORBI-28MAY03-C63709_1.pep
SPYRTAVGSASPMQPNNQSKPKHRLTGMQTPERRPSSEGHGQHTPGRSRMKQGGYEPEEEVAVPPFGEWDDANAASGEKYTGIFNRVRDDRLSPTSSARQPFTTRSEENKVQQKCSCCIL

SEQ ID NO: 38560 - protein, 141 aa, Sorghum bicolor
  Clone ID: SORBI-28MAY03-C63738_1.pep
MLGGKYMHASHKGHTRTTEEFSDTESISSSVGSSSPNSTPHRSQYYNLVCQSGDTCSRTDEDEASTSERETSEHNNVGLREETHLLELHAYRATMLALYACGSISWEQEALLTNLRLTLNISTDEHLAELRSLVTDAVTSR

SEQ ID NO: 38561 - protein, 143 aa, Sorghum bicolor
  Clone ID: SORBI-28MAY03-C6282_1.pep
KPVGNGSRLADLTRAKNLTLHSIARWMDSELARHPKMKVFLRTISPRHFVNGDWNTGGTCGNTIPLSNGSEVLQDHSIDIPAENAVKGTQVKLLDITAISKLRDEGHISNSTFKKASTGINDCLHWCLPGIPDMWNELLFVQI

SEQ ID NO: 38562 - protein, 126 aa, Sorghum bicolor
  Clone ID: SORBI-28MAY03-C62825_1.pep
KYALMVTPLATAVEERLQLAAGSGSGSARGSSSKRSVNVLVRTLLVVSTVVVALAVPFFGHLMALVGSLLSVMAAMLLPCIFYLKIFGVARCSRAEVALIATIIVLGSVVAAAGTYASVKKIVLDY

SEQ ID NO: 38563 - protein, 86 aa, Sorghum bicolor
  unsure (1)..(86): unsure at all Xaa locations
  Clone ID: SORBI-28MAY03-C6270_1.pep
MYRTGSGECIIHVWYHGPAVQAXKYQICHCVISLLVPAALSEQEDDPHAHCILGGIXHYNCRFGGVPRSLTQSFSYLPKELVVSWW

SEQ ID NO: 38564 - protein, 184 aa, Sorghum bicolor
  Clone ID: SORBI-28MAY03-C63031_1.pep
TREEVYEEDNKLWKKHVNTYKRVNKLIGSSRYRNIMDMNAGLGSFAATLHSPMSWVMNVVPSISERNTLGIIYDRGLIGIYHDWCEAFSTYPRTYDLIHGNGIFSLYQNKCDAEDILLEMDRILRPEGAVILRDSADVLNKVRSMVAGMRWKSKLLDHEDGPHVPEKILISVKEYWVGSEEQNS

SEQ ID NO: 38565 - protein, 127 aa, Sorghum bicolor
  Clone ID: SORBI-28MAY03-C63046_1.pep
MKKLYGYLHNIAGKEIEATLPRLKEIEMAPLSKSMDEDLAEAAKEVEEQRRAANEAPVDPKILQKYAIGDDNEIEKALQNTKVSASGIISVKSNKTKADKKEKHKESGKSKRKGTDGGRSESKKKRS

SEQ ID NO: 38566 - protein, 161 aa, Sorghum bicolor
  unsure (1)..(161): unsure at all Xaa locations
  Clone ID: SORBI-28MAY03-C63077_1.pep
MMLLLSTLIANLAPTVAVFFMILGCVCLGPADRDSRRRLGALIGACPVKWKNLWQQSHFYWGEIEAGTLKFDRVXSEVALLRELKKEEFIEFFDQYIKVGAPQRRTLSVQVFGGNHSAEFKKAIAEADPPKTYRVTDMSGSKRSRPLYSSLKGGPGRITMD

SEQ ID NO: 38567 - protein, 205 aa, Sorghum bicolor
  Clone ID: SORBI-28MAY03-C6407_1.pep
LNWDLRSSIALAAARGVEYIHSTSSMASHGNIKSSNILLGKSYQARVSDNGLNTLVGPSSSPSRTTGYRAPEVIDSRRVSQKADVYSFGVLLLELVTGKAPSQAALNDEGVDLPRWVQSVNRSEWGSEVFDMELTRHQTGEEPLAQLVLLAMDCVAQVPDARPSMAHVVMRIEEIKKSSGASNIEQVDDQSSKAESEVQTNPFAT

SEQ ID NO: 38568 - protein, 82 aa, Sorghum bicolor
  Clone ID: SORBI-28MAY03-C63980_1.pep
IPIDGPMSFSTSKVTVQWSLRFEFFTTPEGTDPARYEHPLLVEKREKGEWVLPVTVYAPPLRRRATHGRNDRSVLPGNIFNS

SEQ ID NO: 38569 - protein, 187 aa, Sorghum bicolor
  Clone ID: SORBI-28MAY03-C64089_1.pep
TWLTAPRLIGEGHTHTQTARVVGTFGYMAPEYVLHGRVSPKIDIFSFGVLVLEIVTRRSNCNSDDHSTVNLLSDVWDHWKKGTMSQMLHGSLNEFARSQALRCIHIGLLCVQPEPDDRPDISAVVFMLTRDSIELKPPAQPAFFFGSESPSASRSDGQSSYVYARSGFMLEQGVSVNGITLSELYPR

SEQ ID NO: 38570 - protein, 88 aa, Sorghum bicolor
  Clone ID: SORBI-28MAY03-C64202_1.pep
IRTPAIKRFKLPRHLPVHVMIKKLLQMRKGLFPCDWFMSKAYFCHMVVANNTLIYHFPYVFHEFVAFYTAPLKMCTCIESYLNNTLTV

SEQ ID NO: 38571 - protein, 210 aa, Sorghum bicolor
  unsure (1)..(210): unsure at all Xaa locations
  Clone ID: SORBI-28MAY03-C6415_1.pep
MTPRRVGGGSFRRRLVRRDLTGGPGGPGPRRVGVLNTAAHPGPPGVSQLPFPEHTAHPPGRESGGGRGGIACLSRKEVRFCLRALAMPSGWRGILGFDYGIVQAPLGPDISGPDLVAAVANAGAIGLLRLPDWPAPDHVRELIRKTRSLTSKPFGAAIVLAFPHEDNLRVVLEEKLAVLQEILGDFPKESXQQAHXAVVKVLHQVAHLEE

SEQ ID NO: 38572 - protein, 108 aa, Sorghum bicolor
  Clone ID: LIB5048-010-R1-XP1-H5.pep
MPSGWRGILGFDYGIVQAPLGPDISGPDLVAAVANAGAIGLLRLPDWPAPDHVRELIRKTRSLTSKPFGAAIVLAFPHEDNLRVVLEEKLAVLQVYWGDFPQESVQQA

SEQ ID NO: 38573 - protein, 109 aa, Sorghum bicolor
  Clone ID: SORBI-28MAY03-C63258_1.pep
PRMDHQNSSSSIDPLIQANTGSNASSSLSFMRGILPKYFSSEWSFAQFHLPEVTRYIVAFGAQNTVMMVGLDGSFYRCSFDQVNGGQMLQKEYFRFLKSDNPPFRTAAA

SEQ ID NO: 38574 - protein, 137 aa, Sorghum bicolor
  Clone ID: SORBI-28MAY03-C63343_1.pep
GKVHSTVRQRWLDGDEFIISRMKEVAQLAFDGHKALLQKDYTELARLMNKNFDLRREMFGDDVLGSVNIKMVEVARRVGAASKFTGSGGAVVALCPDGDSQVEHLGEACQEAGFVIQQVKVAPSVLTDAELSSLLAS

SEQ ID NO: 38575 - protein, 174 aa, Sorghum bicolor
  Clone ID: SORBI-28MAY03-C63320_1.pep
DVFRGLTSLVDVGGGQGSFAKAIAAAFPGIKCAVMDLPHVVADAPVAAGGGDDVQFVAGDMFESIPPADAVLLKYVLHCWDDDNCVKILKNCKEAIPARDAGGKLVITEMVLGSGPRRDRNVAETEEMHSLFLTCITGVGREEHEWKKIFVDAGFSDYKITPVMGPLSVIEVYP

SEQ ID NO: 38576 - protein, 150 aa, Sorghum bicolor
  Clone ID: SORBI-28MAY03-C63358_1.pep
AFAFIIIPRQVMPWTGLLLMLEWTFVAFFLLFASYLRFVYRWGSISANHVGFSNSDASENHMGPGHQRNMSDCDMDATFYWIGMATIATITVLLPTILGITALFTKLGLMVAGGIVLASFMTYAAEHLAISAFNKGQKDRNASRTRSFCF

SEQ ID NO: 38577 - protein, 183 aa, Sorghum bicolor
  Clone ID: SORBI-28MAY03-C6338_1.pep
MRTPIGIHQRFPSPSRPAQISLTRTRSPRPMASAGTGAGDGAAAQPKAAISHVIFDMDGLLLDTEGFYTEVQEKILARYGKVFDWSLKAKMMGKKATESARIFVDECGLNGLLTPEEFLEERESMLQALFPSCTKLPGVLRLVHHLHANGIPMAVATGSHKRHFALKTQNHQEMFALMHHVVM

SEQ ID NO: 38578 - protein, 185 aa, Sorghum bicolor
  Clone ID: SORBI-28MAY03-C64744_1.pep
KYCKEVIFTGITFSDEENHLIEIFWDMHKAREDDNPKDHVKSQSHSIEDIPITNGVKKRYRDGAFVEASSFSASSGHDAMQMLRSEMQDHGFHYMPPRKPRKSDGYLRYRRKRLSSGFIYVAHADYYMLLRAFAKLAEIDIRIMHISVLKVERRLACIEERIERSLNTLQNFSTGTGDELRSVSD

SEQ ID NO: 38579 - protein, 89 aa, Sorghum bicolor
  Clone ID: SORBI-28MAY03-C64768_1.pep
NWVASEVAACSRCSSPRIVVRPSGPLSRSPSPFGNDYFVWDLDSWSRPDWFTHVIISSLFSISEEHLLKDARLPVGPFPVYVYLTLKVL

SEQ ID NO: 38580 - protein, 281 aa, Sorghum bicolor
  Clone ID: SORBI-28MAY03-C64833_1.pep
HEAPEKVSRDRALQEKLVAYLTARPEWRRFGGADHVIVAHHPNSLLRARETLSPAVFVLSDFGRYPPRVASLEKDVIAPYKHMAKTFINDSAEFDDRPTLLYFRGAIYRKEGGSIRQELYYMLKDEKDVYFSFGSVQDHGASKASQGMHSSKFCLNIAGDTPSSNRLFDAIVSHCVPVIISDNIELPYEDVLDYSKFSIFVRSSDAVKKGYLMQLLSGVSKQQWTKMWNRLKEVDKHFEYQYPSQKDDAVQMIWQALSRKVPTIKLKVHRSSRFSRSDRGK

SEQ ID NO: 38581 - protein, 105 aa, Sorghum bicolor
  Clone ID: SORBI-28MAY03-C64839_1.pep
SNTTLRVALNNFPSDEKSLIALFLSALLDMERCLILEQFLALPLFLGAWGVSTTFAELLNPTKRLQVACLPCRISGQCQQVPACVLSSPMPLSMVVSRSHGTGEE

SEQ ID NO: 38582 - protein, 169 aa, Sorghum bicolor
  Clone ID: SORBI-28MAY03-C64836_1.pep
NEDAMLGKLEGMKDVIEQVNRQFKDPDLTTFVCVCIPEFLSLYETERLVQELAKFEIDSPNIIINQVIFDEEAVESKLLKARIKMQQKYIDQFHMLYDDFNITKLPLLSEEVCGVQALQNFSQHFLTPYKFNLKRGTIEELEQRITLLKSALQEAEAELDRVRKGKQSA

SEQ ID NO: 38583 - protein, 135 aa, Sorghum bicolor
  Clone ID: SORBI-28MAY03-C63814_1.pep
EELKQALAKDVPWRLKGPRVLEIIEAIDSNTDGLVDFEEFVAATLHMHQLVEHDTEKWKSLSQAAFDKFDVDRDGYITSDELRMHPGMKGSIDPLLEEAAIDKDGKITLDEFRRLLKTASMSARNVQTPRGVRVS

SEQ ID NO: 38584 - protein, 225 aa, Sorghum bicolor
  Clone ID: SORBI-28MAY03-C63832_1.pep
MLPVPPLAAARRAATAAASGAAHRLLLPVRSLSSYPSSSSTLVPRRRFGHMPQECTFERALLPPVGRNFAVAVGDGVLDGEAPSLLVVSFYRFADFPDHAAFRRPLKELCEELHVSGGIILAPEGINGSICGTPVAVDKVLNFIQEDDRLKGLRMIQSPVTPEDEAIHHGHTSHSPVGAGEDAPFRWDHVRVKLKKEIVTFGDPGVTPTNMVGKYVKPKDWRHAQ

SEQ ID NO: 38585 - protein, 142 aa, Sorghum bicolor
  Clone ID: SORBI-28MAY03-C63868_1.pep
LIRAYTEAKLYMEAEEAIRMMLNSSTTPSCPHFSHLIFAFLKEGQIGEAQRIYNQMKEASVAPDLACCRTMMRVYMEHGLMDEGITLYETTRGSLKPDSFILSAAFHLYDHAGRESEAQDVLDAISVSGTSFLRNMKIGSKL

SEQ ID NO: 38586 - protein, 140 aa, Sorghum bicolor
  Clone ID: SORBI-28MAY03-C64005_1.pep
SGSAPTEHIYDNDCRTLRSGSFIVTLITEQPRISTFSLRISISYYSPPYKICDECYNTDSPAPLRLPPTTGPSNGLPPSNPSIHKGPLVRFLCRFCFSSNERKRTPHDLTSTPVTSLLVGHCPIFATHQYLLPKERLKLV

SEQ ID NO: 38587 - protein, 112 aa, Sorghum bicolor
  Clone ID: SORBI-28MAY03-C63887_1.pep
SCKIKPESGLAQVESYGTKPQQSICCTQKFTSPFNPATVTLQTTIHRLNHPFHPKVPQIQLHPCFVLSYSKNEDVYHQQTNDWGPAQLVGKKRRTVESQANLRACVVSLVFA

SEQ ID NO: 38588 - protein, 139 aa, Sorghum bicolor
  Clone ID: SORBI-28MAY03-C65379_1.pep
PNYLEIWKLTSFWEFPCILYGGALAPGAFVALLARGVPLHRPRCCACVSPLRAPPTAVLSPLCTPVQLHVGSVLGAVTIIVGLYVVLWGKADDTKGGDLQPSDSKQTVDADCIPVRVETRTDLSEPLLPTTTNANTRLC

SEQ ID NO: 38589 - protein, 140 aa, Sorghum bicolor
  Clone ID: SORBI-28MAY03-C65423_1.pep
TFAEVMSNIVHLQEEEVNLRRRCDETRRDLTRKRAHFEDWHQKYLERRAAFGEDTNPDAAETQNIDPVEDRKRNIEELEVRLREEEGHHLRHARQVREKSLANLRTHLPELFRNMADFAYFCHDMYNNLRKTAVVPKDEV

SEQ ID NO: 38590 - protein, 204 aa, Sorghum bicolor
  Clone ID: SORBI-28MAY03-C6557_1.pep
PVHYVQGGQASIVGGAINYVRELEQLLQSLEVQKSIKSRGASAGSTDAGSSSSPFAGFFSFPQYSTTTSAHGGGCSGNTSNGGNCSDAVAAASAAGSAETGCRRPAAAAVADIEVTMVEGHASLKVLARRRPKQLLKLVAGLHQLRIPPLHLNMTTVDAMVLYTFSLKVEDDSKMGSVEDIATAVHEILGSIQQQQQEEETAVM

SEQ ID NO: 38591 - protein, 127 aa, Sorghum bicolor
  Clone ID: SORBI-28MAY03-C65673_1.pep
AIMFDRLNGGTSSKLPLSKEQAHVEIKTPDRHGAVRVSETQSRLADHFSPRSFFSLDVACKEISTKSHEHYLWIVSQIIFLPVCTEPDAVFGYICGSVSGKEHIGYVERFHHLLYYDNVFGKEHRIG

SEQ ID NO: 38592 - protein, 201 aa, Sorghum bicolor
  Clone ID: SORBI-28MAY03-C71489_1.pep
AATVQFKEIGGDARSKGAVGTGKPSVQSNEKKKGFDWMFTKPVDEVKDHWVPDEVAKKCHSCAVDFSPFNRRHHCRNCGGIFCDKCSQGRIALTAEDNAPLVRVCDRCMADVTQRLSIAKEAANRSATVQSHEDLARKLKEEMEKNRKSSGPASGGGSSGTRMREVACPTCTVHLQVQVPTSGSETVECGVCQHAFLVSAN

SEQ ID NO: 38593 - protein, 81 aa, Sorghum bicolor
  Clone ID: SORBI-28MAY03-C7150_1.pep
MATTTAAPGLAVAATDPIRSFLSSAAASVDLDTDLRDLAADLTSDPAVPYRSLRAIWCATTSDTRPPLRDLLQGADFVLPS

SEQ ID NO: 38594 - protein, 208 aa, Sorghum bicolor
  Clone ID: SORBI-28MAY03-C71513_1.pep
MQHGSGDYASSAPSGHYYQHQYAPPGSNPYPAATDAPAPGAVAGGYASAPPYSLGGGYPDQPPSAPAYSQPPSAPAYSQPPPQPQHGAGYTPYNTNPTTYPPEAYYSYTPPPTQTTAPPPAEPNPVPLPYDAPYYGGGYQPPAAGYDNEDYLNEGAYAYSGGRGSEPYGARGTAPARSGSALFDDYGRSISAPSDDYGRSISANLDGR

SEQ ID NO: 38595 - protein, 135 aa, Sorghum bicolor
  Clone ID: SORBI-28MAY03-C71525_1.pep
MYHHQQQLQSHSHFLSSRQTFPPQRHMILQGGSIPAESGLVLSTDAKPRLKWTPELHERFVEAVNQLGGPDKATPKTIMRLMGVPGLTLYHLKSHLQKYRLSKNIHAQANGGNAKNVVGSPLPMVQPKQKHSCPS

SEQ ID NO: 38596 - protein, 146 aa, Sorghum bicolor
  Clone ID: SORBI-28MAY03-C71530_1.pep
MDGNARSSAANQKKPIVADDDLIELLWHNGSVVAQPQAHHRPAPAPAPPPSDRDRPAGASGLTGEETAAWFPDTLDDALEKDLYTHLWYSTIADAAPQHEGTLLATPQPSPPPPLPVGSSGVESSWAGDICSTFCGSNQVPRTPAG

SEQ ID NO: 38597 - protein, 197 aa, Sorghum bicolor
  unsure (1)..(197): unsure at all Xaa locations
  Clone ID: SORBI-28MAY03-C6607_1.pep
QKRYVESVPLIIPLLEKQHRNTTSKLREVSHELSDMNEAKLKEKAQLFHDSFLTKLSLLLKGMVVAPPDKFGETLVNERINGGTFTGSENFQLPNKMMPNGGMRLYGGAQYHRAMAEFRLVVGSIRCPPITREEIVNACGVEDIHDGTNYSRTACVIAVAKARDTFEPFLHQLGXRLLYILKRLIPICVYLLEKDGE

SEQ ID NO: 38598 - protein, 135 aa, Sorghum bicolor
  Clone ID: SORBI-28MAY03-C66117_1.pep
TRPVLADKNVKYHEPEYWKFGEEGNKYFRHATGQIYAVSKDLATYISINQPILHKYANEDVSLGSWFIGLEVNHIDERNMCCGTPPDCEWKGQAGNVCVASFDWSCSGICKSAERIKDGHARCGEGDSAVWSALI

SEQ ID NO: 38599 - protein, 114 aa, Sorghum bicolor
  Clone ID: SORBI-28MAY03-C66084_1.pep
NIIHAQEQVDVASFSEDYSNYANAFESTGHRYYIALATTSLAFFAQLDVVVGTVSRVCCCGIFSSHGCRCLRSSLLPCGHEVASSSSATRSHRRCSVSRTEYPARSCQQFFLTP

SEQ ID NO: 38600 - protein, 64 aa, Sorghum bicolor
  Clone ID: SORBI-28MAY03-C66177_1.pep
NKPRTLIPIIYACALLLATMPSITSYLRRSLEWQTPKVVGFELFSSLVMAFISWQLFSACQRPM

SEQ ID NO: 38601 - protein, 317 aa, Sorghum bicolor
  Clone ID: SORBI-28MAY03-C6661_1.pep
ARGREKLEAARQEEREARIAHGDKKNDLNSVRSVLGKLHQANSVEELDELIAKKERTMQHETISSLKEEKLLIKEINELKAQRKQLSATMGSKAEINEAFDQKDHIHERHKVLKKDSDVLFTNLKALEENTRKIQKSFEDERTALRKLTEEHRAANEIRQKAYSEWTELRNEPSKKNEYFFEYRDARNAAETFRANGDANGLKTHCNSQIERIMEMWNTNEDFRKQYVESNKVSTLRRLGTHDGRRLGPDEDPPVIPSRRPSNIYPLSASSPEVPTLASMPAPVLAAPAAVPAKEDSFPALAAPQTSKRAKSKASGS

SEQ ID NO: 38602 - protein, 110 aa, Sorghum bicolor
  Clone ID: SORBI-28MAY03-C64853_1.pep
AGLETCPSLEQDLWQLQHTKCTFSMTNQSQFYNIVYIVTITAHSPGNKHPHLCQQIIPFTMLHTFISGICNTGMVRFYSKISSSCLRGRTSFIRTMNIGFKSCHEMQHIT

SEQ ID NO: 38603 - protein, 145 aa, Sorghum bicolor
  Clone ID: SORBI-28MAY03-C64910_1.pep
MTMQGRGSRVCTVRFNMPTMRLSCSCSKFETMGLLCPHALKALSIKNICKIPESYILKRWTKDAKKWVFNPKQYESSYQECMNNEAAYCNYVMRYAYDLVTKSQGQEALRKVLWENLESGEKELESYLENVTQHAPSYPLERITN

SEQ ID NO: 38604 - protein, 148 aa, Sorghum bicolor
  Clone ID: SORBI-28MAY03-C64991_1.pep
HIYARYHPNYYLRNYTTGSQLQHRVTAQRINSDQTPPMSRLVGAKPLAGCGLRPSTIVAWCPRLTDWKRAQSKCHVDNVDSISTCYSISRMCLHLIHHQLSGRWEHHRSWNGIETIHSLLHARVSVKIIRGALHLNSTFTSVYRNLWY

SEQ ID NO: 38605 - protein, 92 aa, Sorghum bicolor
  Clone ID: SORBI-28MAY03-C65107_1.pep
VVRKMPKKDLAEEVWSLQAALGEQSEITKCTKQEYERLQNEKVLCRICYEGEICMVLLPCRHRTLCKSCAEKCKKCPICRVPIEERMPVYDV

SEQ ID NO: 38606 - protein, 197 aa, Sorghum bicolor
  Clone ID: SORBI-28MAY03-C6516_1.pep
THGAAEIQPGLDRPTPTLLCEDKQDCLLSAGKWTKLTADIICLEGTSGRKGSGQGPIRSMDKTANVVLDIEGLPQPPDKCCSGSPKMIRALSRKGSNRMERRGSDELEQEDLAKKLIIKVVPSQLEQPLGQIKALVAPHCTPCTPVLIDSGEGRSKRFSRFTSINPRKILLLFATLSSVGTTILIYFTLAINSKAEA

SEQ ID NO: 38607 - protein, 130 aa, Sorghum bicolor
  Clone ID: SORBI-28MAY03-C65354_1.pep
KKPEHKWRKDLMLIGTLAVTVTYQAGLLPPGGFWPDDQVGHFAGDPILHDTHPSRFKVFFYCNATAFMASMVMVILLLNNTISKYRRSLLAMKTAMVLDLFGLLGAYAAGSCRKFKTSAYVFALVIAVFI

SEQ ID NO: 38608 - protein, 63 aa, Sorghum bicolor
  Clone ID: SORBI-28MAY03-C6648_1.pep
SIFDAHTILIYFFTMIHLPSLCINLAWNVKPKGFASCRSAWLLASYRHNFLLVSDDSLLVVCA

SEQ ID NO: 38609 - protein, 121 aa, Sorghum bicolor
  Clone ID: SORBI-28MAY03-C66522_1.pep
FYVKRIEDDDDDDDDDDLVPGQSSRTIKTNGSSEPVTKPTDVLSKTNGSEGANKEGSKSWMPKFIVKPKSASADPHKKQKIESMAVQDNGKGLDDEQKGESAKQTNVLQSLCQNYDSDDSE

SEQ ID NO: 38610 - protein, 165 aa, Sorghum bicolor
  Clone ID: SORBI-28MAY03-C66542_1.pep
MGSDADMEDYGFEYSDEEPEEQDVDIENQYYNSKGLVETDPEGALAGFDQVVTMEPEKAEWGFKALKQTVKLYYKLGKYKEMMDAYREMLTYIKSAVTRNYSEKCINNIMDFVSGSASQNFSLLQEFYQTTLKALEEAKNERLWFKTNLKLCKIWFDMGEYGRMS

SEQ ID NO: 38611 - protein, 173 aa, Sorghum bicolor
  Clone ID: SORBI-28MAY03-C66593_1.pep
IPTLLGFNRRQEAYHCGLRRRRRFESLWIVCEEIVRVLRIIIIIIFCLPCPMEESDVGVNPGKQMEEDKAAGVSGDEGKIERSHSINLNRAPTVAVEARSTQGNVETHGAVVSGTKDAGTGKAEQSSGDGQEKLPKCEQVDYESEIEGCVDDENPVKKAALVTLVGNEYCGGD

SEQ ID NO: 38612 - protein, 82 aa, Sorghum bicolor
  Clone ID: SORBI-28MAY03-C65677_1.pep
CNFSGDTFVYLPLFFHADLTLSPVHHAAIGLVHPSRGISVRMPRYIRSVPDRSPEDCGTATDIASMFKAQTRKMDVSSEGQE

SEQ ID NO: 38613 - protein, 131 aa, Sorghum bicolor
  Clone ID: SORBI-28MAY03-C65687_1.pep
YGRQEPRSKKAKTMFSPSSMSGGGGNGGDNAKNQLQTFLTRAGHSNPTYKTKQIKSYLFRSTVEFNGMQFVGQPCANKKLAEKDAASEALNWLTGDGGATITDSRGAQDADPMPLLMQPPRRRRHSHRRRS

SEQ ID NO: 38614 - protein, 248 aa, Sorghum bicolor
  Clone ID: SORBI-28MAY03-C657_1.pep
NPRGEESRPQHVLSERARPKSHQFLFVTLSKTKKKPGLERKGKVVAEIKDAIDKYSSAYVFTYDNMRNQKLKDLREQLKSSSRIFLAGKKVMQIALGRSPADEAKTGLHKLSKFLQGDSGLFFTNLPRDDVERMFREFEEHDFARTGSTAAETVELKEGPLEQFTHEMEPFLRKQGLPVRLNKGVVELVADHVVCEEGKPLSPEAAQTLRLLGIQMATFRLYLVCRWSCDDFEVYKEGLMHLGADDSS

SEQ ID NO: 38615 - protein, 76 aa, Sorghum bicolor
  unsure (1)..(76): unsure at all Xaa locations
  Clone ID: SORBI-28MAY03-C65804_1.pep
ERWDNTACIGAALVLCGSLTVQLFGSAXKKSKKVKKRSSNALETPVKQQDYLSLSPIPVDSGKFIGRQLERRNKTL

SEQ ID NO: 38616 - protein, 86 aa, Sorghum bicolor
  Clone ID: SORBI-28MAY03-C65902_1.pep
SKCKIGSYCTVGRRLQEVNILGGLILPVWGTIEKALANQVRLIHRRIRVVRLVTTNDNKRIVGLLIPNSAVESVLTGLQWVQDIDD

SEQ ID NO: 38617 - protein, 163 aa, Sorghum bicolor
  Clone ID: SORBI-28MAY03-C66029_1.pep
DTDRSQVELKGGVSDFMAGPPDNKQIVPYGTMPNDVCDESSVVFGALHRLRLSRSDIIRWLRSPIMHTTLDGFFVRLRFGKWEEALGGTGYHVARLNGALDRSRLSVTIRNSTCQVDSRFVSNHDFHEDELKAWWSAAMKSEWKLPSKEELSVKLRERELLRS

SEQ ID NO: 38618 - protein, 183 aa, Sorghum bicolor
  unsure (1)..(183): unsure at all Xaa locations
  Clone ID: SORBI-28MAY03-C6525_1.pep
FDQKFTYVLAGWEGTTHGALVLRDALSREGGLRVPQGKYYLVDAGYGAKPGFLPHASGVRYHLNEWGSNPVQNQKELFNRRHCSLRIIVEQAFGALKRRFKVLDDASTFFPYETQVDIVVACCIIHNWVIEDGSDEFNVPSDNDEDTQHTTYAGTASEXPAIMLAFREGLADQMWADRLSHGN

SEQ ID NO: 38619 - protein, 193 aa, Sorghum bicolor
  Clone ID: SORBI-28MAY03-C66870_1.pep
MFRNALRQSTRAVGAVSAAGRVAAVRNAAPASINAARFYASDAKATPTEVSSILEQRIRGVQEESGLAETGRVLSVGDGIARVHGMANVQAEELVEFASGVKGMCMNLEAGQVGVVLFGSDRLVKEGETVKRTGEIVDVPVGPEMLGRVVDALGNPIDGKGPINTKEKRRAQLKAPGILPRKSVNEPVQTGLK

SEQ ID NO: 38620 - protein, 169 aa, Sorghum bicolor
  Clone ID: SORBI-28MAY03-C66874_1.pep
MGHVNVVYQLLQASLAQRLLLLVPLLLLLLHFASRNRHGSKEKQKRPKHHLPPPSPPGLPIIGHLHLVGDLPHVSLRSLAAKHGGLMLLRFGTVPNLVVSSSRAARLVMQTHDHAFASRPASKVSNTLVYGSSDIAFSPYGDHWRQVRRLVTTHLFTVKKVNSYRLSRQ

SEQ ID NO: 38621 - protein, 145 aa, Sorghum bicolor
  Clone ID: SORBI-28MAY03-C67092_1.pep
PEGFLARTKGRGLVVRSWAPQRDVLGHASVGGFVTHCGWNSVLEAVMAGVPMLAWPLYAEQRLNRVFLEKEMRLAVAVEGYDTDTGLVAAEEVAAKVRWLMDSEGGRRLRERTLEAMRQAKDALREGGESETTLAGLVDEWKKRT

SEQ ID NO: 38622 - protein, 181 aa, Sorghum bicolor
  Clone ID: SORBI-28MAY03-C6699_1.pep
VAGDKKPTKKKIIKKVVKVVRKKTTGPSADKSSEDKNAVAESANKTAEGGQSQQKNEDGGKEQEGAGISQQPEAKKTGKKKIIRRIVKRKVSGSGSQLTAPATPAETSKQETVQPDKNVESSTDVGSPQTKLQEGSKIPSGEDISNQKKEEKPEENEHPLNDRSSNEDKGNHKEAMEQKDP

SEQ ID NO: 38623 - protein, 97 aa, Sorghum bicolor
  Clone ID: SORBI-28MAY03-C66231_1.pep
NVLGDVFGKNPPVSNPNPVEASEIADIIDFLHHAVMYEGQGGPVQSTSKPKLEILTLCGKVIEILRPDVQHLLSHLKIDPASSIYAATHPKLVQSSS

SEQ ID NO: 38624 - protein, 228 aa, Sorghum bicolor
  Clone ID: SORBI-28MAY03-C66346_1.pep
TRTDQPKKKRKKADLTKNVQPNNVGYGYNAPFEPAYCNPFNNGYPWATEPYMYSSMGMPYTGYPMDPYCVNTFTGMPPQVLAMQGYPASYQRPATVPMHCGGTAAARALSNHPERSERPNDTRVQPRSPEHKRQMVSSHGSESRTRNRTRPSSERREHGHSDRASVEDHSSRKRMRDSSPKYDDRQSGRRSRHGSRGMMTREEDASDDERNFKRRWGRRSSGGVDTRH

SEQ ID NO: 38625 - protein, 98 aa, Sorghum bicolor
  unsure (1)..(98): unsure at all Xaa locations
  Clone ID: SORBI-28MAY03-C66350_1.pep
LNPEKVXEPSSKKLRLKDKEEQVPPTKTATAIAVEAEDDDPEEPPGFGFSNTQRNDIGATKPPMNLENGNEAKPNGGEPAAISNPGDEEDPEVPPGFG

SEQ ID NO: 38626 - protein, 76 aa, Sorghum bicolor
  Clone ID: SORBI-28MAY03-C66359_1.pep
ALLPGPRPAGQALGHPAPPGRRVITGDPEQPDNPWGITPFKKVVNLPSRIDPHQTSAVVTLHGQLFVRAPFGHPDM

SEQ ID NO: 38627 - protein, 219 aa, Sorghum bicolor
  Clone ID: SORBI-28MAY03-C66449_1.pep
NPSSCRTTDCFTSDMILFRSTSLSLTLRTMARRRASKSPSSLSRPTAAAAVGGRRQEQRRGRRLRRGAAARAGHEMGSGSSGSKPQSLVLQATTARPTRPPLQASGTHRPGHPSNWRLRGRRRGFTLALKRQPRGCLPLGQMRGFGRLMSWESPIRATAAGTGTHLLPACFTVLEVLRRRWGGRAVAEGESLRRPACACGLVGVLSGGLRRWRAGGPRA

SEQ ID NO: 38628 - protein, 174 aa, Sorghum bicolor
  Clone ID: SORBI-28MAY03-C6639_1.pep
TRDRSAYDLKAPHASGGVPLVAHEKFSKPREVEKLVIVPSKKDLGLAFKGNQKMVLEALEAMSEKEAFEMKAELETKGETNFRVCTLGKDVVITKKMVSISMEKKLEHQRVFTPSVIEPSFGIGRIIYCLFEHSFYTRPSKSEEEQLNVFRFPPLVAPIKCTVFPLVKNQEFDA

SEQ ID NO: 38629 - protein, 209 aa, Sorghum bicolor
  Clone ID: SORBI-28MAY03-C6731_1.pep
MAKGGAATVILAVVLLCLCHPAKNDGSLSLLVVGDWGRKGACNQSRVAEQMGRVGEKLDIDFVVSTGDNFYDTGLTGVDDDAFEQSFTNIYTAKSLQKPWYLVLGNHDYKGDALAQFSPVLRKIDSRFICMRSFIVNAEIADFFFIDTTPFQLKYWTHPKDNHYDWRGVAPREKYIANLLKDLDKALKKSTGKWKIAIGHHTMEGCSHH

SEQ ID NO: 38630 - protein, 137 aa, Sorghum bicolor
  Clone ID: SORBI-28MAY03-C67274_1.pep
KKDVIAMPRVLYSRYRSVLVVKEKKEHGERLTEEEETMNMEAQAEDLKQKIEERLEDSNRMDCYLFYVYGKIYEKIDEDIDRAIEWYQKGSDVDTDSCLKNHLLCNEAWRIKCNKRLLKLQARKGLQVIIVNKNRED

SEQ ID NO: 38631 - protein, 144 aa, Sorghum bicolor
  Clone ID: SORBI-28MAY03-C67272_1.pep
LADGVRGLYRGFGVSLLTYAPSSAAWWGSYATAQRLLWRAVGPAHHDSRGAAMAVQGASAAAAGSAAALVTMPLDTVKTRLQVMDGGAQAPTLAAAARALVREGGWAACYRGLGPRCASMSLSSATMVTTYEFLKRLSAKEGSL

SEQ ID NO: 38632 - protein, 180 aa, Sorghum bicolor
  Clone ID: SORBI-28MAY03-C67327_1.pep
MAFGTLFTRENNCRSTAIRAVAKANDIELNIVEAEKGNATVEHLKANGLGKIPAFIGEDGFALSECIAIAIYITSQNEKTTLLGKTKQDYASILKWMSFFNSEILPSLIAWFGPLKGDAPYNKKNVDDASKASLKAFSVVEEHLIRNTFLVGERITLADLFAAGIAVRGFQYFFDKQWRE

SEQ ID NO: 38633 - protein, 138 aa, Sorghum bicolor
  Clone ID: SORBI-28MAY03-C67312_1.pep
LRFLMEPPPLLPHRSFSPPLKHTLILTPLTVTRTHYTHNSSAVTSSPAAPSLSPPVEEALLLLLPAGYPALFALPFRGASHRKGGSHSFALARLLLAPLWPCPVHQRRKRPAGNSSRRLSRLVSSRIIGVEGRKRWMG

SEQ ID NO: 38634 - protein, 124 aa, Sorghum bicolor
  Clone ID: SORBI-28MAY03-C66650_1.pep
GETWQLIQKLKTESINPKQWRLGNFQRMLCPQSFTMENNRSRAPLGDKTNTSGQVDDKERKRERDRARWHAMSLEKKTAINKRRRESYHQRKQHVTGPTDCNESNILSSLCMFISHVCVFLMYV

SEQ ID NO: 38635 - protein, 167 aa, Sorghum bicolor
  unsure (1)..(167): unsure at all Xaa locations
  Clone ID: SORBI-28MAY03-C66652_1.pep
LFMSAYPCVYRPSDDPXDVCPFAAPSVAAWQAVATAVTMPSIPIPKSSAYFSIAMGILCAVQAIAKHFWLVGSREKYRDWLPNWMSVGVAWVLGPDSGYANAILFGSITAWWWRKWFNNHFEMYAFAIAAGLIAGEGFGGVINAALELGKVSGSFKGTEIALPGAEW

SEQ ID NO: 38636 - protein, 209 aa, Sorghum bicolor
  Clone ID: SORBI-28MAY03-C66760_1.pep
MVAETVVPERLPEDSLQPRYDETAQPRYDEKEPHFDTDLKSEADSEDDRIVDLFSSFPPAKGVEHEPNPLTVRAVIVGIILGSLVNASNVYLGLKTGFTFPATMFGAIFGYGFILMLTKSLPHVPILGGKFGPQENSIIQAAATGAGGMSGVFVAGLPAMYRLDLLSDDPKKDFGRILTITFVCAFFGLFAAVPLRRFFIINVARELNL

SEQ ID NO: 38637 - protein, 103 aa, Sorghum bicolor
  Clone ID: SORBI-28MAY03-C66802_1.pep
LFSSSTAADQGHSRSSGGCGSGCGGGGCGSGSMVAEGSTGRHAKSGGCGSSCGGGCGGGGGCGTIFNVSTKAGGEGKHSVSGGCGSGCGGGGCGGGCGTVFNA

SEQ ID NO: 38638 - protein, 203 aa, Sorghum bicolor
  Clone ID: SORBI-28MAY03-C6668_1.pep
MEDEEHEVYGQEIPVDGEDVDMAGGDDATKLQELDEMKRRLKEMEEEAAALREMQAKVAKEMQGVDPNATTSENKEEMDSRSVFVGNVDYACTPEEVQQHFNSCGTVNRVTILTDKFGQPKGFAYVEFVEVEAVQEAVKLNESELHGRQLKVAPKRTNVPGMKQPRGRGFNPYHGHPYMRPYGYSPYGYGRFPRFRRPRRPYF

SEQ ID NO: 38639 - protein, 85 aa, Sorghum bicolor
  Clone ID: SORBI-28MAY03-C66814_1.pep
GESAVFIFLVAESEEALVKRLIHRKTETSDMLLVRVATAREEVKRMKNFDYVVVNAEGKLEEAVKQVESIIDAEKAKIHKRHVNI

SEQ ID NO: 38640 - protein, 164 aa, Sorghum bicolor
  Clone ID: SORBI-28MAY03-C67538_1.pep
TDVDILWFRPPFPRLPRGAQVVMSSDFFVGDVDSPHNYPNGGLLYVRSSPATVGFYRHWQASRARFPGHHEQYVFDKIVKEGSYAAAAPGARVQFLDTAVFGGFCQHGDDLGKVATMHANCCVGLENKLFDLKNVLQDWKTYRARARAGNAQGFSWRVPGRCIH

SEQ ID NO: 38641 - protein, 116 aa, Sorghum bicolor
  Clone ID: SORBI-28MAY03-C67558_1.pep
VIFGIRSLDSWWPSDDAANGLDAQLWCGRGPGVAVAQRCMRTLGQGACSPLNATALKTQPQAHHVHVAPSRLRRRWSACSYSAFYFAGEGTGCPIKSPSPIRVYDISFTRADYTVL

SEQ ID NO: 38642 - protein, 172 aa, Sorghum bicolor
  Clone ID: SORBI-28MAY03-C6756_1.pep
HDASPSLYLSRTSSAAAHRRPPPPLPPSSLSLPLSPHVPAQLGGLDEAATHQVASGVGGSAAHGSRASITGSRASPCPLHTASPRQPRRIQPRLWWFGPQPWWILRIWPQPWRLRRLAARASRYSASTSTAWLHLCLFHSAIDYLSHRMLLASIRFPWAVPRDALLRFVQEG

SEQ ID NO: 38643 - protein, 136 aa, Sorghum bicolor
  Clone ID: SORBI-28MAY03-C67579_1.pep
VLDRPEVVAKAPTDNGVQYVVGDIFQSIPPANAVFLKWILHDWNDDECVKILKNCKQAIPPRDAGGKIIIIDMVVGSEPSDLKHLETQVLLDLIMMNVNGVERDEHEWKNIFFEAGFKDYKIIPLLGVRSIIELYP

SEQ ID NO: 38644 - protein, 86 aa, Sorghum bicolor
  Clone ID: SORBI-28MAY03-C67143_1.pep
WHCLVQWWIFRITTVCPVILRLSPVEHFSCSFRSSTALETAAKSVYSFCGVAFLVCCKQAWFHGSPGCAFLQYGVSKSSFCCENEP

SEQ ID NO: 38645 - protein, 160 aa, Sorghum bicolor
  Clone ID: SORBI-28MAY03-C6715_1.pep
MAQQQTNPEEVVLGQEAGGARVITLNRPRQLNGISDRVVYLLAQFLEKWEKDENAKLVIFKGAGRAFSAGGDLKMFYEGKSNDSCLEVVYRMYWLCYHIHTYKKTTVALVNGLVMGGGAAMVAPLKFAVVTEKTIFATPEASVGLHTDCSFSYIHSRLPG

SEQ ID NO: 38646 - protein, 94 aa, Sorghum bicolor
  Clone ID: SORBI-28MAY03-C67252_1.pep
AILLLNVHQRLTIVITVETVWQDREINGLNEQLEEDSRVLELLQKQLADERKKRAEIEKENSMLHEQVNMLMNMLDENEGFDEDGEAPPPDSFD

SEQ ID NO: 38647 - protein, 187 aa, Sorghum bicolor
  Clone ID: SORBI-28MAY03-C67194_1.pep
RRRRLRPHRSHRHGCGLVRRRGQRLGGGFLDLRRRPRLKQGIQHVVRDGRDGRHGDAAAGGKSMTAAPPWHQRGPGWQGPGHGGGGASTEKMGNPSGGSCLRSTSFPGVVEEEKTALAFFCVSFATAAAATVARLDSNLWDRGRIAARGRRGRAARRASLAQLTAQGNKLGGRQRRRGGKVRDFCAQ

SEQ ID NO: 38648 - protein, 164 aa, Sorghum bicolor
  Clone ID: SORBI-28MAY03-C6726_1.pep
MQMQLGSSPAAAAATTSCGQGEPTVRLVGPEGRCVDVPYGVYYNGKQVQLWSCKSNGDVNQLWTLKRDGTIRSNGKCLAASRSDTAGARVVIDDCPPRVPTGRVVWEVRVDGTIALKGSSSSGGGGLVLAVTSSTLFAGLTVRRDDRGTGQSWTPTNDTAPMDA

SEQ ID NO: 38649 - protein, 159 aa, Sorghum bicolor
  Clone ID: SORBI-28MAY03-C6725_1.pep
VLNALFNLCKINKRRQEQAAENGIIPHLMNFVMSDSPLRQYALPLLCDMAHASRNSREQLRVHGGLDVYLNLLEDDAWACTALDSIAVCLAHDNDHRKVEQALLKKEAIQKLVKFFQDCPEQYFVHTLDAFLKIITKSSRLNTAMAINGLTTLLIARLD

SEQ ID NO: 38650 - protein, 193 aa, Sorghum bicolor
  Clone ID: SORBI-28MAY03-C67669_1.pep
MDNVVSSKQTVVLYPGGGAGHVGPMTQLAKVFLHHGYDVTMVLLEPPVKSTASGASFVESLAASNPSVIFHVLPAIPLPDFASSTKHPFLLLQELLARVPVYPVCSPRAGPRARLPPPAALLAGPHAGLVAPGVAPPVFPGVPPIPAALAVRALPAALLAGRQTGLKELGDTPIEFLGVPPMPASHIIREMLE

SEQ ID NO: 38651 - protein, 272 aa, Sorghum bicolor
  Clone ID: SORBI-28MAY03-C6768_1.pep
IERRFINVPFGASWAEVTMRTSAFDTPRRFFLDTVQICPLKRPVKWEAVVTFSSPSSKNFSFPVEGGLTLELSIAQFWSSGIASHEPTCVDFEIVFHGISIDQKVTTLDGESPLLIVARSLLASEKLVPVATLNKIRMPYRPVECNLSSLPTDRDRLPSGKQIIALTLTYKFKLEDSAEIKPHVPLLNNRIYDNKFESQFYRISDSNKRIYSTGDVYPSYVKLSKGEYTLQLYIRHENVQVLEKLKELVLFIERKLDKKDFVPLSFYSEPDG

SEQ ID NO: 38652 - protein, 163 aa, Sorghum bicolor
  Clone ID: SORBI-28MAY03-C67707_1.pep
SKYPILNSSFIEETSEVVFKGSHNIGVAMATSHGLVVPNIKKVQSLSILEITKELARLHEMASHNRLSAADIEGGTITLSNIGAIGGKFGSPLLNLPEVAIIALGRIQKLPRFDDDENVYPSSTINVTVGADHRVVDGATVARFCNEWKSLVEKPELLLLHMR

SEQ ID NO: 38653 - protein, 162 aa, Sorghum bicolor
  Clone ID: SORBI-28MAY03-C67808_1.pep
MAWARLASRSRLRPAASASAAVGRPPHASPSVPPPTPPTVPAATSAPPLRHLLLLPRHRFAAAASSASTARLLGARWPQGHGRRCFASEASAAQAPPGEASELVEVPLAQTGEGIAECELLRWFVAEGDQVDEFQPLCEVQSDKATIEITSRFKGKVHQINF

SEQ ID NO: 38654 - protein, 218 aa, Sorghum bicolor
  unsure (1)..(218): unsure at all Xaa locations
  Clone ID: SORBI-28MAY03-C6764_1.pep
FVVSVNKYLEAKARGMSVGMRFKMRFEGDESPERRFSGTIIGLGSMPANSTSPWANSEWRSLKTSSHALTTDXVQWDEPSAILRPDRVSPWELEPLDATNPQPPQPPLRNKRARPPASPSIAPELPPVFGFWKSPAEPAQAFSFSGLQRTQELYHSNPNSIFSSSLNVGFNSKNERSTPNNNHLYWTMRETRTESYSASINKAPTEKKQESATSGCRL

SEQ ID NO: 38655 - protein, 148 aa, Sorghum bicolor
  Clone ID: LIB3476-024-P1-K1-C2.pep
KYLEAKNHKMSVGMRFKMRFEGDESPERRFSGTIIGLGSMPANSTSPWANSEWRSLKVQWDEPSAILRPDRVSPWELEPLDATNPQPPQPPLRNKRARPPASPSIAPELPPVFGFWKSPAEPAQAFSFSGLQRTQELYHSNPNSIFSS

SEQ ID NO: 38656 - protein, 59 aa, Sorghum bicolor
  Clone ID: SORBI-28MAY03-C67361_1.pep
MSFSAARVAEHGGEVEDARGMPAEVSWEMLDKSRFFLLGAALFSGVSAALYPAVVLKTH

SEQ ID NO: 38657 - protein, 222 aa, Sorghum bicolor
  Clone ID: SORBI-28MAY03-C67363_1.pep
KNFYFFSLNTQPNMDISAQCEQWLASHPRLNWRSTFNFLLTPEASKAIEFNDYGIACFAKGLQYELNDKNYQEAFNCYENGAMQLDSLCLFRLHEIYAGDANFDIQYDERQSMCHLLYSALISQFETFDTKVSFWQKLEAFWKKDTSRKEYLIDLLVNPPTDYLVATGPLFARLFNFYNNKETFTEILPELKALSSDVLKNKFFSILNAIFDFLAYTYNSAF

SEQ ID NO: 38658 - protein, 186 aa, Sorghum bicolor
  Clone ID: SORBI-28MAY03-C6749_1.pep
MDVDPSPLLESPVRDWSELPLDPLSSIFMKLGAIEVLMGAGLVCRSWLAAAKAPEIWRFVDMTRHKLVFSKSTSILCAMARVAIDRSDGRMESFWAQQFVTDELLDYIGNRANYLKSIRLVSCAYFWHMPLVMMVDKCPLLEEIECSYQIMPEGFFRNLGIVCPQLKRLRINIGGVDDSDEIWREM

SEQ ID NO: 38659 - protein, 160 aa, Sorghum bicolor
  Clone ID: SORBI-28MAY03-C67491_1.pep
MADAAAAAAPTKTANIPTTMRAVQYDAYGGGATGLKHVEVPVPMAKKNELLLKLEAASINPVDWKIQKGLLQPFLPRKFPFIPVTDVAGVVADVGPGINGFQAGDQVVAMLNSLNGGGLAEYAVASENLTVKRPPEVSAAEGAGLPIAAGTALQVLRTIG

SEQ ID NO: 38660 - protein, 166 aa, Sorghum bicolor
  Clone ID: SORBI-28MAY03-C6746_1.pep
FFYFFHPFLFESLMHAVLFLFPFYVAHVHQLALVNLMLSCHLDWWCCQVFKRCTTFIILHTFHSDQTSDDLRSSQAAVTCSRRTHASAHASASSRICCCLHLSSLGIPRFWPATPKPRSRKSKPPMPLNPVLFSLSAESCCCCLEVSCTLSSTEVTFQSLLHCTDY

SEQ ID NO: 38661 - protein, 139 aa, Sorghum bicolor
  Clone ID: SORBI-28MAY03-C67506_1.pep
MSQPRSWGVLLAVLVAAAVAVPPATAAVASIDLGSEWLKVAAVHLAPGRAPIAVAINEMSKRKSPALAALADGNRLAGEEAAGITARHPSKVFARARDLLAKPFSYVQSVTESLFLPYDLVPDARGAAAVRADDGQVYS

SEQ ID NO: 38662 - protein, 145 aa, Sorghum bicolor
  Clone ID: SORBI-28MAY03-C68129_1.pep
MAAAAGYWLAEHPAIVGFRWSPTHLWFSTWAFLLGSLAAYVILCLALDAVLSLAAAATAPRPPKRRRAPLAVPLGPLPAAHALLMAAASSAIFAGTLLSAVAEIRDTRWSWRGRSRTTPLRWLLCFPPGTRSSGRVFFWSYAYYL

SEQ ID NO: 38663 - protein, 143 aa, Sorghum bicolor
  Clone ID: SORBI-28MAY03-C68130_1.pep
MELVTGVMGSLLPKLGELLKEEYGLQKGVKKKIQSLSRELTVVHAVLRKIGDVPPDQLDELVRLWASEVREASYDMEDIVDTFLVRVQDPAHSTEPHMLRRLRKKVSRLFKKSWARHKISCLIDDINEKLEEVAARRGRYTLD

SEQ ID NO: 38664 - protein, 210 aa, Sorghum bicolor
  unsure (1)..(210): unsure at all Xaa locations
  Clone ID: SORBI-28MAY03-C68131_1.pep
MSAAARALPAPSRRAPLGAVTFSAPRPGARVRAARPREENFHNNCLLTSSSQNSSPLLCPPCNCAQMALAETIIPHQPDVDKHAGVLSYELVQGNLVQWNSFMDKSIPDPPTAVLLHGILGSRKNWGSFAKRLAQEFPMWQFLLVDLRCHGDSASIKKRGPHTVASTALDVLKLIVQLRLTPRXVLVGHSFGGKVALSMVEQAAKPLARP

SEQ ID NO: 38665 - protein, 123 aa, Sorghum bicolor
  unsure (1)..(123): unsure at all Xaa locations
  Clone ID: SORBI-28MAY03-C68215_1.pep
MSSSAPSPPAGAPPEPPPPPSELYCYECDATVSLPAEPVPAARPLCPLCHSDFIEENPSTSTPSPPPPPPPPPPPPXSSPAPPPPRSPTTXTMTTTTTTSTSSXPRRGAGLPQPPRPPPPPPP

SEQ ID NO: 38666 - protein, 284 aa, Sorghum bicolor
  Clone ID: SORBI-28MAY03-C6818_1.pep
PRVRSQMRDYALSLTKCLAQTAQKTFSDFEEAVEKDATKNIHTDGTVHPLTSYVINYVKFLFDYQSTLKQLFQEFKKEDGTGSELAAVTMKIMQALQNNLEAKAKQYKDPALMHIFLMNNIHYIVKSVRRSEAKDLLGDDWIQRHRRIVQQNANQYRRIAWSKVLQCLSGQGLTSSGGSGQVGSDGGNSSGASRAAVKERFRSFNVLFEEIYQKQCGWSVPDTELRESLRLAVAEILLPAYRSFIKRFGPLIENSKAPGKYVKHTPEQLELLLGNLFEGKQERA

SEQ ID NO: 38667 - protein, 195 aa, Sorghum bicolor
  Clone ID: SORBI-28MAY03-C67581_1.pep
CWGSKGLLSGEQLKEIAAGLEKSGQRFLWAVRTPAASDPKRLWETRPEPDLDTLLPEGFLERTRDRGLVIKSWVPQVDVLNNPAIGAFVTHCGWNSTLEAIAAGVPMLCWPLGAEQKINKVLMVEAMGIGLELEGYNTGFIKAEEVETKVRLVLESEEGREIRMRAEAHEALEDGGSSQAAFLQFLSDVKNITSA

SEQ ID NO: 38668 - protein, 131 aa, Sorghum bicolor
  Clone ID: SORBI-28MAY03-C6758_1.pep
MASSTKPALLLVALNLVLFTVANACGGGCPTPPTPPTPTPPSPSTGGKCPKHALKLAACANVLGFVSAEVGHPPAEPCCSILGGLADLEAAVCLCTAIKANVLGITVDIPVKLSLIVNYCGKNLQSGFICA

SEQ ID NO: 38669 - protein, 131 aa, Sorghum bicolor
  Clone ID: SORBI-28MAY03-C67585_1.pep
VKAMKQVAGSLKLFLAQYREVAAFAQFGSDLDAATKQTLNRGERLTELLKQRQYSPMAVNEMVPLIFAGVNGLLDTVPVNKILQWESDFLAHLKTNESELLATIDKEGAISKDTEAKLRDVTQSFVKSFLG

SEQ ID NO: 38670 - protein, 121 aa, Sorghum bicolor
  Clone ID: SORBI-28MAY03-C67595_1.pep
IYNAVIMFAAPLLFSNWPYANGFEALRFCQENPEVAWDIFLFCLCGAVGQNFIFLTISRFGSLTNTTITTTRKFMSIVVSSVISGNPLSLKQWGSVVMVFLGLSIQIYLKWKKKKGRDHKE

SEQ ID NO: 38671 - protein, 247 aa, Sorghum bicolor
  Clone ID: SORBI-28MAY03-C67602_1.pep
WMVHGCVAVEYKSVAMVCAARLLILCIATSLLADAGADDQVNYVVVETSSLKPSAVCKGHRVHPSVNNYSSSWTPLSNPHGPCSPSWEEGAAMDYSASSMVDDMLRWDQHRAGYIQRKLSGNVSHEDTEISDSTTTLESVNGGGAGDFSMGDDGTGGMAKAQQQDTHHQVVEELSSAADPAATGGSRRSRLRPGVRQLMLLDTASDVGVGAVLPLPRLAVLRADGRPVRPLPVAIVGVLRVQLPDLQ

SEQ ID NO: 38672 - protein, 190 aa, Sorghum bicolor
  Clone ID: SORBI-28MAY03-C67628_1.pep
MMTRQQPQHQAGGLLLRSLGLGAGGGAGGGARRAGAMKSATSLLLGAALATAFFLLYTSLCRDLVGAAAPSRSSATPAPRWEEQETNTTAAGVAPHQQEGTKHVAASSGDADGDDDGAAATTEEKKGQSEKQQPRFVMPATSAQLQQQKKKKSSPPPSQDLADLLRRAATADKTVLMTAINEAWAAPGSF

SEQ ID NO: 38673 - protein, 206 aa, Sorghum bicolor
  unsure (1)..(206): unsure at all Xaa locations
  Clone ID: SORBI-28MAY03-C68636_1.pep
LGTPPSPPPPRGPPPPPRPTPGPPPPPGSTLPRPPPTPPRTGAPVRPIPAPLRPCPAPTPPPEQTGRLSCLSRAPPPAXPPPFEPGPPRPHCLSRPETRAPVHIPAPTGAALPESQDGVGAGAPKGNARKVGRSGQGRRPKRNTTKTAVGFRTGSPRSRILSIQGLSQLKKKDRASRFPGPRWPRAIADVNFGPVLVVTKLEFGLV

SEQ ID NO: 38674 - protein, 208 aa, Sorghum bicolor
  Clone ID: SORBI-28MAY03-C68640_1.pep
LVGKPSQSMTTPGSIASRWRELQGADSWSGLLDPLDLDLRTNIITYGELTQATYDGFNQEQRSPHAGACVFGYSNLLTSSGAAAAGNYTVTKFIYATSALPGVPEAFLLLPLPDLLPESWSRESNWMGYVAVATDDGVAALGRRDILVAWRGTMRSLEWVNDFDFTPVSAAPVLGSAAAANPAALVHRGFLSVYTSSNPDSKYNQTSA

SEQ ID NO: 38675 - protein, 188 aa, Sorghum bicolor
  Clone ID: SORBI-28MAY03-C68642_1.pep
MKHGNSMLLQLALLISLSLAGGVAVVVGGSAPTSTHLLFYMHDLVTAYPGAPATAVRVARGTTPLPTAGSLRFGDTFVVDDALTEGPDAASRAMGRAQGFYLFASQTELAPLLCVNVVFTAGPHNGSTVAVLGRDLILDKVDVRELAVVGGTGTLRRAAPPSLVPTRAANATHGNAVLKIDMYLSLSV

SEQ ID NO: 38676 - protein, 91 aa, Sorghum bicolor
  Clone ID: SORBI-28MAY03-C68850_1.pep
DGVVLARCLGEAFSHGHGHDEQDEGRRFTAALEKYAEARRWRSIQLITAAYVVGFIQQSNNAVIRFLRDKFLSRLLSKTLVAMADYDCGTL

SEQ ID NO: 38677 - protein, 219 aa, Sorghum bicolor
  Clone ID: SORBI-28MAY03-C68924_1.pep
KKKKKKKKTWGAWGRLLAPRGPLLAILRALSGLSLSLSLPLPLLDHSSSRRAGGRRTPGVNGMVVLVATAARWPGGGTAVRARPPAARARGPRRVAAAEPEQKSAATVRFVKCRLLSWMKPIRHDVRAQMSNVNVGAGSYGENEANSRGERLDTSSTGDPNKLAKQLSGSRYLQSIGAVLLLCALAASFFVLFKGLSSAVVAMLAKSGFTAAFTLIFGI

SEQ ID NO: 38678 - protein, 252 aa, Sorghum bicolor
  Clone ID: SORBI-28MAY03-C75557_1.pep
LYLSSAQCQTWTSHHLLHCCWLLSSPCSSSPQGERALRPARDGRRRRLPPSPPGLPLLGHLPLLGSLPHRNLRSMAASYGPVMLLRLGRVPTVVASSAAAAQEVMKARDLAFASRPRVRMAERLLYGRDNMAFAPYGESWRQARRVCVLHLLSQRRVHSFRHAREQEAAALVGRVRRAGARDGAVNLTALLISYTNGIICRAAFGDDGSSWNYGGEKLSKLFADFEELIGAVTVGEFVPWLAWIDTLMGLDA

SEQ ID NO: 38679 - protein, 206 aa, Sorghum bicolor
  unsure (1)..(206): unsure at all Xaa locations
  Clone ID: SORBI-28MAY03-C75559_1.pep
MAALQPSFSPAMTLKSSCSALKFPQTALLPGFGGIPRPQDRKASFACLIPKVASVTDQSIAEPSKPKQNRHTVDPTAPEFLPLPSFEECFPRSTKESSEIIHEESGHVLKVPFRRVHLTGDQKHFDTYDTSGPQNISPRIGLPKIRKEWIDRREKQGSPRYTQMYYAKQGIITEEMLYCASRENLSPEFVRTEVAXRGRAIIPSNK

SEQ ID NO: 38680 - protein, 121 aa, Sorghum bicolor
  Clone ID: SORBI-28MAY03-C75572_1.pep
MDLASVNEELAEIDGQIGDILRALQNGFQKLEKIKDANRRSRQLEELTDKMRDCKRLIKDFERVSKDGARRSEPATPTLLLGSNRPVIIGVSSFVALKKQQASENKRIDLFDGPSVEDGFG

SEQ ID NO: 38681 - protein, 171 aa, Sorghum bicolor
  Clone ID: SORBI-28MAY03-C75588_1.pep
HPPSLLPCSLVPSPSPNPSPAAASSTCLSLQTQALDPPPLGGSAISCCRREPPALPPPIQTPALAPAPTRNPSRQRQCQDPAAPARWKWEIRAGSEASPVDGSLKVLERSGDAGGGGLEMIVRVWVLLSLSLPLRRTLFSLARSSCLAVCVCSRRGWTLEFQFRSGCALEF

SEQ ID NO: 38682 - protein, 166 aa, Sorghum bicolor
  unsure (1)..(166): unsure at all Xaa locations
  Clone ID: SORBI-28MAY03-C75700_1.pep
KNPXRSLLPVSPPDATATGDGATHGRASPLSVPLLRRCGVLGGQGLWPPLHAMAGCLFPPRALDETLGRQNVQMIWLSSPFYQQWIHLVLTTSFLGYRLPGSQRHDIRNFSCFHWPNSTMALSGFMCLTKLIRFPALKSQFSVLRATVFLLSSHPFTTGLNRWKHA

SEQ ID NO: 38683 - protein, 75 aa, Sorghum bicolor
  Clone ID: SORBI-28MAY03-C75719_1.pep
MGSLTRAAEEDPAAAAEEEWSDEAVIYVNGVRRVLPDGLAHLTLLQYLRDIGLRGTKLGCGEGGCGACTVMVSCY

SEQ ID NO: 38684 - protein, 144 aa, Sorghum bicolor
  Clone ID: SORBI-28MAY03-C6913_1.pep
PHARPPYLAKGIELFRKGKLEIGTKLAEFCSRALLALDVLVHPRALSLERTVPSQGNTVFGAGTYQISRFGDQPQAMEVEDMYDDWLTSNNDEPAEVPVNDSAAGVSTDVILVEVGKQLNSKAEDPKVDPPRITDAAQDAPTST

SEQ ID NO: 38685 - protein, 136 aa, Sorghum bicolor
  Clone ID: SORBI-28MAY03-C69385_1.pep
MSPPAYTASPCTGSALFSNSRAPPPRLLLQRGPGAPSSAGRHGGRVAPSQERRRPAPAQEKRRHSESSSRTQLPERKRHWKAGEFPGTATADGGGGGRLPAQGKRHSKAGEFPGTHGGRADPAPSQGKRHWKAGEF

SEQ ID NO: 38686 - protein, 230 aa, Sorghum bicolor
  Clone ID: SORBI-28MAY03-C69395_1.pep
MAAGSGPDTAAEAQPPPPIHHLPPDALHNVLLRLQLRDAVVCRPVSRLFNETLSPQLLALLPTLRLLLLRHPRPDGGGCLHAFDPARRTWLRLPFAHFLPYQSFSPVASSTSLLYLWVETSSTTTSPLALPSTSTSSSSKASPVHPPKSLAVCNPFAGTYRLLPQLGSAWARHGTVLAGPGGTVLVLTELAALSYTPSGSSKWMKHPLSLPSKPRSPILASAAAAVFALC

SEQ ID NO: 38687 - protein, 175 aa, Sorghum bicolor
  unsure (1)..(175): unsure at all Xaa locations
  Clone ID: SORBI-28MAY03-C69416_1.pep
MSSSNGEAEQQWIESVKLGGAVPCLTPENCPNGWATPSGDSFMVRGPEYLTNKVKIPGGEYLLKPLGFDWIKGPAKICEILKDNNHRVRKAIDEEVSRGNQPFVWAFNLQLPKDNYSAIFYFVSLEAIPEGSLMDQFLKGDDAFRNSRLKLIAXIVKGPWIVRTAVGEQAICILG

SEQ ID NO: 38688 - protein, 74 aa, Sorghum bicolor
  Clone ID: SORBI-28MAY03-C69481_1.pep
VYKKIAIPFGTLFRIQDFDHSLCKLAFVRYEFFLRDYSICMECFAKFLFYEWVHELVSIWNICVPPFDGLFSPV

SEQ ID NO: 38689 - protein, 138 aa, Sorghum bicolor
  Clone ID: SORBI-28MAY03-C68394_1.pep
NKLQERFRNFNLDATDLVALQGAHTFGKVQCQFTQQNCTAGQSGGSLENLDQVTPKVFDNKYYSNLLEGHAQLRSDQVMLSDPSAVVTTAPIVHRFAGNQQDFFRNFAASMIKMGNISPLTGKDGEIRNNCRRVNKRY

SEQ ID NO: 38690 - protein, 172 aa, Sorghum bicolor
  Clone ID: SORBI-28MAY03-C6828_1.pep
HEGLLPLTKRRAKPAVPIGGAYRLIDVPMSNCINSGINKVHILTQFNSQSLNRHLSRAYDCTNGVAFGDGFVEVLAATQRPGSEGKRWFQGTADAVRQFDWLFDDAKSKDIDDVLILSGDHLYRMDYMDFVQSHRQRGAGISICCLPIDDSRASDFGLMKIDDTARVISFSE

SEQ ID NO: 38691 - protein, 206 aa, Sorghum bicolor
  Clone ID: SORBI-28MAY03-C68412_1.pep
MSLAEAPSPSPSSSSGSDDFAALLDSELELASGADSAFPGDPSSAFPAATDDEDEDEDPEVEAVEQNGTKRRRVEEQRQDQGTSVRPDKIPTGASKNVQVEACPHPGYFGGLCFRCGKPQDEENVSGVAFGYIHKGLRLGTSEIDRLRGADLKNLLRERKLVLILDLDHTLINSTKLQDISSAEKDLGIQTAASKDDPNRSIFSLD

SEQ ID NO: 38692 - protein, 142 aa, Sorghum bicolor
  unsure (1)..(142): unsure at all Xaa locations
  Clone ID: SORBI-28MAY03-C68450_1.pep
KASDVFAFGAFXLEVACGRKPVVQDARDNRLVLVDWVLDRWRAGSVTDTVDPRLRGDFVEREASLVLRLGLLCSHPLPGARPGMRQIVQYLDGDAPLPELSPTYQGLNMLSLMQDQGFDPYIMSFPMTSTGTSTISDLSGGR

SEQ ID NO: 38693 - protein, 151 aa, Sorghum bicolor
  Clone ID: SORBI-28MAY03-C68404_1.pep
MAAASSRVSSLGLLLAAHCALLLALAGAAHAHSYAPSGGVALSSAFYDESCPSAYDVARRVIQDARVSDPRLPASLIRLHFHDCFVNGCDGSLLLDDNLPAIQSEKHAPGNDKSARGFEVVDDIKSALEKACPGIVSCADILVLAAEISVE

SEQ ID NO: 38694 - protein, 209 aa, Sorghum bicolor
  Clone ID: SORBI-28MAY03-C68621_1.pep
MGKDKPHVNLVVIGHVDSGKSTTTGHLIYKLGGIDKRTIEKYEKESNDLGKSSFKYAWVLDKLKAERERGITIDIALWKFETNKYYFTIIDAPGHRDFIKNMITGTSQADVAILVIASGKGEFEAGISDNGQTREHALLAYTLGVKQMIVLINKMDDKSTNWSQARYDEIQKELSSYLTKVGYKPETIPFIPISGWLGDNMLERSTNLP

SEQ ID NO: 38695 - protein, 72 aa, Sorghum bicolor
  Clone ID: SORBI-28MAY03-C69733_1.pep
GGWVCVMTLFVYFFLPETKQLPMEQMEQVWRTHWFWKRIADADADAGEEEEQGQRRPRPRGEAAGTIALSAT

SEQ ID NO: 38696 - protein, 192 aa, Sorghum bicolor
  Clone ID: SORBI-28MAY03-C69753_1.pep
MLLVMGNPGRSGQLSALIASAAILLSLSALPICRPYTYEQDVPAMNGLYTALGAPQLPSWTSNGGDPCNENWQGVSCVASNITSIVLSGANLGGQLGNTLGNFTSLITLDLSNNNIGGTIPDGLPLTMQRFFLSANQLSGGLPNTLSSLTLLTSMSLNSNHLTGAIPDVFSTLTGLANLDFSDNNLTGPMPP

SEQ ID NO: 38697 - protein, 186 aa, Sorghum bicolor
  Clone ID: SORBI-28MAY03-C69765_1.pep
MYDYGLGHPWLNPEGTFKVFCKADEGLCLAVRGGALVLAAADPADVHQHWFKDVRFSLRIKDEEGKPVFSLINKATGLAIRHSLGPYHPVRLLGPAPPAPPGSLLWAECGHVGWGGGSIPGVPAGVRPRGPPWPPAVDGVRPRARCPLTEGAEGDTRSWKILFWSEEANKTCAGLYAEPTCRIYCK

SEQ ID NO: 38698 - protein, 140 aa, Sorghum bicolor
  unsure (1)..(140): unsure at all Xaa locations
  Clone ID: SORBI-28MAY03-C69866_1.pep
RPRPPRPGRRPERPPPPARRRGPPGRRCVPTTATPPLRPARSPGRRSRPSGRPAXDATXRPPRQPVPLPRVAPSRQRLCRHPCSPPSSSSPCVAPCSPPQPPMLSDPHYLSPLLVPFSHSVFLVQERCWCSTDQPDDRCG

SEQ ID NO: 38699 - protein, 190 aa, Sorghum bicolor
  Clone ID: SORBI-28MAY03-C68930_1.pep
RQAGSQPDKGLHRPCSAPLLPPSPIPIPAPPPPAAKSSPTRAAMSWWWTGAIGAVKKRQDEQAAAAEPSYQSVALVVGSTGIVGTSLLDILPLADTPAGPWKVYAVSRRPLPPWSPAPSPAVTHLHLDLADAAAVHDALTPLTDVTHVFFVAWTSRATEAENREANAAMLRNVLSVVVPHCPALVHVCLQ

SEQ ID NO: 38700 - protein, 214 aa, Sorghum bicolor
  Clone ID: SORBI-28MAY03-C68936_1.pep
MAMPPSRPWAELQHDLLVAIVARVGVPDLLSGGASRACSSWRAAARDPLAWRRVDLRDWVALTSGRRAARPGHSSSRVPVHAALFGILEVAAKLAKGRIEAVLLPEFADEDHLLFLAERCPNLQYFSLPSTCMTYDQFCKAIGGLHSLKGMAVDETLINYDVLLHVHQCCPDFVELKVSALYVDEEMASVICNSLPHLKKLEIPSADMSSAAII

SEQ ID NO: 38701 - protein, 216 aa, Sorghum bicolor
  Clone ID: SORBI-28MAY03-C68985_1.pep
MVLGALATAVASMQLQWSLLLIYGLLGGLLLWKAGRLLERLWWEPRRLERALRAQGLRGTSYRFLTGDLKEYRRFNKEAAASKPLPLRCHDIAGHVAPFVHGAVLEHGKTCFSWFGPIPRVTVTDPDLARDVMSNKFGHFEKPKFPALSKLFADGVANYEGEKWVKHRRILNPAFHLEKLKLMLPAFSACCEELVGRWVQSLGSDGSCELNVDPEL

SEQ ID NO: 38702 - protein, 125 aa, Sorghum bicolor
  Clone ID: SORBI-28MAY03-C6903_1.pep
RDIQEGEMVLEYRGEQVRRSVADLREEKYRVQGKDCYLFKISEEVVVDATDKGNVARLINHSCTPNCYARIMSVGHDESRIVLIARKNVCAGDELTYDYLFDPDEADERKVPCLCQTANCRKFMN

SEQ ID NO: 38703 - protein, 101 aa, Sorghum bicolor
  Clone ID: SORBI-28MAY03-C69042_1.pep
MVFGRSKSSSSATPSAPSKAAAACSELRTAYHECFNRWYAEKFAKGQWQRDDCADHWHKYRACLEEHLEDKHLKQILLDAETSAFYTRPEADPPSGQGTTK

SEQ ID NO: 38704 - protein, 150 aa, Sorghum bicolor
  Clone ID: SORBI-28MAY03-C70139_1.pep
SMMVKCDPRHGKYMACCMMYRGDVVPKDVNASTATIKTKRTIQFVDWCPTGFKAGINYQPPTVVPGGDLAKVMRAVCMISNSTAIAEVFSRIDHKFDLMYAKRAFVHWYVGEGMEEGEFSEAREDLAALEKDYEEVGIETAEGEGEEEGY

SEQ ID NO: 38705 - protein, 184 aa, Sorghum bicolor
  Clone ID: SORBI-28MAY03-C70104_1.pep
DPSSKKIPVMEFDVAKVLEELELTMDQFIDLCILCGCDYCDSIKGIGGQTALKLIRQHGSIESILENLNKDRYQIPEDWPYQEARRLFKEPNVTLDVPELKWTPPDEEGLISFLVKDNGFNEDRVTKAIEKIKSAKNKSSQGRLESFFKPVATTSAPLKRKETSDKTSKAAAANKKTKAGGKKK

SEQ ID NO: 38706 - protein, 105 aa, Sorghum bicolor
  unsure (1)..(105): unsure at all Xaa locations
  Clone ID: SORBI-28MAY03-C7014_1.pep
MFQLESLLLPFGAKVLDFKDNYLRMFMKAPDCEIYGQKFNCPIDSFISDHELLIEIDKRNMEPKKVQIIPDDMSVDILVERMXSSREAISCGTLQWLIQQCQHQA

SEQ ID NO: 38707 - protein, 171 aa, Sorghum bicolor
  Clone ID: SORBI-28MAY03-C70169_1.pep
MEGEAAPPAPAPAPDKPAAHVVLLASPGAGHVLPMAELARRVVTHHGDGAEFTATLVTYTNFSAAEHSFTALPPSVSTAVLPEVPLDDLPADARVETRILTVIKRALPHIRDLLRSLLAAAPAGVAAFVPDVFSSWALEVSAELGIPGYMFCTSNLTARCPTSRWPSLPRG

SEQ ID NO: 38708 - protein, 213 aa, Sorghum bicolor
  Clone ID: SORBI-28MAY03-C70237_1.pep
MREVISIHVGQGGIQIGNACWELFCLEHGIQPDGQMPSDKTIGGGDDAFNTFFSETGAGKHVPRSVFLDLEPTVVDEVRTGTYRQLFHPEQLISGKEDAANNFARGHYTIGKEIVDLCLDRIRKLADNCTGLQGFMVFNAVGGGTGSGLGSLLLERLSVDYGKKSKLGFTIYPSPQVSTAVVEPYNSVLSTHSLLEHTDVAVMLDNEAIYDIC

SEQ ID NO: 38709 - protein, 153 aa, Sorghum bicolor
  Clone ID: SORBI-28MAY03-C69510_1.pep
MALASQVAANQPPLLSSPARRLPRTSSSNALLLLQPASSAVLGGRKNLRLAPPAAGARRALLDAVVVVRASSEAKAAAETTKSEGSGGGGGGEEEEERPYEEYEVTIQKPYGIKFTKGRDGGTYIEAILPGGAADVTGQFEVGDKVLATSAVF

SEQ ID NO: 38710 - protein, 171 aa, Sorghum bicolor
  Clone ID: SORBI-28MAY03-C69652_1.pep
AKRWLPIPSLPALCCLLAVASLPLLAVADCECEASTGEEDDKSRALTLKIVAIFCILVASSVGCAIPSLGRRFPALRPDTDLFFAVKAFAAGVILATAFVHILPDAFEKLGSPCLVDGPWQKFPFTGLIAMLAAIATLVVDTIATGYFQRAQAAKTAAVVVVGDVETSGGH

SEQ ID NO: 38711 - protein, 221 aa, Sorghum bicolor
  Clone ID: SORBI-28MAY03-C69675_1.pep
MIARRLLRSNAPAQASSLLKHVTGTASLQGHADSLLDASVRHFSSAPSAQSASTEENGFKGHGMLAPFTAGWQSNDLHPLIIERSEGSYVYDINGNKYLDSLAGLWCTALGGSEPRLVKAATEQLNKLPFYHSFWNRTTKPSLDLAQEILSIFTARKMGKVFFTNSGSEANDSQVKLVWYYNNALGRPNKKRFIARSKAYHGSTLISASLTGLPALHQKFD

SEQ ID NO: 38712 - protein, 201 aa, Sorghum bicolor
  Clone ID: SORBI-28MAY03-C69683_1.pep
AARRRRTHGGWRRQRTRRGCVEVPRRNCSIWPSFRGSSASSLELHLPPSFAHPLTCHRNRSPAQWIQVLLLEPVGPRAIPSHPRVDSQHAPLQAATPFDDQLLPRSSLSRRRSRPGRGSHHGREQRLAAAPTLLSSRLWSRRSSRPGTESRHSRERRRLRITALEKGGGEKSAWRRRSEKGKGRKSTWRRPLRITALARTK

SEQ ID NO: 38713 - protein, 79 aa, Sorghum bicolor
  Clone ID: SORBI-28MAY03-C697_1.pep
FILSSLNSQYVHYNRDLRTIIIILPLLQPPGVKTLNPGQKSSRKSPLNTSFTTDHQNSDTDKGTKKQRQKFRTKHYMSA

SEQ ID NO: 38714 - protein, 183 aa, Sorghum bicolor
  Clone ID: SORBI-28MAY03-C69723_1.pep
ERMRKPGHGSGSGDEFDYPGCARAYQEFVRAVVAYQEKTSAVPRGVPAPSPKLSKEMERRRKVISRSFSLAKDMYLSGGRTNPAEQRDLEAGAEFLESNTASLSVQQEKRLKQMGATVRNASGYLNSLKVSGVREAAARALMAEMTVNQLSDLAAFYGTMGKICSEVLDAKLQALHGNVNLHE

SEQ ID NO: 38715 - protein, 60 aa, Sorghum bicolor
  Clone ID: SORBI-28MAY03-C70632_1.pep
LKICSKTALAEVCTISSIFFSSIFRNLPQSLASPHLKKGVLGLHQIPSKLGIEYQVPLPF

SEQ ID NO: 38716 - protein, 175 aa, Sorghum bicolor
  Clone ID: SORBI-28MAY03-C70703_1.pep
IDSQKKCCILYYSHINVSPHNMYIYLSYMQYITNNIVLRFAELIFLEVIHPSGSGSGSGSHLMLQAWHHVTAELAQHCLEQLLVAVERIKAAAQFRQQAMVQVAHHAMAAACGHGQVAWLSYCCCSSSSAVAIAVAVAGNVVVEAGEAGHLLKCAGAGGGWWCSWRPGAVLGWCP

SEQ ID NO: 38717 - protein, 74 aa, Sorghum bicolor
  Clone ID: SORBI-28MAY03-C70707_1.pep
LFLPPHNPYKIDLCSRSKRTFSSYPAHKQLAYFASSVAERLRVLFKLDAFINGWLPGLSPVGRTRRTAVRLPGI

SEQ ID NO: 38718 - protein, 148 aa, Sorghum bicolor
  Clone ID: SORBI-28MAY03-C70732_1.pep
KGAPAIKAHPWFRGVQWEKLYQMKAAFIPEVNGELDTQNFEKFEETGTQIQSSSKSGPWRKMLPSKDANFVGYTYKNFEIVNDDEVAGIAELKKKSSKPKRPTIKTLFESMDEEEPVHGSFLGMLPPKEGQPSSHSSIPPEKYQPRRK

SEQ ID NO: 38719 - protein, 105 aa, Sorghum bicolor
  Clone ID: SORBI-28MAY03-C69947_1.pep
MAASIAASSFVPGSPAPAPPAPKSGLGERPESLDVRGVAAKPGASSNAVRAGKTRAHAAVPKVNGGGKSALADGEHDTVPSSVPKTFYNQLPDWSMLLAAITTIF

SEQ ID NO: 38720 - protein, 147 aa, Sorghum bicolor
  Clone ID: SORBI-28MAY03-C6978_1.pep
VVVLEIVSGKSNTNCRPKEDVVSLLDGAGELPERSPRLATVEPARGTTNFREEAGLMLNVALLCTTAAPTLRPKMSKVVSLLEGSTPLQPLLSDLSLAANSLSSSGVRRNFWQNPSESQSLTAQASCSDTNESSTIDIDGILRPLVS

SEQ ID NO: 38721 - protein, 127 aa, Sorghum bicolor
  Clone ID: LIB3476-027-P1-K1-G7.pep
YDGQGKFHKSTTTTLKFVVSQANYTVDNLRNLSDSLSAAKRIDIANSFLLPPNVQSQINEIQGKLNTSATDLAIKTTDNAARIKKLLNRVRLALIVIAAVMLLLAFIGFLLSIFGLEFNGSGLGVLD

SEQ ID NO: 38722 - protein, 219 aa, Sorghum bicolor
  Clone ID: SORBI-28MAY03-C70066_1.pep
MASACLSLCLHLHASSPSPSPSYSSPGSRRSSLAFSSSSKSKRTLKVRAKALREDWRQKSKHIPPGAVYPAKDHCSRCGLCDTYYVAHVKNACAFLGEGMSRVEDLEPQVHGRGRKEGMDEMYFGVYDQLLYARKTEPVQGAQWTGIVTTIAVEMLKANLVDAVVCVQSDPDDRLAPRPVLARTPDEVIAAKGVKPTLSPNLNTLALVEAAGVKRLLFC

SEQ ID NO: 38723 - protein, 174 aa, Sorghum bicolor
  unsure (1)..(174): unsure at all Xaa locations
  Clone ID: SORBI-28MAY03-C7007_1.pep
AGRTEPDDCDDSGSIPESFYTNGGFKLRVVWTISSLIAAAARHYLLQPIIADHRMLESLDLTDADGQGVLTMDKCQLQELRVRPISTSRGSHRTLMPELSMWLWYAPCIELPGGLVLNGATLVAIKPSEEGTGDTVWNGADGAXWVLDAFEEPYRTAVRMLLKRRTYSLEMNSF

SEQ ID NO: 38724 - protein, 107 aa, Sorghum bicolor
  Clone ID: SORBI-28MAY03-C70080_1.pep
CMASLLRWKDRYVKERLLGLSGLSCSSAASTSVVASTGRAIDRHSPRPRDSHRRLPPSLPKPPCSPFSSAKDSSTSMKQQQLCHYDDDGKDRRKKKSTEADAGSGRG

SEQ ID NO: 38725 - protein, 304 aa, Sorghum bicolor
  Clone ID: SORBI-28MAY03-C7009_1.pep
HEAPLVQGGLDFLLNTMNDANSPRGDTTAWTLGRVFELLHSPAGANPIINNSNLPRIMSVLLESSKDSPNVAEKVCGAIYFLAQGYEDAESMSSVLTPYLPNIIAALLSAADRADTTHFRLRASAYEALNEIVRVSNIPETSGIIGQLLQEIMRRLNLTFDLHILSSGDKEKQSDLQALLCGVLQVIIQKLNSTDAKSIISQTADQLMMLFLRVFACHNSTVHEEAMLAIGALAYATGPDFVKYMPNFFTYLEAGLQNYEEYQVCSISVGVVGDICRALEDKILPFCDRIMTVLLKDLSSSMLN

SEQ ID NO: 38726 - protein, 172 aa, Sorghum bicolor
  Clone ID: SORBI-28MAY03-C71088_1.pep
MSSDQADAAKAAEGASGKSLPSRPAKQPKEKQPKDKSAKGGKSAGLELPETPEFIQHRLDLFDKIKARQDAEIAAKPREEITISLPNGKEEKGTSWETTPGAIAKGISKSLFERTVISRVDGELWDLTRPLEKSCKLELLDFEHTEGKKVFWHSSAHILGEAAEKRFGCYLC

SEQ ID NO: 38727 - protein, 113 aa, Sorghum bicolor
  Clone ID: SORBI-28MAY03-C71106_1.pep
MDEFDSGGRSGDRPGAAAAGGDDGAAPPLPHTVQIGNSPTYRLERKLGKGGFGQVYVGRRISAPRLSDRNPGSNALEVALKFEHQTSKGCNYGAPYEWQVYNTLSGNHGVPRV

SEQ ID NO: 38728 - protein, 137 aa, Sorghum bicolor
  Clone ID: SORBI-28MAY03-C71471_1.pep
MALMAAGGCAGARGRARPPSPAPPAPPTSGPWPRRRLLRRRRSPASSGDRTIRIGSIHSSSQASIVVVVSQQLHAHAYLRLGFSPRHADRSISIKLIKVACMHAVNIYIPCTTITLFLLLLACKGRCIGSLAIACFR

SEQ ID NO: 38729 - protein, 101 aa, Sorghum bicolor
  Clone ID: SORBI-28MAY03-C70318_1.pep
MEAAAVVGLGTGAGAGLTRWQAAALAAVAGWVCAASFFDLTRRTRALVQPWVTRRVHAETAAILRLQRLLEHKLLDNFFSVLSCVVSVPFYTGFLPLLFWS

SEQ ID NO: 38730 - protein, 212 aa, Sorghum bicolor
  Clone ID: SORBI-28MAY03-C70317_1.pep
MPLPPDPRRRAAAASVCRPPRTLLPSPPLRLGPRTRRELTGRPRGVVRAAPEGPEETGDQVDETERRRGPVPDPRDGPAPPPGPASRALQTRLPRPPDYFIRVHPQVVAGQPLVPWGREVDSTPHWGEDTYDEFADPPVAGPPPLLRFADDKRHANHPFRLFRLTVKTLKSAIESIRGKQNVMDQDPEGKYEALEKYGKDLTAMARQGKLDP

SEQ ID NO: 38731 - protein, 162 aa, Sorghum bicolor
  Clone ID: SORBI-28MAY03-C70341_1.pep
MSLDSEASSQGGDYRSFRQITRDRLLFEMLRSTRKNSKSTWKVLIMDKFTVKIMSYACKMADITEEGVSLVEDLYKRRQPLPSLDAIYFIQPTKENIVMFLSDMSGRSPLYKKAYVFFSSPVHKELVAQIKKDSSVLPRIAALSEMNLEYFAIDSQGFTTDH

SEQ ID NO: 38732 - protein, 154 aa, Sorghum bicolor
  Clone ID: SORBI-28MAY03-C70386_1.pep
VIRFVANNPGMWFFHCHLDPHVPMGLGMVFQVESGTTPGSTLPTPPGDWVGVCDAQHYAAAAAVAAAPVPVPAPAQAPTLAPAPAESPRTAGSPRQSPRAVDHKPSPNLPQHKEHTGTSGSSNSAAGPGRRSTGNLACFLCYVLLLFVLHEHMA

SEQ ID NO: 38733 - protein, 183 aa, Sorghum bicolor
  Clone ID: SORBI-28MAY03-C70529_1.pep
MAPPISADALVVEAASAIAASPAIAPNGMVSRKDVAAAAAPAISVVSKQTVRPAAGASAPVVGGDLRLSVSDMPMLSCHYIQKGLFFPPPPPSVLTTTASLVSSLVTALSRALGVFPALAGRLVTLHDDSIVIRCGGGGDDADAAVEFYHAVAPSLSLGDFLVPGADVPTSLTNALFPMDRTV

SEQ ID NO: 38734 - protein, 247 aa, Sorghum bicolor
  Clone ID: SORBI-28MAY03-C7069_1.pep
TRVVPRKTLQSHLRSEGDTEEDDDPVGPVDSNGSAEDEANLTQMRASSNFQNIRDKCACQRGNRNKDTKARTADVEDRGEPSTKDSTAATMNIPGEGPFINNKTNWLAIQRQLTHLERQQTSLMNMLQDFMGGSHDSMVTLENRVRGLERVVEEMAREISLSSGRRGGGPALGFDSSPGRSSKYNGFHEYSNSEFGRGGDGRMGFAERYFSADGMASGTKNPSWRPNSEPWDSYAYSGSRSGMNARR

SEQ ID NO: 38735 - protein, 224 aa, Sorghum bicolor
  Clone ID: SORBI-28MAY03-C71348_1.pep
MRLTRRQGRAGAAMEKEEPAAAELEIPGECQYAGDPVVVRPSQPTPRHTLHLSNLDDQRFLRFSIKYLYVFASHAAVSADALRAALGRVLVDYYPLAGRLRPSDEEEGKLVVDCNAEGALFAEGRLPGLTAADFLRGRGGATPHKSWRKLHYRVEAQSFVAVPPLVVQVTWLGCGGMVLCTAINHCLCDGIGTAQFLHAWARAVRGGPRAPAPGAAAAAASAAP

SEQ ID NO: 38736 - protein, 219 aa, Sorghum bicolor
  Clone ID: SORBI-28MAY03-C7141_1.pep
ANFKCRRLGGIEKAFQEVKARGYNPDLVIFNSMLSMYAKNGMYSKVTEIFDSIKQSGLSPDLITYNSLMDMYAKCSESWEAEKILNQLKSSQVKPDVVSYNTVINGFCKQGLIKEAQRILSEMIADGMAPCVVTYHTLVGGYASLEMFSEAREVINYMIQHNLKPMELTYRRVVDSYCKAKRFEEARSFLSEVSETDPNFDKKVLHTLAAYIEDAQFGR

SEQ ID NO: 38737 - protein, 111 aa, Sorghum bicolor
  Clone ID: SORBI-28MAY03-C71449_1.pep
RIPNFIAVNFYMRSDGGGVFDVQDRINGRTLCGCDTIAACQAGAPMGACKDTGAPNQTTSSSSSVNGNVYSGTIEFKTHSTSAASNTSIRRSLVFLLRLQMTSLLFLSFRV

SEQ ID NO: 38738 - protein, 99 aa, Sorghum bicolor
  Clone ID: SORBI-28MAY03-C71461_1.pep
ETSYRLSEHGVLVSMSSFSECVTLVWPVFIPQPGVLCRVRASRCGGRSGERAVIAPAGGVRELLGPEVGAVLRREGRRRVRGLAGAARAQEVGAAALVN

SEQ ID NO: 38739 - protein, 150 aa, Sorghum bicolor
  Clone ID: SORBI-28MAY03-C70801_1.pep
MSMSFLSMVEAELPPGFRFHPRDDELICDYLAPKLGGKVGFSGRRPPMVDVDLNKVEPWDLPVAASVGPREWYFFSLKDRKYATGQRTNRATVSGYWKATGKDRVVARRGALVGMRKTLVFYQGRAPKGRKTEWVMHEYRMEPALDPSSS

SEQ ID NO: 38740 - protein, 189 aa, Sorghum bicolor
  Clone ID: SORBI-28MAY03-C70768_1.pep
MVNFIEAQKPLLSRLMKMAGLRPIEVELEPGTTMHVWAPKHHVGKKGTTISPLEPTAAAADADAKKKKKTTTKKRSPESRPNVVLIHGFAAEGNVTWQFNFGVLVSRYNLYIPDLMFFGKSTTSSADRSPDFQAACVAGALARLGVAHCDVVGFSYGGMVAFKLAEARPDLVRSLCVSGSVVAMTDAVN

SEQ ID NO: 38741 - protein, 129 aa, Sorghum bicolor
  Clone ID: SORBI-28MAY03-C70838_1.pep
DSKSRMLDPRVVGQEHYDVATRVQQILQEYKSLQDIIAILGMDELSEADKLTVERARKIQRFLSQPFTVAQVFTGIEGKLVDLKETINSFKAILNGEGDNLPEGAFYMVGDFASAKAKGEKILAELEGQ

SEQ ID NO: 38742 - protein, 137 aa, Sorghum bicolor
  Clone ID: SORBI-28MAY03-C70845_1.pep
IFDKIFSAYHDARSCIRNDLASAGNAEDIRDDLNGLDKAVSAVLGLRTIERNQLLVSIAKSKFTKHRDEKNERITKPEELVRLYDLLIQNATDLTDLVSSGRNKNEEEGICPLKFWCTILIVRFAWCMNQCKMRMSS

SEQ ID NO: 38743 - protein, 223 aa, Sorghum bicolor
  Clone ID: SORBI-28MAY03-C7108_1.pep
PSSAAAASRLKTAGTTTPAKAGSGSGATQQKQHKATAMSSAAAMTGAGKVVCVTGASGYIASWIVRLLLDRGYTVRATVRDTADPKKTLHLTALDGAKDRLHLFKASLLEEGSFDAAVHGCDTVFHTASPFYHNVKDPKAELLDPAVKGTLNVLGSCKKASITKVVITSSMAAVSYNEKPRTPEVTVDETWFTDPQICEKTQQWYVLSKTLAEQAAWKFSRDN

SEQ ID NO: 38744 - protein, 108 aa, Sorghum bicolor
  Clone ID: SORBI-28MAY03-C71031_1.pep
SPRQVLVVPVMPAANDYAKEVQQIFRAKGLYSDVDLSSNTFQKKIRTGQLEQYNFIFVVGAEEASSRTLNIRNRDDQATQAKGELVPIDEALEKMVQLKSSRGLVNKL

SEQ ID NO: 38745 - protein, 161 aa, Sorghum bicolor
  Clone ID: SORBI-28MAY03-C7094_1.pep
MGSEGSSGPVVVPRNFRLLEELERGEKGIGDGTVSYGMDDADDIYMRSWTGTIIGPPNTVHEGRIYQLKLFCDTDYPDKPPTVRFQTRINMTCVNQETGLVDPSLFPMLGNWEREHTMEDILVSLKREMSTPQNRRLYQPHEGNEDQRVEQKGLSVRCVIM

SEQ ID NO: 38746 - protein, 134 aa, Sorghum bicolor
  Clone ID: SORBI-28MAY03-C71068_1.pep
NERMHLMTFLEVTQPKWWERALVLATQGVFFNAYFVGYLLSPKFAHRVVGYLEEEAVYSYTEYLKDLEAGIIENTPAPAIAIDYWRLPADAKLKDVVTVVRADEAHHRDVNHFASDIHYQGMKLRDTPAPLGYH

SEQ ID NO: 38747 - protein, 264 aa, Sorghum bicolor
  unsure (1)..(264): unsure at all Xaa locations
  Clone ID: SORBI-28MAY03-C71591_1.pep
CAIGSPPPSPPPLPXPLPLAPRPRLPPRLPPPLAPQSPQVLRAGPPRAALRAPRGGPRRAPVLPAAPPPPRPPASAVGPPAARLRRHPGGAGAAPAPPPPPPRPARPTPASPRHGRRPPPPRPPAPASARRAPARPXPPAPPPPRPHLPPPAAGSVPPPPPRPXPASSLRPLSATACRPLPPCAPAPPPRRRAPLLLRHLGSACTLDIAADDYSSQPYFYHGNKKNFTHAVQAVKALCIVVSLQQIVNFTNCNLRSLQLIDDSR

SEQ ID NO: 38748 - protein, 212 aa, Sorghum bicolor
  Clone ID: SORBI-28MAY03-C71623_1.pep
HEVPTPLLPRPSSRALAVAPCSSASSASSSSASPSTSSAPPRHAAAGRRGLLALGAGFLASAALLIPAGDAGATRVEYYATVGDKLCDLSLVKSGLAYCDVEVGTGVQPPRGELINVHYTARFPDGTLFDSSYKRGRPLTMRIGAGKILRGLEQGISGGGGVPPMLVGGKRKLMIPASLGYGPEPAGCFSGDCNIPGNATLLYDLYLVGIYK

SEQ ID NO: 38749 - protein, 177 aa, Sorghum bicolor
  Clone ID: SORBI-28MAY03-C71665_1.pep
MPVKRSASVAALLPPVVGRRARARLCVRLAAPLTFLLLFVALFRTQSLLGVPPAAPPPSAGPAKVAFLFLVRAGVPLDFLWDAFFRNGEEGRFSVYVHSAPGFQLDRTTTGSPYFYGRQLARSVKVVWGEATMVEAERMLFAAALQDPANQRFVLLSDSCVPLYNFSSIYTYLMASP

SEQ ID NO: 38750 - protein, 63 aa, Sorghum bicolor
  Clone ID: SORBI-28MAY03-C71632_1.pep
VKSCTRWLGDTINHSRLDYFYWLLAVLGVVNLVAYLVCAMWATAPASRQAEQPQSAMAADEKC

SEQ ID NO: 38751 - protein, 205 aa, Sorghum bicolor
  Clone ID: SORBI-28MAY03-C71214_1.pep
ERAMATQRLVAALVACLLVLAPLPVRGRNITAILQGYKEYKLYNQYLSETKVCDEINSRQSTSMTILVLSNDAMTTLAKDAGDSLPAIKNALRLHSVLDYYDRKKVKKYGDESAATLYQATGDAAETTGNVKVVDQEDKNYGFSAATAGARICTVTKEVETHPFKFAILEVTAPIEFDGLFDVPSTANLTRLLERAGCKVFASLA

SEQ ID NO: 38752 - protein, 153 aa, Sorghum bicolor
  Clone ID: SORBI-28MAY03-C71226_1.pep
MESNNPSHSQIAEVKMDISASASGAAGYKFCKGAACDFSDSSNSSKDAKERSASMRKLIIAVILCIIFMTVEVVGGIKANSLAILTDAAHLLSDVAAFAISLFSLWAAGWEATPQQSYGFFRIEILGALVSIQLIWLLAGILVYEAIVRLINE

SEQ ID NO: 38753 - protein, 144 aa, Sorghum bicolor
  Clone ID: SORBI-28MAY03-C71246_1.pep
HACEASHAHTHAAAPRSSSRTLARPPPAACRTPPPQLAPARARISALGPRSAAFVLPVVGPRLPCSPAPTAAPREPGRRACAPITPSPAAAPAQIYAGRAGSAALLSATEAARQRLAPQAEDLLSLLFLFVHSNICLTHGVNHP

SEQ ID NO: 38754 - protein, 87 aa, Sorghum bicolor
  Clone ID: SORBI-28MAY03-C71285_1.pep
VHEQLCAMLEKSERELLGHNNQYLPKIVSVFAEILCAGKDLATEQTASRMINLLRQLQATLPPSVLASTWSSLQPQQQLALQSVLSS

SEQ ID NO: 38755 - protein, 111 aa, Sorghum bicolor
  Clone ID: SORBI-28MAY03-C71300_1.pep
TRVGLAVLEPSMIGEPADPFATPLEILPEWYFFPVFQILRTVPNKLLGVLLMVSVPTGLLTVPFLENVNKFQNPFRRPVATTVFLIGTVVALWLGIGATLPIDKSLTLGLF

SEQ ID NO: 38756 - protein, 191 aa, Sorghum bicolor
  Clone ID: SORBI-28MAY03-C7133_1.pep
YPLANYTFGTKEPKMEKDTSVADRLARMKVNYMKEGMRTSVEAILLVQEHNHPHILLLQIGNTFCKLPGGRLKPGENEIEGLKRKLCSKLAVNSPSFPPNWQIGECVAVWWRPNFETVMYPYCPPHITKPKECKKLFIVHLSEREYFAVPRNLKLLAVPLFELYDNVQRYGPVISTIPQQLSRFQFNMVSS

SEQ ID NO: 38757 - protein, 124 aa, Sorghum bicolor
  Clone ID: SORBI-28MAY03-C72242_1.pep
RSGMEFEPVGIMPGGEMRIVRESPTSAYVRFKAGSVEPAHHHTFGHDLVVIKGKKKVWNLTKKESYDLVDGDFLFTPAGDVHRVKYFEDTEFFIRWDGHWDIFLDEDLDTAHNAIDAELAAASK

SEQ ID NO: 38758 - protein, 114 aa, Sorghum bicolor
  Clone ID: SORBI-28MAY03-C72250_1.pep
LPPYYHYFPQKTYHHFPREVWIHNVGLGSLIIYSIEEICDDSGEDPTCSRSVSGNSVHDHIHYLGISMHAESWGHCRIVTDNRTLPQQYKMDPDGNIILSKQPGLSVNELHSAQ

SEQ ID NO: 38759 - protein, 126 aa, Sorghum bicolor
  Clone ID: SORBI-28MAY03-C7214_1.pep
GGRIGHEHTQSGPPNRAASSRHGHSEHQGPEGEKVAEPARRWLHAPGPRGTQEEDRNRQRQEGKGETGPRDTPTASTRAPNKAYSPKGTETTSDTKTALSQRTESVVTHCQSANVHSACGMREPPS

SEQ ID NO: 38760 - protein, 160 aa, Sorghum bicolor
  Clone ID: SORBI-28MAY03-C79271_1.pep
PCPKWSQEDHHFLVASHGEVVLVSRPGTMENAFEFFRLDIEAMEWSQLDDRELDDTSWFLCKGQSFRVKDAGRRRVYPFSGPKQWSVPMDSCEQTTDDGMAMGSTACFTGTSGHDDVGLKSITNVYAYDLDDGTVEMVIPASLVTEVRHWVQPSTFATAK

SEQ ID NO: 38761 - protein, 193 aa, Sorghum bicolor
  unsure (1)..(193): unsure at all Xaa locations
  Clone ID: SORBI-28MAY03-C79162_1.pep
RGGGAPALSYPSSPASTPSSKLSGSLPSQATRNGGGLRSRAPGLVQAVAAASACPHHQAPPAPAPHAPRRLRXAAPPRQQQQQHRARPRPPPRNKPPGPARRPPRIPLDQDDYEYDDGDREEGRFAGGTRAAAMPKPPAGFVLDDQGRCIAAASKRIVTIIDDTSNRPLECIIRRVFRSSQGHDCLLLCPVDM

SEQ ID NO: 38762 - protein, 152 aa, Sorghum bicolor
  Clone ID: SORBI-28MAY03-C79279_1.pep
ANTNISSLHQPINLDKSLGGFAGRITDSEAHVIKFSSDGRRILLTTKAGRVHVLDSFHGNSIASYNVKPVVTNSTLEASFSPDGNHIISGSGDGSVYAWNVRSGKVARWGSTDNDPPLVRWAPGSLMFVTGSSELSCWVPDLSKLGSFTISK

SEQ ID NO: 38763 - protein, 134 aa, Sorghum bicolor
  Clone ID: SORBI-28MAY03-C79430_1.pep
EAPDISIYAAVLGMVFDLNLHSPRTRRLSMAYTVQKHRHADGAEQNVVITIFRSDRTPGFHAPAKHRTEKIRQRRQQQQQWGLVEWDGVSGSVKWGSGTDGPSEQHGRKHVHPIGFARRGLQLAGEMLAGARRR

SEQ ID NO: 38764 - protein, 123 aa, Sorghum bicolor
  Clone ID: SORBI-28MAY03-C79530_1.pep
NYLFPSILGRDQGALVNVKIKQAFCPPKIVEGNPCLEYIKYIVFPWFGRFEVVRKEINGGNKTFTSMGELISDYETGALHPADVKPALAKAINEILQPVRDHFNNNNEAKVLLNTVKKYRVTN

SEQ ID NO: 38765 - protein, 160 aa, Sorghum bicolor
  Clone ID: SORBI-28MAY03-C79531_1.pep
MHLNFSAALSDAKRKTEFTLDTRTSLALFGSFTATDYVASQSIRRRIMHYHMEAFKKVDVIVTPTTGITAPKIPPSALKSGESDYVVSAYLMRFIIAGNLLGLPAITVPVGHDKQGLPIGLRLIGRPWGEASLLRVASAVEELCLKKRKRPSAFYDILKA

SEQ ID NO: 38766 - protein, 267 aa, Sorghum bicolor
  unsure (1)..(267): unsure at all Xaa locations
  Clone ID: SORBI-28MAY03-C72475_1.pep
TGNARLLESAPARRRAPPPCPPPPLAPAPPQRSSRSPAPSHGTSPPAPRWCASAWTTTATPSSLLPQPPRRRWMTCWRTASHFRWTCQTLKSPATPPPPPPPSSSXAPDDAVXLPPTPLSPRSPRPPTPPPTATHLSRNKSSSSCPSCMPPPASARAPSASSRRSPRPRTPSSPPRPPPPAASVAPPSGARCAWRSSPRRSPPWPPSTSRSPPTSTRAASTTGTTSCPPPDPSTALRPPPPPPPVRLDLDRPDETVIAPSVLSLLKC

SEQ ID NO: 38767 - protein, 155 aa, Sorghum bicolor
  unsure (1)..(155): unsure at all Xaa locations
  Clone ID: SORBI-28MAY03-C72702_1.pep
ASPIQGTTGXVGHTGEGGVMMLGGQAMARMQRGEGVAAILNTSRSDPKIKLQTSNRARAWKNDPRGLPLLDKRSGSVATTGGYAQQAASSGETLPLRLPVILTKMNNLPRLPHPLSCRNSPLWLCFTTGLDALGWAAGVYASMLVSIRIIVPVKW

SEQ ID NO: 38768 - protein, 160 aa, Sorghum bicolor
  Clone ID: SORBI-28MAY03-C72552_1.pep
SDKPQAADHALKRQVKHSVACGVDWVVLVSDDSDFTDTVRNARAADLRTVVVGDGCRALGKVADIWLPWDRVENGEVDEEMLRSCTFAEYREDQEDERGEQFIGDWDASAFDDVVDDIVGMRTSLLGATTISAFADEDITDGIFDSMFWSSDDEEEDGYL

SEQ ID NO: 38769 - protein, 259 aa, Sorghum bicolor
  Clone ID: SORBI-28MAY03-C7276_1.pep
MSTTECSDLGEEFWLPEEFLDDDFFSEEEKAAVAARSESDEEDSLAGLSPRRAGLLGDDGERKPPTAAKQAELTVGSPQSTLCGLPKSGQESPNGVASKGTSPPSSPLEQKPADPWDLLYEAAGQVARMRATNSIPVPANNAYGFGQSGFAPPARKPSPPPIAPPSAKVPAGGGQGHYHPFAHLVSQRQMQAAQFHLLKQQQLLKLQRERQQLAAAAAWSARQGACAKAVGGGDAPLGLNPAAWPPLQKPPQQQHQGAG

SEQ ID NO: 38770 - protein, 204 aa, Sorghum bicolor
  Clone ID: SORBI-28MAY03-C71736_1.pep
MRIGAGAAAAANMAACSSVPCSFPTKPDPHRRGRSSHLPRLPAATQFRRFRSLSAAAAASSSASRLRPRASVSASAAPSKDYEFTDGNGEVELRLDIQKLGIESARDVFVDVDDTSLLIRAKSDGTLRTLMNVQTLFDRIKSSETIWFIDEDQLVVNLKKVEQELKWPDIDESWESLTSGITQLLTGISVHIVGDSTHINEAVA

SEQ ID NO: 38771 - protein, 263 aa, Sorghum bicolor
  Clone ID: SORBI-28MAY03-C71761_1.pep
MPTTISTRQSLQFALPSNNARPISTAVRMTCFAKKQPIVAVPLSSSLEDKRYEPVVKMCGITSAIDAEMAVMAGAKLIGMILWPNSKRSVPLSGAKEISRVAKSYGAESVGVFVDDDNSTILRASDTCNLDLIQLHGDSSRELLPLLWKNNRIVYVLNADDDGILINAPPSEEYVLDWFLVDSAKGGSGKGFNWEKFQMPTVKSKNGWLLAGGLHADNVHQAASALKPNGLDVSSGICYPDGLRKDPKRMCSFMSSVKTLNLL

SEQ ID NO: 38772 - protein, 70 aa, Sorghum bicolor
  Clone ID: SORBI-28MAY03-C71808_1.pep
ARGERGAGATLACGTGACAVVVAAVLEGRAERKCVVDLPGGPLEIEWREDDNHVYMTGPAEAVFYGSVVP

SEQ ID NO: 38773 - protein, 105 aa, Sorghum bicolor
  Clone ID: SORBI-28MAY03-C71814_1.pep
EMLYRQVKNGQHQCPICKGYMVIAGTIARTVAKRILKLWAVRSRSGSNQPEAMSVDMKNAPVKSKAARKKKQVANKQKGKSLLGSFDSPAMATRSKKTLTLLALL

SEQ ID NO: 38774 - protein, 154 aa, Sorghum bicolor
  Clone ID: SORBI-28MAY03-C71839_1.pep
PPRTRHARPLPARPRPPPNPNAHGTHAPTLHAAAAARAPPPPTKSAARRRPTLPAATAPLALLSQTPARSEFAGGSPSDLASWVLATRRTPETSEKLRSGSSGWQESEQRRRRSAGSRCIGSIAGKLLFIHTLLGRLLRSILQLHAWSSAGRQP

SEQ ID NO: 38775 - protein, 111 aa, Sorghum bicolor
  Clone ID: SORBI-28MAY03-C71908_1.pep
QVEIHSGRPHQIRIHLAYIGHPLVDDPLYGIGGHPKFVEPESTGTDNSFAFDGGYERPLQPVPGDCGYHLHAHWLVLCHPTTNKMVKITAPLPQILQTREERRATAEQVDG

SEQ ID NO: 38776 - protein, 154 aa, Sorghum bicolor
  Clone ID: SORBI-28MAY03-C71840_1.pep
MAAAGAGPGPGGGEGKKRGASRSWILLDAAGEERVLDADKYAIMHRVDINARDLRILDPLLSYPSTILGRERAIVLNLEHIKAIITSDEVLLRDPSDENVIPVVEELRRRLTPSNATQHDGKENLNGQHDVEGAEEDESPFEFRALEVTLEAIC

SEQ ID NO: 38777 - protein, 219 aa, Sorghum bicolor
  Clone ID: SORBI-28MAY03-C73318_1.pep
MAATAAALRCCFPGSSGVGSGFVKAKSSRRGWCAAAVAAPSREAEPVSSLGHRTRVDFPILHQEFDGAKLVYFDNGATSQKPYSVMRTLDEYYRSYNSNVHRGIHALSAKATQAYEDARRKVANFVNAADSREIIFTRNATEAINLVAYSWGLSNLKEGDEIVLTVAEHHSAIVPWQFVSQKTGATLKYVGLTKENAPDIEQLKRLLSNKTKIVVVHHV

SEQ ID NO: 38778 - protein, 231 aa, Sorghum bicolor
  unsure (1)..(231): unsure at all Xaa locations
  Clone ID: SORBI-28MAY03-C73390_1.pep
ADASPRPPPPPPRPRPPAPAPALPPXSGSPARLAPPAGRPPAPRVPSPGPRPAPPSGSPPPRTPPSTPACLPLTPRRPSRLAGSPRRRRSSGAPRHASAPAGLALAPGXPPPSPPAXGCPRPVRGPPPAPADRSPPLPPPHHHVILKSPAGRPHXAPCPRAGGSPGARCPAAPSSLVSLPPGPPPSAAPVPSSVPPPTVIPLILTVTDCNRVLSTSTSPSTRTGRILRILP

SEQ ID NO: 38779 - protein, 101 aa, Sorghum bicolor
  Clone ID: SORBI-28MAY03-C73487_1.pep
RNRRSDDPEFFLDFEEIYVIDSKTRSITRAKVVVSVPEGKKRDRRNDLLLIRDGGESFRIIDKTKRGDATPVIQREEWAKSRQDVEKHFRKLRDFDYSNWF

SEQ ID NO: 38780 - protein, 113 aa, Sorghum bicolor
  Clone ID: SORBI-28MAY03-C73467_1.pep
MAVAASNKSSSKPRLSYPDLEEQALQFILDCCEPNIAKYTKYLEGGGGSPEVSMNAKQANRTLLLKQVARDLCISERRILYRTQYILRRRLRDMRGGELRALSLFNGLRKLFK

SEQ ID NO: 38781 - protein, 163 aa, Sorghum bicolor
  Clone ID: SORBI-28MAY03-C72283_1.pep
GQGSKFPSLSPELVDIVTVRLPWLCARAGTVEQADASADEDGRAGRGFCREGRRGMSPAAWQSTGRFRCPWSASSVHGRKPGPRPCLGHEAGGRAGLAGISFGCAQRRWTNGLGDVRYLAVPLHGARERCAFTWFPALHVVAWHSHVQMHRKGGPCCAGPWYG

SEQ ID NO: 38782 - protein, 154 aa, Sorghum bicolor
  Clone ID: SORBI-28MAY03-C72335_1.pep
KGVPLQPWTCRSDSDRSQKTQGSASANPRDLYHKHLGFPVAQEYRWSRGRMWRTTHRPPSGKRTTVIAVSPCWRAPAAVALAASREREIEQKGERERERREHAGGGGGGSPQLRCPARALRRRPHRSREGASGEEEGGVGVRVGNHRKGEEAPV

SEQ ID NO: 38783 - protein, 199 aa, Sorghum bicolor
  Clone ID: SORBI-28MAY03-C72344_1.pep
MAADRRFKIFTAADGFGQALKDAVAAHLRAHPAVAEVVDLGVDKYYAAAAAVARHVSSPDSAPDDAHEIRGVVVCGTGAGVCIFANKYPRVYATHCASPADAVNTRSINACNVLALSGSATPPDAAAAIVDAWLATPFRAPCPASGDAPWPEDIQRFFDTAPDEMAAIPEAAEGAPDSACAICCLRSGMEFEPGGIMPG

SEQ ID NO: 38784 - protein, 158 aa, Sorghum bicolor
  Clone ID: SORBI-28MAY03-C72445_1.pep
LATLMNPSASHVTTLVAGTFGYLAPEYFDTGRATTKGDVYSYGVLLLELLTGKRPTDESFLENGTRLVTWVKETMEEKREEHAIDEALLKLHHHHLPTEEVRLVFSVADRCLDADPANRPTMAQVVKMLEQGKNTTHHHSSTSPPPPPTADHPILNPI

SEQ ID NO: 38785 - protein, 152 aa, Sorghum bicolor
  Clone ID: SORBI-28MAY03-C72353_1.pep
MEQRRWLAASVLMCLLVLCSGRDLKTKHAPIYDPGLARTLAEYTSAVYTADLSQLFTWTCERCCDLTEGFEVIELIVDVKNCLQAYVGFARDMNAVIVVFRGTQENSIQNWIEDLFWKQLDLDYPGMPEAKVHSGFYSAYHNTTMRDGVVRG

SEQ ID NO: 38786 - protein, 134 aa, Sorghum bicolor
  Clone ID: SORBI-28MAY03-C72461_1.pep
MEYRAFDSSVTGDELPPAYQIRGPRVHFSGNGRSLAGTLSQPRSHIKLDSDIHQIEQQAYTGVLRAFKMQSDALTWEKESLITELRRELKVSDVEHRMLLNMVNEEEAVHRIRQSRQGGGMQSSLPHNSIVDHN

SEQ ID NO: 38787 - protein, 212 aa, Sorghum bicolor
  unsure (1)..(212): unsure at all Xaa locations
  Clone ID: SORBI-28MAY03-C72471_1.pep
MHNPGLVALYITICSVLFLLSKMLISFLLYKKWARKKRIIDNSLAGGGKMVIFRSATMAMPQSLTPKSLLAMLMGLSTKDVIGAGGYGTVYRLRLDDKTAFAVKRLNRGTAEMDRGFERELDAMGDIKHRNVVPLCGYYAETHFNLLIYELMPNGXSLDQALHHHLQLQASRLDWPARYXIAVGVARXLSYLHHDCIPHVIHRDIKSSNILL

SEQ ID NO: 38788 - protein, 276 aa, Sorghum bicolor
  Clone ID: SORBI-28MAY03-C73955_1.pep
MGDHLALIVDRLLTESTLEAAIGGGKRMVDLHQETVAVEYCHRALGGGSATKVVECRICQEEDWDTCMEAPCACCGSLKYAHRKCIQRWCNEKGDTMCEICLQQFRPGYTSPQQLFHYGSIPMNFRGNWEITQQDLNDSQIITMMPTERDFMDNYDDYFPIRTRSSALCCRTIAIIFMALLVLRHTLPLMIGDNGEYSLALFALLVLRTAGILFPILVMVRALASFHRRRRQQESREAYISSSESEEEDEDEAEEEDTITDSAHPNYSQPRFIPVY

SEQ ID NO: 38789 - protein, 161 aa, Sorghum bicolor
  Clone ID: SORBI-28MAY03-C73951_1.pep
GGGGTESVGSSSSPPPGDPDANANAAADQVAAASDAASDHEGEESDGRDASPAEEEQQEQSSSAEPPPELLCPLPRNVRRAASMDAAADVAELDRLPEEAPEEEQIGGRRKRWTGTGPPRAKASGSGHRSNLSTDRLAAPSGVPRSFFSRHCRARSSVLPL

SEQ ID NO: 38790 - protein, 240 aa, Sorghum bicolor
  Clone ID: SORBI-28MAY03-C73983_1.pep
ARGVDAQRLERILLGYGRNEDSCFKIKITHAPALRMFGKIELAKDELQVGNTIIKAGTMVNPSVMLSAVTILDLHVRFGVRNDPKMLPTILRCFPNIETLHIHSKKTTESTGRLSNKFWKESGAIKCVMSSINMLQVHDFRGERSELAFLKFFIESAQMLNVLVVVYANGFFSSRGEANSKVKALFAGRKATQSCKVVVCESRFSEGGSRWDFEQGSDFSFDDPFGIIGCSSFGVSQWFV

SEQ ID NO: 38791 - protein, 63 aa, Sorghum bicolor
  Clone ID: SORBI-28MAY03-C7281_1.pep
QETEPPYKAVLAKRENFRDIVVTPSMFTDHLPWRCHFAMQKILEAQTPMHRRANSDSPIQHLV

SEQ ID NO: 38792 - protein, 154 aa, Sorghum bicolor
  Clone ID: SORBI-28MAY03-C72912_1.pep
PNPDNNPRPPNPDEDGSGENGNLPGQNEAAVEIEEEEKKEEVEEDENLFAERNEAAARVNMSIEEERKEENDQALTFAFNSDHQIQSFLETNLPKELKSTQFSNLFGDTQASTQASTQASTQASTQASTQVNTRVNTQASLQVSTQAIVELDSS

SEQ ID NO: 38793 - protein, 215 aa, Sorghum bicolor
  Clone ID: SORBI-28MAY03-C72934_1.pep
KAIIRMQQNILAGNNIDNPVDTFAVYEPLYDLAVENPDYPSHLYHYHFHDPNIQTTNPDVYTLDDNGQGRFTARTITDFWPSRRLSKLRVKGVILGVSQYDRGHPDKLPFSNRIRLIPWNLIFGNLRDDSEGLFIVEETFNDREGKAPIIHITLLWGDRVTILRDYPRLDEIPLGANSYLSIQQEGGRLVMKCPKNNSGWSGVVVKNMDSHLSSW

SEQ ID NO: 38794 - protein, 206 aa, Sorghum bicolor
  Clone ID: SORBI-28MAY03-C7292_1.pep
MFKFLKEVVAGSGSGLKDFPYTIGEPYASAWGSWTHHRGTSKDDGSPVSIFSLSGRDPQDRHMVAGRNGVKRLRTVRHPNILSFLHSTEAEVADGPAMKHTIYIVTEPVMPLSEKLKELNLGGTQRDEYFAWGLHQISKAVSFLNNDCKLVHGNVCLASVVVTQTLDWKLHAFDVLTEFDANNEASGSRMLQFEWLVGTQYKPMEL

SEQ ID NO: 38795 - protein, 109 aa, Sorghum bicolor
  Clone ID: SORBI-28MAY03-C73097_1.pep
KSYPYTQTQPSPDSQPDGLQTHFSTKHGVDASRRTTRGCGALCSFAPYVAPSPPIRRPPRALSIDAAARPQSPTQEDAEAGAPLPPAAAGADLHRLYRFAAFLIDFFVS

SEQ ID NO: 38796 - protein, 133 aa, Sorghum bicolor
  Clone ID: SORBI-28MAY03-C73201_1.pep
GPFGRTLMLAAYLYTRVLLGCIYVIGAYFSHDLRSWVSRGGGKLIETEPREGRHKEKFSNHEIVIVNPAPHQGLSRTKLARDLDTQLLLLAPRVRLAGPPPLGCPPGLRDSLADRRRRSRPMHLGQVIIWPSC

SEQ ID NO: 38797 - protein, 165 aa, Sorghum bicolor
  unsure (1)..(165): unsure at all Xaa locations
  Clone ID: SORBI-28MAY03-C73305_1.pep
MKPDARKDAGGGVAALGVSCFDIKSFVASLALLTLVMALWQLHPYQPLLSASRPSTTCPLLPRPPISASSRAAATVAPFPSGNSSANAASTKAASSAVPAVTTMKPAASVVPAARPRDPNKREFRSYGSAAALFVRWPXTRGGPRTFAVIGLASKPAHVYGTPYF

SEQ ID NO: 38798 - protein, 224 aa, Sorghum bicolor
  Clone ID: SORBI-28MAY03-C74152_1.pep
MEASSASAVESTATVSVFDVSSNKQRPDTAKLVLNSPSPPSLREELVGVVGKAFRPRPPGGGGRAPRCPWILTALQCVFPVLQWGRTYTLKSFRSDVMAGLTLASLGIPQSIGYANLAKLDPQYGLYTSVVPPLIYAVMGTSREIAIGPVAVVSLLLSSMIQKVVDPAADPATYRSLVFTVTFLAGVFQVSFGLFRLGFLVDFLSHAAIVGFMGGAAIVIGLQQ

SEQ ID NO: 38799 - protein, 172 aa, Sorghum bicolor
  Clone ID: SORBI-28MAY03-C74178_1.pep
MSPSLLLLPSSTTTCRRLLPPPSRCFASSSRASFLLRPRRRIRLVCAAEQPNGAASPGSGSGSGGDATANPTNNGLPKNRRDILLEYVKSVQPEFMELFIKRAPAQVVEAMRQTVTNMMGTLPPQFFAVTVSTVAENLAQLMYSVLMTGYMFRNAQYRLELQQSLEQIALPE

SEQ ID NO: 38800 - protein, 154 aa, Sorghum bicolor
  unsure (1)..(154): unsure at all Xaa locations
  Clone ID: SORBI-28MAY03-C74201_1.pep
MGNCWGAKISSDSPSRGAISPSGATSKFTSRNGAAALSGCSSHASSASMLPTPRSEDEILESANVKAFTFNELRTATRNFRPDGVLGEGGFGSVFKGWIDEKTLAPTRPGTGMVIAVKKLNQEGYQGHKEWLTXVNYLGTLSHPYLVKLVGYCL

SEQ ID NO: 38801 - protein, 126 aa, Sorghum bicolor
  Clone ID: SORBI-28MAY03-C74213_1.pep
QEAEKYKAEDEEVKRKVEARNALENYAYNMRNTVRDEKIASKLPAEDKKKIEDTVEDAIKWLDGNQLAEAEEFEDEMKELENVCNPIISKMYQGGAGAAGMDEDVPSGGAGSGGGSGAGPKIEEVD

SEQ ID NO: 38802 - protein, 76 aa, Sorghum bicolor
  Clone ID: SORBI-28MAY03-C73523_1.pep
CPPSRRKGWRRCGGGDLASCTPLAKKMKEQLGDNCFLYGIRKAGHLLHVERPCAYNRQLQRWFAYVNSTAAGDQAS

SEQ ID NO: 38803 - protein, 242 aa, Sorghum bicolor
  Clone ID: SORBI-28MAY03-C73541_1.pep
DKENSNAMKIAVIVLVCFAAYIAAQAPATVDRFTSDYSFTFEFGGSFGVKRAMEVSGQESLLPIEVQKELVKRQATSLVTTVYGNIEADVPNNIWLQTAKRFVLSVGGMDLDFTLDASNLVYYDLNKNYTWDTTACECNAIEGSTEMPIISLPPFATVKATGVSITVNGAAVTTTEYTASWSAGFNSGSKKRNVQQDFTFQYTFYVDASNQMRRTVFEVNLSGSTVKTTLDFWNIAAVSANK

SEQ ID NO: 38804 - protein, 179 aa, Sorghum bicolor
  Clone ID: SORBI-28MAY03-C73608_1.pep
RTDETALHEELSNRFDYDGVFGTALNRFCVQAAVGHPLTVYGKGGQTRGYLDIRDTVQCVELAIANPAKPGEFRVFNQFTEQFSVNELAKLVTAAGAKLGLEVQTKSVPNPRVEAEEHYYNAKHTKLIELGLVPHLLSDSLLDSLLNFAIQYKDRVDTAQIMPSVSWKKMGAKPRTVSV

SEQ ID NO: 38805 - protein, 253 aa, Sorghum bicolor
  Clone ID: SORBI-28MAY03-C73717_1.pep
YWMPQQPVSKKPPPLAPIPIQILRHEPIEPNPISSPHAISHLSFISFFFTDNKDPIDRSPAAANSPAGLEMKVDREMEILLNEIPLLHHGGLLGGSGEAGADDDADLSFLIHELAAMGVVDGDDEPPAPGAANGFGFSSMMIYPKKGGENLVSLHPFSMAGHCAHMPSLFDPVTFAAADGWDIRCSPPPSVSVSPPPATPRARCKNVRRKNGGCGAVTATSPKKCGAAAAAAAAAANKSHGESLAGLRGVMSH

SEQ ID NO: 38806 - protein, 225 aa, Sorghum bicolor
  Clone ID: SORBI-28MAY03-C7386_1.pep
TREGSDGDGKKVDPRCPNAPNPFHVCTDHCLAKIADAGRSSEGAKSPISLFSRHSRRSSSSSEEGSLKSPGSRKVDPKCPNAGNLFHECGEHCATKMQQTEQHKGFNIKSPRRKGGKNATVIPNWKVDPRCPNASNPFHMCAQYCFDHLSETAQTSATKSDKSRGKDIPKDERRGEINSDCVNASNPYHKCGADAWRRARSRARTSRRDKISSEGRSTTTTMKNY

SEQ ID NO: 38807 - protein, 138 aa, Sorghum bicolor
  Clone ID: SORBI-28MAY03-C74570_1.pep
KARRPPPHRCPLGCFPPPWRTLLPGSPNLARHSPHLGTASSPSSGGTLSPPVTELLSPDSHDAPSARISSPPYVAIVCFSWCRCSCGPLPSCLARARPTARRRGGRVRRVGSGHGGTGGFQRALVYHRYASCGFLDAR

SEQ ID NO: 38808 - protein, 293 aa, Sorghum bicolor
  Clone ID: SORBI-28MAY03-C74741_1.pep
GRCRPVPRAAPPGPPPRPPPRPPPAPPPPRRAAPPPPPPRPSPPRPPRPAPPPPPPPPPAPPPPPPPAPSPPRRVRPSPPSAPPTPRRAPRAPPAGHEAAQACPGARPPRPLSGRGVGAAPACVLRSACPRGACIEDGLLSQTANKISELLQLRICNQHARALCGQPAEILFQQHDVSNAIDELLSKTPAGLTEAGIQLVKTRVLESSQDFFDTTFTSNKVKVFKCPELVAELHMPLACRVRQWISRNTICVATFCILHCSGYCGSFTGGGHYLIELNKYMSSRFVKSLKIMP

SEQ ID NO: 38809 - protein, 188 aa, Sorghum bicolor
  Clone ID: SORBI-28MAY03-C74569_1.pep
RHLGAAERPPAATAPRRRRPQPTPTQRTPKRIRPTSAAVRTSESQRRCAHGTAGRGAAMDMDSVECLSLPDAAMDVDDVDGHPHHGHHGHLGLPLHPAHLPSSGAGRAFPKVNAGGGGAGPAGAGAAGAAGAAGAGGGPPATSVHELLECPVCTNSMFPPIHQCQNGHTLCSTCKARVHNRCPTCRQE

SEQ ID NO: 38810 - protein, 200 aa, Sorghum bicolor
  unsure (1)..(200): unsure at all Xaa locations
  Clone ID: SORBI-28MAY03-C74745_1.pep
YWTRTLTNPWRHRAEPPQPPARPPLPALHGALRAPAPPLLPPLVPPQHPPPPPAPPPXPPPRPPATSPPPPRPPPRPPPLHPPAAIALPHPPPARGRRGCRSGRPPTPPAXVPPPAPVPSPTTSXRPHRAPAPQPRPXPPTTTTPPPSPLPRPPRRPPTAPSASATCSTAAGRGPTASSRPPASTMPSSRGRETTSPWGR

SEQ ID NO: 38811 - protein, 214 aa, Sorghum bicolor
  unsure (1)..(214): unsure at all Xaa locations
  Clone ID: SORBI-28MAY03-C73991_1.pep
MAAAEVEPSLNPAPTTASDLPNVSKTKAREADRRRRRRKAKKNKSAAEADAQDADGGASGSDAKENADPNPELQVEVEIEYVPEKAELDDPLLDDFKAIFEKFTFKDAAAAAAEDGKKDEGATDATKKGSDDDDDXDDEQEANKKKEGGLSNKKKKLERRMKIAELKQICNRPDVVEVWDATAADPKLLVYLQAYRNTVPVPRHWSQKRKFLQG

SEQ ID NO: 38812 - protein, 163 aa, Sorghum bicolor
  Clone ID: SORBI-28MAY03-C74055_1.pep
MRPHRRALFPGAGDCEDPWSAGCQTPPPVPSSLDYGPGPSPSLPPFAGIPLCPPLLQPSPAPAHNGRRDQGGGMQQGYGPPPPGVGGDADDHARRHFVKYALIAAGVIAFVSLILLGVSVAVRRRQVRRRRQALLAPSLNAGGAANVDDGGGGWGGGGGGGGG

SEQ ID NO: 38813 - protein, 253 aa, Sorghum bicolor
  unsure (1)..(253): unsure at all Xaa locations
  Clone ID: SORBI-28MAY03-C73999_1.pep
MVPSTACSLPHGLSLGFSRSYNSRLLRLSRTGLGAACSSPSGSESPSGLKSAGNLYLYPLSRGSTVVCSVMGTPKSKQEPDHLLVLVHGIMASPKDWTYGEAVLKRRLGDNFFIYASSSNNYTKTFDGIDIAGRRLANEVLDVVNKMPTLRKISFLAHSLGGLFARYAIAVLHSVETKNAGQSSALIVPTTKGPPKSRWTSGLGSIAGLQPINFITLATPHLGVRGRXSGLSILEKLAAPLAPLIVGRTGAQL

SEQ ID NO: 38814 - protein, 190 aa, Sorghum bicolor
  Clone ID: SORBI-28MAY03-C74029_1.pep
MTTRIAPGVGANLLGQHSAERNQDATTYVGNLDPQVSEELLWELFVQAGPVVNVYVPKDRVTNLHQGYGFVEFRSEEDADYAIKILNMIKLYGKPIRVNKASQDKKSLDVGANLFIGNLDPDVDEKLLYDTFSAFGVIVTNPKIMRDPETGNSRGFGFVSYDSFESSDQAIEAMNNQHLCNRPITVSYAY

SEQ ID NO: 38815 - protein, 210 aa, Sorghum bicolor
  Clone ID: SORBI-28MAY03-C7412_1.pep
NLSNNQLNGSIPELGSLFTFPKISYENNSGLCGFPLLPCGHNAGSSSSNDRRSHRNQASLAGSVAMGLLFSLFCIVGIVIIAIECKKRKQINEEANTSRDIYIDSRSHSGTMNSNNWRLSGTNALSVNLAAFEKPLQKLTFNDLIVATNGFHNDSLIGSGGFGDVYKAQLKDGKVVAIKKLIHVSGQGDREFTAEMETIGRIKHRNLVPL

SEQ ID NO: 38816 - protein, 183 aa, Sorghum bicolor
  Clone ID: SORBI-28MAY03-C7413_1.pep
NTHRDDGSTASTAVLVGDHLYVANVGDSRAVISKAGKAIALSEDHKPNRSDERKRIESAGGIVMWAGTWRVGGVLAMSRAFGNRLLKQFVIADPEIQEQEINDELEFLIIASDGLWDVVPNEDAVTLVKMEEEPEAAARKLTETAFSRGSGDNITCIVVKFQHDKPGSSGGGDPPSSPPGDKS

SEQ ID NO: 38817 - protein, 59 aa, Sorghum bicolor
  Clone ID: SORBI-28MAY03-C74130_1.pep
SLKKAPKGPFPLSSFVPTDERFCQRWAGTSLETYHTFRQRLLLTGFAEKSGRKTLVSRR

SEQ ID NO: 38818 - protein, 131 aa, Sorghum bicolor
  Clone ID: SORBI-28MAY03-C75306_1.pep
LYLPLSPVRVVFYLRLLPPTPSLRDSPSLYGPSLSPPPPSSVSPRLEPIESLICFSSIDPAVDYLMFLSIFKCTVASIIDRSFICDYSIIPQFFSSVLSISPAFCFLSYRSRFFCDTYGSRFSLFDIFINL

SEQ ID NO: 38819 - protein, 146 aa, Sorghum bicolor
  Clone ID: SORBI-28MAY03-C75354_1.pep
PPGTCRLSAAPHLLHSPAAAARRGCPDAAPPPRPRPRAAGHAPPNGAAPPGLRRRRLAASATARRHDDAKEAVKWERITYAGIATCTVLAMFNLSKGHQEFPDPPPNPYLHIRNKDFPWGPDGLFERKKKHSNDISGAFMSLDNFY

SEQ ID NO: 38820 - protein, 138 aa, Sorghum bicolor
  Clone ID: SORBI-28MAY03-C75399_1.pep
ESSEWYSDHLDSPDNRLDSPRVWPNEALGSPSIWSDERRNLARLPQINRVSPRLSLGSRRTLHSGWQGVRRSSTRSLLQRGFSNHYSGHRRSNYRGHRHMLLDRSYAGTRNSGTGRSLNPSVVPSRRQRLRYTHRSHY

SEQ ID NO: 38821 - protein, 273 aa, Sorghum bicolor
  unsure (1)..(273): unsure at all Xaa locations
  Clone ID: SORBI-28MAY03-C7552_1.pep
AAYLLYNADRVAEWPDLLQMAVVDLIRKVCRSQNRANKGRYITIITSLLSTPSTAVVYECAGALVSLSSAPTAVRAAANTYCQLLSSQSDNNVKLILLDRLNELRISHRDVMVGVVMDVLRALASPNLDVKRKVLDLVLDLLTPRNVEEVVLYLKKEVVKTQAGDLEKGGEYRQMLVQAIHACAVEYPEVAGSVVHLLMDFLGDTNVAAAVDVVLFVREIIETNPKLRVSMIQRLIDTFYQIRASRVCSCALWILGEYSLSLSEVESAIATIX

SEQ ID NO: 38822 - protein, 199 aa, Sorghum bicolor
  Clone ID: SORBI-28MAY03-C7426_1.pep
VICCTCVGAGDPRLSNFRFRQVLIDESTQATEPECLIPLVLGVKQVVLVGDHCQLGPVIMCKKAARAGLAQSLFERLVILGVKPFRLQVQYRMHPCLSEFPSNCFYEGTLQNGVTVNERQSSGIDFPWPVPNRPMFFYVQMGQEEISASGTSYLNRTEAANVEKIVTTFLRSGVVPSQIGVITPYEGQRAYIVNYMSRN

SEQ ID NO: 38823 - protein, 147 aa, Sorghum bicolor
  Clone ID: SORBI-28MAY03-C74317_1.pep
MLAAAATAVAIPPAASHCFPANTARKWRISWRCRAARVEAGYSQLEVRKVTYRPPGTEQNLLKEINLSLREKSFGLIFGRSGSGKTTLLQLLAGLSEPTSGSVCIQKYDDTGNPIGLPELLTSQRVGIVFQFPERYFLADTVLEEVT

SEQ ID NO: 38824 - protein, 221 aa, Sorghum bicolor
  Clone ID: SORBI-28MAY03-C74277_1.pep
LIPVAAMAALFASRGGVKCTILTTPVNATVIRSAVDKANNSFRGTSALAIHISTIPFPDVGLPPGVESVVGISSESDLHKLLEGVQRLREPLDRFLADHRHPRPDAVVVDSFYLWAADVAAEHGIPRLSFLGSSLFARACNESLLRHNPFALAPDDPDAVVSLPELPHRVAMRRRQVMDPRKDQLEWEYNQLVHAADRRSYGEVFNSFAELEPDYVEHYRT

SEQ ID NO: 38825 - protein, 213 aa, Sorghum bicolor
  Clone ID: SORBI-28MAY03-C74465_1.pep
MVAPDVKAETMKLMDQRGGLEAEVDAIIARLTEPGGPGITGGLVDAEGFPRSDIDIPNVLAQRRRLAELRNDHKDVTNKIDKNLEILHSAKLSRNEQSTSRRSDTTSPSHIGSSQSEPMEEDHVSKLPFAMIDEITDGSPASVDGLQLGDEIVKFGNVEAGDQLQERLVSEALSNEDSHVSLVIIRQGSAMNLTITPRKWHGRGLLGCHFRML

SEQ ID NO: 38826 - protein, 105 aa, Sorghum bicolor
  Clone ID: SORBI-28MAY03-C74546_1.pep
AFQLGMAPVYMAFLRFMGDENEAKNYSYSLEVGANGRKMVWEGTPRSVRDSHRKVRDSHDGLIIQRNMALFFSGGDRKELKLRITGRIWKEQQTPDGACIPNLCS

SEQ ID NO: 38827 - protein, 87 aa, Sorghum bicolor
  Clone ID: SORBI-28MAY03-C74564_1.pep
LKPVTIRTKTPERRHCPDTARNHRRRKKNSPDGFNGFLQNWLKLSSIWLKGRGAHAMKLVPALQPPVATACQVPYSCIKTRWNRRRE

SEQ ID NO: 38828 - protein, 179 aa, Sorghum bicolor
  Clone ID: SORBI-28MAY03-C73925_1.pep
NEADDSSLAIADICPSIDGSLVAVAIQSFSGVMLLACDLVGKKLSFLKVITMEKSYIPTSLASSLSSELLWTVMGASNMPNQASSHLLTRLRIIPCFQKDRLSSSDAGPATLEDGEVPHGEKLLLALQGSLDVTKQEEVLASVLAALKVSMHKMLVKKHYSEERREQRKRGRNDKKIKN

SEQ ID NO: 38829 - protein, 74 aa, Sorghum bicolor
  Clone ID: SORBI-28MAY03-C75811_1.pep
MVGVGAGLGLGMEGPSCGALLRELQQIWAEVGESEAEKNKALLDIERECLEVYRRKVDDANRTRVQLHQSVAAK

SEQ ID NO: 38830 - protein, 142 aa, Sorghum bicolor
  Clone ID: SORBI-28MAY03-C75822_1.pep
SPPPTPPTLGVCCRICRPRLPSRARRAPLVLPHPHAQQQRRHRMALPQVFVGGRYLSGAEEVRRLHESGELRRIVAPALTNPAFPGNCARCGGERYVLCSACDGSHKRYSLKGGGGFHACTECNENGLVRCPACCCIPVPAA

SEQ ID NO: 38831 - protein, 87 aa, Sorghum bicolor
  Clone ID: SORBI-28MAY03-C75888_1.pep
ECFSFIDEAISSGGNCLVHCFAGRSRSVTIVVAYLMKKYQMSLESALSLVRSKRPQVAPNEGFISQLEKFQKSFQVEQERRMQSVQN

SEQ ID NO: 38832 - protein, 168 aa, Sorghum bicolor
  Clone ID: SORBI-28MAY03-C75899_1.pep
PSYIIEEDIKHFHSVQKQVCDSYDPSFYPRFKKWCDDYFYIKHRGERRGVGGIFFDDLNDYDQETLLRFATDCADSVLPAYIPIIERRKDTLFTEEHKAWQQLRRGRYVEFNLVYDRGTTFGLKTGGRIESILVSLPLTARWEYDHKPEVGSEEWKLLDTCINPREWI

SEQ ID NO: 38833 - protein, 202 aa, Sorghum bicolor
  Clone ID: SORBI-28MAY03-C75845_1.pep
MSPENPHLRFLLFLAVAAVAAGGAAAGTTLTASLSGDQIKIRWTGLPAPDGLDYVGIYSPPSSRDRDFLGYLFLNGSASWRSGSGELSLPRLPTLRAPYQFRLFRWPANEYSYHHVDHDQNPLPHGKHRVAVSADVSVGDPARPEQVHLAFADGIDEMRVMFLCGDRGKRVVRYGLQKEDEKEWKEVDTDVSTYEQKHMCDW

SEQ ID NO: 38834 - protein, 113 aa, Sorghum bicolor
  unsure (1)..(113): unsure at all Xaa locations
  Clone ID: SORBI-28MAY03-C74811_1.pep
LRPGHASLTHIAPLGVSPIAQEDFGVPSARMGXLEYEQYEVRAGESSLARLYAADDAVLADPEKAMREQGWDLVARVYPGGQNVTLDLARFRRTLARMHAHALQQRRRRRERR

SEQ ID NO: 38835 - protein, 204 aa, Sorghum bicolor
  Clone ID: SORBI-28MAY03-C74857_1.pep
MDLLQSSYAPDGASSPEDSAAASSPDSSPLRLPSKSAAPAVDDTALALSSAASAARPLDPSLHLVAFNPTADQLWAPILGPQHPHAPISSASGNRNHKLGHVEDAAVLPFLFDEQYNTFHRFGYAADPSGLHIVGDAQTQAPEPDTVYNLAPSEHKRRRLLAKADNQEEPAPPGAKNPASEEWILHNKQSPWAGKKEAPPAELT

SEQ ID NO: 38836 - protein, 51 aa, Sorghum bicolor
  Clone ID: SORBI-28MAY03-C74975_1.pep
FLVGGRKMEGDFKVLEDLDIPEELRDMFISIPEEMFRIDISSTEIRKSHGL

SEQ ID NO: 38837 - protein, 291 aa, Sorghum bicolor
  Clone ID: SORBI-28MAY03-C7522_1.pep
ARGSDIAEQSGEVVSRSVTGSMISRDFGYADAHMDRHMVPRQIPAATGPADWREALEIVALGLPEQSVEGMKVICHELTQAADPESTVLEDLIKEADRLVSCLAVMVPKTFNFSLSGASSRSCKYVLNTLMQTFQIKRLAHAVKEGTLDNLITELLLWLLDERVPLMDDGSQLLKALNVLMLKILDNAERTSSFVVLINLLRPWIPSRWPSPTPAESLAVKNQKFSDLVVKCLIKLTKVLQSTIFEVDLDRILQSIHIYLQELGMEEIRRRAGADDKPLRMVKTVLHELVK

SEQ ID NO: 38838 - protein, 212 aa, Sorghum bicolor
  Clone ID: SORBI-28MAY03-C74994_1.pep
MAAPSHVLPFLSPAGGCAASSARARSHSHSGRRAGILRCSAAAGQAGFFTRLGRLIKEKAKSDVEKLFSGFSKTRENLSVVDELLTYWNLADTDRVLDDLEEALLVSDFGPKISFRIVDTLREEIRDGKLKSGAEIKAALKRCILELLTSKGGNSELNLGFRKPAVIMIVGVNGGGKTTSLGKLAYRFKNEGVKVLMAAGDTFRAAARDQLE

SEQ ID NO: 38839 - protein, 100 aa, Sorghum bicolor
  Clone ID: SORBI-28MAY03-C75278_1.pep
AEEYYGEKSLEDAVMPPAAFINQIAAGLRRALGLQLFNFDMIRDVRAGDRYLVIDINYFPGYAKMPGYETVLTDFFWEMVQKDGVDNQQEEKGANHVTVK

SEQ ID NO: 38840 - protein, 137 aa, Sorghum bicolor
  Clone ID: SORBI-28MAY03-C76244_1.pep
MEERGVAAMGRAQAFLFLSLLWVAMLSAAPRVVQSLPYDYSSSSECLPEPLEPQYGGGILRNANFSAGLQGWSSFGYGAVEEGLSESGNSYGVARNRTRPYQSVSQKVFLQNDTHYTLSAWLQVSNGSADIRAVVKT

SEQ ID NO: 38841 - protein, 88 aa, Sorghum bicolor
  Clone ID: SORBI-28MAY03-C7626_1.pep
VEELFEEGSAMLEERLGRNLSLKAASPPFRCAICQVDQEPFEDLMTDNGGGYCSSPYAPWGGPHLCLDCRKKKDAMEGKRSSRSTACR

SEQ ID NO: 38842 - protein, 146 aa, Sorghum bicolor
  Clone ID: SORBI-28MAY03-C76319_1.pep
KQRNYYESLLLEVKEETEREISAATEKAMSIKLQKLEAKFEKFREEKRFLDEVNGNLVKNQEMWIETIRKAQAREQAALRLKDEKIEKLQEELRGLIAHFECQSAIAQAQDSFSSDIPGDMILPVASESSSSGGDPVGGTRNGKQN

SEQ ID NO: 38843 - protein, 208 aa, Sorghum bicolor
  Clone ID: SORBI-28MAY03-C7630_1.pep
GPTGAGFTPHLIFVKAGEDVSAKIMSFSQHGTRAVCILSANGAISNVTLRQSATSGGTVTYEGRFEILSLSGSFLLSENGGHRSRTGGLSVSLAGPDGRVLGGSVAGLLTAASPVQIVVGSFDADGKKEPKRKKLAPSPSDPSPAPLKLAPATTGVAAGPSSPPSRGTLSLSESSSGAPSPPHAGASGGGGGHGQQQQPGVFSGLSWK

SEQ ID NO: 38844 - protein, 103 aa, Sorghum bicolor
  Clone ID: SORBI-28MAY03-C83892_1.pep
YPKKGAHAVAGIALQCIRNDGKNRPAMSEVVEKLEQLQDPKYNIAAPQVNTRQMSSSSSGSVPRSPMKAQPSPRRLSGSASPKPAAAAAGSPLPGSCRTAQVH

SEQ ID NO: 38845 - protein, 146 aa, Sorghum bicolor
  Clone ID: SORBI-28MAY03-C8357_1.pep
LRLSAWSPRSPWDRNPCVRLLSAQLSPAGSCLFASVQSASPPPANPPVHLTVVALSPGCAYVYWAGLGVFHSGIEVHGVEYAFGAHDYSISGVFEVEPRQCPGFKFRRSICMGTTCLDPLQIREFMEIQSVNYNGDTYHLISKNCN

SEQ ID NO: 38846 - protein, 63 aa, Sorghum bicolor
  Clone ID: LIB3476-047-P1-K1-H7.pep
HRMSVMIPGSKKERNLSMRFQSGQKSSGKFCLFSKVQSASPPPGNTLVYLNVYDLTPVNGYVY

SEQ ID NO: 38847 - protein, 225 aa, Sorghum bicolor
  Clone ID: SORBI-28MAY03-C8393_1.pep
AQASNKSSGRKGIRGGSPNIGRRAPVGNDPSPPSASALRAALWLRLQFIIRLLPVIMADRRVGQTLASAILGLLATRMIYEDADLPLPPTNANALRREMDSLLEPPLDVLLDRPGESLFERLLCVLHALLGSYKPSWLKSRSASRSTNRTQRDFSAFDNEAAEGLQSALDHMELPETIRRRIQAAMPLLPPSRHPSMQCQPPQLSLAALTPLQSRTSGAGPQQKS

SEQ ID NO: 38848 - protein, 81 aa, Sorghum bicolor
  Clone ID: SORBI-28MAY03-C84011_1.pep
DADLQADLDYACSQLGVDCGAIQPGGACFEPYTVRAHAAYAMNQLYQAAGRHPWNCDFRASATLTSENPSYGACVYTGGAQ

SEQ ID NO: 38849 - protein, 93 aa, Sorghum bicolor
  Clone ID: SORBI-28MAY03-C8403_1.pep
GSLKSRIHSRPAARLSPGILESQAEIATAQGRISRPAGHPPARHEARAPRLGLLFSEGGAASRPTSGEETAQAGNLPCRQCSCRHPPRQLSLY

SEQ ID NO: 38850 - protein, 250 aa, Sorghum bicolor
  Clone ID: SORBI-28MAY03-C84041_1.pep
WYGQVQLCREKSTGNIYAMKKLKKTDMLVRGQVEHVRAERNLLAEVGSHCIVKLYYSFQDVEYLYLIMEYLPGGDMMTLLMREDTLTENVARFYIAETVLAIESIHKHNYIHRDIKPDNLLLDKNGHMKLSDFGLCKPIDCSKLSTLNEDEPMTDENLRESMDIDRSLSDTANGRRWRSPNEQLQHWQNNRRKLAFSTVGTPDYIAPEVLLKKGYGLECDWWSLGAIMYEMLVGYPPFYSDDPLVTCQKV

SEQ ID NO: 38851 - protein, 103 aa, Sorghum bicolor
  Clone ID: SORBI-28MAY03-C76631_1.pep
NRKLGVAADAVKRRHSDLKLVVFDIYQPLLDLVQNPTNAGFFESRRACCGTGTIETSVLCHQGAPGTCTNATGYVFWDGFHPTDAANRVLADALLLQGLQLIA

SEQ ID NO: 38852 - protein, 297 aa, Sorghum bicolor
  Clone ID: SORBI-28MAY03-C76647_1.pep
MFRRKHDPGFNSNDAEQREAKISELKAALGTLSARGEKYCSEACLKRYLEARNWNVAKARKMLEESLKWRAAYRPEDIRWPDVSVEAETGKMYRASFRDREGRTVVVMKPTKQNTSSHEGQIRFLVYTLENAIFSLPEGQEKMVWLIDFTGWTVAHASPLKTSRETANILQNHFPERLAIAFLFNPPKVFEAFYKVIKIFLDPKSIEKVNFVSQKDEESMKVMYKYIDPEVLPVEFGGKNNVVYNHEEYSELMIQDDIKTANFWAVDAKTDHTNPAINGNLVPEVAPQPSLLAAKAS

SEQ ID NO: 38853 - protein, 110 aa, Sorghum bicolor
  Clone ID: SORBI-28MAY03-C767_1.pep
GAAAWEGEPLGFEVSTEPMPQLPDPETPDFWEGPQWEALGFFVQYMWAFGVVFGLIACGVAVATYNDGATDFRDTPAYKESQSHEFPWEAEWASADVFEGNPTEVAPALE

SEQ ID NO: 38854 - protein, 212 aa, Sorghum bicolor
  Clone ID: SORBI-28MAY03-C76859_1.pep
QMTIRNWLFFVLLASFTYSAFGWNNTDTNNDVLLQFRVNKTQTVSCPNFTVCANPSTIAWNISLGGVPVQFCHERCRLLFFVNFGTHTPGVSPGSIFSAASYTSTRDLYRFMDMLNNWFPYILGYEFDWAYGGFSESGGFPDVDLSNATIHDITLTINALTATVANTSGSSVLNLYYDLIFTVLGNWHPNLTNITALPVGDAFVRNGTSFST

SEQ ID NO: 38855 - protein, 223 aa, Sorghum bicolor
  unsure (1)..(223): unsure at all Xaa locations
  Clone ID: SORBI-28MAY03-C7592_1.pep
MEKWDLDDTLQNKKMIWAIANERYKGXRSTFCATYRAYDTYDERMRHKPEDLHIVEWHYLVLYFGTEEFQKLSNMNSQNRSLAQTKHMMGSKPFAQCSYELRDPQTGEEPNDVDLWVKTHSKGGKWTNDASKAVYESACSKIAEKEKESPNSFIPLVERNLIFQEAYKQTTRAKSSKVHGNGYLARYPSRRQLMTERFEDQACSEMASHMENEELKATLETRT

SEQ ID NO: 38856 - protein, 83 aa, Sorghum bicolor
  Clone ID: SORBI-28MAY03-C76025_1.pep
ARPRRLSRVRFGMARRWVLPLRLVARGSCSKRAGVRPLCAHLGVALGTCALLTALRRDSIGEYSVNDAWNFDELEQQITKGYI

SEQ ID NO: 38857 - protein, 189 aa, Sorghum bicolor
  Clone ID: SORBI-28MAY03-C75985_1.pep
ARGITLLGTAFMEGGTSEPAAPATFLRGEEGASPESARARFERMIRRVQADVCAELEAVEGSGTSNGGGGGALFREDAWTRPGGGGGISRVLQGGRVFEKAAVNVSVVYGVMPPEAYRAARPEAAAAAAAGGDKAGPVPFFAAGISSVIHPVNPFAPTMHFNYRYFETEAPKDAPGAPRQWWFGSGTDL

SEQ ID NO: 38858 - protein, 161 aa, Sorghum bicolor
  Clone ID: SORBI-28MAY03-C76048_1.pep
KPKLQFVGSCRNKEDLDRLQKLKDRSTELQIDELVEFHRDISYSDLVRLLGGAISGLHSMTDEHFGISVVEYMAAGAIPIAHKSAGPMMDIVLDEDGHQTGFLASEKEEYTEAIIKVLRMRESERQEMAAVARKRAQRFSDQRFHEDFTEAVRHILSAREA

SEQ ID NO: 38859 - protein, 173 aa, Sorghum bicolor
  Clone ID: SORBI-28MAY03-C7606_1.pep
TDVQCLHRWQKVLNPELVKGPWSKEEDEIIEQMVNKHGPKKWSTIAQALPGRIGKQCRERWHNHLNPGINKDAWTQDEEIRLIHAHQTYGNKWAELTKFLPGRTDNAIKNHWHSSVKKKVDSYRSSGLLAQFQGLTPVEYTPGGLNVDSSSAMTNQISEDSGFNVFREAEDSM

SEQ ID NO: 38860 - protein, 140 aa, Sorghum bicolor
  Clone ID: SORBI-28MAY03-C76218_1.pep
AALDTMSKANAPIWLTEIDVAPGPNQAHYLEQILREVYAHPAVHGIILWTARHPQGCYVMCLTDSNFRNLPTGDVVDKLIAEWKTHSHAGVADADGYYEAELFHGDYKVTVSHPVANSTVVQSLSVDRETDTDSEYTIHV

SEQ ID NO: 38861 - protein, 279 aa, Sorghum bicolor
  unsure (1)..(279): unsure at all Xaa locations
  Clone ID: SORBI-28MAY03-C77280_1.pep
MWYLCVFYHRLLDYRRPEVESLAELFAGPGGGESVEWRMPENHHVDSPFHLVRLPGDERLAAQVANRSLLVKGIYELWGHGTTYEELEKSVTEYPDERKLPFLTPESTFKIVIDSFGKVISSQEQNEIIESLTYIPFKGRVNLKKPDHKFFVMETDDYGSNNGLPPVVKRSIFFGREVGAADRHLLPTYQLKSRKYIGPTAMDAEMAFLMANQGLARPGKLVYDPFVGTGSILVAAAHFGAMTXDIDIRVVRDGRGPDCNVWSNFEQYKLPEPLCLLRA

SEQ ID NO: 38862 - protein, 138 aa, Sorghum bicolor
  Clone ID: SORBI-28MAY03-C77139_1.pep
MASIAPPSSASCARTSRLCYDASLLPSATSNTLRTIGSICLENTRRLRKFHISHAVGGSSENVIINGKANPSNAVQADAVALGTIAADMAPVVDGFSVDDDELDLDFPTEGFSSIPEAIEDIRQGKYVIVVDDEDREN

SEQ ID NO: 38863 - protein, 67 aa, Sorghum bicolor
  Clone ID: SORBI-28MAY03-C7733_1.pep
MFGYDPSRYAGRDEDVSDMEADFATIEMEEKRSARIARQEDEEELRLIEEEERREQERKRRKMARGR

SEQ ID NO: 38864 - protein, 280 aa, Sorghum bicolor
  Clone ID: SORBI-28MAY03-C77275_1.pep
LSINSLLCAMAPACILLDRTVAFRSHPQETEPFDLGERAERVVGAERAKDLVGATTAELPKLSSREDIEASIAEYLLAMTPDLEIVKPPEISYLTMQRPLSSEPIPNHGWSLRDGAAAAAADKNLVVLFPGSYRPAYSYNRWYLILDLDADASSSSSLSAIPGIRFEYSDCYMTAGYGVVIMTREGGAFVLAELLFDFYHRRRGPWLGMLCLWQSSLCSWVYKHGELPAEVSRTWKTHMSFPVQSRNMNLFCWVDLRCGLLLWDLGRHCEVDSSDDLLDL

SEQ ID NO: 38865 - protein, 169 aa, Sorghum bicolor
  Clone ID: SORBI-28MAY03-C76339_1.pep
LLIRGFALPVGGAPGACGRVTAPHPFWVLRLIGYPVDIPKEQRTDTGCGAHTDYGLLTLVNQDDDICALEVQNRSGEWIYATPIPGTFVCNIGDMLKVWTNGIYQPTLHRVVNNSPRYRVSVAFFYESNFDAAIEPVEFCREKTGGAAKYEKVVYGEHLVQKVLTNFVM

SEQ ID NO: 38866 - protein, 189 aa, Sorghum bicolor
  Clone ID: SORBI-28MAY03-C76349_1.pep
LNEHSGVIGAFNCQGAGWCQVGKKNLIHDEQPGTVTGVIRAQDVGYLAKVADHSWNGDVIVYSHVGGEVVYLPKNASLPVTLRSREYEVFTVVPLKHLPNGVSFAPIGLVGMFNSGGAVREVRFSEDADVELKVRGSGTVGAYSSTRPRSVPIDSKAVGFCYDDACGQLTFELGLSEQELYFWTVSVGY

SEQ ID NO: 38867 - protein, 187 aa, Sorghum bicolor
  Clone ID: SORBI-28MAY03-C76366_1.pep
EWAMTELLQNPVSMSKVCNELAGIIGSGRNLEESQIVQLPYLRAVIKETFRLHPPAPLLLPRQPETATKVIGYTIPKDAQVLINVWAMGRDANIWSEPEKFMPERFLAKTVDFKGGDFDLIPFGAGRRICPGMPLAIRMVHLVLGSLLNQFKWKLPADVERNGVEMAEKFGVTLIKAVPLYAVATPI

SEQ ID NO: 38868 - protein, 220 aa, Sorghum bicolor
  unsure (1)..(220): unsure at all Xaa locations
  Clone ID: SORBI-28MAY03-C76391_1.pep
MRSFIYVLPLFAVAAIAQMTYTGVNLSGGEFGQVPGQLGTTYQYPTTADVDYFIGKGMNTIRLPFRWERMQKTLNGXIDQQEWSYIQNLVNYVTSKGAYAILDPHNQGQYNGNQIGSAAVPATAFADFWAKIAVMYKDNQKVIFGLMNDPNSMDSAVWKGICNTVIDAIRKTGAQNLILVPPVEWSRVQNWSTNPGTPQSVGMLGVVDPANNFAYEVHQF

SEQ ID NO: 38869 - protein, 209 aa, Sorghum bicolor
  Clone ID: SORBI-28MAY03-C76427_1.pep
MERGGTAMSLLLLLVLVLTVSPWQAAGAAGGGRPRVPAILVFGDSIVDTGNNNAVLTLTKSNFRPYGKDLNGGVPTGRFSNGRIPTDFVASRLGLKDLVPAYLGTDLTDDDLCTGVSFASGGTGYDPLTSTLVAVLPMQEELNMFAEYKEKLAGVVGDAAAAGIVADSLFLVCAGTDDIANNYYLAPVRPLQYDISAYVDFLVEQACDF

SEQ ID NO: 38870 - protein, 322 aa, Sorghum bicolor
  unsure (1)..(322): unsure at all Xaa locations
  Clone ID: SORBI-28MAY03-C76585_1.pep
LVKIQGRAVRAIPPRSLHGAAAPAAAAARRRPALRPPPFPGPWRLXSATALHARAGGVAFSLQTNVRLLKPNRRVRRSRDPYYDLDEDDEEEAEFDEEDDDEGYESDDDMSGLEYPGVLYSNSPRASSKRQELEPPLVKENWEGRQPKTRDNYGSPGKSKSLYPRSKVGRSSMDLKNMDSEVELKNASISRSLFQKLQEDYDFDDKWLPLIDYLCTFGLKESHFTYIYERHMACFQISQASAEERLDSLLSAGVKSKDMKRILVRQPQILEYTLGNLKSHVDFLVSIGVPNTRIGQIISAAPSMFSYSVEHSLKPTVRYLIE

SEQ ID NO: 38871 - protein, 227 aa, Sorghum bicolor
  Clone ID: SORBI-28MAY03-C7659_1.pep
TRVDHSYSCALERSFLYHGRMYVSSWHICFHSNVFSKQISHLFLLLQTLQIRRSQHAVINPAITIFLRMGAGGFGVPPLGCPDGRVRYKFASFWNRNHTFRSLQRAVKNFQMMIEAEKQERAQSALRAHSSSRKTSKQEINVPEDCAALTGQLQPFVKEEVLVPVFNGTFPCTAEQFFSILLSDDSNYITEYRTDRKDKDINLGQWHIADEYDGQVRELNCKSICHS

SEQ ID NO: 38872 - protein, 154 aa, Sorghum bicolor
  Clone ID: SORBI-28MAY03-C77524_1.pep
LNVTGAAVGGTALAAQGLGASNVLIDSGTVITRLAPSVYRGVRAEFTRQFAAAGYPTAPGFSILDTCYDLTGHDEVKVPLLTLRLEGGAEVTVDAAGMLFVVRKDGSQVCLAMASLSYEDQTPIIGNYQQKNKRVVYDTVGSRLGFADEDCNYV

SEQ ID NO: 38873 - protein, 139 aa, Sorghum bicolor
  Clone ID: SORBI-28MAY03-C77548_1.pep
SPITGDPKPYAVLASVHARFGCVPLAHVQDACDAHVLLMEAPRAEGRYLCAAGGYSAAHLARLLASRYPPFRPGDRLSRDFDDDASCSPPVVSSRRLLDLGFRFRYGVEDVVKDSVAQCLAHGFLEQPEGQSTFRLSAV

SEQ ID NO: 38874 - protein, 90 aa, Sorghum bicolor
  Clone ID: SORBI-28MAY03-C77552_1.pep
SEKLDKFIEVSMVARKDRARMAETQKILANSKIEAARLNDEAAEKQLKCKMLDTYRELLLATTTDMNSHALTEREKALESMRLALFATDN

SEQ ID NO: 38875 - protein, 167 aa, Sorghum bicolor
  Clone ID: SORBI-28MAY03-C76991_1.pep
MAAPLTAVRARLLPVTCCTAAGTGGPPPPSKNSSNRPPHLLPLPTTGTTAPPLLRLEAPAPAPSAAAAAVAAMMLALSPDEALAVGGEFGILEGRSFALLHPLVMGGLFAYTLWAGYLGWQWRRVRTIQDEVNELKKQLKPAATPAAVGAGADSSSSSSPPAASPKS

SEQ ID NO: 38876 - protein, 144 aa, Sorghum bicolor
  Clone ID: SORBI-28MAY03-C76996_1.pep
MDRRRWIGKAAAAAAVAVALLLLSTPPPGGARREPHVNNNGRSFVFNYTLAKAVVEYAAAVYMTDLTALYTWTCSRCNDLTRGFEMTCIIVDVQNCLQAFIGVDHNLNAIIVSITGTQENSVQNWIKDIIWKQVNLNDPNMPNA

SEQ ID NO: 38877 - protein, 328 aa, Sorghum bicolor
  Clone ID: SORBI-28MAY03-C77003_1.pep
MGSVPEETAALDNIGDLVSDLREVYESGRTQDMEWRQSQLRGLVRLLEEKEEEIFDALHEDLGKHRVEAFRDEVGVLKKSVVDKLQNLKKWAAPEKAHTPLVAFPATALVVPEPLGVVLIFSCWNLPIGLALEPLSGALAAGNAAVVKPSELAPSTSAFLAANIPKYLDSKAVKVVEGGPEVGDKLMDYPWDKVLFTGSSRVGRLIMTKAARHLTPVALELGSKCPCIVDWLDSNRDSQIAVNRIIGAKWSTCSGQACIAIDYLLVEEEFAPILIEMLKSTLERFFTRPEYMARILNEKHFQRLSGFLADRRVASSVVHGGHFNPKTL

SEQ ID NO: 38878 - protein, 191 aa, Sorghum bicolor
  Clone ID: SORBI-28MAY03-C77008_1.pep
MSNPTAIGIDLGTTYSCVGVWMNDRVEIIANDQGNRTTPSYVAFTENERLIGDAAKNQVARNPTNTIFDAKRLIGRKFNEDVVQKDIKLWPFKVEAGSDGKPLMVVKHKGEVKKFHAEQISSMVLTKMKETAEAFLNKPIKDAVVTVPAYFNDSQRQATKDAGAIAGLNVLRIINEPTAAAIAYGLDKKGK

SEQ ID NO: 38879 - protein, 122 aa, Sorghum bicolor
  Clone ID: SORBI-28MAY03-C77030_1.pep
MERVMSQLHYSPAALAGILPKRVQQLLIQGGFLDDPSDSTILHHVQEWQELYSPCFWMGTFAPIQLIFNIILAHFLFKKFRWWRQRLKAAAPTRTWLLTASDKDGDALGPIASQSAGHRRTA

SEQ ID NO: 38880 - protein, 183 aa, Sorghum bicolor
  Clone ID: SORBI-28MAY03-C77051_1.pep
MPRAPASLRLQAAASTATATPSQQQAAASSPPQQQQQQAAVSVDSDMVVILASFLCALVCVLGLALVSRCACRLCGRGPAAASSSAQQEQAPPPKGLKKKAIDALPTVPFTAAASSSSDCAICLAEFAEGDALRVLPRCDHAFHVACVDAWLRTRATCPSCRAGIVAAPAQQLPQPPVVSPGG

SEQ ID NO: 38881 - protein, 162 aa, Sorghum bicolor
  Clone ID: SORBI-28MAY03-C77067_1.pep
MMFLGELEEVLELTEMADFQKCVVPLFRRIAQCLNSSHFQVAERALFLWNNEHLFDLISQNRQVILPIIYPALERNARWHWNQSVLNVTMNVRKMFLDMDERLLLACQTNFQEEEKKRAASEERRRLVWEHLERNAAFHPVTGDIGFAVPPTSAPLVAPTMT

SEQ ID NO: 38882 - protein, 133 aa, Sorghum bicolor
  Clone ID: SORBI-28MAY03-C7774_1.pep
MKGKADTSKKDEGRLRAGGGAGKRKKAAASGKPKRPPSAFFVFMSEFRQEYQAQHPGNKSVAAVSKAAGEKWRAMSEQEKQPYVDQAGQKKQDYEKTKANFEKKESTSSKKAKTDDDDGSKSEVDDEDDEDDE

SEQ ID NO: 38883 - protein, 139 aa, Sorghum bicolor
  Clone ID: SORBI-28MAY03-C77758_1.pep
MDFFTEYGEGSRYKIEEVIGKGSYGVVCSALDTHTGEKVAIKKINEIFEHVSDATRILREIKLLRLLRHPDIVEIKHILLPPSRREFKDIYVVFELMESDLHQVIKANDDLTPEHYQFFLYQLLRGLKYIHTANVFHRD

SEQ ID NO: 38884 - protein, 206 aa, Sorghum bicolor
  Clone ID: SORBI-28MAY03-C77766_1.pep
MSSSARFDLRASSQQLQPPPSHASMSDGGAFANAGNLEHCARYLNQTLVTFGFPASLDLFATDPVSIARTCNCIYALLQQRQRDIEFRESTNDQRQRMQSDISRLEAKIERMDAQLAAKDRELATLTRTEAKNTAALKSQIDKLQQERDEFQKMVIGNQQVRTQQIHEMKKKEKEYIKLQEKLNQVLMEKKKESSRSGMEIMNLLQ

SEQ ID NO: 38885 - protein, 90 aa, Sorghum bicolor
  Clone ID: SORBI-28MAY03-C77789_1.pep
DDPVQVVQQARSLRLPRQTAAQWTPTTMTLLSEHWHHLTSRMQATLNLPVARGLASATNVWICRCKNVKRNIDQVCTAYIVRQQEHELVN

SEQ ID NO: 38886 - protein, 216 aa, Sorghum bicolor
  Clone ID: SORBI-28MAY03-C7884_1.pep
HEGHQCEETAARLIEALLNNVRIREAKAAKNAIAPLSMYLLDPQTQSQQGRLLAALALGDLFQNEGLARSTDAVAACRALVNLLEDQPTEEMKVVAICALQNLVMYSRANKRAVAESGGVQVLLDLISSSNPDTSVQAAMFVKLLFNNHTIQEYATSETVRVITASIEKDIWASGSANEEYLKALNALLSNFPRLRVTEPATLCIPHLVTSLKTGS

SEQ ID NO: 38887 - protein, 242 aa, Sorghum bicolor
  Clone ID: SORBI-28MAY03-C77388_1.pep
MRKAYRDSIKVLEADIQHANTLASEFPRDYDGACLQMRLSYSPAAHIFLFLVQWTDCSLAGALGLLRILIYKVYVDGTTTMSTHERKASIKEFYAVIFPSLLQLQRGITDVEDKKQKPVCMERYTKKDEDERGSLSDIDVEREEECGICMEMNSKVVLPNCTHAMCLRCYQDWSSRSQSCPFCRDNLKKTCPGDLWIYVEDQDVVDMETVSSENLRRLFMYISKLPLIVPDVIFSVYDSHIK

SEQ ID NO: 38888 - protein, 108 aa, Sorghum bicolor
  Clone ID: SORBI-28MAY03-C77385_1.pep
QQQACRILHCAASMKNNVTHTLANLGTSFAGKKWQAHWNRGCVPLESLLFKINQSSVKLAVDKYLVGLFDFTSFVWHESPYRLVSAAAARLHSYEGRIHAGFQLNTWT

SEQ ID NO: 38889 - protein, 157 aa, Sorghum bicolor
  Clone ID: SORBI-28MAY03-C77364_1.pep
NSKEEKADAEKDRNRRSSEGRPSDERREKLHDREKDKPKSENKKILDAKQLIDMIPRTKEELFAYDINWTIYDKHELHERMRPWISKKIIEFLGEEESTLVDYIVSCTKDHVHAEKMLDLLQSILDVEAEMFVLKMWRMLIFEIKKVESGLSGRAKS

SEQ ID NO: 38890 - protein, 149 aa, Sorghum bicolor
  Clone ID: SORBI-28MAY03-C77401_1.pep
FLFRRNLLRQLVSQLANNHDRFLKQLNGTHKAHVHTKREAHILARYKPRLNTTSLIWQLKQADEYTRDAIQNLNNTRHITVYYEDIVRNRTKLFDVLDFLKVPRRNLVSRHVKIHTRPLSEQIENWDEVYSALNGTQYEGFLNAADYVV

SEQ ID NO: 38891 - protein, 140 aa, Sorghum bicolor
  Clone ID: SORBI-28MAY03-C77404_1.pep
MQPKEGTDGYPVKARKPYTITKQREKWTEEEHGKFLEALKLYGRSWRQIQEHIGTKTAVQIRSHAQKFFSKVVREPGASNAIEIPPPRPKRKPLHPYPRKCADSTIANRPIGEPKNAPISSSSGSDQENGSPVSVLSAMQ

SEQ ID NO: 38892 - protein, 198 aa, Sorghum bicolor
  Clone ID: SORBI-28MAY03-C77436_1.pep
MAIRVPSMELHRSSPLLSGGRGRNTCPQKKPFLVQAKRLGGLEKASTRLGTQESGQPKKRAPLVRGTVSPPLPVPGNIPRPPYVGTKYVPEIAKEVQMHDNESIVHMRAACELAARVLDYAGTLVKPSVTTDEIDKAVHKMIIDAGAYPSPLGYGGFPKSVCTSVNECMCHGIPDSRELQDGDIINIDVTVYLNGYHG

SEQ ID NO: 38893 - protein, 292 aa, Sorghum bicolor
  Clone ID: SORBI-28MAY03-C7850_1.pep
IGLYDVQGPIPLVKNVFIPPDLEEDGLPVALEDAMPLHSFLAPVDTCKDRIAAALETLRPTSSWERGAASGQEEDTVLLGGRGFGTAMSALIEYLSSEYGSTFALARVFAFLSGAPDYGAGLLDTRRYGEQYASKGVDADLALLPEQIPFYRDLAAVAVQSGVCVDIFAVTDEYTDLASLKFLSIESGGSLFLYANTDDSTLPQDIYRLLSRPYAFGCVLRLRTSSDFEPGNSYGHFFPDPQYENVQHIICCDSFATYAYDFEFAHNNGFSRHTDPAVVQIAFQYSVIEPVK

SEQ ID NO: 38894 - protein, 90 aa, Sorghum bicolor
  Clone ID: SORBI-28MAY03-C78526_1.pep
TPGCSPRGSGDLSNWPLGNYRGFVMSAAVQGEGRCSKPTVEVGVAHIGCPEDAAAFVALAAAVDLSMDACRLFSPRPRKELSPLRADLLR

SEQ ID NO: 38895 - protein, 176 aa, Sorghum bicolor
  unsure (1)..(176): unsure at all Xaa locations
  Clone ID: SORBI-28MAY03-C7877_1.pep
KAFLPVVYNIFNLHGATLMARENDRFLKQIAFHLLRLAVFRNDSIRKRAVVGLQILVRNSFNYFKNTTRLRVMLTITLSELMSDVQVTQMKSDGSLEESGEARRLRKSLEEMADVRSKDLLKDCGLPVTALEAVPEGSSDXXWSWVEVKHLSKCLVQALDAGLEHALLGSAVTVDR

SEQ ID NO: 38896 - protein, 160 aa, Sorghum bicolor
  Clone ID: SORBI-28MAY03-C77572_1.pep
MSRAAAMAAVAAAVLVCATALGVVGAEVVDEFGGGASFIFGDSLVDAGNNNYIPTLSRANMTPNGIDFAATGGAPTGRFTNGRTIADIIGEMLGQADYSPPFLAPNTSGGAILNGVNYASGGGGILNGTGKVFVNRIGMDLQVDYFNVTRRQLDALLGKE

SEQ ID NO: 38897 - protein, 112 aa, Sorghum bicolor
  Clone ID: SORBI-28MAY03-C77575_1.pep
MNQLKRNPSSSSRRGTGTLAAVAASSARVARSPAAPADGSAPGAHGSNSTDGNHAALAAASPSLLSFQAAGFPAWWLSSSPMGSSEGMHPPGGFTNILQSNISPENFHLVGN

SEQ ID NO: 38898 - protein, 158 aa, Sorghum bicolor
  Clone ID: SORBI-28MAY03-C77599_1.pep
MASGSSNGEPSTAPQANRWYDLRLGSSCRDPSPTAKFCTLRYEFKPASIDKTQAGSLQSTKDNRVTVEFHNNQPGKPKVTFEGSQEEYKDNDGVLFFDGETFRLERLHRAVKRLRHVRVPGESAAVNLAATTTGMGAESQSPPLPKVSKSQTMSKPAV

SEQ ID NO: 38899 - protein, 249 aa, Sorghum bicolor
  unsure (1)..(249): unsure at all Xaa locations
  Clone ID: SORBI-28MAY03-C77624_1.pep
MHTTHIPLSLALSDPPCQLASLHCQIYLSTVPHGPQQRANLTMAAAARLLLGVLALLAAVQAVYGKSAVLSLRELDGRRGAATETWSRRYGDAKLAEMLGEHKKAGAARTATTVLELKRHSLVAIPDDDPAAHDRYLRRLLAADESRANSFQLRIRNDRAAAASTQSGSAEVPLTSGIRFQTLNYVTTIALGGGSSGSPAANLTVIVDTGSDLTXVQCKPCSACYAQRDPLFDPAGSATYAAVRCNASA

SEQ ID NO: 38900 - protein, 119 aa, Sorghum bicolor
  Clone ID: SORBI-28MAY03-C77671_1.pep
TVTANGRQESGSPQSPLGGKTDVFDLPFHMARDQIEESLRTKMTSIKARMTQLQDAQKGAEVTSEATDRELELEAQLVEARSIIQEQASIMSKHFTKSDKTSGRRHSGLDGEREAPAEV

SEQ ID NO: 38901 - protein, 85 aa, Sorghum bicolor
  Clone ID: SORBI-28MAY03-C77623_1.pep
KKNAVPRLKKIVSLSCPDAGRLSLSLCGAPSPDGCRRLRCSLSSRRSQPRLCSSLANMVPLPQRSPCRALCWARAHPLPRRWRIA

SEQ ID NO: 38902 - protein, 274 aa, Sorghum bicolor
  Clone ID: SORBI-28MAY03-C77461_1.pep
GKKRAQEKAKETEDVSGDGTTAVAENESSKPVPDESDKETGDAGDKDNEESTKKFGIVTDEDSQADKDIAEKISNMIEEWLKTRPPPPPPPPPVQPSADSSGVDKAKNDSDDKNDADTDKRAVNETERSETASPDRRKDREHDKRDRDLERHDRERERERVRRDREKDHKHREADRLYRDRLKEWESREREKEYQRYSEKEKERDREHNRRREILKQEDDSDEEDNRKRKRRSSSSLEDRKRRRQREKEEDLADKIREEEEIAEARRRAVELQR

SEQ ID NO: 38903 - protein, 116 aa, Sorghum bicolor
  Clone ID: SORBI-28MAY03-C79128_1.pep
TRESVDQTMSISTETDRNARFVKLVYSLAPACASGASTEVSSIVFSTVGASPSVVFVSAGAMASCRVFSTVEFSCVTTEAHPPGHPAAGGRSPGALASAGGMAAGGGFSTDAFTCA

SEQ ID NO: 38904 - protein, 121 aa, Sorghum bicolor
  Clone ID: SORBI-28MAY03-C79138_1.pep
DPHYIRTGVVTKKSDVYSFGVLLLELLTGMEAFCAEEGRLLTAVLAPRLRAGGDARGMVDERLGSAYDAAEAAAVAALAAACVGENPSLRPSMADVVRTLEQSAQGSISAVGRRSDGHGKV

SEQ ID NO: 38905 - protein, 285 aa, Sorghum bicolor
  Clone ID: SORBI-28MAY03-C79145_1.pep
PTGYFWKNLLWYTIVFGTIAAISRKVVADELQVIDPEGAMCLAVHQTHYMPKRWRGKENSELVRREFETLFQYTIIMLLEEMASIFITPYLLIFEVPKRVDDILARGSDFTIYVDGVGDVCSLSMFDFKRHGNRNYGSPFNGLKGLRSSQGKMEKSFLSFQSVYPSWEPNADGKQFLSNLQKFKEKQIRQQALAQYQAMEASGFVAGTRGQRDDTFQQLNSDIHGHAETTLPPVYNLSPLGLLDTDQRTHPYILDWYYVCHPPHQDRAEAPQFEQAFPETGVITS

SEQ ID NO: 38906 - protein, 193 aa, Sorghum bicolor
  Clone ID: SORBI-28MAY03-C79150_1.pep
QVDSLEKAGNIAPGLIDHANQIGKGTEAASVPEASSQQVGNVEEAYTQKEVSISDLPTETETLHSDAIIKELPQNDAPDNMQTDAVEAPKQSHISGDNTVFEADTEAPSTAQDHTEDDTGNEVLEEHMVSPELLQSQTSGEKLVGKTATEQKVGPEDPESQSENFAAEPEPFVQGAVEQVEVEVESKTTVEVS

SEQ ID NO: 38907 - protein, 203 aa, Sorghum bicolor
  Clone ID: SORBI-28MAY03-C78038_1.pep
KKSKNRWKSVFQSTPCRLRWTSSSTTGTGVPTSSLPAMCSCARLLPPLFSPAPSPKPRPAFPHGPTPARSRALVALAGAASRDDAPAPLSGFDFLALKRELEEEEEEEEAVVAVDSKEGGAVNVDDGGSGAERSAGGTRRRRRRQMARRSALLAKQVISVSSARSLGFVSQLWIDAASITDSSRGQVNTSLLIAELDGQAQYV

SEQ ID NO: 38908 - protein, 130 aa, Sorghum bicolor
  Clone ID: SORBI-28MAY03-C78057_1.pep
LYLDSLRKKVPARLASGAHVLGNVLVHETAVIGEGCLIGPDVAVGPGCVVEAGVRLSRCTVMRGARVKQHACVSSSIIGWHSTVGKWARVENMTILGEDVHVCDEIYSNGGVVLPHKEIKSSILKPEIVM

SEQ ID NO: 38909 - protein, 138 aa, Sorghum bicolor
  Clone ID: SORBI-28MAY03-C78078_1.pep
ENQLTGAIPEGLGRGSGNGGNVLTSLYLGGNRLSGGVPASLLANSGLGMLNLSRNALGGGIPDAFTPRSYFMLLDLSRNRLTGGVPRSLSLAAYVGHLDLSHNRLCGSIPAGPPFDHLDAQSFASNSCLCGGPLGKCT

SEQ ID NO: 38910 - protein, 258 aa, Sorghum bicolor
  Clone ID: SORBI-28MAY03-C7826_1.pep
MDERSKIGLRATSLVIYPGNDGDSPSSSYYQSEDQQDSSKRVERVQIHNDEPQGNLLGKQCTNKRTRKPTKRYIEELSDIETHDSTVKISSPAKRPAHDEVLMKPRVAPFNEADSLGTIYPTRKDTLGGFSVHVPYVSRMRRGRPRKDFISFADKEPSVEPKGIQTAVEVILEKDGDKGNHLRKAPEVPVKVSSEKGHIEAVDCEGVRNLQAKLYSAVAKPKINRGLTRKHHRALTLCEVVKLVDGVARFGAGKWSEI

SEQ ID NO: 38911 - protein, 136 aa, Sorghum bicolor
  Clone ID: SORBI-28MAY03-C7819_1.pep
HEGYDGESSHWASSAFHINDATRYKSGSKSIGKHKAASESGRPPKSKVQKITESHQEGPIVMSNFLRMPAQILPSTADFHISDSLSEFGISDSEFNYSEDLFQEVDDFEFFPDQGDSGLLPGIEELEPLSDFTDIG

SEQ ID NO: 38912 - protein, 250 aa, Sorghum bicolor
  Clone ID: SORBI-28MAY03-C7836_1.pep
HEDFLCIALSEMLRILTNNATIAKGPSAAKVVQPLFSLLSKADMGPEGQYSTLQVLVNILEHPECRADYNLTPRQTIEPVITLLNSSPPAVQQLAAELLSHLLLEDHLQKDTTTEQAITPLIQVLSSGLPNLQQRAIKALANLAIAWPNTIAKEGGVFELSKVLLQSDPPLPHVVWESAASVLSSILQYSTEFFLEVPVAVLVQLLRSGTESTVVGALNALLVLESDDSTSAEAMAESGAVEALLDLLRS

SEQ ID NO: 38913 - protein, 156 aa, Sorghum bicolor
  Clone ID: SORBI-28MAY03-C78416_1.pep
MVFGQVVIGPPGSGKTTYCNGMSQFLSLLGRKVAVVNLDPANDALPYECAINIEDLIKLSDVMAEHSLGPNGGLVYCMDYLEKNIDWLEEKLKPLIKDHYLLFDFPGQVELFFLHSNARSVVNKLIKKMDLRLTAVHLIDAHLCCDPGKYVSALLL

SEQ ID NO: 38914 - protein, 97 aa, Sorghum bicolor
  Clone ID: SORBI-28MAY03-C79545_1.pep
SINTTLKRKMLLVQSSSSSTSPWLNVQTPSREQCRERRVHELNSPLGDMRTEGSLAVQWAVCLAASWFFTRPPAVLLLYPIQCVALKLQFETEATIQ

SEQ ID NO: 38915 - protein, 92 aa, Sorghum bicolor
  Clone ID: SORBI-28MAY03-C79733_1.pep
ARGKHPLAIVNIKNRADGTPIQQLISELEEATGSVLVSRETNKVILYRGWGAEVAQESSKESSADEGEKEVISPQLLEAIRLECGLLPGDSE

SEQ ID NO: 38916 - protein, 180 aa, Sorghum bicolor
  Clone ID: SORBI-28MAY03-C79690_1.pep
MKFMKLGTRPDTFFTADSVRSVCTEVATDLQILVDNCIYHLHKFPLLSKCMLLQALCADAGDVVELPGFPGGAEAFEACAKYCYGITITVSARNLVPLRCAAAHLGMSEAADRGNLAAKLDAFLASCLLRRWKDALGVLHSTRHYAPLCEDLGLTSRCVDAVAALIVSPDTGLPAKSSTS

SEQ ID NO: 38917 - protein, 127 aa, Sorghum bicolor
  Clone ID: SORBI-28MAY03-C79764_1.pep
AAAVAGGRSLRSLAPDSAAPHGAARARPPARTARRAAPSCFLPHFRVQGVASPRGLPGAACDGLLIGPCLAHCQSEQLGTWNTKPGGSPTIQNKGIAKSVGDWYFDRAEVKAIDCRYPCDNTCHHII

SEQ ID NO: 38918 - protein, 175 aa, Sorghum bicolor
  Clone ID: SORBI-28MAY03-C78908_1.pep
METKDVSPLPATAAAAAPVPAPASQPPPAPPSMAPPPQQHQHQHQHQHQPPPPFAQQAAPASSPAGSMPGGMRLSFDQMSGKAAGEQHHHSAPMLYAASPQSAPGAGAPGAPGANVLGMGELMRKKRGRPRKYAPDGSMALALAPISSASAGGAAAPGQQQQHGGFSISSPPSDP

SEQ ID NO: 38919 - protein, 148 aa, Sorghum bicolor
  Clone ID: SORBI-28MAY03-C78987_1.pep
FYRMGLSDKDIVALSGGHTLGRAHPERTGFDGPWTKEPLKFDNSYFVELLKGDSEGLLKLPTDKVLVEDPEFRQYVELYAKDEEAFFRDYAESHKKLSELGFTPPRSSFTCKSGNKQKSLLVQAAAGVAVAAAVVALAYLCESNKKFI

SEQ ID NO: 38920 - protein, 151 aa, Sorghum bicolor
  Clone ID: SORBI-28MAY03-C7903_1.pep
TKNGVRVRTTRSGGGGFARKVKFESIVMRNVTNPIIVDQGNSDHLPASSEAVAPAAATAVQVEKINYIDITGTSASKHAVTFSCSDAKPCRHLSLVNVNLTQVDGTKALSYCRKAFGRSIGTVIPESCLSKEDFVQHVPQRSQDGEEDSDS

SEQ ID NO: 38921 - protein, 210 aa, Sorghum bicolor
  unsure (1)..(210): unsure at all Xaa locations
  Clone ID: SORBI-28MAY03-C79075_1.pep
MAAAPVAPPPASADDEIVYESMPCIRVYKNRVERYFGTEFVAASTDAATGVASRDVVISPNVSARLYLPPRLGDGNGAAKLPILVYYHGGGFCLGSAFNPTFHAYFNAFAGLATALVVSVEYRLAPEHPVPAAYADSWDALAWVVSHPPPAASADRDPWIAGHADFSRLYLXGESAGSNIAHHMAMRVXHGGRAXHGARIRGLVMIHPYF

SEQ ID NO: 38922 - protein, 158 aa, Sorghum bicolor
  Clone ID: SORBI-28MAY03-C79082_1.pep
KGAPLLVNVYPYFAYSGSGGQVALGYALLSSDASAASSSSVTDGGVVYTNMFDAIVDATHAAVEKAGVQGLELVVSETGWPSGGGGDGATVENAAAYNNNVVRHVGGGTPRRPGKAVETYLFAMFNENGKAEGVEQHFGLFQPDMSEVYHVDFTAASS

SEQ ID NO: 38923 - protein, 92 aa, Sorghum bicolor
  Clone ID: SORBI-28MAY03-C79083_1.pep
YNTLFRCTRRKLAEYPSLHAYTRDIYQMPKVAETCDTEAIMAGYFKTLFPLNPGGIQPLPPATCDRESLLRPHGREALSSAADTPLEAAAVS

SEQ ID NO: 38924 - protein, 190 aa, Sorghum bicolor
  Clone ID: SORBI-28MAY03-C84077_1.pep
MGMGAAARRKPAAAAAALLPIWLICLVCASRAAAEPYIGVNYGEVADNLPSPDETAKLLKSTSISKVRLYGVDAGLIRALAGSGISVVVGVANGDIPSLAADPAAASRWLAANVLPFVPATTISAVAVGNEVLESGDATLAAALLPAMQNLRAAALAAGDGAAGIRFSTVNTMGVMAQSDPPSTGAFHPD

SEQ ID NO: 38925 - protein, 215 aa, Sorghum bicolor
  Clone ID: SORBI-28MAY03-C80169_1.pep
MAAVGTLPGAAAVAGASVRQRQCRGAAPSFVAAYVREGTRLVYGRQLRPAPVLACPARRRFLGAAAAAASSGSAGDAEPQGFAERYPTLVTGFFFFLWYFLNVIFNILNKKIFDYFPYPYFVSVSHLFIGVLYCLIGWSFGIPKRAPINSTLLKQLLPVAVCHAIGHVTSTVSFAAVAVSFAHTIKALEPFFNAAASQFILGQPVPLTLWLSLVP

SEQ ID NO: 38926 - protein, 180 aa, Sorghum bicolor
  Clone ID: SORBI-28MAY03-C80145_1.pep
MRVLLLLLLLLLSVASSPATASGDGGVAVPVGTTVLSSFCSPSSVDATMYYDQCQLRFSDQDFLAGAGNMPESAASNMNKVSAGNAAAFDALVTRLVAAVSDAASNRSGRYATGQAGFPPEDMNVYALVQCTQDLTTAQCRECLADLRGQIPRLLARGVRRERRRVRRPGHAARRRGVRR

SEQ ID NO: 38927 - protein, 180 aa, Sorghum bicolor
  Clone ID: SORBI-28MAY03-C80214_1.pep
IRAAVAAAGAGDDDVTEDDLELLPYHKQVIKEMLRLCTPVPLLLPRETMEDTEHLGYHVPARTHIFFNAWAISRDPAVWRSADEFMPERFADDDMKTTTTEYLLGQDFDEFVPFGASWRRGCSGVGFAAPAMELELALASLLYHFGWELPAGRPPAAPKDELSVRLKTTLHLVAKPWSSQ

SEQ ID NO: 38928 - protein, 246 aa, Sorghum bicolor
  Clone ID: SORBI-28MAY03-C80228_1.pep
NLQLADAKEVLKGIQQEPGVRYPVLTPNLRGFEAAIAAGAKEIAVFASASESFSKSNINCTIEESLVRYRGVTAAAKKHGLTIRGYVSCVIGCPVEGTINPPKVAYVAKELYNMGCSEISLGDTTGVGTPGSVVAMLQAVMAFVPVDKIAVHFHDTYGQALANILVSLQMGINVVDSSVSGLGGCPYAKGATGNVATEDVVYMLHGLGIETNVALNKLMEAGDYISKELGRPLGSKTATALRKLTT

SEQ ID NO: 38929 - protein, 158 aa, Sorghum bicolor
  Clone ID: SORBI-28MAY03-C89662_1.pep
MAGRNIGVAVDFSSCSKAALRWASTNLARNGDKLILIHVNNSYQNEQGAVHLWEQSGSPLIPLAEFSDVTRTYGVSPDKETIEILTQVANQRGIEVFAKIFYGDPAKKLYEAVDLVSLSYMVIGSRGLSTLKRALMGSVSTYIVNYAACPVTVVKEHM

SEQ ID NO: 38930 - protein, 162 aa, Sorghum bicolor
  Clone ID: SORBI-28MAY03-C89692_1.pep
LQKTYYKTASLISNSCKAVAILAGHTAEVSVLAYEYGRNLGLAFQLIDDVLDFTGTSASLGKGSLSDIRHGVITAPMLYAMEEFPQLQEVVDRGFDNPANIEIALDYLRKSRGIERTKELAREHADRAVKAIESLPDSDDEDVLTSRRALIDITERVITRTK

SEQ ID NO: 38931 - protein, 282 aa, Sorghum bicolor
  unsure (1)..(282): unsure at all Xaa locations
  Clone ID: SORBI-28MAY03-C8945_1.pep
MAGKHGRNGYDDDNVNPFAGGSVPPATNSRLSPLSHEPADFYNVDIPLDSSKDLKKKEKELQAMEAELNKRERELKRKEEAASRAGIVIEEKNWPPFFPLIHHDISDEIPIHLQRMQYLAFSSFLGLVACLFWNIIATTTAWIKGEGVMIWLLAIIYFISGAPGAYVLWYRPLYNAFRSVSAFQPGWLFLFSPFHIIFCXWAAVAPPFPFKGKSLAGILPAIDVISKNAIVGIFYFVGFGLFSLESLLSIGVIQQVYMYFRGSGKAAEMKREAARSALSSPF

SEQ ID NO: 38932 - protein, 157 aa, Sorghum bicolor
  Clone ID: LIB3476-055-P1-K1-H9.pep
HHDISNEIPIHLQRMQYLAFSSFLGLVACLFWNIIATTTAWIKGEGVMIWLLAIIYFISGAPGAYVLWYRPLYNAMRTESALKFGWFFLFYMIHIIFCVWAAVAPPFPFKGISLAGILPAIDVISKNAIVGIFYFVGFGLFCLESLLSHRVIQQVYM

SEQ ID NO: 38933 - protein, 296 aa, Sorghum bicolor
  Clone ID: SORBI-28MAY03-C8973_1.pep
LVQALKELRRTPEMFVQLKRMFGSVASVPARVFLTGATIQMAAGSVSDLKPNFEEYLANWRYTNDEVFVLDGGHGSASNGFVVTSVMSTGQYFQVAELYTVTFLCIVSQDSETAISWAEKADLTEQSRQDLLKKLHAVRLAANKKLSAVEGVKQTAERNLSTSTNGSTPLPHEDPPKKIAPVCDGLKKVLVKSAQPSQHVANQFDPLFWWFHSIRLKFGKIHIVLPSGKLMFLFSLLFSTMYVLRRKTAGLKRTVFQQASSLRRAFLDALQLAFSVQMNPLAAVQQVPQAPRGSWL

SEQ ID NO: 38934 - protein, 174 aa, Sorghum bicolor
  Clone ID: SORBI-28MAY03-C8979_1.pep
LRAMITKGLIEPISSVFVNLVNADFTAKQRGVRITEERILLDGSPETPIDYIQVQIANVESKFPSAISESGEITVEGRVKDGVPHLTKVGAFQVDVSLEGSLILCRQVDQPGMIGSVGSVLGEENVNVSFMSVGRIAPRKHAVMAIGVDEEPSKATLTKIGEIPAIEEFVFLKL

SEQ ID NO: 38935 - protein, 178 aa, Sorghum bicolor
  Clone ID: SORBI-28MAY03-C8983_1.pep
LREQKRIAAEKVCDICGRPMLPGKDVATLLNCNTGNLACSSRNSSGAYHLFHTSCLLHWTILCQYEMLNDQIASKGKSNRGRKAKNAPKKSKITSIVCPECQGTGIHVNGEELEKPSISLSEMFRFKMKAIEAHKAWLKSPEVLENCSTGLHFPSEHVENSEEKVMPLKSLAFYASDG

SEQ ID NO: 38936 - protein, 242 aa, Sorghum bicolor
  Clone ID: SORBI-28MAY03-C8054_1.pep
MATKKVLCKFFMHGACLKGEYCEFSHDWSDQANNVCTFYQKGACSYGSRCRYDRARVSRNPTVPPPPSTSSAARRVTSNSLQLLSYSHAPHTGHQTDSSNQRHQISVDVLAHSASKPAWRNDFQHDIVSDDGIDWSSNRNLLNETSLKPADLPICSFAAAGNCPYGEGCPQMHGDLCATCGKMCLHPHRPDEREEHIKVCEKNHKRLEALKRSQEIECSVCLDRVLSKPTAAERKFGLLSEC

SEQ ID NO: 38937 - protein, 141 aa, Sorghum bicolor
  Clone ID: SORBI-28MAY03-C80535_1.pep
GGTGIQNTQFYWETANPSSSSSRGSSGSNSLGFERQSTSSLLESSVFPWTDLTPDKNSQVHLEEELKWPDLLHGTFTDTPATMQNLSQSLYEDVIKAESQFNIEGLCAAWSQNLQPQQHLQVVSDLYDKDLQRMSLSFENI

SEQ ID NO: 38938 - protein, 145 aa, Sorghum bicolor
  Clone ID: SORBI-28MAY03-C80632_1.pep
MRLPDLPAARGCPSATSTTGSDNNYICIDSCGSCGYPLNLSSSNRSTSEVGSSYKKSLKKGLISFISVDLSRFTQVDEVSCFPLAWRSYRPKTKLLCRKCGASIGYGYGEPAVLCSFDPASSSSSSTSQKYLIKIQALQPSDGTQ

SEQ ID NO: 38939 - protein, 163 aa, Sorghum bicolor
  unsure (1)..(163): unsure at all Xaa locations
  Clone ID: SORBI-28MAY03-C80634_1.pep
MGRHSCCYKQKLRKGLWSPEEDEKLMNHITKHGHGCWSTVPKLAGLQRCGKSCRLRWINYLRPDLKRGAFSQEEEDLIIELHAVLGNRWSQIATRLPGRTDNEIKNLWNSSIKKKLRQKGIDPNTHKPLAEVEHSXAAPTISTERTSESSDVDPSSGGALGNL

SEQ ID NO: 38940 - protein, 194 aa, Sorghum bicolor
  Clone ID: SORBI-28MAY03-C79871_1.pep
MTDRPSFPALIALAVLVVGSYCCVATSAASPAVEDDELRGRTMRRRRAASVMVPITILKSAVSDGAVCMDGTPPAYNLDPGSGTGSRSWIVNLEGGAWCNSAKTCRLTKSSGRGSSDHMDKEIPFTGIMSSSSAVNPDFYNWNRVKIRYCDGGSFAGEAFDKNTGIYFRGQRIWNAVIRHLLSIGMASADRVLL

SEQ ID NO: 38941 - protein, 166 aa, Sorghum bicolor
  Clone ID: SORBI-28MAY03-C79864_1.pep
MASEVSSEINQNQGGEEETRLDLPPGFRFHPTDEEVVSHYLTHKALNSSFSCLVIADVDLNKIEPWDLPSKAKMGEKEWYFFCHKDRKYPTGMRTNRATASGYWKATGKDKEIFRGHRVLVGMKKTLVFYTGRAPHGGKTPWVMHEYRLEGSLPSNLRRGAKDEWA

SEQ ID NO: 38942 - protein, 99 aa, Sorghum bicolor
  Clone ID: SORBI-28MAY03-C7994_1.pep
GRLSQKTMPYHHLYLGEHAIRSARQGTERAVRPSAEIFGGWRLARESRAGGRVEGDERSPAAVERAEGDRRVEGGEGDRGEELGTGREGSVFISSRSFF

SEQ ID NO: 38943 - protein, 137 aa, Sorghum bicolor
  Clone ID: SORBI-28MAY03-C79888_1.pep
FSILLLGDKLKDALNELEKACLSSTTALPFRLRGRLLEEYDQNQVSTISSCYEEALRRDPTCSYSMERLKGYYNVIQLLEAIALHLDSVNGKPCIWEELVSCFLRLFSDNTADYEDCISCTNTHGDEALVSSKLSSV

SEQ ID NO: 38944 - protein, 282 aa, Sorghum bicolor
  Clone ID: SORBI-28MAY03-C7997_1.pep
RTRGLQKSYNKNLSQKDLQLIASSVLLAALSVAPYDQKYGASHLETENEKERNMRMGNLVNFSLDSKRENREMPSRASLLSELVSKGVLSCASQEVRDLYNLLEHEFLPLDLASKVQPLLSKISKIGGKLSSASSVPEVKLSQYISALEKLTTLRVLQQASFIFQSMKIDMLSRRIPFLDFSVVEKISVDAVKRNFVAIKVNHLSGAVHLGTVDIESDGLSDPLSVLADSLDKGRIHIRPPVKKPSKLSESLVSWAGIVENEHKRLLARKSIIEKRKEELER

SEQ ID NO: 38945 - protein, 161 aa, Sorghum bicolor
  Clone ID: SORBI-28MAY03-C80062_1.pep
TGFINAMISNISFTYRSIYSKKAMTDMDSTNLYAYISIIALFVCIPPALIIEGPQLMQHGFKDAIGKVGLTKLISNFFVVGLFYHLYNQVATNTLERVAPLSHAIGNVLKRVFVIGFSIIVFGNKITTQTGIGTSIAISGVALYSFIKAKIEEEKKQIKSA

SEQ ID NO: 38946 - protein, 131 aa, Sorghum bicolor
  Clone ID: SORBI-28MAY03-C80119_1.pep
VLLLEIISGKRTAGFYQYGKFFNLTGYAYQLWQDGKWHELVDPALGDDLPVGEVIKCVQVALLCVQDSADDRPNMSEVVAMLGSEGITMPEPRQPAYYNVRITGLAVSSDSFGESSCRISSITITDHEEGR

SEQ ID NO: 38947 - protein, 276 aa, Sorghum bicolor
  Clone ID: SORBI-28MAY03-C81172_1.pep
QAEPALVSGDPTIQTIGNYEKAYVYKSSSGACAAFLSNYHTNAAARVVFNGRRYDLPAWSISVLPDCRTAVFNTATVSSPSAPARMTPAGGFSWQSYSEATNSLDDRAFTKDGTREQLSMTWDKSDYLWYTTYVNINSNEQFLKSGQWPQLTIYSAGHALQVFVNGQSYGAAYGGYDSPKLTYSGYVKMWQGSNKISILSAAVGLPNQGTHYEAWNVGVLGPVTLSGLNEGKRDLSNQKWTYQIGLHGESLGVHSVAGSSSVEWGSAAGKQPLTWH

SEQ ID NO: 38948 - protein, 132 aa, Sorghum bicolor
  Clone ID: SORBI-28MAY03-C81357_1.pep
MGNSTSGDKVHDKETHGTSSNITEETSVEKVKAPDLLERAKEEIEALAGAVHTKMEHHSSPHEKKGESHKEDKEGSLHNIKTHTNETHGTSDDINENTPVDKVKGPNVFERAKEEIEAIVEAIHPKSGSDSK

SEQ ID NO: 38949 - protein, 89 aa, Sorghum bicolor
  Clone ID: SORBI-28MAY03-C81342_1.pep
IIFLCLYFVAHKLTVLPVLLIALAKGGSKLEATTAQLARKPQVWSAIDFVTFLQVMQFLPHAWCHHMQYANVFASSRDFRPPAPHPFIQ

SEQ ID NO: 38950 - protein, 256 aa, Sorghum bicolor
  Clone ID: SORBI-28MAY03-C81368_1.pep
MAAAPPPPPPPPRPRLMVLPFPAQGHIMPLMELSHRLVDHGFEVDFVNTDFNHARILTALATGGDTGAAVHAGIHLVSFPDGMGPDGDRADIVRLAQGLPAAMLGQVEELIRAHKIRWVVADVSMSWVLDLAGTAGVRVALFSTFSAATFAVRMRIPKMVEDGIIDENANVKRNERIKLSPNTPAFDAADIPWVRLRSPMIKGMIKTNQMFALADTIVCNPFHAIESEALALLPKAALAIGPLEAPASNSASHLWP

SEQ ID NO: 38951 - protein, 157 aa, Sorghum bicolor
  unsure (1)..(157): unsure at all Xaa locations
  Clone ID: SORBI-28MAY03-C80332_1.pep
FFLLFFITFLGFGASLPACLPDSARLAPFPPLPTVHRIQGASEVRAHRPESPDDPRGRMSSLEEPLGLGDLPKLSINRLGRFLSPTARRSSPSDDHSTGKYSNSCNGSPFHGNSYPWHPQCRQADSSCDAVELRDLPRKVMWEXAKFVKIVEVGPRD

SEQ ID NO: 38952 - protein, 124 aa, Sorghum bicolor
  Clone ID: SORBI-28MAY03-C80393_1.pep
SGGGSGESIWTFPQMGSAAAAAAVYRGSVPSGLHFMNFPAPVALLPGQQLGLGPTVGGSGGGGGGAEGHMGILAALNAYRTQAATDPAASQGGGGGAGGGSGQQQQQHGGGRGDRHESMSTSDS

SEQ ID NO: 38953 - protein, 233 aa, Sorghum bicolor
  Clone ID: SORBI-28MAY03-C80346_1.pep
MRRHQASNGCVGTVTLAMSTTISISIQLALAAAGDLWPPTTGMPAVYVFGDSLLDVGNNNYLPGADVPRANMPYYGVDFPGGARPTGRFSDGYNVADLVAKAMGFKRSPPAYLSLSRRSGRRHRLVARGIGGVNYASGGAGILDSTFAGKNIPLSKQVRNFDATKAQMVLKLGATTVKHLLSKSLFLIAVGTNDMMAAFATSSSNNNGHVAVAAFYSDLISDYSATITTIICL

SEQ ID NO: 38954 - protein, 298 aa, Sorghum bicolor
  Clone ID: SORBI-28MAY03-C80455_1.pep
QQLNLARSAGPPELRDWTDMAESYDNLKNSVKVALVGKYTNLTDSYLSVVKALLHASVACSLKPSIQWIAASDLEDATAISAPDAHAEAWETLKGSSCILIPGGFGDRGISGMILAAKYARENKVPYLGICLGMQISVIEMSRHVLGLGDADSEEFNKDTPNHIVMYMPEVSKTHMGNTMRLGCRRTFFRKPDCLTSKLYGSPPHVDERHRHRYEVNPSFVPMLESAGLHFVGCDESRKRMEIVELQDHPFYVGVQFHPEFKSRPRRPSPPFTGLIMAATKQLGTISNSSNGYVGASG

SEQ ID NO: 38955 - protein, 169 aa, Sorghum bicolor
  Clone ID: SORBI-28MAY03-C80458_1.pep
MEISLEASWVGVQRHGQDLADRLAQGFSGLLLHAHPPQLPPWSPPALLPPKIVIPFDIDLPVVPFVGGVRRAAGAVDLPAVAVSSLVEIGGRLGQAGSELGAAVQQLARLVPVPVPVPVPVPEMGSRTAADRGGSGRGGGCSRCEDGCVHQRPFGKGWTHRVPRSGSGR

SEQ ID NO: 38956 - protein, 91 aa, Sorghum bicolor
  Clone ID: SORBI-28MAY03-C80533_1.pep
HGVHLPGWSAIGLYCNKLRVLHVNRCRHICDQSLLALGNGCPRLEVLHINGCAKITNNGLALFTISRPHVNLRVDEVLSIGPSIENLFQMH

SEQ ID NO: 38957 - protein, 138 aa, Sorghum bicolor
  Clone ID: SORBI-28MAY03-C81589_1.pep
LFVASLKKIIMNRPMYVRTNLQVKIGVQRREKNNARGQIKKIKINEKQQWPCSDRCVTARWAPPPSLIHPILRPDSGAPPTKSLKSSSSSSSSPLRRSLPTHSTLSTQKSHSPLSWPCRPIQTVRPSLPQHESRKLTG

SEQ ID NO: 38958 - protein, 197 aa, Sorghum bicolor
  Clone ID: SORBI-28MAY03-C81614_1.pep
TGSPSPHFHPRRHTPPSILAGREREREEGVAPMAAPLPLVDGVGPQVDAPAPLPLVDGVGPQVDAPAPLVDGVGPQVDGLPNTLNLLLRTATSSPNHPDQEQRNLLRASLLPVIVCKIKVRDAGPFMQLVRLPLAAANPHGNRTIPNRLAIERVAAAANVLFLLIDPLLPCLRRHPSRPHPPPWGEGLRGETPASRR

SEQ ID NO: 38959 - protein, 123 aa, Sorghum bicolor
  Clone ID: SORBI-28MAY03-C81585_1.pep
YSPEAQESRKQEMEKLLQDQEAMRTSLLQWCYASYSEVFSSWMHFCAVRIFVESILRYGLPPSFLSAVLAPSTKGEKKVRSILEELCGNVHSIYWKAEDDVAVAGLGGESEVHPYVSFTVNFV

SEQ ID NO: 38960 - protein, 141 aa, Sorghum bicolor
  Clone ID: SORBI-28MAY03-C81684_1.pep
MAPPDEGAGAAAGGARRRWVRRETLLGLALGQFVSLLITATGFASSELARRGINAPTSQSLLNYILLAVAYGGVLLYRRQPLTIKWYYYLILGIIDVEANYIVVKSYQYTSLTSVMLLDCWSIPCVIVLTWVFLKTKYGLR

SEQ ID NO: 38961 - protein, 112 aa, Sorghum bicolor
  Clone ID: SORBI-28MAY03-C8166_1.pep
LYNHHCTISLFQSTKISPLHNPQTSADNMNEPISHQCTRKTIIECAHDLHIYKNKIIAGDDGPAILSPRSGKLGPRARENSILTVPHQCYLTGLPQLIKIHPSKSPIQWSTR

SEQ ID NO: 38962 - protein, 187 aa, Sorghum bicolor
  Clone ID: SORBI-28MAY03-C80733_1.pep
LRSTCPPRFHRHCRPPCSAPSKPPAFLDPISVAFDGVRAVPAGGAVARCVVFDLDGVPQFRDLEGTNVCTTYRQGHISIVVNSSEIAPAPAPAAPPPPPFPTGGGAAAACAAARGPPRGAAGRPAPCGLCAPPLRRWLRRHGAGQPHRLRRVPAAPATLRMAQVGRTQAPVALGTRTQPVIENDYAA

SEQ ID NO: 38963 - protein, 149 aa, Sorghum bicolor
  Clone ID: SORBI-28MAY03-C80835_1.pep
PRPVTVRGYVLLMPFFGGVRRTPSEAECPAEALPNPDLVDRFWRLSLPAGATRDHPAANPFGPDSPELGSVDFRAPVLVVVGGLDMMRDRAVDYAERLAAMGKPVELVEFAGKPHGFYLHEPGSEATGELIGLVSRFLHSCACDRGAVA

SEQ ID NO: 38964 - protein, 67 aa, Sorghum bicolor
  Clone ID: SORBI-28MAY03-C808_1.pep
LVCLLFFVGFSSNKTIDYCSADMSVSSDIWKLKLCFSLFPGVLEFRIYTRHPFFLFAHMPYWPSQIS

SEQ ID NO: 38965 - protein, 212 aa, Sorghum bicolor
  Clone ID: SORBI-28MAY03-C80856_1.pep
LYELNVLGTRGPRRMNCVMHSIPASCLEAGGSVPCQPDSIVAHSVGEMFSSIPLSKSSTMDHSMHFSSSRFSDAITADAIVSGGQALSNADDEESTDTPLVLRNKAPRWHEQLQCWCLNFRGRVTVASVKNFQLVAAVMTQPAVGAPTPSQAAPLPLPAPAPGPPLPDQEKVLLQFGKVGKDIFPMDYCYPLSAFQAFAICLSSFDTKLACE

SEQ ID NO: 38966 - protein, 223 aa, Sorghum bicolor
  Clone ID: SORBI-28MAY03-C8094_1.pep
SNHIVGRYPYGMTYFHRPTGRCSDGRLVVDFLAQAFGLPLLQPYLQSRGKDLRRGVNFAVGGATAMDPPFFQEIGASDKLWTNLSLSVQLGWFEQLKPSLCSSPKKCKEYFSKSLFLVGEIGGNDYNYAFFKGKTLDDAKTYVPTVAAAVTDATERLIKAGATHLVVPGNLPIGCSSAYLTLHPGRNSSDYDADGCLKTYNDFAQHHNAVLQQNLRALRVKYP

SEQ ID NO: 38967 - protein, 214 aa, Sorghum bicolor
  Clone ID: SORBI-28MAY03-C80963_1.pep
MGIELSPLYEEFLREKKTVVRGMAHPFLFGNKFDSSRQEISRIDTVSMYGGLPVTPINMYRLFKRNDFVLLYPGGVREALHRKGEEYKLFWPDQPEFVRMAARFDVTIIPFGCVGEDDVLELVLDYNDQKNIPGLREWIESINKEAERVRDSVKGEDGNQDMYLPALLPKVPGRFYYLFGQPIEMKGMNNLVRDRRGTHGVFVPVYPPPAVSVS

SEQ ID NO: 38968 - protein, 138 aa, Sorghum bicolor
  Clone ID: SORBI-28MAY03-C811_1.pep
SLALEISQANLDSENQPHNDDQNIEQHTVLSSTLSPNHDKGQKGAQRTNKTKKLNQRKILGDAGLAQPSGVRRSTRTRSRPLEHWLGERLLYGPINDTLPAVIGIKSYSPGQDGKKTLKVKSFVPDQYSDLVAKSAKY

SEQ ID NO: 38969 - protein, 117 aa, Sorghum bicolor
  Clone ID: SORBI-28MAY03-C81889_1.pep
GTLPDTIGNMRALEQLDVAHNRLAGEIPESICELPHLKNFTYSYNFFCGEPHRCLEVPRIDDRQNCIAGRPDQRPGEECISFLHQPRVHCDGHGCIAPPLPPPPPPPPVHAPPPPVY

SEQ ID NO: 38970 - protein, 102 aa, Sorghum bicolor
  Clone ID: SORBI-28MAY03-C8179_1.pep
MVAGPHRRRTLGRAPPRREPAALVPPTRANLYIDPREKVTARYQLICPSKREVMIFGSLKQAGTLLPKAPKGWGWRTAILFDELADLLQGGALRIAAVVQLV

SEQ ID NO: 38971 - protein, 148 aa, Sorghum bicolor
  Clone ID: LIB3476-045-P1-K1-A9.pep
MQTRYRSVASVSTPGGSSVQMQESKEHELGSDWETAEDATISLDMKTPLSHFPPFRFGVEFEDVHRLADGQVKHSTEVFYAGSLWKVSVQAFNDEDPHGRRTLGLFLHRRKAELLDPLRKANLYIDPREKVTARYQLICPSKREVMIF

SEQ ID NO: 38972 - protein, 237 aa, Sorghum bicolor
  Clone ID: SORBI-28MAY03-C8198_1.pep
GLSRCSGRCGDGAPHGRRTGGRPRPCSWISFLPPSPTCSALLRGSCGNSSTLDGQWRGLVADVPLPLHLPMWRLRWGHGGPLCRAPARAPPACRWPSPRCGRGWSPPLAAPTPSPASPGAGAPVDPLFLVLSARRVSNGFWRHISASVLHDMVEAIQDSRFEAQFFFISLLPLSLKLSSRIIDVRPCKNVKFPICFDHGNQETCRVSFRNSKWQLINFLGSLKREGYLKIKKLAAQH

SEQ ID NO: 38973 - protein, 146 aa, Sorghum bicolor
  Clone ID: SORBI-28MAY03-C82161_1.pep
NKSRLSKWGLHFSSMNTRMPSGESQVSLGTNRNGLALYGSFSRSASRVSPDSDSTPALPTTSILCLKSCSTTDSSTRRTTDSMRPSCLYWPTMTRNSGLPSLSPSLTMRACSCACILSGVRQCGEMIVRTTPGWSCRMCSRRGLLP

SEQ ID NO: 38974 - protein, 154 aa, Sorghum bicolor
  Clone ID: SORBI-28MAY03-C82075_1.pep
AAAAFAPGTDGVGKRRRPWRARDNNGLADALDCSDQQQERIVLAATSSSSSLVRSCSLDRRVEFGVKNKSSWLPLHACSGSEATSPAPADPRDIIEPSSEDYTCVISRGPNPRTVHIFGDRVVEGGAGAAAEREESSPRPINLPARGDRGFFSL

SEQ ID NO: 38975 - protein, 90 aa, Sorghum bicolor
  Clone ID: SORBI-28MAY03-C81476_1.pep
MDKILAFSILSSSPADISAAGFFSTRLSWRTSAAGKPQTPQVDPAPQNQKAAEQQRGSPRVPAAEREREARPRFAPEFDGLNCFESIVSF

SEQ ID NO: 38976 - protein, 125 aa, Sorghum bicolor
  Clone ID: SORBI-28MAY03-C81494_1.pep
MLGRGAVRSLLDRLRAPPPGWNWNPSSAAMPPPPPPPPPSPAAANRACLCRFAHSTARCGGESGRTLPGNRAVFLDLGAGTGRRFAPSGALSLKGCLGWQDGGGGEFRRRVDGEAAGMKAQVLTT

SEQ ID NO: 38977 - protein, 176 aa, Sorghum bicolor
  Clone ID: SORBI-28MAY03-C81527_1.pep
MQAPARSSAPSSPLVSSAPPLPPRPQRVAAPSLRRRDLLLLPAALTLPMAAPASLPASARGLFRMPPPRLANRYFLVRAGESVYEGQGLLRTNPVAKTSVDSGLSPVGLRQTARAALELQRLGACEDDCWIWPSITQRAYQAAEIIAAANGINRRRIVPEYSFLDARGLGAFEWKS

SEQ ID NO: 38978 - protein, 186 aa, Sorghum bicolor
  Clone ID: SORBI-28MAY03-C81580_1.pep
KINYNCNICHAELIYSQVILTDGDPCTLRNMKENMELNNLCIEQEDSSVLKESKNKVECKYLSWEEVCESDLWGYQPDIVLGADIIYDPVCVPHLVRVLSVLLRRDRRQGKANATSGDEFETEAPVAYIATVVRNPETFNCFATAAADTKLSVLNITSTAAPSKFLPYMLSYDRSSVQLLKVTSLF

SEQ ID NO: 38979 - protein, 232 aa, Sorghum bicolor
  Clone ID: SORBI-28MAY03-C81547_1.pep
MELRTCAAPSSASLSSGRGAVPSSRLLSRQIWSRSAYCTVSSTSSSPVARRSRFSTLMATAYNTGTPDLADFNWDALGFQLIPTDFMYLMSCSSEGVFTNGKLVPYGPIELNPAAAVLNYGQGLLEGLRAHRKEDGSILLFRPHENALRMKTGADRLCMPAPSVEQFLEAVKLTVLANKHWVPPFGKGSLYIRPQLIGSGAILGVAPAPQYTFIVFVCPVGHYFKDGLSPIS

SEQ ID NO: 38980 - protein, 143 aa, Sorghum bicolor
  unsure (1)..(143): unsure at all Xaa locations
  Clone ID: SORBI-28MAY03-C81581_1.pep
GISFEFNAVAFDPSDPLPPTELSVAPGEAVAVHLPIGSGTPLPTTLRVVKQLRPAIVVCVDDHGCHRGDLPXVASRAQRRALHRGVPRVAGFAPVQLSNAAEAQAECLVSRTPTPGFHVEKRQAALALRWQESELVMVSAWRC

SEQ ID NO: 38981 - protein, 176 aa, Sorghum bicolor
  Clone ID: SORBI-28MAY03-C8252_1.pep
MATTTLFLLLCAAAALASAAAAADDTGFTTFKLYFHDIVAGTSSPTAVRIAQAASSNTSSTSFGAVVAIDDPLTTGPTRSSGTEIGRAQGTYTFADQTTFGLLMVMNFVFTAGDHNGSTLSILGRNEVLTDVREMSIVGGSGKFRMAKGYVQAHTIDSGATTGETVVQYTVNVKTP

SEQ ID NO: 38982 - protein, 207 aa, Sorghum bicolor
  Clone ID: SORBI-28MAY03-C82739_1.pep
MAMEHLRWRPTVNERDFIERALQSDLRVDGRHSFDFRKLKVTFGREDGSSEVQLGETHVMGYVTAQLVQPYRDRPNEGTLAIFTEFSPMADPAFEPGRPGESAIELGRVIDRGLRESRAVDMESLCVVAGKHVWSVRVDLHILDNGGNLIDAANIAALAALSTFRRPECTVGGDGGQQVTVHDPEVRDPLPLTIHHMPIAVTFAYFG

SEQ ID NO: 38983 - protein, 176 aa, Sorghum bicolor
  Clone ID: SORBI-28MAY03-C8276_1.pep
PTRPLKSLRLRIGLVQQEPVLFATSILENIAYGRDGATEEEVVEAAKTANVHGFVSALPDGYRTPVGERGVQLSGGQKQRIAIARAVLKDPAVLLLDEATSALDAESECVLQEALERLMKGRSAVLVAHRLSAIRGVDPIAVVQDGRVVEHGSHGDLLARPDGAYSRLLQLQLHRV

SEQ ID NO: 38984 - protein, 332 aa, Sorghum bicolor
  unsure (1)..(332): unsure at all Xaa locations
  Clone ID: SORBI-28MAY03-C82753_1.pep
MEHAKSGPSSWPELADVVPVPQDDGPSPVVPIAYRDDFREVMDYFRALYFTGERSPRALRLTAEAIELNPGNYTVWHFRRLILEALDFDLLEEMKFVGKIAECNPKNYQIWVQFYYXHHKRWLAEKLGPDIANKEHEFTKKILAIDAKNYHAWSHRQWVLQALGGWETEMEYCNQLLKEDVFNNSAWNQRYFVITRSPLLGGLTVVRDSEVDYTIEAILANPRNESPWRYLKGLYKGENNLLVDDERISGVCFKVLKNDWTCIFALGLLLDLLCTGLQPSDELKSTLEPIRSSHPETADADPATVVCCILQKCDPLRVEYWSWFKATLSQMS

SEQ ID NO: 38985 - protein, 151 aa, Sorghum bicolor
  unsure (1)..(151): unsure at all Xaa locations
  Clone ID: SORBI-28MAY03-C81687_1.pep
RGGAGHHRHRAGAAPPEARVPRRGASRLRPSTRQVERCQDYTYTTIIFKKIISEVELSSNVVIDELYEEFAQQGFIIKQDXHIYKEISFLSSTASNISSKLVSVVARLSCSSNMLEGDTGCALWPSSLFLSEFILSYPKIFSSKCCFEVSD

SEQ ID NO: 38986 - protein, 159 aa, Sorghum bicolor
  Clone ID: SORBI-28MAY03-C81688_1.pep
ARCRPCPSSRTTAPAEMAKTKPPPPPPSRRRPSASAAGRRRRSPPPCSTTAAPARPRPPPWPLPPRPSRPPSAPRTGSGRPSSTWPRHQPPHGLRTPPPSSAGSWTPTPKLTPLIPSCLRRLARRPPPSSPSCTRSSSSRSRSPWRRRTLTLSQGWRWT

SEQ ID NO: 38987 - protein, 182 aa, Sorghum bicolor
  Clone ID: SORBI-28MAY03-C81702_1.pep
MAVATTTARSWLLLLLLLLAVIVSAAAAASGKKQHERWRVSGGAVGGQVVEKERRRAVADSEAGSVTAVDVADAAGTAYRLHFITMDPGALFLPVQLHADMVFYVHSGRGKVTFIEEESSEQSSMEVQRGDVYNFEQGSILYIQSYPNARRQRLRIYAIFTSEGINADDPSKPKVEAYSSVS

SEQ ID NO: 38988 - protein, 244 aa, Sorghum bicolor
  Clone ID: SORBI-28MAY03-C81750_1.pep
MAATSSRRVSVPALAAAAAVLLLASVAAGDDHNGVYDPCADASVQRGDGFTFGVVFSGRDSFFSGGVQLSPCDSRLGLANRAQLALYRPQVDEISLLTVNSSSFDPSSSGGYMVAFAGKKYAARSTPVFVANTSYTATGFTLVLEFQKGTLQNLFWKPSGCSSCSGRSDFACVDSSCAIKTTSCKGKGGQVDCNPGIQLAFSGTDKHEAVLNPWYEVSKLRQYSLFGLFSNLKDSLTSQFSSFF

SEQ ID NO: 38989 - protein, 158 aa, Sorghum bicolor
  Clone ID: SORBI-28MAY03-C81775_1.pep
NVAVEGFCSSRCGKHGSAAPGAEVGSTYIWVGNAVKQCPGQCAWPFAQPLYGPQGAPLVAPNGDAGMDGLVMVLASMVAGTVTNPYRDGFYQGSRDAPLEAGTACPGVYGSGAYPGFPGSLLVDQTTGGSYNANGVNGRKYLLPALYNPATSTCNTLV

SEQ ID NO: 38990 - protein, 94 aa, Sorghum bicolor
  Clone ID: SORBI-28MAY03-C8337_1.pep
RKTQGRAMEVEKAKCECCGFTEECTPAYIAAVRAEYLGRWVCGLCAEAVGDEIRREGSAITTAEALDRHVAFARAAPSYRTASAAEDDLVAAVA

SEQ ID NO: 38991 - protein, 143 aa, Sorghum bicolor
  Clone ID: SORBI-28MAY03-C83540_1.pep
HEAGLLNFVDGLWSTSGEERIIVFTTNYKERLDPALLRPGRMDMHIHMGYCTPESFRILANNYHSVEYHDTYPEIEKLIKEVMVTPAEVAEVLMRNDDADVVLHDLVDFLKSKMKDANEIKAEHKEANNQLDEKKDDKDNEKK

SEQ ID NO: 38992 - protein, 112 aa, Sorghum bicolor
  Clone ID: SORBI-28MAY03-C837_1.pep
GASTCFHWCSSLAVFEAPRTKAAAIKVKTSADWDNAWATFKKKGKLFSDFSPDKYVTWNPRRSEYPLSEEVDPIKRTERSNLMLWTSPQFTLVGAIIIVLTLLIYTLVVPPK

SEQ ID NO: 38993 - protein, 160 aa, Sorghum bicolor
  Clone ID: SORBI-28MAY03-C83739_1.pep
HEVFFSILGKFGAIFASIPLPIFAALYCIFFAYIGACGLSFLQFCNLNSFRTKFIMGFSLFMGLSVPQYFNEYTSVAGYGPVHTGARWFNDMINVPFSSKPFVAVLVAFLLDNTIQVRDSGVRRDRGYHWWDKFRSFKTDSRSEEFYSLPFNLNKFFPSV

SEQ ID NO: 38994 - protein, 145 aa, Sorghum bicolor
  Clone ID: SORBI-28MAY03-C82190_1.pep
ATDGTCDANKANDEKVAAIDGFVEVASNNETALQEAVAIQPVSVAIDAGGRAFQHYSSGIFNGPCGTNLDHGVTVVGYGSENGKAYWIVKNSWSDSWGEAGYIRIRRNVFLPVGKCGIAMDASYPVKDTYGPAATAMDVLKMVLA

SEQ ID NO: 38995 - protein, 109 aa, Sorghum bicolor
  Clone ID: SORBI-28MAY03-C8220_1.pep
EDNGIGETQPFRGQGDATDQQTDRYQTSAGTLDALRERMKSIQAAAIGHFDGAQARPLASMNGSNVLHGGARLDGEPQQQSNIPPMDERALSGLQARMERLKSGSMESL

SEQ ID NO: 38996 - protein, 207 aa, Sorghum bicolor
  Clone ID: SORBI-28MAY03-C82248_1.pep
MNSIEPFNRLVRLAARAFYDDVSMKGDNQPKTSRGDNRGMAVVVLDALTRRQWVREEDLAKALKLHSKQLRRILRFFEEEKLVTRDHRKESAKNAKAHNAAAAAANDGQPVAKEGEEKVKMHTHSYCCLDYAQICDVVRYRIHRMKKKLKDELDSRNTIQHYICPSCNKRYSAFDALQLVSYTDEYFHCETCNGELVAESDKLASEE

SEQ ID NO: 38997 - protein, 159 aa, Sorghum bicolor
  Clone ID: SORBI-28MAY03-C82256_1.pep
MGGKGPRQVLQASAATKGPRRLTEVPAETSQHQAMEKITATINANLLQCCVCSGPLTPPLFQCTKGHVSCSRCCPADGYLDDEVECLMCDEPETATRFRAMEHILVGMRMPCPFRQHGCAKMIPYASVQAHKASCVHAPCHCPISGCTGYGSKPLREHI

SEQ ID NO: 38998 - protein, 279 aa, Sorghum bicolor
  Clone ID: SORBI-28MAY03-C82289_1.pep
PAAPPPGRPRGGCRRDPPPPRPPPAPPRPGPRRRPWGAFLLRARSPPVPRYPHCSRPLGGGRRPPPPAGERARGGADTGGAALRARRARGTRAPRSGWRHELRRGAPRVSSLAQGVVYWQPPESALDKIEKIVREPTVSKYGSDDGLPELREALLEKLRRENKLTKSSVMVTAGANQAFVNLVLTLCDAGDSVVMFAPYYFNAYMSFQMTGVTDILLGGCRPTPLQPVVPGLGLVLKENDPIPKLVTVVNPGNPSGAFVPRPMLERISDLCKNAGAWLV

SEQ ID NO: 38999 - protein, 162 aa, Sorghum bicolor
  Clone ID: SORBI-28MAY03-C82410_1.pep
MRRQTAASGGRWRGGDGSVAAAWWVGVVVLGGHLLSCAQAGLLESNPGLAYNFYQKSCPSVDSIVRSVTWAQVAANPALPARLLRLHFHDCFVKGCDASILLDNAQSEKTAAPNLSVGGYEVIDAIKAQLEKACPGVVSCADILALAARDAVSYQFRSSLWQ

SEQ ID NO: 39000 - protein, 133 aa, Sorghum bicolor
  Clone ID: SORBI-28MAY03-C84163_1.pep
HNSSTSETSDESEVSGFIILKANKVKPFRSWSIVQPTFFLFCFLRQRNVPLTTGSQKLGFRVSRRTRRHEWNAQQCLQPRMICLPGAKRWEGQSRTLELGTASSHQLLAFGCPATPLVMLSGGRSRLQRLLPT

SEQ ID NO: 39001 - protein, 111 aa, Sorghum bicolor
  Clone ID: SORBI-28MAY03-C84201_1.pep
VVNPKKTYGPAADIWSLGCTVPEMLTRRIPYPDLEWTQALYRIGKGESPAIPNALSKDARDFISQCVRSNPEDRPSASKLLEHPFVSKSIRSVRSMRPISSRSNSSTRGIN

SEQ ID NO: 39002 - protein, 99 aa, Sorghum bicolor
  Clone ID: SORBI-28MAY03-C84343_1.pep
APGDQPLSDDGEVTDWDDEDAADGSDIEMTPVSSERSVRGDDFAACDDDHNDGDGDDTSVDEELLKLAAKAEPDGEEEVDRKADEFIAKFREQIRLQRH

SEQ ID NO: 39003 - protein, 193 aa, Sorghum bicolor
  Clone ID: SORBI-28MAY03-C84400_1.pep
MFLRRRLLSTAAAAASARGPPPIRVSLTESAGRGVFATRPVSSGELLHSAQPLVSHPSHSLLHEVCYNCLRRKPGEGRASSGGYYFCSDTCSDHAKGFHDIDKDVDWSLFDYHCSSRGLKYPYMAKRLACMVISGSANADCLNILQPARLHQGTLIEMKEEFELLESTLRKAGFQEEATACILQFVSSHCDYS

SEQ ID NO: 39004 - protein, 158 aa, Sorghum bicolor
  Clone ID: SORBI-28MAY03-C8287_1.pep
MNGDIDLEDRAEELLVSLDPSKANPKKLPTPPPKRRLGINMLDGRNKLVEYRLPPKIEKKVVNEQRYVPDTRYVLHDIDQEAKEQALLYHSERLAIAYGLISTPARTPLRIIKNLRICGDCHNAIKIMSRIVGRELIVRDNKRFHHFKDGKCSCGDYW

SEQ ID NO: 39005 - protein, 124 aa, Sorghum bicolor
  Clone ID: SORBI-28MAY03-C82934_1.pep
ACMQFHKHSFCTTTAATAASRSIVSHGTTENQHVRHRRTTHKISMTKTNKTGTAGCGSLTIDRGDTERRARRSLGADASSSAASPKSQDFDGPCQATAAAPSRGRDAELQTVDGDDAEVQTVGG

SEQ ID NO: 39006 - protein, 169 aa, Sorghum bicolor
  unsure (1)..(169): unsure at all Xaa locations
  Clone ID: SORBI-28MAY03-C8289_1.pep
MICGNKSGGNCSSVSLDPLSYPPDDLKTQPQQGIGKSHHIATICGATVGSVAFAAVVVGMLLWWRHRRNQQIFFDVNDQYDPEVCLGHLKRYAFKELRASTNNFNSKNILGEGGYGIVYKGYLRDGSVVAVKRLKDYNAVGGXEVQFQTEVEVISLAVHRNLLRLIGFC

SEQ ID NO: 39007 - protein, 142 aa, Sorghum bicolor
  Clone ID: SORBI-28MAY03-C82952_1.pep
IIVPGGVQEILHMDHDSEVAFLKSRKGFVKIAIEMGCPVVPVFAFGQSYVYKWWRPGGKLIVKIARAIKFSPIIFWGKLGTPIPFATPMHVVVGRPIEVVKNPQPSIDEINEVHRQFVVAMQDMFEKYKTRTGYPDLRLRVL

SEQ ID NO: 39008 - protein, 147 aa, Sorghum bicolor
  Clone ID: SORBI-28MAY03-C83095_1.pep
MAAVGELVIPPVFERCSRVLDPGEQKAARDLYWEAITSSTKDDKRKDPEALLRESIAKNPLVGEPHLVLAQVLLNGGRYAEAAAAAARGVRLLLQWGSSWDKRMSWEGWVSWGRLMGDKARRGTGTWPRTAWGIINLGLVQGVANRN

SEQ ID NO: 39009 - protein, 226 aa, Sorghum bicolor
  unsure (1)..(226): unsure at all Xaa locations
  Clone ID: SORBI-28MAY03-C83244_1.pep
MVQCLDGVRQLLAVLLKCCDVDLKQPRGLEDPQVLARETVFSVSEVEALYELFKKISSAVIDDGLINKEEFQLALFKTSKKESLFADRVFDLFDTKHXNGILGFEEFARALSVFHPNAPVDEKIDFSFRLHDLKQQGYIERQEVKQMVVATLAESGMNLSDEIVESIIDKTFEEADTKHDGRIDKEEWRSLVIRHPSLLKNMTLQYLKDITTTFPSFVFHSQVDDN

SEQ ID NO: 39010 - protein, 228 aa, Sorghum bicolor
  unsure (1)..(228): unsure at all Xaa locations
  Clone ID: SORBI-28MAY03-C89855_1.pep
ARGNYTSMFDAQMDAIYTAMKKLGFGDGVEIAVGEAGWPTKAEAAQVGVGVEEXAKDFNAGMIRVCSGGKGTPLMPGRKFETYVFSLFDENQKPGPVAERNFGIFNTDFTPKYDLGLLRQGSSGSPNPSPKPSPNPSPSGGGKWCVAKSGASATDLQNNINYACGYIDCKPIQSGGACFDPNNVQSHASYVMNAYYQANGLHDYDCNFKGTGVVTSSDPSYGSCKYVS

SEQ ID NO: 39011 - protein, 109 aa, Sorghum bicolor
  Clone ID: SORBI-28MAY03-C8479_1.pep
LCLFFFTKQLYLLFIELVVQILVDDSKREAKKLKPEGGEQISKVETDVNQLPLTVSDVLAIFFGTGEREMVHSEAVKRVWEHIKSNNLEVWMITIKIVMCYCAFLKCWV

SEQ ID NO: 39012 - protein, 81 aa, Sorghum bicolor
  unsure (1)..(81): unsure at all Xaa locations
  Clone ID: LIB3476-050-P1-K1-A1.pep
KIICNDELRLVFETDSTDMFQMNKLLSKHIRPLESKNDSKREAKKLKPEGGEQIPKVETDVNQLXLTVSDAXXYLFGYGEK

SEQ ID NO: 39013 - protein, 190 aa, Sorghum bicolor
  Clone ID: SORBI-28MAY03-C85191_1.pep
MGNRHLCCLSLLLLLGLASGQVLFQAFNWESWKQSGGWYNLLMGKVDDIAAAGVTHVWLPPPSHSVSTQGYMPGRLYDLDASKYGTAAELKSLIAAFHGKGVQVVADIVINHRCADYKDARGIYCIFEGGTPDGRLDWGPHMICRDDTIYSDGTANLDTGADFAAAPDIDHLNDRVQRELTDWLLWLKSD

SEQ ID NO: 39014 - protein, 189 aa, Sorghum bicolor
  unsure (1)..(189): unsure at all Xaa locations
  Clone ID: SORBI-28MAY03-C85222_1.pep
MASWLLLPLPSFPWPPPPPPGSSSGRGGGGGGDGGDWRPNVVAAFAGAQLGRSLRRRFAGLLRSPEVRHLDALPKMGDFWFEGSEPFATFPILGAIGNVLSAPYVCSSALFSGNGSGGRYISNGKLLSRRPRGIDSKKRLWTNVLLALNVLAYVAQVASQGKLLLWGXAKINSLIDRGQFWRLATSSLL

SEQ ID NO: 39015 - protein, 221 aa, Sorghum bicolor
  Clone ID: SORBI-28MAY03-C96202_1.pep
MKSAMGFEVQVIESSFVTPSEPAPRKGLWLSSLDLWLANQGHTPTIYLYSSSNDAAAADHFFDVARLKEAMARALVAFYPLAGRLGVNDADGRMEISCNGEGALFVVARADDFTANDVKKFKPSPELRRLFVPLIEPLSIILAVQVTFLKCGGVVLGTALHHAAVDALSAFHFFQTWSAFSKHGHRATVELPCHDRDLLRARSPPTVHPDALLTFYPKHTF

SEQ ID NO: 39016 - protein, 118 aa, Sorghum bicolor
  unsure (1)..(118): unsure at all Xaa locations
  Clone ID: SORBI-28MAY03-C96313_1.pep
RMIEAEKAGFEILKSTMVEKLPNDLEGMESSMEKLYILIDEIYKXYVDDVVEGRVAPDNRIGRFISDSVASMPKLSPAAFDKLFNDKIQDNLALVYLSSITRTQITIAEKLNTAAQVL

SEQ ID NO: 39017 - protein, 174 aa, Sorghum bicolor
  Clone ID: SORBI-28MAY03-C96358_1.pep
MAAARARPPPVAALLLLVLLLTGAAGSSTTTSTTSPIKTVVVLVMENRSFDHMLGWMKRLNPEIDGVTGREWNPANTSDPSSGRVYFGDGAAYVDPDPGHSFQEIRQQIFGSDDASGPARMDGFVQQAASIGGGNTTDAVMHGFAPDSVAVYRELVSQFAVCDRWFASVPSSTQ

SEQ ID NO: 39018 - protein, 194 aa, Sorghum bicolor
  Clone ID: SORBI-28MAY03-C96396_1.pep
HEASCRIRHEGGKALTENLSPTFISSGDPCLDFFFHVVPGTPAASVESLLGAAWAADPTTALCLVANLRGVRGSGKSDREGFYAAALWLHARHPRTLALNAAPIAHRAGPSGRPGPRRRGAHGGPPPGAPRLGPPLPPLRRPRGARRARGPGRRGFGAPAPRPRARRPRSPPLGAAPIADFGYLKDLPELLHRI

SEQ ID NO: 39019 - protein, 63 aa, Sorghum bicolor
  Clone ID: SORBI-28MAY03-C96436_1.pep
ATSVISKLTEEKMSAIQQNQKLRQELELLRKESSKTSGGGFSITFLFVVGLLGIIVGYILKRT

SEQ ID NO: 39020 - protein, 107 aa, Sorghum bicolor
  Clone ID: SORBI-28MAY03-C96444_1.pep
RYFQKRVETGLKGDPSEEFSFSSFFPEFVRPILDPVASVFHRLLCGRSERSDARGQTLDTSPLPGSDSIEANRRRERGQRALEQRLAEKLAAVRSSEGTSLDAADKV

SEQ ID NO: 39021 - protein, 158 aa, Sorghum bicolor
  Clone ID: SORBI-28MAY03-C85598_1.pep
MIGVSIVSYYKSLIMVLLALLLCVSLAAASPATAAAGRAEEVHLVPAVYVFGDSTVDVGNNQYLPGNSALQLPYGIDFPHSRPTGRFSNGYNVADFVAKLLGFKRSPPAYLSLTPRTSRQILRGLRGVNYASGGSGILDTTGNTITLTKQIEYFAATK

SEQ ID NO: 39022 - protein, 121 aa, Sorghum bicolor
  Clone ID: SORBI-28MAY03-C8589_1.pep
LLLFHHLISSLLKCTDIKHTISTGYICTDTIHIYKQNLSKGYNASHSTTFLHSCRPILPPSSAILAGQMHLSISTSSVSRHVQPYSTWAHMHNPHLPRQQPLQSPVYHIKHLQTFLHLKKE

SEQ ID NO: 39023 - protein, 129 aa, Sorghum bicolor
  unsure (1)..(129): unsure at all Xaa locations
  Clone ID: SORBI-28MAY03-C85924_1.pep
TTGVTTQIPPPGSADPPPPCPTARSDASPPPWCASPAAPGSPPRHPRAAAPSPHPRAXPPPPRPLPDPLPRSLPKPLSKPPPRPLPEPLPGPPRTLSEPLPRPPRPLPEPLPRPPPPVVALPQRPRPGP

SEQ ID NO: 39024 - protein, 135 aa, Sorghum bicolor
  Clone ID: SORBI-28MAY03-C84541_1.pep
GRSYSRSPSPRRERSPVRSYSRSRSRGYSRSRSPRQNSRDERSPRDSRSPRRSPRDSRSPRRSPSLSKGRDRSPSPNGSRSPAPRERNGSDYSMSPRRDDSRSPADHLRREISPAANGRSPSPGVNDNGNHRSSP

SEQ ID NO: 39025 - protein, 97 aa, Sorghum bicolor
  Clone ID: SORBI-28MAY03-C84641_1.pep
QGGHVKIMDELLERGANIDARTKGACGWTPLHIAAKERNKKAVRFLIENGAFLPPEMNDHRFNPPLHYCFGLEWAYEMKRVQDESDSPGETSLSSDN

SEQ ID NO: 39026 - protein, 176 aa, Sorghum bicolor
  unsure (1)..(176): unsure at all Xaa locations
  Clone ID: SORBI-28MAY03-C84555_1.pep
MDMDMSSAYPHHWLSFSLSNNYHHGLLEAFSNSSSAAPLGDEQGTVEESPKMVEDFLGGVGGAGAPXRRRRRLQRITSLSAASXGSITAGFLRHYPAPGTTVENPGAVTVAAMSTDVAESDQARRPAETFGQRTSIYRGVTRHRWTGRYEAHLWDNSCRREGQSRKGRQVYLGGYD

SEQ ID NO: 39027 - protein, 209 aa, Sorghum bicolor
  Clone ID: SORBI-28MAY03-C84674_1.pep
MHEGAHDLNLAFPHHNGRALQPPEFPAFPSLESSSVCNPGAAGMVGNGAAGRGMGALSAMELLRSTGCYVPLQHVQLGMPAEYAAAGFALGEFRMPPPPQSHSVLGFSLDTHGTGGVGGAGGYSAGLQDSAAGRLLFPFEDLKPAVSAAAGGGGASNGADHHQYEHSKDQAAGDGGSGPSGVTGGHETPGFWSNSLIGNGSSNGGGGPW

SEQ ID NO: 39028 - protein, 210 aa, Sorghum bicolor
  unsure (1)..(210): unsure at all Xaa locations
  Clone ID: SORBI-28MAY03-C8468_1.pep
MGQAAATGSASTTAGSVKIYDANPGVLRALAGTRWPVSIMVPNEIIPDLAPRVRPRVRWVAKNLVPYYPATRVKFLLVGNEILSDHSIANSTWPRLVPAMENIHRSLRKRGISSVKIGTTLAMDALADGAFPRPPSAATFRADIAEAVVRPLLHFLNGTNSYYFVDAYPYFVWADNNLTVSLDYALFQGGRXRYVDPGTRLTYTNLLDEM

SEQ ID NO: 39029 - protein, 126 aa, Sorghum bicolor
  Clone ID: SORBI-28MAY03-C84812_1.pep
NQSGSGRPDPHMDAAYRRALEALCPKGGNEEVTGGLDATPRVFDNQYFKDLVALRGFLNSDQTLFSDNARTRRVVKQFSKNQDAFFRAFIEGMIKMGELQNPRKGEIRRNCRVANCSPVAPRVVDI

SEQ ID NO: 39030 - protein, 192 aa, Sorghum bicolor
  unsure (1)..(192): unsure at all Xaa locations
  Clone ID: SORBI-28MAY03-C84930_1.pep
MASSVAPSPTQTSSNVSRPTIPTGLVPVAVLLAAAAVLLALLPSLAQXVWEVPHLFLLGAVISFGVFTQRNNDADGNGNAAGAKRSSLAWNARYHPDDPLVVIADHHAVPSDEDDDGGLEGARRERPLSLPVRRLKPASASAAAAAAPETGGDASCGGFGEETDSCASSSGFWAGARAVPSPPSVLDADLDF

SEQ ID NO: 39031 - protein, 287 aa, Sorghum bicolor
  Clone ID: SORBI-28MAY03-C863_1.pep
RPASVRYSDFINKELILFSMADLQRSIPSMVDGLKPGQRKILFCSFKRNFVKEAKVAQFSGYVSEHSAYHHGEQSLASTIIGMAQNFVGSNNINLMFPGRQSGTGAQGGKDAASPRYIFTKLSHITRSIFPKDDDILLNYLNEDGQSIEPTWYMPILPMVLVNGSEGIGTGWSTFIPNYNPRDIVANLRRLLNEESTVPMHPWYRGFKGSIEKAVNTKVAGSTYTVTGIIEVVDNSRLRITELPIRRWTGDYKEFLESLGPDKNKDKVPFIEDVTAQGDNEDIYIEI

SEQ ID NO: 39032 - protein, 175 aa, Sorghum bicolor
  Clone ID: SORBI-28MAY03-C86353_1.pep
APPVEAESKKDEPSENSPEEKKNGQQNGKKEEINEENKAGGGEEEEDHVDESPETAKPGDAAGEGHGAHAGEAPNHNNGGDGLVVENHTKDGRLFTVPMPAGVVTVAPEMALSNRSYYYPPPAYPYAQYYYPYNQYYQYPQPYPAYAACSPAAMYGHGYPPEAFCEENPNACTIV

SEQ ID NO: 39033 - protein, 278 aa, Sorghum bicolor
  Clone ID: SORBI-28MAY03-C86470_1.pep
LKPATMRPIPHSGKQQMHPFMGLPETSLHETSIVKPSLPVAPTVKHNSVFFAPTTHRKSTSGPSHTPSVIQLNPLPMKKHGCDRLPIQVCSEEDFLKDVMQFLIQRGHNRLVPHGGLAEFPDAILNAKRLDLYNLYKEVVSRGGFYVGNGINWKGQVFSKMRNHTATNRMTGGGYSSVRRYVTSVPAFELAPDDLDGLCCCLGLSRAPGDWVNCGLCGEWAHFGCDRRQGLGTFKDHAKTDGLEYICPHCSLANYKKKPPPPKAANGFSNTASVPRNV

SEQ ID NO: 39034 - protein, 155 aa, Sorghum bicolor
  Clone ID: SORBI-28MAY03-C8658_1.pep
MKMSSSSVPAAAAVAAVLLLSAVWTTTTVTGQALVPGVMIFGDSVVDAGNNNRLATLVRADFPPYGRDFPATHAPTGRFCNGKLATDYTVESLGLSSYPPAYLSEEAQSNNKSLLHGANFASGAAGYLDATAGLYGAISLRRQAEYFREYQSRVA

SEQ ID NO: 39035 - protein, 334 aa, Sorghum bicolor
  Clone ID: SORBI-28MAY03-C8525_1.pep
DAWADAWVTSPSSVRLAISVNGRINPLEETDVTVDFLAPARPGRYISYWRLALPRPQRFGQRIWVHIKVEQPIQSTGGKQAAAMNLNQLPEANSRKLKPFTVDLETNSVSSEPFYGCHGIPEANSTKLKPLTLDLETNSVSSEPLSRCPGSFLRTMKLKESKPAPCDVSSVPTTVELVQIPATDVSAESLLASIPGGVPAFEASPLPNPVPMLPVSSSAPVVGHVSMPAPAATIAPVPAAPLPEQIINHLEEKLMTELEGLGFMQADLNKQILRQNNYNLEQSVAHLCDYDEWDALEFSELGFDDAEMNKEVVDNSDEEGFIVADLVTKAANDH

SEQ ID NO: 39036 - protein, 204 aa, Sorghum bicolor
  Clone ID: SORBI-28MAY03-C85316_1.pep
NETTIQTLEWTMAELIANPRVTAKLKNEITRVVTADQPTISESDLNRMEYLKAVFKEVLRLHAPLPLLVPHESTAPAVVQGYEIPAKTGLYINVWAIGRDPAAWDAPEEFRPERFVGSSSPVDFRGNDYQFIPFGAGRRICPGINFALPVLELAVASLMRHFDWELPAGMQLTDLDMSETPGLMTPRRVPLVVVPRTVPQPALP

SEQ ID NO: 39037 - protein, 150 aa, Sorghum bicolor
  Clone ID: SORBI-28MAY03-C8532_1.pep
CAALRRRVRLTSRPPPSLRPPAAATGQHPTSKACFPSLVTETTATPTATTRAPAMASAFFFDAEPVCEVSSLLLPALDACALCAKPLGRDDDIFMYRGDTPFCSEECRDEQMQLDAIRARQAAGRRQQQQQYSSRTESRHQESRKVSVAT

SEQ ID NO: 39038 - protein, 135 aa, Sorghum bicolor
  Clone ID: SORBI-28MAY03-C85503_1.pep
KDEAEKVIRSLEAAISRRVSEGFTLEVRGRDRVGLLSDVTRVLREHGLTVSRADVTTEGGQATNVFYVRDPSGQPVDMKTVEGLRGQFGQTAMLNVKKVSVPAAAVARAPEPRSSGGIVRNSFFSFGSLFAKLRA

SEQ ID NO: 39039 - protein, 183 aa, Sorghum bicolor
  Clone ID: SORBI-28MAY03-C85474_1.pep
GLGHDSPMWAALNHGGRTVFLEEDASWIASVRATHPSLESYHVAYDTVLTDADALLQLRDHPACVAQPDLASAADASCRLALRGLPPVFHELEWDLIMVDAPTGWTPEAPGRMGAIYTAGMAARARRPGDGPTDVFVHDVDRPVEDAFSKAFLCEGYLAEQVGRIRHFVIPSHREKDGTPFCP

SEQ ID NO: 39040 - protein, 302 aa, Sorghum bicolor
  Clone ID: SORBI-28MAY03-C8553_1.pep
CHTMSLWAIMPLLILFYAAYLYYQATSREVKRLDSITRSPVYAQFSEALNGLSTIRAYKAYDRMANINGRSMDNNIRFTLVNMSANRWLAIRLETLGGIMIWFTATFAVMQNQRAENQKAFASTMGLLLTYTLNITNLLTAVLRLASLAENSLNAVERVGTYIELPSEAPPVIEDHRPPPGWPSSGVIKFEDVVLRYRPELPPVLHGISFLINGSEKVGIVGRTGAGKSSMLNALFRIVELERGRILIDDCDTSKFGIWDLRKVLGIIPQAPVLFSGSVRFNLDPFNEHNDADLWEALERAH

SEQ ID NO: 39041 - protein, 279 aa, Sorghum bicolor
  unsure (1)..(279): unsure at all Xaa locations
  Clone ID: SORBI-28MAY03-C85873_1.pep
MGTRRGSGVLHRLLALSSLLLLASGEIVFEGRFEDGWESRWVESDWKRSEGKAGRFKHTAGRYSADPDDKGIQTTMDARHFAISAKFPQFSNKNRTLVVQYSIKFEQDIECGGGYIKLMSGYVNQKKFSGDTPYSLMFGPDICGTQTKKLHLIVSYQGQNYPIKKDLECETDKLTHFYTFILRPDASYSLLVDNRERETGSMYTDWDILPPRKIKDLHAKRPKDWDDREYIEDPDEVKPEGYDSIPKQIPDPKAKKPDTWDEDEDGIWKPRMXSNPAYK

SEQ ID NO: 39042 - protein, 121 aa, Sorghum bicolor
  Clone ID: SORBI-28MAY03-C8687_1.pep
AAALRLPGEGDSRLLLWALAVLWSSPLPCIVFSFAPAASLGCCYPFFAGSCAGPVHLTPLAAYSGKLLQSLAVATSHGSFLSLDQIIYNGIGFTIAAASTAAITIYAKKALQKLQAEDEIF

SEQ ID NO: 39043 - protein, 92 aa, Sorghum bicolor
  Clone ID: SORBI-28MAY03-C87076_1.pep
PCSEPEAPAVYHKVLPKRSSFASLEFEAYQRISLMNLGKPLPSSSAWWRRSPLLSSSSPSSVGLAVSAGKAKSMQCRMVPSWFRLDRSVALA

SEQ ID NO: 39044 - protein, 175 aa, Sorghum bicolor
  Clone ID: SORBI-28MAY03-C8708_1.pep
LLFGRNITRLYDLKGSSRSRYNADSNGSNKVLLDQNLIEAMPTSPIFVGNKAKRLLERAVWNDTSFLAGIDVMDYSLLVGVDEEKHELVLGIIDFMRQYTWDKHLETWVKSSGILGGPKNSSPTVISPMQYKKRFRKAMSAYFIVIPEQWMPAIINPSKSSSNICQEDSQNGSQE

SEQ ID NO: 39045 - protein, 176 aa, Sorghum bicolor
  Clone ID: SORBI-28MAY03-C85985_1.pep
PKHIIRWVSYACTSGFMFGWHVHEKASLHFTIPLALIAMDSLNDSRHYFLLSIVSCYSLFPLLFENQEYLIKVMLLLTYAALMWVGFTSHFAANSDLEGKKVNRSGSTVKKNGIIGWIGLSYLLGIAGIELWSRVFHHHVFGERLPFLPLIMVSFYCGLGMMYSWVWQLVHIVRHT

SEQ ID NO: 39046 - protein, 176 aa, Sorghum bicolor
  Clone ID: SORBI-28MAY03-C8608_1.pep
MDGGGEDGKQQPHLVLAHKLFLLSRSDVDDLAKVDLRADVLAAVKSDDMAALYESLAADGVLEMDAALLAEMRARIDEEIRKLDEKIADAEENLGESEVREAHLAKSLYFIRVGEKEKALEQLRVTEGKTVAVGQKMDLVFYTLQIGLFYMDFDLISKSIDKAKNLFEESGDWRGR

SEQ ID NO: 39047 - protein, 128 aa, Sorghum bicolor
  Clone ID: SORBI-28MAY03-C86188_1.pep
QTTAQSVSCFSGKVRCSKLQNHYFLFLLGNYSFGPICEIVSSMFQNARGRTRLNRKQGELLVVGVAEEGAKKHPRGDKIQLKVCSQQPRSHKGGCWFFSEIFSRRCNIISWTLGGDSLLEERVEGCWE

SEQ ID NO: 39048 - protein, 211 aa, Sorghum bicolor
  Clone ID: SORBI-28MAY03-C86199_1.pep
MRPEGAARLAWLLLLAAAAAGHGGVQPLSRIAIHRARVALDASAAVRASPELLGTKGEDTAWVNVDFITPHPSDDDWIGVFSPSNFNASTCPGSHGSGPGPVICSAPIKYQFANYSSDFGKSGKGALKFQLINQRQDFSFALFTGGLSNPKLIAVSNAIAFANPKSPVYPRLAQGKSWNEMTVSWTSGYDINEAYPFVEWGIKWSPAVRTA

SEQ ID NO: 39049 - protein, 178 aa, Sorghum bicolor
  Clone ID: SORBI-28MAY03-C86206_1.pep
MAPAVTITDVAYVAAPDGALPPEPVIKLNAMEAQWVVIPLLQHLLLFDGDHLPPFDAILQSLRSSLAATLATHAPLAGKLHYLADTGDVAICRSTGGADDDDDDRGVRFVAAECDADARRLAGDEDHDVHTFERLVPELDMSLLPAPVLAVQATRLAGGGVALGVSVHHGVADGQSLW

SEQ ID NO: 39050 - protein, 161 aa, Sorghum bicolor
  Clone ID: SORBI-28MAY03-C86219_1.pep
MLRGGTSVLGIINFITFLISIPILGGGIWLASRANSTDCIRFLQWPIIVVGLVLMVISLMGFAGACYRQTWLLRLYLFAMFFVVLALLFFIVFAFAVTDRGDGQVVMNRRFPEYQLSDYSGWLRDRVADPEYWATISACLRDGHACAGMRRLARDPNTGML

SEQ ID NO: 39051 - protein, 90 aa, Sorghum bicolor
  Clone ID: SORBI-28MAY03-C86344_1.pep
ISPKKPLTVSLSEYRFSFADPGAHERPPPPPPSTLLQRSASVRPSVRRFQILFPHLGFVWFVEELKLSYHHRVCLVSLSVVVKVLRRIEK

SEQ ID NO: 39052 - protein, 127 aa, Sorghum bicolor
  Clone ID: SORBI-28MAY03-C87630_1.pep
MRRWLCCSHFDTPYLENENGFTSSPDKTSGNDLNSNSDPAKPPSIEVPALSFDELKEKTDDFGSKALVGEGSYGRVYYAVLETEQHVAVKKLDTSADPEPDNEFLAQVSTVSRLKHENFVDLLGYCI

SEQ ID NO: 39053 - protein, 168 aa, Sorghum bicolor
  Clone ID: SORBI-28MAY03-C87652_1.pep
MASGGQPQFRYTQPPSKVLHLRNLPWDCTPEELVELGTPFGKVVNTKCGVGANRNQAFIEFADQNQAIAMISYYASSAEPAQVRGKNVYLQYSDRQEIINNKTTGEGSGNVLLVGMEGVAPDSVSIDVLHVVFSAFGSVHKIATFEKASGYQALIQFSDAETATSAKA

SEQ ID NO: 39054 - protein, 156 aa, Sorghum bicolor
  unsure (1)..(156): unsure at all Xaa locations
  Clone ID: SORBI-28MAY03-C8770_1.pep
MERPAPVRKSHTSTADLLIWPEGAPQEAPAGATPPSNRRPHQPSEALKKVVFGGQVTEXEAESLNKRKPCSAPKWKEMTGSGIFAAGGEAEEDESANASATPIRTAPKNYQAISTISHISFAEEENISPKKPTSIAEVAKQRELSGTLLSEDDSKM

SEQ ID NO: 39055 - protein, 136 aa, Sorghum bicolor
  Clone ID: SORBI-28MAY03-C87723_1.pep
NALVGPLPQQVPGMRKVEQLDVAHNRLSGAVPEAICALPRLKNLTISYNFFTGEPPSCARVVPTPDGDRRNCLPNRPAQRTPQQCAAFYSQPPVDCAAFQCKPFVPVPPPPPSYPGPRPPGGPGPGAPPPPPAHYR

SEQ ID NO: 39056 - protein, 146 aa, Sorghum bicolor
  Clone ID: SORBI-28MAY03-C86610_1.pep
HEGDPEVSTDVGRFARLVNSADVMVGVHGDGLTNMVFLPAGAVLVQVVPYGGLEWLARGTFREPAEGMEVHYLEYVVQKDETTLSEEYGEDDPVIRDPAAIHKQGWDALKAVYLDKQNVRPHLGRLKNTFVQALKLLPHGRQVADD

SEQ ID NO: 39057 - protein, 114 aa, Sorghum bicolor
  Clone ID: SORBI-28MAY03-C86637_1.pep
NEDLYTGNEMSPSDQRQNHVSASRKRPISLPPSEEAKPGKKQRENAEDMIPTSENYSPEDALEHVQDSKGTDLPESFPVKKLREGDYVDVGTIVSSTNIFADRYKGDDEEVDVD

SEQ ID NO: 39058 - protein, 138 aa, Sorghum bicolor
  Clone ID: SORBI-28MAY03-C86759_1.pep
PDDPMARALLNGKAPEHHHRWIQRGAGADGTNIFPPAEIAGTPDAGHRHTQAASPNRQRQWLQQRGSGRPCEVLLRKGCGVDKFGAQDPINCQVHHPLNHLMYQLFMPLPLSRLCCETLEFAPLDSEPTSINLFVPGF

SEQ ID NO: 39059 - protein, 144 aa, Sorghum bicolor
  Clone ID: SORBI-28MAY03-C8680_1.pep
ARGLRKELSLVKDVPVLFAIDQYNSWFTFSDFQEPVTVRSCRSIHAKELTTVNTYRPMVHNDMMVGAFSHSTAVGKLRQELPDVPSDARLIFPRYTLDEAETVCHYYMRQKIIRRENFSEEKWKKIFYLSNGNGAEMRWLAAFV

SEQ ID NO: 39060 - protein, 122 aa, Sorghum bicolor
  Clone ID: SORBI-28MAY03-C86803_1.pep
PNSITSCRVSTGRGRGSERSLGALTPRRRAGGGRSLLERDNRGGEDRSRNQGAGGPKPCHVEDGEIRVDLEPRAGCTRSLNVARGTARGGHKHQKKGKAADDKTTLVRSLVSGAKPKNQFTF

SEQ ID NO: 39061 - protein, 130 aa, Sorghum bicolor
  Clone ID: SORBI-28MAY03-C8682_1.pep
STIEEADKAIEMFNRYDISGRLLNVNRASPRGTRMERPPRQFAPAFRAYVGNLPWQVDDSRLVQLFSEHGEVVNATVVYDRESGRSRGFGFVTMVSKEELDDAISALDGQELDGRPLRVNVAAERPQRGF

SEQ ID NO: 39062 - protein, 126 aa, Sorghum bicolor
  Clone ID: SORBI-28MAY03-C86859_1.pep
TAVVAQDRSHHARKPGRLLTPRALVFQFDALPSEPEAGDILPQVPPPLRDSACDHSVADRQPGDYSYQDVVWQQTDVAVSLCTQRLQWSPAVLKLWASCHCSELSLGTRDDPTGRTSLSDACLVPS

SEQ ID NO: 39063 - protein, 175 aa, Sorghum bicolor
  Clone ID: SORBI-28MAY03-C88404_1.pep
MFSAPGNNSLALVAPRPGMELANVQHPNQAPGPGGKQRTSSLEAPIMLLTGHQSAIYCMKFNPAGTVIASGSHDKDIFLWYVHGECKNFMVLRGHKNAILDLQWTTDGTQIISASPDKTVRVWDVETGKQVKKMAEHSSFVNSCCPARKWPPLVVSGSDDGTAKLWDLRQRGAIQ

SEQ ID NO: 39064 - protein, 86 aa, Sorghum bicolor
  Clone ID: SORBI-28MAY03-C885_1.pep
GPHSGSPSVQNTDISWTLITAALSSVARTSMVTMQDILGLDSSARMNTPATQKGNWRWRMPGSVGFDSLSPEAAKLKELLALYNRQ

SEQ ID NO: 39065 - protein, 211 aa, Sorghum bicolor
  Clone ID: SORBI-28MAY03-C88519_1.pep
YTNMFDAQVDAVRAALDAKGYKDVEIVVAETGWPHKGDTDEAGATAENARAFVSGLVSHLSSLAGTPRAPGKSVETYIFALYDEDLKPGKASERYFGLFQTSLTETYPTGLLRNGTAGLIPAPAPAPTTTSAPALKPTPGQQPQVTPGQQGSTAAAGPSGLCTPAGPGTATSKGTTTTTACAHPNAAESSRTSSMLPIIAGFWFIALQMFI

SEQ ID NO: 39066 - protein, 408 aa, Sorghum bicolor
  Clone ID: SORBI-28MAY03-C87151_1.pep
LWDIETPENMVFPSPLNSKRQCLPSYAVPGLQIGSVNMSSIPRAQGSPFGNLQQMPGSGSDLALLLLNQSGQNLGSPIACQQSSFSSIIQNAKHSYFPPSTFGASTGSMKQETMPSNEAPQQLNALGIQKGDQVSCEVQPGIDSISAREMSVKPRGPRSTDSYSSQSISDQNGKGEPRTKSPRSKKSSSHKTISDKSELSSLPSQICDKQRHGSEPTLVDCGAEQATCGNIEDSSGAPTRGDFVGELQVLEVEQHELLSPPKLESSKSPDGGKSVSSFPNQGCFSQFLEGLDWMIPPSYYQDSYGIQSATASDNIFNPSEGIPSAMNTDGMEAFQTSCLSECFPNSIQEFINSPDINTLTFMSPEMQHLDAQHDGSNLPSTSNSYVQMSFSEESQSASLSGLHMEAIH

SEQ ID NO: 39067 - protein, 182 aa, Sorghum bicolor
  Clone ID: SORBI-28MAY03-C87191_1.pep
MPRMVAVVGAGPAGLVAARQLLREGLHVAVFEKSGRAGGTWAYDPRADADDPLSRDPGAPGAVHGSLYASLRTNLPRDLMGFSDFPMAGRVFAGDARAFPGHREVLAFLDAFAEESGVAARVRLRSEVVRVAPALGHGERWVVAWRREDGEVVEEVFDAVVVCNGHWTVPMVPKIRGIDNWS

SEQ ID NO: 39068 - protein, 96 aa, Sorghum bicolor
  Clone ID: SORBI-28MAY03-C8731_1.pep
MASSTSQTEAPAPSVPKNPAMASCRKKKTDDATFLEDLKDHIDEFIHASMDEHKTCFTKTIQKMFGMSKAVAERSAAEAKEAEVESALPLQTSVSQ

SEQ ID NO: 39069 - protein, 219 aa, Sorghum bicolor
  Clone ID: SORBI-28MAY03-C87529_1.pep
MGTEADAAAVDLLRSQIPFQTDGEFVLPPRGVGLVLVDLCNGFCTVGAGNLAPVAPNKQISKMVEEANRLSKLFCDRNLPIFAFLDTHYPDKPEPPYPPHCIIGTGEENFVPDLEWLEKEPNVTIKRKSCIDGCISCIEKDGSSVFVDWVGKYQIKTVLVLGICTDICVLDFASSTLAARNIDRVPPLQDVVIYSEGCATYDLPVEIAMNIKGALAHPQ

SEQ ID NO: 39070 - protein, 185 aa, Sorghum bicolor
  Clone ID: SORBI-28MAY03-C87536_1.pep
MKIIPVPCLEDNYAYLIVDESTKKAAAVDPVEPEKVIKAAGEVGAYVDCVLTTHHHWDHAGGNEKMRLQVPGIKVFGGSLDNVEGCTDQVENGTKLSLGKDIEILCLHTPCHTKGHISYYVTSKEGEDPAVFTGDTLFIAGCGKFFEGTAEQMYQSLIVTLGSLPKSTRVYCGHEYTVKNLKFIL

SEQ ID NO: 39071 - protein, 126 aa, Sorghum bicolor
  Clone ID: SORBI-28MAY03-C87608_1.pep
GYHAPEYAMTGQLTQKSDVYSFGVVLLELLTGRKPVDHTMPRGQQSLVTWATPRLGEDKVKQCVDPRLNGEYPPKGVAKLAAVAALCVQYESEFRPSMSIVVKALSPLLVNAPYQPAGAPDISSDA

SEQ ID NO: 39072 - protein, 306 aa, Sorghum bicolor
  unsure (1)..(306): unsure at all Xaa locations
  Clone ID: SORBI-28MAY03-C8733_1.pep
VQTYTLATRLPDNTSSSGSGRGYVQPIIHFSPSDTMLLWNGVLWDTRQPTPVHQFDQFTDYCGGGFHPAGNEVILNSEVWDXEKFKLLRSVPSLDQTVIKFNGTGDVIYAILRRNLEDVTASINARRVRQPLFPAFRTIDAVTYSDIATVQIDRCVLDLATEPNDSLIGGGGMDDHREPFSSARVCVLRCSRGPAAASPPVPPGGSDDEDDDDNDDSDDDVLLAPVLEGDTDSEELSSSGDDGDEDGGDDIPSSDDIEDDPEFIDDGGDFEGGGDLMDLLGDDEGEDDESDTMESFSSGDEEGWIM

SEQ ID NO: 39073 - protein, 117 aa, Sorghum bicolor
  Clone ID: SORBI-28MAY03-C8937_1.pep
QHLEVGRSPDESQRRWSQPRRRCHHLLRRGAAGSRGGEERGRCGGGCGGSVDADNQFTTLNQCGFVDAAEWRCGSGMGGCIGCSRVEELHGLRRYGGGGVDCVLRCCGGALGFEGGR

SEQ ID NO: 39074 - protein, 62 aa, Sorghum bicolor
  Clone ID: SORBI-28MAY03-C8941_1.pep
AMELSEWHYKQLKLIFTAPLFVICRTCMAPHSCCWLQDTPCFHRLPPFSANNNQSLLITLPM

SEQ ID NO: 39075 - protein, 158 aa, Sorghum bicolor
  Clone ID: SORBI-28MAY03-C8952_1.pep
QGSGAPCVALLHRRAPCHGSSPWISPSSSSSSWISPLPSSSPWISLLCSRPLVAQAQCLPPVTWACLSSIVWARSPLLHRHATPPSACLPVCCSPSPNVGHIFFLHEADQAARTYSSSEAGSLAPLPVAMAHFLGQRRDPLLAHSSRELGLADLPPSA

SEQ ID NO: 39076 - protein, 138 aa, Sorghum bicolor
  Clone ID: SORBI-28MAY03-C89623_1.pep
MEASVGVRAPARGRAWAGIEKPHGAYSVRVPPVRLTADRLRLPPPRRLVLGADPWRTAGPALRPAKLRVSCSAKSAGTGKVHYSTDEALILQQKAQDVLPYLDGRCVYLVGMMGSGKTTVGKILAEVLGYSFFDSDKL

SEQ ID NO: 39077 - protein, 147 aa, Sorghum bicolor
  Clone ID: SORBI-28MAY03-C87784_1.pep
MRGAVEVHAIGRDVASPSPLRLRDAPALDMMRYQRLSPDCLPLGNGGGGGGGSAVPRKQASRSSFIRDDDAPAVATDGSRLASYLAASPPESKPLRARAPQPAPLSSATAGRSPAREQAHHHTSDSSDTASPSSTGGGGAVVGDVLL

SEQ ID NO: 39078 - protein, 176 aa, Sorghum bicolor
  Clone ID: SORBI-28MAY03-C87823_1.pep
MTSAAGAASAAIALLILLPLAAASDSDHKYQAEEPVTLWVNKVGPYNNPQETYNYYSLPFCHASENHVHKWGGLGEVLGGNELIDSQIDIKFRKNVDKATICSLDLDLVKAKQLSDAIENSYWFEFFIDDLPLWGFVGEADRNNDNQYFLFTHKNIVIRYNGNQIIHVNLTQEFDP

SEQ ID NO: 39079 - protein, 307 aa, Sorghum bicolor
  unsure (1)..(307): unsure at all Xaa locations
  Clone ID: SORBI-28MAY03-C87884_1.pep
MARKCSHCGNYGHNSRTCGLGHSREVMLCEAGDNGGGHGGSGLRLFGVQVRIGGGGAGSSASMKKSYSMDCLQLAAAQAGCSLVSPSSSSSSSLLLSIEEGLERGAAANGYLSDGPHGRVVQERKKGVPWSEEEHRQFLAGLEKLGKGDWRGISRNYVTTRTPTQVASHAQKFFLRQSSMGKKKRRSSLFDMVPICENSASISDPVSSEEGAGSTSLSLNVACHCHGAASDSERAALDLNSTEEGGDSRAAPGAGTTRPFPAPVAVAQTELLLHQXSXSSHGHGRGHHCSPLDLELGMSLPAPSIGT

SEQ ID NO: 39080 - protein, 120 aa, Sorghum bicolor
  Clone ID: SORBI-28MAY03-C87920_1.pep
VKVQRRMQEKRVQKCVETLDAIRAKNAAAAAPKANGNMNGHAKPRAPHLPPRPPPVSQRRNFQQQPSPAPPTQSWESFDLLSSVPSTSSAAVTTTMAAATTTSPAGASPSPIPRFDWELF

SEQ ID NO: 39081 - protein, 69 aa, Sorghum bicolor
  Clone ID: SORBI-28MAY03-C88215_1.pep
EGCIYLHHLLGPVNICRISNVIMFKCTLCSTRMNDPVQAGLHQLQLEDRCSIIYIVDIALMKYRGTRVC

SEQ ID NO: 39082 - protein, 237 aa, Sorghum bicolor
  unsure (1)..(237): unsure at all Xaa locations
  Clone ID: SORBI-28MAY03-C8831_1.pep
MQRISLRLLRSSAAAAASTTSSSLRGLAVLRGGWPARPALQPPARTAAPADLTRWPPRRGYSQFASGFTPLKPKPLGSILDIERAKGLSPEHLVAAWDDYHXRGHIGASMKAKLYHLLEQRSDSCRHFVIPLWKGSGYTTMFMQVQMPYIIFTGLEDYKARGTQASPYYTVTHYTEFAETKDTVLIRGDVVFTSKLTDSEAKTLLETAHSFYLNDVRYRLVERFNKETHDXEFRDVP

SEQ ID NO: 39083 - protein, 117 aa, Sorghum bicolor
  Clone ID: SORBI-28MAY03-C88334_1.pep
TSPSSSPPSGSAAPVPAPAATPTSPPSPAASAPAPAPTSTAPSSPPAPAAQTPSPSTTPTPGGGSSSSPPSGSASAPGGDGGSGSTTTPPPPSAAAPVVAGFVGSLGALIGYAMLAA

SEQ ID NO: 39084 - protein, 149 aa, Sorghum bicolor
  Clone ID: SORBI-28MAY03-C89900_1.pep
MHPSCSPLAVPPGFRFHPTDEELLYYYLRKKVAYEPIDLDVIREVDLNKLEPWDLKDRCRIGTESQDEWYFFSHKDKKYPTGTRTNRATTAGFWKATGRDKAIFLGNAGRRIGLRKTLVFYTGRAPHGKKTDWIMHEYRLDDDSVEVPV

SEQ ID NO: 39085 - protein, 206 aa, Sorghum bicolor
  Clone ID: SORBI-28MAY03-C9_1.pep
MAIKQKGATTTTFLLFLVLAVVVAAEAAQLQDDEPATAAGGSHARHQRRANKASAGTGDAPTHLHFYFHDTVSGKSPTAVRVVSAPATSPSPLFGMVNVMDDPLTDGPEQSSSAVVGRAQGLYMGSDQAKLGFLQAMNLVFTAGDYNGSTLALLGRNCPLDAVRELPVVGGTGAFRFARGYALLRTHWLDFTTGDATVEYDVYVMH

SEQ ID NO: 39086 - protein, 200 aa, Sorghum bicolor
  Clone ID: SORBI-28MAY03-C89955_1.pep
MVGCSRGSLPTWMTAAAARVDLSGGVTPSHQGSSSPSPSSSGPAPSAGADQELGMFERALSAAGAAFVSAIIVNPLDVAKTRLQAQAAGVLYHQPAQMAALGPDAILSEFRCSPSCTRGLVLGSEPVCPPDCFQYKGTLDVFLKVVRQEGFVRLWRGTNAGLALAVPTVGIYLPCYDIFRNWIEDFTRSNAPGLTPYAPL

SEQ ID NO: 39087 - protein, 250 aa, Sorghum bicolor
  Clone ID: SORBI-28MAY03-C88536_1.pep
MDMAPAPVSSNPRSVEDIFKDFSGRRAGLVRALTSDVDDFCSFCDPDKENLCLYGLPNGTWEVSPPADEVPPELPEPALGINFARDGMQRRDWLSLVAVHSDSWLISVAFFYGARLNANDRKRLFSLISDHPSVFEAFADRKHGRDRSGVDSSGKSRHSSKRANDGHAKNSRAAAPAAKDYDADDDEEDEEHTETFCGSCGGLYNANEFWIGCDICERWFHGKCVRITPAKAEHIKHYKCPDCSSKKMRQ

SEQ ID NO: 39088 - protein, 113 aa, Sorghum bicolor
  Clone ID: SORBI-28MAY03-C8848_1.pep
NHCSGDQKRHYFQHGMTQYPEMPDVQEAQPCQNPISSCLQVVVASPQIGKSPVPHRWGRRSPGSASRFALWRICRRGRRSNHPSLGRDQVGMRGGAAGSGRDKVWRHRHERRR

SEQ ID NO: 39089 - protein, 104 aa, Sorghum bicolor
  Clone ID: SORBI-28MAY03-C887_1.pep
STTRPLHLEAMSIFDMGNKLLEKVRNVNFTGVSGQVQFNAQFELIHPAYDVISIIGNGMRTIGFWSNYTRLLSTVLPEDLYSKPPNTSLANQQLYDVIWPGETA

SEQ ID NO: 39090 - protein, 208 aa, Sorghum bicolor
  Clone ID: SORBI-28MAY03-C8899_1.pep
WGTGTGSTTLTENIHTLETTKMGSRRALQLGAAVLVIFSFFGKIGALLASIPLALAASVLCFTWALSIALGLSTLRYTQAASSRNMIIVGFTLFISLSIPAYFQQYEPSSNLILPSYLLPYAAASSGPVRTASSGLNYAVNALLSINVVVALFVALILDNTVPGSRQERGVYIWTDPKSLEVDPATLEPYRLPEKISCWFKWAKCIGI

SEQ ID NO: 39091 - protein, 235 aa, Sorghum bicolor
  Clone ID: SORBI-28MAY03-C89066_1.pep
QRERPSKHAQAHCLTMARLTACFALSAVLVLATGISSGNGQLLDLIPTDATTGCLQFPSGQLFPSPDLLPLAYKFLGSLPPMRIISRGNTSLSVAAGDNGNVVLAKTNCWDARQLWVQHYPILFDKTRFSLVNLGNKGPLLAMPIPEDSSIYPVKLAPYSYSPWLFFMPVPTSMLWTQETPLADGFYKIRSYKVPRLLLDGLYGNVHEGTVVGAYPAGHDDDNILWKIEGFLSNP

SEQ ID NO: 39092 - protein, 140 aa, Sorghum bicolor
  Clone ID: SORBI-28MAY03-C89084_1.pep
HEAAIDRNLLVPNGSYVLTANNCVMCGCSSSTWQLDCQPTQGLSSSFCPAAKCGDMFLGNTSSTSSCESTTCSYAGYTNTTSFAILANVTTSNVCNAGMSPVAQPVHSSAFRLERAWLRWTELVFSLHVVLVCLGYLRQD

SEQ ID NO: 39093 - protein, 99 aa, Sorghum bicolor
  Clone ID: SORBI-28MAY03-C8934_1.pep
IWWTERARWRRRAPWCRLAKCARSSWDESEVPALSEVFSSTGHILNVLHDVESITLIIYKWFCPLAKFSLKTPQYFRKPFLQNFYFYTSFILNDDTGLL

SEQ ID NO: 39094 - protein, 376 aa, Sorghum bicolor
  Clone ID: SORBI-28MAY03-C91148_1.pep
AAGKARRFDLAWAVVRRMRNRGVLTGRAMVILMERYAAANEVNKAVKTFDVMEKFKVESDQSVFYSLLRALCKSKNIEDAEELLLLRKKFFPLSAEGFDIILDGWCNVITDLAEAKRVWREMSNHCITPDGMSYTLMISCFSKVGSLFDTLRVYDEMKKRGWIPGIGVYNSLVYVLTRENCVKDAHNIFSKLTDEGLQPDVETYNSMIVPLCESCKLDEARVVMESMILKGIVPTISTYHAFLKQEGIDESLKLLQKMKEDGCGPKSDTFLMLFDKFFLLNESGNALRVWNEMRKYKISPVRSHYMTVVEGLVKHGCIPRALEYYDEMKEKGFAFDTQLDKEFKTFLLNNRDHWRGAGKYNIIPQRGKHFAKRSRM

SEQ ID NO: 39095 - protein, 82 aa, Sorghum bicolor
  Clone ID: SORBI-28MAY03-C912_1.pep
MASIGGGASSAAAKNESYVRADKIDLESLDIQLEKQLAKTWGKHKGSYNQGPREDWEIDLAKLEIRYVIAQGTYGTVYRGTY

SEQ ID NO: 39096 - protein, 102 aa, Sorghum bicolor
  Clone ID: SORBI-28MAY03-C91309_1.pep
MKAPSLLVQCFPGLLPSKATSCVPIISEKDLQLPSPAVEIIPSKSAHPYKYAGEKVDVQGLDIFKGKVSVADMIAFSPSEVASSKYDGTLKYWESSITLVNI

SEQ ID NO: 39097 - protein, 209 aa, Sorghum bicolor
  Clone ID: SORBI-28MAY03-C9143_1.pep
ARGQDDPGNDMWSMPSPTPGLQTSSGLGADGKDTSCIVEEARADQGDGAFVETLPTQGDKKMEHANSSASGSLVPEQVKPKASTASGLSLDGSTKALGWQPPGSSLEGSAKASGWKPPALSLAGIGNAAGSQASCPSTQGSTKSSGWQRSSSPDGSRKASAWQRSSTSPEGSGKAHGWQRSSSFTQGGTKSAGWQPSGSSTDRGAKVDG

SEQ ID NO: 39098 - protein, 195 aa, Sorghum bicolor
  unsure (1)..(195): unsure at all Xaa locations
  Clone ID: SORBI-28MAY03-C1016_1.pep
MAGGKSGGNAARSRKRVEATVLKRSRDGSAFTRCEACNKDVPVVLIDMHSCSLDKHIRMMLEAQVVEKTVEVAAKPAERNKSSAKGHGGGGNKDAKRKRSPTAFFLFMDDFRKEFKAAHPDNKSVATVAKEGGEKWKSMTDEEKKPYVEKAAELKAQAENGEGSGENXVAKKKAKXDDKDXGAEVDQPAKSASGA

SEQ ID NO: 39099 - protein, 192 aa, Sorghum bicolor
  Clone ID: SORBI-28MAY03-C10171_1.pep
MSWGRFRFTPHSGLSRTRWTRVFPAQKSAPCTVVLSDEDDDGDDTSDSDVLIIDDAAAGESASAAGRGSQARKGNHSSSNVINIDDDEDEEDGTRGDKAGPSMSRASGSPAAMTPGRGSPRNRYGIGMNGMDSMSDSSESDLTEGWDSYTDDGSSDCEILDDTYTDDGSSDCEILDDTGTTRKMWETAASRK

SEQ ID NO: 39100 - protein, 126 aa, Sorghum bicolor
  unsure (1)..(126): unsure at all Xaa locations
  Clone ID: SORBI-28MAY03-C92305_1.pep
TPFDSLINYCSGYIAPEYLYRGEISTMSDIYCWRVFGLVCSASVPCFPPSPDRSAXTPRPXIHQIWKTDEQIMYKYPSLDPNGLQQVKACVVIGLKCVEADRNKRPSIEDIVNKLNGRRVPIFDQV

SEQ ID NO: 39101 - protein, 145 aa, Sorghum bicolor
  Clone ID: SORBI-28MAY03-C9232_1.pep
PRARGRHNQTHPHPRRSSSSPNPSCTGGGCTAVAVFESSANLLLSRYEPLSTSGQSERAARCSSSAARHHRSSTSATRPGEHCPLPRAGFRPRVHSIRTGRLHYTMSKSGALDLASGLGGKIDKEGVKSAVDEYEKYHGYYGGKE

SEQ ID NO: 39102 - protein, 161 aa, Sorghum bicolor
  Clone ID: SORBI-28MAY03-C90361_1.pep
CVRSNSAHGSGQARLAFQCPKLCSCLADIPICSHEVAQFLPALASPITSLLPQTNKLEYLGETGRGEAIADHAVSLAKSVEGAVTKALAAIEEEATLRKSTQNDLAFITGEFQMMQSFLNVADEERARNNVVRTWVRQVRDLAYNVEDCIEYVIHLDKASD

SEQ ID NO: 39103 - protein, 215 aa, Sorghum bicolor
  Clone ID: SORBI-28MAY03-C90408_1.pep
MAESSSSRGKRIRLEEESHRFGGDRGEESIYADEIGRLPDDVLTNIITLLSTRDGARTQAISRRWRPLWRAAPLNLQVDRSLSGQDRKRIIFVPKILADHPGPARRLALPMIRLRNRYAQIDGWLRSQALTGLQEIKFCYEVEDPEVPYPLPPSALRFAPTLCVAEFCCCDFPNEMALSLNFPCLKNLTLNRASMSEAALHCLLSSCPVLESLWL

SEQ ID NO: 39104 - protein, 294 aa, Sorghum bicolor
  Clone ID: SORBI-28MAY03-C90499_1.pep
HEAQKNPQFVSKLIKMAEASPIFADAFHKKRRLPGFEYITEATETATSFFDDHSSSSRQEMGNLLNQHFSDKLKLGLCPAMTESNLITLSTQSSHEDNGSPHGKHPDYERTAMECLPLVPQMMELSDTGTSICPAKSLSFAAAANDDGFLPCHLNLSLASCSMDVGRSQIPVANGNIVDEKDGPAEMTTPTMEKVGSIPDRCHDADTQNEASGDAGAAADATGRPHQGSQAPPEEHAAPQVVANDKFWEQFLTERPGCSEAEEASSTLRRDPDHTQQADQGTTSDRRDMGQLKL

SEQ ID NO: 39105 - protein, 130 aa, Sorghum bicolor
  Clone ID: SORBI-28MAY03-C9066_1.pep
MAASYFNHSSSSYPPPPPPPGTSPYGAYRHAYPPAPAPAPPAFYGAYYDRAEQALPARDELRTLFIAGLPADAKRREVYNLFRDFPGYVSSHLRTGKSSQAYAFAVFADQQSALTALSGTNGMVFDLEKN

SEQ ID NO: 39106 - protein, 104 aa, Sorghum bicolor
  Clone ID: SORBI-28MAY03-C90795_1.pep
CPVCRQELPAAATPDAEADAGLTIWRLPRGGFAVGRFAGGPREQLPVVYTELDGGFSNGVGPRRVTWPEGEGQVDGGEGRIRRLLRNLFGCFGQPASSSQSRSG

SEQ ID NO: 39107 - protein, 182 aa, Sorghum bicolor
  Clone ID: SORBI-28MAY03-C9081_1.pep
KRKLSDYIGELNAADASLRALKRLATAKKAEVSSDETGKILSDEDFKRIKELKAKKEAKLALAQHGLIKGGDTRSVTFKMPSSDQLSRKRVDPLELEAHVRRKMSKEERLALVKAGREDRGAYMARTAVKQKKTGGLSNKQKQHKKRMPLAATRAKAARSRQEKKQQRKRSGNQFRGRKAWK

SEQ ID NO: 39108 - protein, 177 aa, Sorghum bicolor
  Clone ID: SORBI-28MAY03-C9275_1.pep
MRPGAGFNATAAAAAKVAAVAPAVAGSAAAHSAWHSPVPYLFGGLAAMLGLIAFALLILACSYWKLSGYLEGGAGRGDGDGDGSGADGAKPAASDLPPPIWEEKILVIMAGDVKPTYLATPMSSRASSFGDRSSKGDEEETKKVQEVAMASIVKDAEQNGEHSESRREGEEHRIPEV

SEQ ID NO: 39109 - protein, 105 aa, Sorghum bicolor
  unsure (1)..(105): unsure at all Xaa locations
  Clone ID: SORBI-28MAY03-C92927_1.pep
SLGSLWRVMCPTTTGEDDPLINPFVDGAPPLASLACSRVLVCVGEGDVLRDRGRNYXYDRLTASGWPGEAEIWQAPGKGHTFHLLEPSCDEAVAQDKVISDFLNR

SEQ ID NO: 39110 - protein, 145 aa, Sorghum bicolor
  Clone ID: SORBI-28MAY03-C9281_1.pep
MASEEVLHKVQNLIERCLQMYMNQKEVVDALSQHSKIEPCITELVWRQLEQQNPLFFKAYYMRLMLKNQIMVFNKLLQDQFEIMNKDFSSGIPSMSLPNGSNSNLLKQNPCFLPETAPGSAMPDGIMHNGSSSGIINGTPSGNQL

SEQ ID NO: 39111 - protein, 142 aa, Sorghum bicolor
  Clone ID: LIB3476-060-P1-K1-F11.pep
SHRTQTELLHARLSSPRGAGRQAGRQAGIPVRGAGVEAAQVQNLIERCLQMYMNQKEVVDALSQHSKIEPCITELVWRQLEQQNPLFFKAYYMRLMLKNQIMVFNKLLQDQFEIMNKDFSSRIPSMSLPNGSNSNSMKQNPC

SEQ ID NO: 39112 - protein, 153 aa, Sorghum bicolor
  Clone ID: SORBI-28MAY03-C93047_1.pep
SVVVVTSLSLAVAVVCAVVVLCIRDQLSYFFTGGEAVARAVSDLCPLLAVTLVLNGVQPVLSGVAVGCGWQAFVAYVNVGCYYIIGVPLGVFLGFYLDLGAKGIWSGMVIGGTMMQTLILLWVTSRTDWNKEVEKARARLDKWDDKKQPLLEG

SEQ ID NO: 39113 - protein, 201 aa, Sorghum bicolor
  Clone ID: SORBI-28MAY03-C9152_1.pep
RPGFHLTFDSHTRRHSTKAPPPPAFTASISPSPLHLPLPARITHLHLHGPRSHAVSAECLSLHSVLRSKERREHCHLKSGQKRLSNGANNRVGISSVEVRLKSIRACSCCLMIPAFSCCLHQSTTRSIYKCNVYVNMLQCLYIGACSCFCPLDLCATRSSVSATMYVQCITILCNGAFCFGKNYWNLLVFNFSRSCTLQKL

SEQ ID NO: 39114 - protein, 145 aa, Sorghum bicolor
  Clone ID: SORBI-28MAY03-C9189_1.pep
MGIVCVDASSTLLCEEDRSNALGLVGCCDELLEVGSGLDGLDSADGAVLPVHTDEAVSALVEKEMDHQPQEGYAERLERGGLESSWRRDAMDWICKVHSHYSFAPLSLYLAVNYLDRFLSLYELPHDKPWMQQLLSVACLSLAVK

SEQ ID NO: 39115 - protein, 183 aa, Sorghum bicolor
  Clone ID: SORBI-28MAY03-C91950_1.pep
TRVIIVVHQTSVSAGHVKTFLRSHNTIELLSDKCKVNTANRLISEFLFSSVSPRLIKLEKILKTWFSKRNHHNSSMHFIEAKVASIPLVKFRLEFERDVTEEDPIWDDVPEWKTRPMVRRVPVDIIAEVEDDDRLKAISVKKVRRQFPVVDTTTWGSLASNISFTKFLSFILPPEPLSLDVKW

SEQ ID NO: 39116 - protein, 208 aa, Sorghum bicolor
  Clone ID: SORBI-28MAY03-C9196_1.pep
MAPAVEAVKETGSFQKVPALNERILSTMSRRSVAAHPWHDLEIGPGAPTIFNCVIEIPRGSKVKYELDKKTGLIKVDRVLYSSVVYPHNYGFIPRTLCEDSDPLDVLVIMQEPVIPGCFLRAKAIGVMPMIDQGEADDKIIAVCADDPEYKHYNDIKDLPPHRLAEIRRFFEDYKKNENKEVAVNDFLPATEAYEVIQHSMDLYATYI

SEQ ID NO: 39117 - protein, 250 aa, Sorghum bicolor
  unsure (1)..(250): unsure at all Xaa locations
  Clone ID: SORBI-28MAY03-C9200_1.pep
QKAKEKEEKKLKAKQKEVARLQAQANSDGAKKTEKKQRKKAVEDENPQDFIDPDTPNGQKKLLASQMAKQYSPSAVERSWYAWWESSGYFGADPASTKPPFVIVLPPPNVTGALHIGHALTVAIEDAMIRWRRMSGYNALWVPGVDHAGIATQVVVEKKLMRERKLTRHDIGRENFISEVLKWKDQYGGTILNQLRRLGASLDWSREAPALDERXAKAVTEAFVRLHKEGLIYRDYRLVNWDCTLRTAIS

SEQ ID NO: 39118 - protein, 132 aa, Sorghum bicolor
  unsure (1)..(132): unsure at all Xaa locations
  Clone ID: SORBI-28MAY03-C92208_1.pep
PSCPVKKKVQRSAEDSSLLVATYEGEHNHPSPTRAGELXQRRLRDGQRPRAVLHLHQLLRPDHHAGPHQERRGRRRAGARXAEAPDLKKLCQEIASPDFRTALVEQMARSLTSDSKFTHALAAAILQQLPEY

SEQ ID NO: 39119 - protein, 198 aa, Sorghum bicolor
  Clone ID: SORBI-28MAY03-C923_1.pep
MAPKKRKADPAESAAAAEAAAGNHRQEPASSEPKPRGTIYFPITDDPPESTAPDEDEDDGAGDDEDDAEDIAKLLEPLSREQLVALLRTAAEASPATMAAVRRAAEADPASRKLFVHGLGWGAGAEDLRSAFSRFGELEDCRVISDKQSGRSKGYGFVLFRSRRSALRALSRPQLQIGGRLAFCHLAASGPAPPASQS

SEQ ID NO: 39120 - protein, 52 aa, Sorghum bicolor
  Clone ID: SORBI-28MAY03-C92091_1.pep
SSISSVPQSPIGVLDAASCLSQQSDDATGGSPAVCYHSSSTSKRRRITRRLL

SEQ ID NO: 39121 - protein, 274 aa, Sorghum bicolor
  unsure (1)..(274): unsure at all Xaa locations
  Clone ID: SORBI-28MAY03-C9333_1.pep
LGQCCELPVGYVQVPVGIAGPLLLDGQRFYVPMATTEGCLVASTNRGCKAIAESGGATSVVLRDGMTRAPVARLPTARRAAELKAFLEDPANFDTLSLVFNRSSRFARLQGVQCAMAGRNLYMRFSCSTGDAMGMNMVSKGVQNVLDFLQDDFPDMDVISISGNFCSDKKPAAVNWIEGRGKSVVCEAVIKEDVVKKVLKTNVQSLVELNTIKNLAGSAIAGALGXFNAHASNIVTAIFIATGQDPAQNVESSHCITMLEPINDGKDLHISVTM

SEQ ID NO: 39122 - protein, 210 aa, Sorghum bicolor
  Clone ID: SORBI-28MAY03-C9342_1.pep
MEGLNWEAAETEGEQGHQAMDLEMTTSGKQSRGIGCVLDFIEENPIGVTIFPASLLPPLHADDGGARSGGGGGCVLLDLKAYIADFTNETTAKDFTSAGHEMQATLRVACPPRVSHLCIHCPTLKPADFGTEPVILAACDGFLLFRAAICNSYHCDEPTLQDYFVYRAPLSRMHGRPSLTRLPRPDLSSCFVRCNVGLLRYDGGDSGSNN

SEQ ID NO: 39123 - protein, 109 aa, Sorghum bicolor
  Clone ID: SORBI-28MAY03-C93464_1.pep
PRPAPAGPPAPPAPRPPPPRPPGAPRRGGPPPAAAPPARSAAARAPAPPRGPAPRPPPAGRAPPRPGPRASAGPRRPGPPPPRPAGGRRPAPPRPPRPPPSPATGSRTS

SEQ ID NO: 39124 - protein, 50 aa, Sorghum bicolor
  Clone ID: SORBI-28MAY03-C92330_1.pep
AIKRKDQTRALDMIRSDPELMGLNIIQAPLVDMEIRARGALKFLGDIVWK

SEQ ID NO: 39125 - protein, 109 aa, Sorghum bicolor
  Clone ID: SORBI-28MAY03-C92323_1.pep
KLVWPSGAPARALGQCLPLVGEWRRRGGALSLLISCLWLPLGPLPPQCLRLPPSATPRGSALKKGVLPGPITPTPLKKVKPKAKSAKKVLKKQPSSAVKRLRKLQSFSA

SEQ ID NO: 39126 - protein, 141 aa, Sorghum bicolor
  Clone ID: SORBI-28MAY03-C92331_1.pep
FCLLLFSAIGRFSHGLPVLDAETFKTADPFIAGWLLSAYLLGGFGDDAKGRNGVANAVIAAAKSWAVGIPLGLAIRAVTSGHIPPTPFILVTMGSTGVLLTAWRALVSQLLSNQQKQQDDVYRRGSPFELFELLTSLVRRW

SEQ ID NO: 39127 - protein, 161 aa, Sorghum bicolor
  Clone ID: SORBI-28MAY03-C9239_1.pep
LPPTAALAFGGPSGSLSCGNSATADADADALRRGSRIFVGPFAGLRRVLAGDEHPPPPVFVHPCALLGPPLEKTGIFCIHKGSSNLASWRCRGHSVSFSSWIAMASEFPDEVLKSVFPLLDGKDLVFCMLVCRQWREVAKDDYFWKCICSRKWPSICKLPP

SEQ ID NO: 39128 - protein, 247 aa, Sorghum bicolor
  Clone ID: SORBI-28MAY03-C92418_1.pep
MALRPVHGLASLLVLLSCHCHGGRSEQGAEVPRLEHDVTSPLATVPVVNPTATPVAMPTATPTPSLATGGGGSWCVASPSASATALQVALDYACGQGGADCSPIQQGGSCFSPDTVRDHASYAFNSYYQKNPVQTSCDFAGTAVLTTTNPSTSTCQYPATSTGGSVLNTSTPLTPTYGSPPGYGSSPPAGYGNSPPLYGNMSPPNYGDNISAAVRALQPGRRTTTAAVSLATTCLLTAALSLTTVSG

SEQ ID NO: 39129 - protein, 157 aa, Sorghum bicolor
  Clone ID: SORBI-28MAY03-C9269_1.pep
PRTSAPLAARRPRPPPPALANAVKFFPLCNKYLCAMNGWNEVGHVVMSSSFSIANPMGYEESKNHLLSLSYPELQCLCKKYNLPAKKTHSQLASLLASLLEASPSPTAPPVQLANMKEASTCNLVNNKRGPYSGRDDDIPLVHTKHQKGYQTTVDET

SEQ ID NO: 39130 - protein, 113 aa, Sorghum bicolor
  unsure (1)..(113): unsure at all Xaa locations
  Clone ID: SORBI-28MAY03-C92459_1.pep
VSPTSELFGTKNFGVNHNVVVSNIPVGSLXCFGYFAAYLYQRGARGGGTHQCIGDACYRETFVVWGATCAVGTLLCAVLYARSRSFAGKLASVRTPCLARLANCLTKSSSSSS

SEQ ID NO: 39131 - protein, 171 aa, Sorghum bicolor
  Clone ID: SORBI-28MAY03-C93996_1.pep
MLSLSCPGVSSMSKTALDLGQLVAPCRSRCTGAWASPRRRRTPCVCFVASLATAQPGTAAVDVPARTIPAVTTASAPAPERTSVSSLLEVVSDDLLNLNNNLKSLVGAENPVLVSAAEQIFGAGGKRLRPALVFLVSRATAELAALSELTTEHQRLAEIIEMIHTASLIHD

SEQ ID NO: 39132 - protein, 127 aa, Sorghum bicolor
  Clone ID: SORBI-28MAY03-C94060_1.pep
VDGVNAAKVAAMKAAELVNRNIAAFGPGTGRLSTDQKKKLLWGNKKSNPSEETSKRWELFSDRERQEKFNKLMGVKSSAPVQESMVENKAGSSADEAKKLEELDTNLEKHYIAGLRRRDGRTVGLGL

SEQ ID NO: 39133 - protein, 105 aa, Sorghum bicolor
  Clone ID: SORBI-28MAY03-C94285_1.pep
MSVSESTAIPSSLSSSLELDPLLKDLVEKKLTLKRNVTAMATELKDARNRLASQELLLAQELEARKVAELKARNLEDEVSKLQKCLEDKDEQLRASLYSTGPVSQ

SEQ ID NO: 39134 - protein, 157 aa, Sorghum bicolor
  Clone ID: SORBI-28MAY03-C94317_1.pep
IPPSASKHSRAKAYRGHDDAPAPLPPRYKPADLHRAPSAVHAPATRRSQAATPPRPRSRPADGPGAPPGAAAPAPGALPCSQTGHGGPPTRPRPGGSRRGRGPSRTPGTRSLPPASCPSGPRPPPSHPREASGCAILVDAGCSPVGCDLLFRLRCHL

SEQ ID NO: 39135 - protein, 519 aa, Sorghum bicolor
  Clone ID: SORBI-28MAY03-C93_1.pep
RLISAVILAVCSLISRRKPSPGSKKKRPPGPWRLPLIGNLLHLATSQPHVALRDLAMKHGPVMYLRLGQVDAVVISSPAAAQEVLRDKDTTFASRPSLLVADIILYGSMDMSFAPYGGNWRMLRKLCMSELLNTHKVRQLAAVRDSETLSLVRKVVYAAGAGGGGRGQRGEAPVVNLGRLVLSCSMAITGRATLGKLCGDEIMSVVDVAVLYGSGFCAGDLFPSLWFVDVVTGLTRRLWTARRRLDAIFDRILAECEARQRQEEKMTGDDGFLGVLLRIRDDDGEPETGGISTTSIKAILFDMLAGGTETTSSAAEWIMSELMRKPEAMAKAQAEVRGALDGKSPEDHEGQMDKLSYTRMVVKEGLRLHPVLPLLLPRSCQETCDVGGFEVTKGTKVIVNAWALARSPERWHDPEEFRPERFADDDGSSAAVAVDYRGSQFEYIPFGSGRRMCPGNTFGLAALELMVARLLYYFDWSLPDGMRPEELDMDTVVGSTMRRRNHLHLVPSPYKETELTVGI

SEQ ID NO: 39136 - protein, 86 aa, Sorghum bicolor
  Clone ID: SORBI-28MAY03-C93216_1.pep
LADWCSNNVLAEQFLPFKSPPTHHTSHKILWFKASHRLALDMFDVVWCFCSSMASQKSFSSTRKDMRPCFTGLVWDHFIVIDFVYW

SEQ ID NO: 39137 - protein, 89 aa, Sorghum bicolor
  Clone ID: SORBI-28MAY03-C9310_1.pep
STFWSWYRIPRRRRFTFANSKWWWRNLRVRGREEIFDGHANRLAESVASARRTRKEKGVALQLPHAAPWSPRATPWSPRAASSLLLPRA

SEQ ID NO: 39138 - protein, 96 aa, Sorghum bicolor
  Clone ID: LIB3476-061-P1-K1-A12.pep
RTEIDGLHTISLSVLYFVPKTDTFVVITITILLICAYVCKLFQIPFISNFIRLLHPCLHCDVELFIHVLSKSFWCILAFLFSEHVSTIRLLMWFFA

SEQ ID NO: 39139 - protein, 312 aa, Sorghum bicolor
  Clone ID: SORBI-28MAY03-C93226_1.pep
MAFTPPRLLPLPLPPAAAPASTRAVSARHHGGRTAPELSGPTPRVVVVTSGKGGVGKTTTTANLAASLARLGLPAVAVDADAGLRNLDLLLGLENRVHLTAADVLAGDCRLDQALVRHRALQDLHLLCLSKPRSKLPLAFGSKTLTWVADALRRSPNTPAFILIDCPAGVDAGFVTAIAPAEEAVLVTTPDITALRDADRVAGLLECDGIKDIKIIVTRVRPDLVKGEDMMSALDVQEMLGLPLLGVVPEDAEVIRSTNRGVPLVLNDPPTPAALALDQATWRLVERDAMTAVMVEEQERPKKKGGFFSFFG

SEQ ID NO: 39140 - protein, 187 aa, Sorghum bicolor
  Clone ID: SORBI-28MAY03-C93241_1.pep
HEGIMDTDPGTSHGKGLKFEVGAAEEELDMLLNSFSGTHLSSANLDEPFEHASTLQEVSLSNEKVEPSLSSKPPLLAPLDDALDDLLSESSLDVQSEGFAMRSTTSQPTANYGQNIGFRYAKKMDVTPSIDDSVDDLLEDTSSSLNEPKQITTAQVSNSTPLDSAPLHPGPLNTSASDDFDSWFDSL

SEQ ID NO: 39141 - protein, 224 aa, Sorghum bicolor
  Clone ID: SORBI-28MAY03-C9320_1.pep
HGRVLRLGRRRRGGGSGGVLERVEDVVERRRRRGLGRRRGGPEEVVVGGRGGGGGGPPRRIWYWSRRIRRAPKSAQPTWARPSPAGGGRSRGPAGPGSRPWRARGSTDPSPARSLTRAAAPTPPADRRSRTGAASRRRADLGRSSDPRRGGRSARRESAIGGMASRGPASVGPPKTQRRRRRPGVVAAGDGGAANRSGSSRVRERERREVVVASLPLSLSLFSL

SEQ ID NO: 39142 - protein, 153 aa, Sorghum bicolor
  Clone ID: LIB3476-061-P1-K1-B12.pep
IGPDGSEGPRRARSRHGRGLPLRAEAEVAGQQALEVVHGGRADRRIRRPLARSLAQQRLRRLPIGARGRGPRAGAGRIWAGARTLAGGGGAQGVSRRSEEWRRGARRRWGRRRPGVVAAGDGGAAHRPGASRVRERERREVVVVSLPLSLSLS

SEQ ID NO: 39143 - protein, 224 aa, Sorghum bicolor
  Clone ID: SORBI-28MAY03-C9329_1.pep
ARGRLTAHEVLCHPWIVDDSVAPDKPIDSAVLSRLKNFSAMNKLKKMALRVIAESLSEEEIGGLKELFKMIDTDNSGTITYDELKDGLKRVGSDLMEPEIQALMDAADIDNSGTIDYGEFLAATLHMNKLEREESLVSAFAFFDKDGSGFITIDELSQACEQFGLSDVHLEDMIKDVDQNNDGQIDYSEFAAMMRKGNAGGTGRRTMRSSLHVNLGELLKPSET

SEQ ID NO: 39144 - protein, 197 aa, Sorghum bicolor
  Clone ID: SORBI-28MAY03-C9491_1.pep
MAMAGAAAAGRCLLLSRPSPFRLRLLRAALSTSAPTIGPTSTPAPPPRHELLLERLRLRHLKDASSSPGAPRPASRGAERSSQQGKGKRVEAAESFEELGLGEEVMAALGEMGISKPTEIQCVGVPAVLAGTSVVLGSHTGSGKTLAYLLPLVQLLRRDEAMLGISMKPRRPRAVVLCPTRELTEQGYRVAKSISHH

SEQ ID NO: 39145 - protein, 304 aa, Sorghum bicolor
  Clone ID: SORBI-28MAY03-C94912_1.pep
MADQNKVEVKETKVEVKTATYKVFVHCGQCARDIHTEFTEFPGVEEVKVDAGAGNVTVKGFAFDVEKLRKKVEKGCRKKVELIPPAPPKDDMVVDVKTKKEELKVITVKLPLHCPDCAVRVKEMLLENKSIYEAKTDFGKNTCTVEGVLEEDKLVKYIFERTRKKGVVDKVEKKVIVKEEKVLVKKADKEKEKKEKEKEKEKEKAKEVVAKVVKDVIAPYFIPCTHPHFVDYSHPGHRHGCGGCSYCSPYDGGYGYWGGGGYPPYGGVSYTHTELKGYQGTAFLHCTHPSEFISMENPYACAVM

SEQ ID NO: 39146 - protein, 201 aa, Sorghum bicolor
  Clone ID: SORBI-28MAY03-C94972_1.pep
MDAAAATPALRRRPLSVHKESNGTAATGAAGARVAATGAAEELGEPVDDSARLVEDFYIVVVIGTSTPVNLAAARAGIEAQLARYPHFRSIQVKDDASSEEDGRRRWVPTAVNLDDHIIYPKLDAAAVARDPDRAVEDYVATLSTLPMDWSRPLWEFHVLDFPTSEAAATTAIRVHHSLGDGMSLLTLLMACTRSAADPTR

SEQ ID NO: 39147 - protein, 251 aa, Sorghum bicolor
  Clone ID: SORBI-28MAY03-C9348_1.pep
PPHPFFLPARPPAAVSVARLGEHQRSRAMAASARACLVALALVAALILDGPAAAAAEEGNAGGRGSLTLRQRRRQLLRQRQVRSHLKRLNKAPLATIQSPDGDIIDCVHISKQPALDHPFLKNHTIQMRPAYHPEGLYDESKVASQQNAQTITQMWHQNGRCPENTIPIRRTKEEDVLRASSVRRYGKKKGKTTANPMSVDPDMLNESGHQHAIAYVEGDKYYGAKATINVWQPKIEQANEFSLSQLWIFG

SEQ ID NO: 39148 - protein, 153 aa, Sorghum bicolor
  Clone ID: SORBI-28MAY03-C9352_1.pep
DESKNSKPEKPSSAAGAGLPNPFDFSSMSSLLNDPSIREMAEQIASDPVFNQMAEQLQKSAQGAGEQGIPALDPRRYLASMPPLVPRPLPGSWAPRRALPLWQDPAMSSMLENFTSPAHKEQLEERMARIKEDPSLKPILDEIENGGPSAMVK

SEQ ID NO: 39149 - protein, 244 aa, Sorghum bicolor
  Clone ID: SORBI-28MAY03-C93553_1.pep
MGVGNGMAKLLLPALLLAATACIGVHAKFSRYSFPKDFVFGTGSAAYQYEGAYNEGGKGPTIWDKFTHIPGKILNNDTGDVADDMYHRYKEDVQLLKDMNLDAFRFSIAWTRILPNGSLSGGINKEGVAFYNNLINEVIAKGLKPFVTIFHWDTPLALEDKYGGFLSENIIKDYVDFAEVCFKEFGDRVKAWTTFNEPWTYSYQGYAVGKSAPGRCSSYVNKNCFPGDSAREPYTVTHNIILAH

SEQ ID NO: 39150 - protein, 166 aa, Sorghum bicolor
  Clone ID: SORBI-28MAY03-C93763_1.pep
PIGCIPMYLLAFQSDENEDYEPGTGCIKWLNEFARYHNKLLIQELEKLRKLHPRVTIIYADYYGAATEVFASPQQYGIEYPLMACCGGGGRYGVSSGVRCGRGEYKLCENPEMHGSWDGMHPSETVYKAIAMSLLRGSRTQPPIATTASSCIQLSETGISVEDKSL

SEQ ID NO: 39151 - protein, 81 aa, Sorghum bicolor
  Clone ID: SORBI-28MAY03-C93791_1.pep
LIAGLLLAGEVLPLDPRRYSVYEIALLTVQFRRYSSRYCSSSDTEKIIIMRATYLEAQLAMLGPNDFLSPEPVLVGFVLVW

SEQ ID NO: 39152 - protein, 196 aa, Sorghum bicolor
  Clone ID: SORBI-28MAY03-C93852_1.pep
MTSYLYGGGGRRLLLFPMAAAVAALVGAAPSPASACYTRVFSFGDSLADTGNYHFVYSDDDSDPVLRLPYGETFFHRASGRFTDGRIVLDFIADALGLPFVPPYLSGRRAEDFLHGANFAVGRATALAPDFFRDRGFDIGDVVHLDMELEWFRDMLSLLCPADGLSLSGCSDVMNQSLFIVGEIGGNDYTLPLLER

SEQ ID NO: 39153 - protein, 114 aa, Sorghum bicolor
  Clone ID: SORBI-28MAY03-C93897_1.pep
WQIQHKLAALYAEGCRAEEGGGGQVPAGDVSLWSLRLHSHTYYRYVGSFTTPPCTEDVIWSVMAQVREMTVEQAAALMAPLEKAYRHNNRPTQPMNGRVVQVCHRFVMSKKTAP

SEQ ID NO: 39154 - protein, 151 aa, Sorghum bicolor
  Clone ID: SORBI-28MAY03-C95995_1.pep
AFDCPVSYYQRTEQASVYPNYTYYPSVVELASNSDVLVVACPLNASTRHIVSREVMEALGPKGVLINIGRGPHVDEPEMVAALADGRLGGAGLDVFEDEPNVPEALLAMDNVVLVPHVGSGTYETRKAMADLVLGNLEAHVLSKPLLTPVV

SEQ ID NO: 39155 - protein, 154 aa, Sorghum bicolor
  Clone ID: SORBI-28MAY03-C96015_1.pep
MESLGVLLLHPVNAYLEQELDRRCRLYRFWESPREEFLRAHAGAVRAVVGNANYGADAALIDALPALEIVASFSVGIDRVDLAKCRERGIRVTNTPDVLTDDVADLAVGLAIAVLRKIPQADRYVRAGLWKSRGDYTLTTRFSGKRVGIIGLGR

SEQ ID NO: 39156 - protein, 135 aa, Sorghum bicolor
  Clone ID: SORBI-28MAY03-C96093_1.pep
MADAESNPGAGGKPPPYKDPDNGSQRFLLELEFVQCLANPTYIHYLAQNRYFEDEAFIGYLKYLKYWQRPEYIKHIMYPHCLFFLELLQNANFRNAMAHPTNKELAHRQQYFFWENYRNNRLKHILPRPPPEPTP

SEQ ID NO: 39157 - protein, 121 aa, Sorghum bicolor
  Clone ID: SORBI-28MAY03-C9441_1.pep
MSSSNQMCSDGKFGRGPRELSGAVDLISRYKLLNHHSFFCKKPLPLAISDTNYLNNVVGDTEIRKGEGMELDQLFQNSYSSEKTAYIQPFDMETLGQAFQLRETAPVDLPSAEKGTPTISG

SEQ ID NO: 39158 - protein, 78 aa, Sorghum bicolor
  Clone ID: SORBI-28MAY03-C9439_1.pep
NKLESTLVSAVVISSSYNRRMYRSCEITRLGLTLLLEPMFFFPPNLFGCCKAGHKLWCVCCSLHQDTHHFNFRISPWG

SEQ ID NO: 39159 - protein, 45 aa, Sorghum bicolor
  Clone ID: LIB3480-001-P1-K1-H7.pep
DNIPNRWFRPETDAPSSIRSIQIEEQAIKDFKRFYSSVRIVKPQV

SEQ ID NO: 39160 - protein, 152 aa, Sorghum bicolor
  Clone ID: SORBI-28MAY03-C9459_1.pep
MATNSGSSLTKLAPLEAILFDIDGTLCDSDPIHFCAFRELLQQIGFNDGVPITEEFYSATISGGHNDDLARALFPDMDHQKAMQFMDDKEALFRKLAPGQLKALDGLHELCRWIEGRNLKRAAVTNAPRANAELMLSLLGLTDFFPVLVIGS

SEQ ID NO: 39161 - protein, 241 aa, Sorghum bicolor
  unsure (1)..(241): unsure at all Xaa locations
  Clone ID: SORBI-28MAY03-C94488_1.pep
HEAGAVKTILDEGVSLFRMHQSRHGRXSKGSYAKEWAQWEQRLRVTLFGNADYLNSIQVPFDYAVKEVLEQLKTVAKGDLKTPDTGKRKFGNIMFAAVRLSPPDILGLLHKVAEKDTAVNSFLNKIRLEDNLKKAHVTLAHKRGHGVAAVASYGIYQHQEVPVSFSALYYTDKMAALEAQLGAVPDEQINSRNEWSHATLWTAPGVAAKEANMLPQLASEGKAERVPIDPPIPISGVVDFY

SEQ ID NO: 39162 - protein, 204 aa, Sorghum bicolor
  Clone ID: SORBI-28MAY03-C94688_1.pep
MASLLRLQALAPAMTVPRHHFLISPLRLASAATAPLARRLSTAVSSNKPEPRVSEPDLESGLYLVATPIGNLEDITLRALRVLKCANVILSEDTRHSGKLLQHYNIKTPLLSFHKFNEREREPSILRRLHEGEAVALISDAGTPGISDPGMELARLCATEKIPVIPIPGPSAAIAALSASGLPSNEFTFVGFLPKHARSSGYFS

SEQ ID NO: 39163 - protein, 84 aa, Sorghum bicolor
  Clone ID: SORBI-28MAY03-C9470_1.pep
MKKIFGAKKNKDPPPTIQDATDRITKRGDTVDEKIKKLDAELARYKEQIKKTRPGPAQEAVKARAMRVLKQRRMYEGQRDMLYN

SEQ ID NO: 39164 - protein, 244 aa, Sorghum bicolor
  Clone ID: SORBI-28MAY03-C94792_1.pep
MDHQLFDDPFGSSISSLEADIFSAGGGGQLPSPPWPDLDLDDDYDIHDLSAPAANAATSSGGGYGSGGSGRKLSHNAYERDRRKQLNELYSSLRSLLPDADHTKKLSIPPTVSRVLKYIPELQKQVDNLERRKKELTNANCKPGVLNTKEIVTPIVSATCLNDTEIMGQVSLHSNVAATALPLSKCIKVLENEGLLLVSSSTYSTFENKTFYSLHLQRSQRTMKEQCPGFCDELEKIVRKKAGA

SEQ ID NO: 39165 - protein, 219 aa, Sorghum bicolor
  Clone ID: SORBI-28MAY03-C96467_1.pep
MTNDLLSSPSSWCPRAVAAASSHSHPHPLDPLSAAELTAVRAAVLASPFVPARPLHFHYVGLDEPEKPEVLSYSYASATALLPRRALVIARADGQSHELLVDVTDASAPSVLSHAVHRGAGFPMMTTEDHVAAMALPPTYPPFVDSVRRRGLNVSGILEMKATSYTHLEQIKSDAHGTLVAENTVGVYHDHFITYHLDLDVDTNNSFVKNTMVPERNTG

SEQ ID NO: 39166 - protein, 165 aa, Sorghum bicolor
  Clone ID: SORBI-28MAY03-C96516_1.pep
MMSGSSPPAPSLPAGSGGFFRGYTKLCKGLAVILLLVHLVVQLFPSAVTYLALIPGRTIPFAWNLITAGYVEQTIPGVVVSIIGLLLFGKLLEPLWGSKELSKFIFIVNFSTSACVFMTAIVLYYITQQEIYLYTPLSGFYGVLSGLLVGIKQLLPDQELNLFLL

SEQ ID NO: 39167 - protein, 257 aa, Sorghum bicolor
  Clone ID: SORBI-28MAY03-C9648_1.pep
MPPTTMPSTSLALPTAARAGARRHAFFSNRSPSSVPIARRRRAPRFVMVSASASLEALIFDCDGVILESENLHRQAYNDAFANFGVRCPPASADPLYWDEAFYDELQNRIGGGKPKMRWYFGENGWPSSELFETPPSTDTDKEKLVDIIQDWKTERYKEIIKSGTVKPRPGVLRLMDEVKNAGIKLAVCSAATKSSVIMCLENLIGLERFNGLDCFLAGDDVKLKKPDPTIYITASEKLGVGSKNWSVGDDSVIGLL

SEQ ID NO: 39168 - protein, 69 aa, Sorghum bicolor
  Clone ID: SORBI-28MAY03-C96584_1.pep
ILENMHCKTAVQREHYMRICTGLLYKLTIILQKKKQQLEDPRMYSCRFCFTACQVLGTQGNCWLLVRAM

SEQ ID NO: 39169 - protein, 174 aa, Sorghum bicolor
  Clone ID: SORBI-28MAY03-C94983_1.pep
ATELLLGLEATGRPFLAVLNSPDGAAAVVPPPGFKERVSGRGIVHSGWVQQQHILRHRSVGCYVTHAGFSSVVEGLVAGCRLVLLPMKGDQYLNAALFARELRVGVEVARRDEDGWFGRHDVCDAVAAAVANDGGGGDDARKKWTDFFTDDAVQGKFADEFVRQLREIVSTAPS

SEQ ID NO: 39170 - protein, 118 aa, Sorghum bicolor
  Clone ID: SORBI-28MAY03-C94987_1.pep
PRCGTCRARRSPRPPPPLLAPPPAPLAPPAPAPLRCAPPPLPPLARRASPWRCWGRRRRRGGARGRGPGGRGSSAATPAPPPAAARRAGGSPPPPPPARPPRRHLPPPRGARFSTGSS

SEQ ID NO: 39171 - protein, 182 aa, Sorghum bicolor
  Clone ID: SORBI-28MAY03-C953_1.pep
CVLQKGTDDDKISHEKEVIAAADEVVGSIDKEELAKYLSLNSDPEDEEAQKFKKKMEETRDQLVDALYQKCLALAEIESLKSDESIETSAKDIFEENYKELIKWVDAKSAKYGTLTVLREKRCGRPGTALKVLNDLIQNESEPKKKLYDLKIQLIEEMGWTHVSTYEKQWMQVRFPPSLPPF

SEQ ID NO: 39172 - protein, 51 aa, Sorghum bicolor
  Clone ID: SORBI-28MAY03-C95501_1.pep
MELGHGTAADTPPATAAPGGGGGTFGSLLCGAAVDEQPPFWPWADGHHTFQ

SEQ ID NO: 39173 - protein, 131 aa, Sorghum bicolor
  Clone ID: SORBI-28MAY03-C95712_1.pep
AGPLLADTYVTLLKGRNAWYGQMLAKGELSPDMGDSIKGKGMIQGVSAVGAFFELLSQPSLSVQHPEENKLVAPAELCPILKRLYRILIKRELPARDILQALRDETMNDPRERIEMAQSHAFYRPSLLGKP

SEQ ID NO: 39174 - protein, 172 aa, Sorghum bicolor
  Clone ID: SORBI-28MAY03-C95821_1.pep
EQSQIFRLPAHMVEAGYRVKECTKRLRRKLRRRPTNEEIALDTGMPIKRVEAAVNLPKYSVSLDSKIGSTDMTYQEVTADPSAETAEEMLNRMSMKKDVHKALDTLTTREKQVVVLRFGLEDDRIRTLQEIGNIMGVSRERIRQIESGAFRKLRSKKRVKALKDYLVPVGNW

SEQ ID NO: 39175 - protein, 172 aa, Sorghum bicolor
  Clone ID: SORBI-28MAY03-C9589_1.pep
MSHYHSGDFEEMEDEYDMNEPVEGEDEYQELVVRDSDAEEEDDADQLHKLSDTSAADARSGKDIQGIPWETIEVTRETYRQARLEQYKNYENIPNSGEAAMMACKSTEKGRTYYEFRRNTRSVKSTISHFQLRNLVWATSKHDVYLLLHYSVLHWSALNGVDTEIMDVHGHV

SEQ ID NO: 39176 - protein, 118 aa, Sorghum bicolor
  Clone ID: SORBI-28MAY03-C95982_1.pep
WAFGMNIFDLIAWRKENATSLYHYWQEQNSDLLLWRTGTLPAGLLTFYGLMEPLDRRWHVLGLGYDVDIDDRLIESAAVVHYNGNMKPWLKLAIRRYKYIWERYVNISHPYVRECMLH

SEQ ID NO: 39177 - protein, 175 aa, Sorghum bicolor
  Clone ID: SORBI-28MAY03-C101918_1.pep
HEAHHDHVYEITPLSTDNSKCLFFKRIFGSEHIWHEDLEDISSEILEKCSGSPLAIVTMASLLANKACTKQEWDRVCNSIGSTLEKDPDVEEMRRILSLSFDDLPHHLKTCLLYLSIFPEDYEIERDQLVKRWIAEGFINMEGGQDLEEIGENYFNDLINRSMIQPMKIKCDGRV

SEQ ID NO: 39178 - protein, 80 aa, Sorghum bicolor
  Clone ID: SORBI-28MAY03-C97734_1.pep
LSLCIYIYSFYCLIFFNKHSNFFNKNERKEKKTLLAATQSALASQSCVRLARLPSQLGLPFHEHLQTSNSVPTFAVQPCT

SEQ ID NO: 39179 - protein, 138 aa, Sorghum bicolor
  Clone ID: SORBI-28MAY03-C9754_1.pep
KNCAPAVYTPELRYVCIAGRYIQGAPLLGNSAAASDEILAVDTPSEGGEAVITGSNDKSTRSSVTWRARFVGQGYKQVCGQADVWGDGVVPEMAAHLEGALNISFDGVYHSPVGSDDEQRPWYGSPAILKQWVHHLLS

SEQ ID NO: 39180 - protein, 65 aa, Sorghum bicolor
  Clone ID: LIB3480-033-P1-K1-H7.pep
PHTFMCDTISSLYHRYIQGAPLLGNSAAASDEILAVDTPSEGGEAVITGSNDKSTLSSVTWRARF

SEQ ID NO: 39181 - protein, 92 aa, Sorghum bicolor
  Clone ID: SORBI-28MAY03-C97749_1.pep
LKRSTDPEAAAASDAPRPSSQELKDEILEVAGKIYKAGMSLLVIDTENKFVSTGFAKEIARVAQGKYYYLPNASDAVISAATKTALTDLKSS

SEQ ID NO: 39182 - protein, 342 aa, Sorghum bicolor
  unsure (1)..(342): unsure at all Xaa locations
  Clone ID: SORBI-28MAY03-C97769_1.pep
HEVNISTEQLKYLVMEAIRGGCQGHRAELYAARVAKCLAAMEGREKVFVDDLKKAVELVILPRSSPSDNPQDQQQEQPPPPPPPPPPENQDSSEDQDEEDDDQEDDDEENEQQDQQIPEEFIFDAEGGLVDDKLLFFAQQAQRRRGKAGRAKNVIFSEDRGRYIKPMLPKGPVRRLAVDATLRAAAPYQKLRREKERDKARKVFVEKTDMRAKRMARKAGXFVVDASGSMALNRMQNAKGAALKLLAESYTSRDQVSIIPFRGDYAEVLLPPSRSIAMARKRLEKLPCGGGSPLAHGLSTAVRVGSNAEKSGDVGRIMIVAITDGRANVSLKRSTDPEAAAA

SEQ ID NO: 39183 - protein, 165 aa, Sorghum bicolor
  Clone ID: SORBI-28MAY03-C10874_1.pep
HEEQSSTWHWQRRSRAPAKRSSCSDSETKKMQAFLSSSIPATSYSRSSLFLPQPPHQAPVKLVFPSSAPQRGSGAVAADAAARTRRTASEAAGRSGRCVAASSSSSSPATAAVATTEVPRGDEGLGVRRVRGRQRAQARRGRGCAGPGRRPGARQGRRRRASTPS

SEQ ID NO: 39184 - protein, 122 aa, Sorghum bicolor
  Clone ID: SORBI-28MAY03-C109208_1.pep
MAERLVPSTKKAMEHREEKPKVPSSDPEPDLVTLVAEQQPQLQREHQPPNISEMKPLTREAYGGGMYGTDENARRDPARPRASATQSADGPEEQRAATWPTHPPPPSTGDRDLDITGQSYIQ

SEQ ID NO: 39185 - protein, 249 aa, Sorghum bicolor
  Clone ID: SORBI-28MAY03-C10890_1.pep
RRCGGALEPAAATAAGAPAEEAAAGGKEDKAAAVSCSICLDAVLAGAGHGATARLHCGHEFHLDCIGSAFNAKGVMQCPNCRKIEKGNWLYANGSRSAHDVSMDEWAHDEDLYDVSYSEMPLRFHWCPFGRLAQLPSLFEEGESSPPITFHDFMGQHVFTEQVAVSAAPGTTHPCPYVAYLHPLPPLTSSSSSHVPERTMDRPAYHDHWNPMAGPSDVRPMQTMQPADFHHSHWAHVPHSYAQPNSNNE

SEQ ID NO: 39186 - protein, 253 aa, Sorghum bicolor
  Clone ID: SORBI-28MAY03-C10939_1.pep
MAAAAALRSPSSVRVVSGPSSAAGAGLAKARRQQAPRVAIRGAAGAGQQPRSPRGAAAAVVRASLFSPKPAAAKDARPTKVQELYVYEINERDRESPAYLRLSAKQSENALGDLVPFTNKVYSGSLDKRLGITAGICVLIQHVPDRNGDRYEAIYSFYFGDYGHISVQGPYLTYEESYLAVTGGSGVFEGAYGQVKLNQIVFPFKIFYTFYLKGIPDLPRDLLCTPVPPSPTVEPTPAAKAAEPHASINNYTN

SEQ ID NO: 39187 - protein, 106 aa, Sorghum bicolor
  Clone ID: SORBI-28MAY03-C109434_1.pep
GPLPVFTRAIPASAYRPPPGPTLPLRRFCPPSVFGATLHSPANVALNSGKAALITVGGLAAGATVGSAVENFLQVDIVPFLGIHSPAVVVSEFILFSQLLVSLFVR

SEQ ID NO: 39188 - protein, 195 aa, Sorghum bicolor
  unsure (1)..(195): unsure at all Xaa locations
  Clone ID: SORBI-28MAY03-C10969_1.pep
XEWWRLLTPMCLHSGFLHIALGCWALLLFGPRVCRAYGQMTFFLIYILGGICGNLSSFVHTPEITVCGTGPVFSLIGAWLVYQSQNKQVIDKDVSESMFWQAVIAAALSFLLSIFGRIDNWAHLGATISGLFFGYLTCPSVEFDNSAKNGQKEAVVLIRRQAHPCKSTAVFFITILAFAVVAFAYGTQFNNMDLE

SEQ ID NO: 39189 - protein, 80 aa, Sorghum bicolor
  Clone ID: SORBI-28MAY03-C98678_1.pep
IQYAIFQTTHVVAFQIISCGFPSMPETPSSGEDGEKDSQCALLLFWCLLLLCSNAMIKSKFRGGVAQIVSCYSCLGGNRG

SEQ ID NO: 39190 - protein, 35 aa, Sorghum bicolor
  Clone ID: SORBI-28MAY03-C98747_1.pep
SVHVNDCIWTCIANKLGMANMALWESVMSQLKGYE

SEQ ID NO: 39191 - protein, 191 aa, Sorghum bicolor
  Clone ID: SORBI-28MAY03-C98777_1.pep
TRNDQPLHTDRFADNCAQALSDGAKAIFSFNEPDNAGQAFMTAAYAAKAHVKWLNPYAGKALIGAPSISNSGLAGEGVEWLKSWVSECEKLDEQCHYDFCNVHWYSEVEYGSTLFDHLKASHEACGGKPIWLTEFAPTGSDEAIASWLKDAIPQLEDLSYLDAYSYFKVDTGMLMTSETELSSYGSVYASA

SEQ ID NO: 39192 - protein, 154 aa, Sorghum bicolor
  Clone ID: SORBI-28MAY03-C9660_1.pep
EKAAWKFAEENGLDVVVVNPGTVLGPMIPPAINASMAMFCRLLQGCTEEYADFFIGPVHVEDVAMAHIMVFENPSASGRHMCVQSICHWSDFAVKVAELYPNYKVPKFPKDTQPGLVRQEVGSKKLIALGLQITPMEKIIRDAVESLESRGHIS

SEQ ID NO: 39193 - protein, 246 aa, Sorghum bicolor
  Clone ID: SORBI-28MAY03-C96618_1.pep
MAHDLCDDLELVADCGYDDDYLDDFHFHDDDGFPSPATTTAAASGSGLQQHEQMDNTSALDYKEGKDMQGIPWERLNYTREQYRQMRLKEYKSYQNLTRSRSGLQQECKQVERKDTFYDFHLNTRAVKSTIVHFQLRNLLWPTSKHDVYLVQNYSVMHWSALLQRGTEVLNVAGRLAPTQNVKGARPLSRVQISTMAVKDNLIVAGGFQGELICKYVDKPGVAFCTNLTGDDNSTTNAVDIYQAPN

SEQ ID NO: 39194 - protein, 222 aa, Sorghum bicolor
  Clone ID: SORBI-28MAY03-C96625_1.pep
MWRLKIGEGGGPWMQTASDFHGRQVWEFDPDAGTYEERSKVEQLRRRFTENRFRRREPQDLLMRMQFTGEEHLHADMPPATKIEDGDEVTPEILQESLRRALGWMSALQAEDGHWPGDYSGIMYLLPFWIFALHITGSIDAVLSKEHIREICRHIYNHQNEDGGWGFNILDESAMFSTCLNYTTLRLLGEVQKEENDGLAKGRAWILSHGTATAAPQWAKIL

SEQ ID NO: 39195 - protein, 215 aa, Sorghum bicolor
  Clone ID: SORBI-28MAY03-C9745_1.pep
MAGRYDSNPFEEEDVNPFSEQARGKAGGQSNFGGGAFYMPNPRNVPPASNSRLSPLPPEPADFSATVDIPLDSSKDLKRREKELQAREAELNKREKELKRREEAAARAGIVIEEKNWPPFLPLIHHDITNEIPSHLQRMQYVAFASFLGLICCLFWNVIAVTTAWIKGEGAKIWLLAIIYFISGATGAYVPWYRALHNAMRTDSASKFGLAFLLY

SEQ ID NO: 39196 - protein, 203 aa, Sorghum bicolor
  Clone ID: SORBI-28MAY03-C97507_1.pep
MSLSSCLLAGTRAAASPSFPSSAAIRRRDHRPLTVSVVPLSPSQQWRHGLRFCCASSTSSSPPPPAPPEEPDDYELLDTTGNCDPLCSVDEVSSQYFEANYKPKNDLLKALTIIGTALAGAAAINHSWVAANQDIAMVLVFAIGYAGIIFEESLAFNKSGVALLMAVCLWVIRSIGAPSTDVAVQELSHTTSEVSEIVFFLLG

SEQ ID NO: 39197 - protein, 74 aa, Sorghum bicolor
  Clone ID: SORBI-28MAY03-C9752_1.pep
HKYLKRHQCVHSEMRPFKCPWEGCKMTFKWLWAQTEHIRVHTGERPYKCSAPDCGQTFRYVSDYSRHRKKFNHY

SEQ ID NO: 39198 - protein, 187 aa, Sorghum bicolor
  Clone ID: SORBI-28MAY03-C9758_1.pep
LRSDFWGTNFKIYDSKPPYDGAKASSSRSSRRFGSRRISPQVSAGNYEVGQVSYKYNLLKSRGPRRMYCTLECPSAQETWENSLKTKFRRPLGPTTLRNKAPRWHEHLQCWCLNFHGRVTVASVKNFQLVAAADPSDPTSSVDDETVLLQFGKVDDDMFTMDYRQPLSAFQAFAISLSSFGTKLACE

SEQ ID NO: 39199 - protein, 167 aa, Sorghum bicolor
  Clone ID: SORBI-28MAY03-C99243_1.pep
GAYYYSSHPTSANTLYYHEGPFAGRRMGRSSRPLSLQTVELKVRMCCSGCERVVKHAVSRLRGVDSVEVDVEMEKVTVTGYVDRHRVLKEVRRAGKKAEFWPNPDLPLHFTSAKDYFHDEESYRRTYNYYRHGYNGDKHGQLHEPHRGADPVSNMFNDDDVNACSIM

SEQ ID NO: 39200 - protein, 118 aa, Sorghum bicolor
  Clone ID: SORBI-28MAY03-C9924_1.pep
MVKGHPGGRKTHNLLSAADHIQSGDSSVLSRSKGCIAVPENIKDEYFLSGSDETGVPPHAHPGLQVAPSRALRRLNTSTSDGMSSSSYITGRDDILRGSCEFGSSDWEHVLKEEIGST

SEQ ID NO: 39201 - protein, 90 aa, Sorghum bicolor
  Clone ID: SORBI-28MAY03-C99323_1.pep
ERGLELGSNWKRAELEALSHSRLQKEFLLPFLNCRVKNTKDGLARPGAGGYEEGSLVNEATKAHDDANKTRKWSLTHIRSTTQRGMRHLT

SEQ ID NO: 39202 - protein, 47 aa, Sorghum bicolor
  Clone ID: SORBI-28MAY03-C99371_1.pep
QNLRTPNSYFGTRIASNHRLIYHIEKYNFTTDHANIQCCSTVLKFRF

SEQ ID NO: 39203 - protein, 147 aa, Sorghum bicolor
  Clone ID: SORBI-28MAY03-C978_1.pep
LGLRHVLLVVRCLLIEPFPESALNEQAGKMLLENYEEYARHARLYTGIHALKPKNKSKTGAISESTTALNVDKSSTASSENTPSMPPAVSTSTASRAFGTNLQDQNPTVSDPAVGAAAARKKDGPMASKVPVDKKKMDARKKSLKRL

SEQ ID NO: 39204 - protein, 150 aa, Sorghum bicolor
  Clone ID: SORBI-28MAY03-C97877_1.pep
VFMVKVSDPTVVIRVVQSGDDLGGHVNHPVFSPDGRSIAMTADLAAVSADPISLPLFIHSVRPYGDIFVVDIDPDDARKNKDVKKFHRVTHSRYEYSTPAWTMFATDDPNAQWNMLVNKDSYTPACPYAYPDGGESWHMTGHLCIPRRCC

SEQ ID NO: 39205 - protein, 179 aa, Sorghum bicolor
  Clone ID: SORBI-28MAY03-C98479_1.pep
PTVHYCYFKIVGQQFTREGWGFAFQKESPLAADMSTAILQLSESGKLQSIHDEWFTKPSCATDDESNLGATRLGLGSFWGLFLICALICLLALVMFFIQVCWQYKQYSNSEDADESSAAGADGAGKRQRRLSGLGSFKEIVKFVDMKEEEIMKKSTKRRSGEKDNHAAGLSYAQSVASA

SEQ ID NO: 39206 - protein, 323 aa, Sorghum bicolor
  Clone ID: SORBI-28MAY03-C9806_1.pep
QDFLASLPVKKMKQLGGKLGSSLQDDLGVETIGDLLSFTEDKLQEQYGVNTGTWLWKTARGISGEEVEDRLLPKSHGCGKTFPGPRALKNSASVKGWLDQLCEELSERIQSDLNQNKRIAQTLTLHARASKENERDSTKKFPSKSCPLRYGTRKIQEDAMKLFESGLHEFLESQNTGWSITSLSVTASKIFDIPSGTSSILRYIKGPNSAAPPAIPDSSSVPEDPSLDNDVFVKPIHEEQCQPSTSEKEDNNTHSVSAISAKQCQANKEKRISKKLPEVKGTSSILKFLSRGQSTFHEKRKSDGLICSHQGLVDCKMLMQILI

SEQ ID NO: 39207 - protein, 73 aa, Sorghum bicolor
  Clone ID: SORBI-28MAY03-C98557_1.pep
YFIVSLHFIEPPKCETIKKQKLRNGTKFLSAWESGDVYNILWPSYPCRIPSSPALKRNPNRTQRTGEINKKGK

SEQ ID NO: 39208 - protein, 85 aa, Sorghum bicolor
  Clone ID: SORBI-28MAY03-C98566_1.pep
EKFTNRHARTHPRARRKRRNKKFKRNSSLRIRLRLRLRLTKEQRRQRKPTAEANCHRAYPRNEKVPRSKFRTFHSIAYLFSGKRM

SEQ ID NO: 39209 - protein, 116 aa, Sorghum bicolor
  Clone ID: SORBI-28MAY03-C98634_1.pep
SIRSKKNIVQDNDEFIASESDQQILLIKRQDEELDALSASVQRIGGVGLTIHDELVGQEKLLGELSLDMETTTNRLDFVQKRVAMVMKKASWKGQIMMIAFLVILFIILFVLVFLT

SEQ ID NO: 39210 - protein, 168 aa, Sorghum bicolor
  Clone ID: SORBI-28MAY03-C10038_1.pep
EFCKTCRGNKVVPGTKSVHLDILAGSDNEDTIKVVRSGGEDPDGRPGDLYVTLKVREDPVFRREKGDIHVDAVLNVTQAILGGTVQVPTLSGDVVLKVKPGTQPGQKVVLRGKGIKARNSPYYGDQYVHFNVTIPVNLTPRQRVLIEEFAKEEQGEDEKDAKAAGASG

SEQ ID NO: 39211 - protein, 210 aa, Sorghum bicolor
  Clone ID: SORBI-28MAY03-C108479_1.pep
ARGNRFLHDCVQHKWTKARGVHVHVHPVQPMPSHLCHKYVICTKKERLHVLLSLLERDAPKSGIIFVAEQSERSKKAGNPPSTTVVAEFLRNAYKGSLDVLLLEEDMNFNARAASFSEVKGRGFLLVSTDIASRGFDLPQTSHIYNFDLPKTATDYLHRAGRTGREPFSRLECGVTTLITEDEHFVLQRFQNELKFHCEELPLESMFTFS

SEQ ID NO: 39212 - protein, 154 aa, Sorghum bicolor
  Clone ID: SORBI-28MAY03-C10853_1.pep
MDTVAPRLSRSSTRYGPISSSAASFSGPVRKWRKAWVPLTGAGTAGSGGGSSRGDNKVVLFRWTPVNGGSGGGAGADGGMEPAAAGASTSRRRYVPAAGEAQSTSKKGTSSELNLNLELEEPDDDTDADMSTDEPRDIEGNNARPESRLKRKAF

SEQ ID NO: 39213 - protein, 145 aa, Sorghum bicolor
  Clone ID: SORBI-28MAY03-C108703_1.pep
HEATSGDHDHYDELARRLYAYNSRYHRGRLGVTLTATVRCAYPDRPGVQAALATGLFSRVHVRLYGDLKCTWSDREAWEKWAAAYPASRAFVGVVASPEADKDAYMFQKDLYYNVLQFAQKVPNYGGLMIWDRYYDKMNHYISSS

SEQ ID NO: 39214 - protein, 114 aa, Sorghum bicolor
  Clone ID: SORBI-28MAY03-C10865_1.pep
LDQHRQRALCYRLRMEVHRPLRVALVNRGPDTELLVANPVEVSGKGRPLVFYDITLALKNLQKRIFLAEIGRHVVEDREWEVYRLHFGEEHELSSALRSRIVDAVTNMLMGWDS

SEQ ID NO: 39215 - protein, 134 aa, Sorghum bicolor
  Clone ID: SORBI-28MAY03-C9879_1.pep
FLRARAEGILKEYYPTRTERVDKPLLDQIVRASYDPGAATVLESVFNFNLSIPLNFLFDSFGGKILVIQGMKDPLTKSEAFVTMLREHCSKVQIRELNAGHAPHDEVPDEVNAILCKWVEQMEVKPALEKTKAI

SEQ ID NO: 39216 - protein, 111 aa, Sorghum bicolor
  Clone ID: SORBI-28MAY03-C98875_1.pep
REKKEYPNRATKKNAHHRDNHWGCAFPKNAMYTDTIRNARFPLLPFPKEQKKRREKKEESSERRAMMLMNKQKQPGKSIKSQHRLPLRQCHRLRRRSARLRYPSCVCGCCC

SEQ ID NO: 39217 - protein, 143 aa, Sorghum bicolor
  Clone ID: SORBI-28MAY03-C99139_1.pep
DHVVKVADFGVARFQDQGGIMTAETGTYRWMAPEVINHQPYDNKADVFSFAIVLWELITSKIPYDTMTPLQAAVGVRQGLRPGLPKKTHPKLLDLMQRCWEADPSNRPAFSDILAELEDLLAQVQGTSGKTAQDPSNNSNKKD

SEQ ID NO: 39218 - protein, 111 aa, Sorghum bicolor
  Clone ID: SORBI-28MAY03-C99117_1.pep
RAISIFIFLLKTTVCSSDLGDLESTRQSGLEHSLGIVLVGNLANEVNILRSISRERILGKVGVVEIFPVDSSALVDAVLLHGLAETNHALTSNLFLLLAVDHQLDLEHDGV

SEQ ID NO: 39219 - protein, 95 aa, Sorghum bicolor
  Clone ID: SORBI-28MAY03-C99158_1.pep
LGLLSYRGYWTRVLLEILKKHKGNISIKELSDMTAIKADDILSTLQSLDLIQYRKGQHVICADPKVLDRHLKAAGRGGLDVDVSKLIWTPYKEQG

SEQ ID NO: 39220 - protein, 219 aa, Sorghum bicolor
  unsure (1)..(219): unsure at all Xaa locations
  Clone ID: SORBI-28MAY03-C9922_1.pep
ARGPDVEKQKEPILEHVTAALANRYHLKFTTQDVSSLWFLCKQEASLLNITNQACGLFNEAEVRFLEWTDDLEGFVLKGYGESINYRMGLPLLKDVVQSMEEAIIAREENHPDGTYEKARLRFAHAETVVPFSCLLGLFLEGPDFEKIQREEALDLPPLPPQGRNWKGSVVAPFAGNNMLALYQCPSKISDGSATSGGQSNSYFIQVLHNEAPISMPXC

SEQ ID NO: 39221 - protein, 200 aa, Sorghum bicolor
  Clone ID: SORBI-28MAY03-C99220_1.pep
MAAAIMAGLLILLAAVAAPAHAKDYTVGDSSGWTSGVDYTTWASGKTFAVGDNLVFQYSMMHTVAEVSSADFNACSASNAIQSYSDQNTKIALTAPGTRYFICGTAGHCGNGMKLAVTVPAAAATTPPASSSPPTTPAAPGADTPPETTTPSTSTPTATSPPTATKPTSSSAAAACGGEARLAMGMLAGAAGLAGLPLMG

SEQ ID NO: 39222 - protein, 192 aa, Sorghum bicolor
  Clone ID: SORBI-28MAY03-C10790_1.pep
HEAILLGLVLVGRAAFVFPLSFLSNLTKKSPLEKITLRQQVVFWWAGPCRGAVSTALASSSFSCPRHTLLLADAFLTTCTFPVVRFGPLVCRLVPMPLFRLLPPAPGASPRPDPSAPSPLHSPPPTRLRPSPLGVPAALSLRPSRLRWLRSKPTHTVHYYWRKFDDALMRPMFGGRGFVPFSPGSPTDHAGR

SEQ ID NO: 39223 - protein, 136 aa, Sorghum bicolor
  unsure (1)..(136): unsure at all Xaa locations
  Clone ID: LIB3478-018-P1-K1-E7.pep
LEKITLRQQVVIWWXGLMRGAVSIALADNKFTRSGHTQLHGNAIMITSTITVVLFSTMVFGMMTKPLIHLLLPASSNTAHSEPSSPKSVHSPLLTSMQGSDLEGPSAQIVRPSSLVMLLXKCAQTGHYYWRKFDDP

SEQ ID NO: 39224 - protein, 103 aa, Sorghum bicolor
  Clone ID: SORBI-28MAY03-C10824_1.pep
RLRQQSPLASTEQGEGRNLATPQVSGASEEALRFASMVRQIMPFISQVETQNLNAPPDSSSTPAQAASGSSDRARDVPDDSSSRQHNRDQIDEPNSKRQRTSD

SEQ ID NO: 39225 - protein, 114 aa, Sorghum bicolor
  Clone ID: SORBI-28MAY03-C108466_1.pep
TRDEQRAEALQSAVPAVETLERAFAECSRGKAFFGGDAVGIVDIALGSHLIWIRVVDEVGGTDLLDGAKFPGLAAWAERFVAVDAVKKVTPDAGKVLEQYKGFRAKWIAAAGST

SEQ ID NO: 39226 - protein, 166 aa, Sorghum bicolor
  Clone ID: SORBI-28MAY03-C9955_1.pep
MASLAITKLASTITPTNPWKPACQCACVSGGHGRESSALAAEAETEQAAVSEARPRFRWDAFGSEMSESQQRAVRGLSPKLPNRCKALVARVVCLCPGDESLGALLAYWVKAMKPKRADWLLVLKELKAEDAFAAMKGRGFPCDQVMLTALMDMYSKAGDLTRAKE

SEQ ID NO: 39227 - protein, 166 aa, Sorghum bicolor
  Clone ID: SORBI-28MAY03-C99748_1.pep
AKTVVVSGMLPIGCEPQQLALFPGGPGDYDPTTGCITRFNVLAEHHNHMLRTMLRELRRSNYGRTSLTTLLYADIYRPVIKAVASPALYGFGDRPLAACCGGGGGPNNFDFLAFCGTPASMACADPSKFISWDGIHFTEAANRFIARNMIKGLLPLSRAAAYVATS

SEQ ID NO: 39228 - protein, 150 aa, Sorghum bicolor
  Clone ID: SORBI-28MAY03-C99598_1.pep
MSEMGFPKIVVPAAISCSVCCSAVGFVYQTRGLKHGRAIVVSTCTSVASIVSGVVAGMIALDEHLPKAPTARFLLLLGWFFIISGVILLVSSTRLIARLPRPVQKFLKSNIERTHSIRRPGSARGKDAIPTTTIHTSSLHLLTSPTKEKA

SEQ ID NO: 39229 - protein, 214 aa, Sorghum bicolor
  Clone ID: SORBI-28MAY03-C99760_1.pep
MVAPATLALRPSAAPAQPRAALPRARASWFAPAIIRTSPPVAASYPPRRFSGVRRAVAVDADQQGSPEPPEQEKRPKTYYFLVANAKFMLDEEEHFQEQLAEKLRNYGERDKEQDFWLVVEPKFLDRFPDITKRLKRPAVALVSTDGNWITFMKLRLDRVLQDQFDSESVEEALASNPVELKFEKPEKWTAPYPKYEFGWWEPFLPPKSSNGTA

SEQ ID NO: 39230 - protein, 310 aa, Sorghum bicolor
  Clone ID: SORBI-28MAY03-C99873_1.pep
ARGLDDVPNRGLDTQADIMLNGVPYTQTIADITEMVEPPKKQPVIHFEPGLWMHVPASEQMPVLAASLSRMASIPHGTSINAQSFTATITTKGAPVFSPVDITPTLIANGTKIPFRSQTLTNKNTHRLPQDLTSFDKAGTITQAILTDPNTILRNANIGKNIIENTTFEVSSEAQNPNLGGGTSNIGFLIGADAGVTSASVAARSGNANAVRVTAQYWLSRVRAQIDLPACKSADKKTVSPASHGPRDAVPRFLVDIDVPAAKTVNIEYIQIQYSQNVALDFNGLSWPHVTVGTLAPTIRHKLSQVLVSH

SEQ ID NO: 39231 - protein, 122 aa, Sorghum bicolor
  Clone ID: SORBI-28MAY03-C10017_1.pep
FSLQSIHDKILEVVCISGTWHLGKLQVGLSRAHRLAQGKVIRLHFHSSFPVQVDGEPWIQPPGCLEISHRGQMFMLRRTSEEPTGHAAATMSEVLVNAECNGVIDASQKRLLLHEIALRLSS

SEQ ID NO: 39232 - protein, 102 aa, Sorghum bicolor
  Clone ID: LIB3478-009-P1-K1-B7.pep
LHFSLSPSCSYNGSMRYKILSTAAPMNQPQRSRGPILKGTVKHKRKLLFPPCIIVYTFYLLVLYTPSISIYCGDGVLGVLATGGRAGGRDGVGLRRRRERLL

SEQ ID NO: 39233 - protein, 115 aa, Sorghum bicolor
  Clone ID: SORBI-28MAY03-C10573_1.pep
MDLSRPASSDLSLGLHSHGHARGHAHAARVHAVAAPLRLFDGAEDAKPERVVAGEADAERDDEDGGDQHFSLLGHSLCVKRPRRVVNGGGCGGGDTSSCSSTSAALRPAKRQATG

SEQ ID NO: 39234 - protein, 122 aa, Sorghum bicolor
  Clone ID: SORBI-28MAY03-C10603_1.pep
MDGASKEPLRKDYYKVLEVDYDASDDTIKLSYRRLALMWHPDKHKGDNDVTAKFQEINEAYKVLSDPAKRLEYDVSGCYEIDQYTLREYLAKFKGMILTCNGLGIDHPSSKWARHLRELKPH

SEQ ID NO: 39235 - protein, 162 aa, Sorghum bicolor
  Clone ID: SORBI-28MAY03-C106115_1.pep
MTGIFAPSPAAATSPATTTSPAAVIRPTSAALAAHSPVMGPDVEHRNRENGFGVVSTLIHSPIKGEHSNSPSPIIPVHLSNGMLAHVSTHTASGDLGSYNTKIPKVDFPKFDGEHPKLWLSDCVDYFSLYNVESSAWVRIARMHFVGAAKRWYNAVESQLRG

SEQ ID NO: 39236 - protein, 115 aa, Sorghum bicolor
  Clone ID: SORBI-28MAY03-C10638_1.pep
VRPNFLDFQGLDFEAAFGMRRAYSEGDIQNLGANTPRPAAHAANAQTSCERLVTISDLKTEERKQKLSRYRKKKIKRNFGRKIKYACRKALADSQPRVRGRFAKIEECDLLKPSV

SEQ ID NO: 39237 - protein, 227 aa, Sorghum bicolor
  unsure (1)..(227): unsure at all Xaa locations
  Clone ID: SORBI-28MAY03-C10710_1.pep
DAWAKTNAFISPMWGGVLIWNPPDCCDXDSKTHGTRKKMSSQELMETLEIFIGQLRQLFGLKPSYLSQDMDVPTKFVVSEKGFTEWELDLLYRHHAHSNLLSCLTTLESLSTLVRSLPRMIVMDEIGRQVELSLEAANLAQGNATLGISDSSAVYATRARALAEDAFFHPSIMSISYASVEHYFAIYMPFFAPVSLHVLLAAIKELKRYKAERAKYFAFLASQATSS

SEQ ID NO: 39238 - protein, 167 aa, Sorghum bicolor
  Clone ID: SORBI-28MAY03-C107178_1.pep
MEEEQAAAIQVVVPRVKLGAQGLEVSKLGFGCFGLTGAYGSAALDDEAAAAVIAHAFRRGVTFFDTSDIYGPLTNEILLGKQLKQLPREQVQVATKFGLARDDASGAWTVCGRPEYVRACCEASLRRLGVHCIDLYYLHRVDTTVPIEDTIGELKKLVEEGKVKYIG

SEQ ID NO: 39239 - protein, 69 aa, Sorghum bicolor
  Clone ID: SORBI-28MAY03-C107232_1.pep
MTMRGLLRCVSTGACRVAPGAVAEPVPTSPGSTGGKVPAGHVPVEVGAEGEETHRFVGPDELLGRPPIA

SEQ ID NO: 39240 - protein, 374 aa, Sorghum bicolor
  Clone ID: SORBI-28MAY03-C107192_1.pep
SEHLPMSPVEGCPTVFQAICSLSPGIHEYKFFVDGEWRHDERQPTISGEFGIVNTLYLTREFNQLNALLSPSTPGSRMNMDVDNENFQRTVTLSDGTVPEGTPRVSEAAIQISRCRGTRYLNLHTCYDLLPDSGKVIALDINLPVKQSFHILHEQGIPVAPLWDSFRGQFVGLLSPLDFILILRELETHGSNLTEEQLETHTISAWKEAKRQTYGRNDGQWRPHQHLVHATPYESLRDIAVKLLQNGISTVPVIYSSSSDGSFPQLLHLASLSGILKCICRYFKNSTCNLPILNQPVCSIPLGSWVPKIGDPNSRPLAMLRPNASLSSALNMLVQAGVSSVPIVDENDALLDTYSRSDITALAKDKVYTHVRLD

SEQ ID NO: 39241 - protein, 188 aa, Sorghum bicolor
  Clone ID: SORBI-28MAY03-C107436_1.pep
MARTRVSSHLSIFLLLVSLCAHSAASDDGSGSGSGSADADAGRHARAAATVAELLLVHNAARQVVGVPPLTWSAQIAAYAKAYARSRRGDCAPRRSPLFYFGENVFVGRGRHWNATAMVASWVAEGRWYDYGSSSCAAPSGSSCLRYTQVVWRSTTQLGCARIVCDSGDTFLVCDYFPPGNYGKGRPY

SEQ ID NO: 39242 - protein, 250 aa, Sorghum bicolor
  Clone ID: SORBI-28MAY03-C107994_1.pep
TRHKLNEFYIEREEWYVIRLQVLKERIERVKAKKNDAFTSRSEFTEEMLEIRKDFVIIHGEMILLQTYSSLNFAGLVKILKKYDKRTGGVLSLPFTQRVRHQPFFTTEPLTRLVRECEANLELLFPVEAEVLEPSSSSNLEPHDVARCDPTSSRDVETVDVYRSTLAAMKAIQGLRKASSTYNPLSLSRFFHGEDGEACSGAITSESSLSDSSTDSQIQDAGKDDKEVQSNSREQNAAQGGQNCRRPTDE

SEQ ID NO: 39243 - protein, 214 aa, Sorghum bicolor
  unsure (1)..(214): unsure at all Xaa locations
  Clone ID: SORBI-28MAY03-C103883_1.pep
SPTVPFHPSMACINSTFQSCSIARGAKISTRASRGSSGGKGSPTFQCKASTFVNAASLRLELDENPEAIISRVWPENVSLLSYDDLRAYLESQETVQVEDDQHVALLGEAMSTPVLMATADQTLEEVECHFEAVSGLPVVDSSLRCVGVVVKNDRARASHGSKTKVSEVMTSPAITLSSDKTVMDAAVLMLKXEDPQTTSCKSGRTSNRYSYPC

SEQ ID NO: 39244 - protein, 240 aa, Sorghum bicolor
  Clone ID: SORBI-28MAY03-C103920_1.pep
ARGGVRFPSPCHIFFSSQRKPSTHLAIASPLVGEAVVGIALHGLTLEELLTAVWHGGRGASRLAARSCRPSNPSRSVAEETADHRGHGGGVGSRRVYAPRGAPPRPRGPPRPRPPGPPPRRPRPGPLPGSVVGVPPPPPPPPVALPVPPLLPPSCPPAAPATGAVSDLAEFMHQAVSLRADGAPSVVAAMCHPAPLLIVAPCRDFVASEINNSALSQEGIVSILKGKDLHRCTQICNETV

SEQ ID NO: 39245 - protein, 195 aa, Sorghum bicolor
  Clone ID: SORBI-28MAY03-C10393_1.pep
VLHAKIRPLTVSPSKSFIGFFQPEGNDDMSGFDFLNGAMSFDNIWDEIAQAAEFSSSENPNLYIVPGEKKPSSPDSSDPLKDSSGSESSSTDQDSENDTEEDVLVSKGKESCKEFIKSFLAAIPIRELQVDIKKGLMASTPLHHRLQIEFQYTQSSPKETASANQLLTMDAPFEFSWPEPPPTMEVALTPAVSVV

SEQ ID NO: 39246 - protein, 123 aa, Sorghum bicolor
  Clone ID: SORBI-28MAY03-C10490_1.pep
IDCDTYLHHHGHNDKLPWYRGKEWTYLRGGLTTLDRDYGWINNIHHDIGTHVIHHLFPQIPHYHLIEATEAAKPVLGKYYREPQKSGPLPFHLLGDLVRSLRRDHYVSDTGDVVYYQTDPKLH

SEQ ID NO: 39247 - protein, 125 aa, Sorghum bicolor
  Clone ID: SORBI-28MAY03-C10475_1.pep
YWVQNTTVAARRVASLMRFREKRKERCFDKRIRYSVRKEVAQKMKRRKGQFAGRSDFGDGATSSAACVCPTNGEDDHLRETHCQNCGISSRLTPAMRRGPAGPRSLCNACGLMWANKVHVSLCQS

SEQ ID NO: 39248 - protein, 229 aa, Sorghum bicolor
  Clone ID: SORBI-28MAY03-C104981_1.pep
ASKFRGATIHIVEIDPVVVSASIESMGFPMSSVKGLSPGSMLPAHEDDLLWGGIHNRIFLHIADAEDFIANDSNEYDIVFIDAYDGDDVFPRKLWDVDGAFMKNLEKKVHPVHGTVVVNLHSDSELPDSEAEGNARFQSILPMGRHVSQVCQAYKQHFGLAFTAAVPWLCNITLVACRDKGIASGARLGLSHRDFVLGKLLSKSDTVERALDLPFPCLPYIKNGFTLVH

SEQ ID NO: 39249 - protein, 138 aa, Sorghum bicolor
  Clone ID: SORBI-28MAY03-C105106_1.pep
RAPAPGPPAAPQPRPRPRPADPRAGAAAAARPPPAVGLGTRQVDEEKLRGGAHLHRDPAVCPGLGSPRCPRCLSLLDPTAGERDWALTSVLHDAAAAAGSGDAVSLTAPHGLNAGLPFAHEHARFIGPMYMVYKYVYC

SEQ ID NO: 39250 - protein, 106 aa, Sorghum bicolor
  Clone ID: SORBI-28MAY03-C10443_1.pep
CVIIRFLTRDCFVRHLPSCQARELGFLFLHARAFTSVCHMRMAGSYRGWSLVLDHHHDSGHICGRLVGYLCWRPTLAWCSAWSGLCMHACNAPGISVPISWVQNYL

SEQ ID NO: 39251 - protein, 76 aa, Sorghum bicolor
  Clone ID: LIB3478-023-P1-K1-D9.pep
LHIKVCFLFWLLARSTGKFHCRRMYIVVLVLIKLTEDLILQKMAHVYYFSSLQRMTFVDSVNKFNPHCSYMEQIVG

SEQ ID NO: 39252 - protein, 252 aa, Sorghum bicolor
  Clone ID: SORBI-28MAY03-C10527_1.pep
MRRRPGIAGLQNAAATRDQFRLVGENVAKVRTDVMKEQLATFRSQLEEFARKHKSDIRKNPVFRQQFHEMCAKVGVDPLASNKGVWAELLGIGDFYYELGVQIVDICIATRSHNGGLIDLLDLRKLLGQKRKATLESLSEDDCLRAISKLKVLGSGFEVISVGRRKLVRSVPTELNKDHSGILGLAQAEGYVTVEQVEREFSWSTGRAIDALETLLKEGLAMIDDGHRDGKRRYWFPCVTVSSDTAAVEAKS

SEQ ID NO: 39253 - protein, 196 aa, Sorghum bicolor
  Clone ID: SORBI-28MAY03-C10548_1.pep
MAAFWLLLLFVASAVLVLRTWRARSIISKARQAGPTYPPGLEPYPLIGHLPQFLANRHRVLDWMTEFLERQTTCTFVLRRPGGVRGAITANPANVEHFLRTSFDRYPKGPRFSLLLNDFLGRGIFNADGEAWRAQRKVASHEFNTRSLRAFVARCVHTELHGRLLPLLRRAAASGSPLDLQDALERFAFDNICRVA

SEQ ID NO: 39254 - protein, 158 aa, Sorghum bicolor
  Clone ID: SORBI-28MAY03-C102151_1.pep
ARGWIPGGDVGPKPEKMLQPSFGEPGQCFAMQGSSGFVEIKLKSGIIPEAVTLEHVSKDVAYDRSTAPKDCLVSGWYEETPGETQLGHAAKMALVEFTYDLEKNNVQTFDAPAPDVGVINMIRLDFNSNHGSSQLTCIYRLRVHGHEPVSPGTAGSQA

SEQ ID NO: 39255 - protein, 93 aa, Sorghum bicolor
  Clone ID: SORBI-28MAY03-C102474_1.pep
PTMPAIPSTLPPSVEEAYRRKCVQLKNRTNEVEDANDAARLRLARIKRQVEKLRIERAFLLEQLAKRTSANVEDSDGSPSPPPTVCYYFLPIP

SEQ ID NO: 39256 - protein, 195 aa, Sorghum bicolor
  Clone ID: SORBI-28MAY03-C10248_1.pep
EPEEPEDATKGRDVFNEKPPPEELLSVSDLGKTATTSLPDNLVLHTSMGDIHLRLYPEECPKTVENFTTHCRNGYYDNLIFHRVIKGFMIQTGDPLGDGTGGQSIWGTEFEDEFHKSLRHDRPFTLSMANAGPNTNGSQFFITTVATPWLDNKHTVFGRVVKGMDVVQQIEKVKTDKNDKPYQDVKILNVTVPKT

SEQ ID NO: 39257 - protein, 163 aa, Sorghum bicolor
  Clone ID: SORBI-28MAY03-C10259_1.pep
AGLDVAQIWLDGDETLVNTIDRDGNVLPINMIQGHSLTHDPLVVLVNEGSASASEILAGALHDNGRAILVGHRTFGKGKIQSVTELDDGSALFITVAKYLSPALHEIDQVGIQPDIQCSPDVLSLPRAPSLKENSEATNLEMDSCIMVAEQALEIEQTKGSAS

SEQ ID NO: 39258 - protein, 180 aa, Sorghum bicolor
  Clone ID: SORBI-28MAY03-C1028_1.pep
MADAGEGRRVCGMPEKAQLHVAMLALQFGYAGFHVVSRLALNMGISKLVFPVYRNIIALCLLVPFAYFLEKKDRPQLTLNFVIQFFLLALCGITANQGFYLLGLDNTSPTFASAIQNSVPAITFAMAAALRIEKVRLDRRDGVAKVAGTLACVAGASVITLYKGPTIFGPSGGGGGGDKL

SEQ ID NO: 39259 - protein, 318 aa, Sorghum bicolor
  Clone ID: SORBI-28MAY03-C10297_1.pep
HEAYLVEPLWWIGMISMIVGEIANFAAYAFAPAILVTPLGALSIIISAALAHAILQEKLHTFGILGCVLCVVGSITIVLHAPQERDIDSVKEVWDLATEPAFLCYAAIVVAAALVLIYFVVPHHGQTNIMVYIGVCSLLGSLTVMSVRALGIALKLTFSGTNQLFYPQTWAFALIVATCVSTQINYLNKALDTFNTAVVSPIYYVMFTSLTIIASVIMFKDWDHQNPTQIVTEMCGFMTILSGTFLLHKTKDMTDSPGQCLSTRRPKHASQSAFAIEVMPLKCQDSVDDETLTLSLPKVENGYLKEEHLLRYKDSSIV

SEQ ID NO: 39260 - protein, 178 aa, Sorghum bicolor
  Clone ID: SORBI-28MAY03-C103247_1.pep
HEDGIEYGDMQLICEAYDIMKRGLGMKNKEIGDVFAEWNKGVLDSFLIEITRDIMYKNDDKDGTPIVEKILDSAGQKGTGKWTAINALDLGMPVTLIGEAVFARCLSSLKAERGRAASLLDGPSPSFSGDKKQFIANLEQALYASKIISYAQGFMLIQNAAKEYKWKLNKPEIALMWR

SEQ ID NO: 39261 - protein, 238 aa, Sorghum bicolor
  Clone ID: SORBI-28MAY03-C103418_1.pep
MMNSQNLQLQLPVQDLSLRGRSFISKPTNNKVMHHHHQCPAASSSSPPAAARGGLQVAHPSTSRRRPRALVAVRAAGGSDDASGGESSSSGGGEEDDDGGRSSWSSGGGGGLSRDDLERLVGTDDDAKFNGLDLANLIRKKYGRSYDVTLIKKEFMGRNLLAMNVMWKYREQRSFPLSEEEYLLRLDDVANTLKCWGAVAHVRNTLEKLKERPRIGKAVSIFIDMDQTGGRSNEWIYK

SEQ ID NO: 39262 - protein, 286 aa, Sorghum bicolor
  Clone ID: SORBI-28MAY03-C103518_1.pep
HEGGMVQPSSSRGQIDLFDSIPREGSAAMKNVAFNLQGSDDKSMTESRATFGRVSGVDNISRGASVSVHPKSSETAFKILKQLDRTIPSPTSKPLGLRQTLAKRNTSSVATNRQINGPDFSIGNGNRQSSINESGSANSETTYGKKVQQPQSSPIAEESSEKVQRSRANSDVSEAGTSQQPRKSNLAPTSVAEVLNNKNTSRGFSFTFPIPKAPSSLLEPPPTPTMASPPPTLPITNEDIPKFTFGSPSTANKLVFSFNSTSSSLGAGGTDPTFKFGSDNKRELVF

SEQ ID NO: 39263 - protein, 431 aa, Sorghum bicolor
  unsure (1)..(431): unsure at all Xaa locations
  Clone ID: SORBI-28MAY03-C10377_1.pep
MDSCEGSDDYITQSKIVSAKSAALVDGKIEPAGEGLPDGWLKEYSPCLNRYPSGRFGPPFYIDPINGYKFHSLKDVHRYLESGDINQCFRLPNKRKIGDLHTEGDQSHHTGKLSDHTPLDTADKSNRYDLLKGTNTLGHALLNPKSGENAENVTLCKPDDINXSRGKLIRLKLQKVRASNQASXEETPGEAKFVTRKGANVKEKPKENPRVRKPVKGIAVPLRSSPRLAALKISQEANNTPRDGHSGTQTDITNDPQPKQIQKPRRKTNSSVLPERKDGESTRSSAENLPSVPNQTQGASFPHSSGDAGCQNAPAEAPVLRQQAGQGETSDGLSGSALSSLFQHVWSDPCLVFAFRTLLGDIPVLDDARAYRSSAYDGNRDYYLPPQSMNKNTAANWSASAYDGNRNHAQVNHVMPRSSDKFCGSGWFPPQ

SEQ ID NO: 39264 - protein, 224 aa, Sorghum bicolor
  Clone ID: SORBI-28MAY03-C115528_1.pep
TRDGSGYNNANFATPPDGQRPRMRMYLWDWSVPMKDGDLDSGIIVHEYGHGISTRLTGGPANSNCLVNGQPGGMGEGWGDFWATMFIQRKEYGPGDAFPMGSYAAGRGIRAFPYSADFKIDPQTFGYLNQAGYNLSTNVHAKGSVWCTILIDVYWNLVTKHGFDPDWYAGSGGNNALFRNVVDGLKLQPCSPTFADARDAIILADVHNYKGRHVCDMWESFARR

SEQ ID NO: 39265 - protein, 223 aa, Sorghum bicolor
  Clone ID: SORBI-28MAY03-C115547_1.pep
ARGGNLTQQASLLIDLYLKPEYEQYKKRIVELSHMDPKDSDRELQGFVYEGMRHVGVVPGLPRVATRDVTVQDGVRGPVTVKKGHTVLIATSKAAMDPVAFPNPEILNPHRSFKEYTLLGHGLHFCFGARLVGPSLAATLREVFKLPNVRRAPGRQGHFITTEHQLAGITMRHYLDASSKESPIPTSLRLHYDSVDAAVNGVNGHLTNGHANTGRNNAYTFAP

SEQ ID NO: 39266 - protein, 136 aa, Sorghum bicolor
  Clone ID: SORBI-28MAY03-C115601_1.pep
MAKLHRLISAVLRLAAAGAAAAAAIIMVTSHETTSFFGIEMEAKYSYTPSFVFFVVAFAVAFAYSLLALLARPGSTASRLLLLSDVMVGMLLTGAVAATGAISQVGKSGNEHAGWLPICAQVQAYCSHVMGALIAG

SEQ ID NO: 39267 - protein, 163 aa, Sorghum bicolor
  Clone ID: SORBI-28MAY03-C115640_1.pep
GVPDIPSIGPKEFAFQYTQDKHPWLSKVPPQTDILITHCPPKHHLDLGLGDSNLLREVWRVKPRLHVFGHVHFGYGTESAFFDTFQETYERIMSRPRRGLIRDFIPNEAWLDYLRLVAQGLHSVAWKWLMSGPGSNNGSLMVNAAQMNGNSGKVKSRAVVVEI

SEQ ID NO: 39268 - protein, 85 aa, Sorghum bicolor
  Clone ID: SORBI-28MAY03-C12721_1.pep
YLDVSFTKCHKLMGFSTGPRSKATHWKQTVLYLEDVITICQGETLTGSMTVTPNKNNPRDIDIKLKYSIDGHRCQVSRTQFYKMR

SEQ ID NO: 39269 - protein, 193 aa, Sorghum bicolor
  unsure (1)..(193): unsure at all Xaa locations
  Clone ID: SORBI-28MAY03-C12765_1.pep
MATTIPTVLLASAILVAAATYLRHDTRSSGGSVTAGTHLHFYMHDQYTGENPTAALIMQGRPPLSNSNATTTGSSDDDDPRRFGDIAVMNNALTEGPERGSARVGTAQGFTVRVAERGSVNALSMHLXVMEAGEHAGISLVVSGRVDTDLAVRESVIVGGTGRFRAARGYALSRSYDYDLAKGGVVEVDVYLY

SEQ ID NO: 39270 - protein, 518 aa, Sorghum bicolor
  Clone ID: SORBI-28MAY03-C12777_1.pep
TRERVVARLRKDLFSHLINQEIAFFDVTRTGELLSRLSEDTQIIKNAATTNLSEALRNLTTTAIGLGFMFSTSWKLTLLALVIVPVISVAVPTRGRFLRELSHQTQAAAAVASSIAEESFGAIRTVRSFAQESHEISRYGGKVEETLKLGLKQAKVVGLFSGGLNAASTLSVVIVVIYGANLTINGYMTTGSLTSFILYSLTVGSSVSALSGLYTTVMKASGASRRVFQLLDRVSSMTNSGNKCPINEKDGEVELDDVWFAYPSRPSHMILKGITLKLAPGSKVALVGPSGGGKTTIANLIERFYDPLKGRILLNGVPLVEISHQYLHSKVSIVSQEPTLFNCTIEENIAYGLEGKANFADVESAAKMANAHNFICTFPDQYKTVVGERGIRLSGGQKQRIAIARALLMNPRVLLLDEATSALDAESEYLVQDAMDSLMKGRTVLVIAHRLSTVKSADTVAVISDGLIVESGTHDELLDHNGIYTALVKRQLQGPKFEATSSINDASEIEAEPSRNGQ

SEQ ID NO: 39271 - protein, 97 aa, Sorghum bicolor
  Clone ID: SORBI-28MAY03-C127791_1.pep
RIFRENGLTIRRAEISSSGGEAVDTFYLSDPQGLPVEAKTIEAIRAQIGEATLRVKNNPFAAGGDVAGGAGTTAFIFGNLFKFYRPFQSFSLVKLYS

SEQ ID NO: 39272 - protein, 198 aa, Sorghum bicolor
  Clone ID: SORBI-28MAY03-C12867_1.pep
MAARRDTELDGEELGGEGSNPVGGGATPPPLGAAPVVCVLRSAGDFAGGAFIGSVFGYGQGLLTKKGFKGSFSNAGSSAKTFAVLSGVQSLVVCLLRRLRGKDDIVNAGIAGCCTGVALSFPGAPQALLQSCATFAAFSCIMEGLNKQQAAMARTLGGTAVTVVHEKGGVLPPFTLPPILDASDALASCCLALVKPKH

SEQ ID NO: 39273 - protein, 227 aa, Sorghum bicolor
  Clone ID: SORBI-28MAY03-C117077_1.pep
MRRHGEVCVIFAVAAAALLAAAATPAAAGREDRQTYIVHMSHSAMPSDFVEHEEWYAASLQAVSDAATVLYTYNTLLHGYSARLTRAEAAALARGPGVLVVNPEVRYELHTTRTWEFLGLDGTDALFPQSGTGSDVIVGVLDTGVWPERPSYDDTGFGPVPAGWKGKCEDGNDFNATACNKKLIGARFFLTGYEAAKGPVDTSKESRSPRDNDGHGTHTSSTAAGGA

SEQ ID NO: 39274 - protein, 226 aa, Sorghum bicolor
  Clone ID: SORBI-28MAY03-C117318_1.pep
FALRVKLALSFKGLSYEYIEEARGHNSKSELLLKSNPVHKKVPVLFHNGKPVCESMIIIQYLEEAFADAGPSLLPSDPHERAVARVWAAYIDEKLFSSWMMVFRGKTDEEKAEGTKQSFAVAATLEGALSECSKGKPFFGGETIGYLDVALGGFVAWIHAIEKLYGLKLFFDAGKTPLLAAWLERFCELDAAKAVLPDVEKLVELAKMRQAQAAAAAAAAAVAQDN

SEQ ID NO: 39275 - protein, 194 aa, Sorghum bicolor
  Clone ID: SORBI-28MAY03-C11692_1.pep
LKGLQQCKGRDWFDYISALLLSDLGLPFMSIDEVITVNSDDLILEAFKCMKDNKIGGVPVVEGPKRKLVGSVSIRDIRFLLLRPNLFSNFRQLTVIEFMKTLGSTLPDSGNNCLVKPPPTCTPDASLGSVIDSIASRITHRIYVVDVDLEVVGVVTLRDVISCFIHEPPGYCDSYLTSAMEKLDGKGVGSVEKR

SEQ ID NO: 39276 - protein, 115 aa, Sorghum bicolor
  Clone ID: LIB3478-032-P1-K1-F10.pep
EPEKPIIKNFITQTGVLKGLQQCKGRDWFDYISALPLSDLGLPFMSIDEVITVNSDDLILEAFKCMKDNKIGGVPVVEGPKRKLVGSVCIRDHRFLLLRPNLFSNFKQLTVIEFM

SEQ ID NO: 39277 - protein, 180 aa, Sorghum bicolor
  Clone ID: SORBI-28MAY03-C117673_1.pep
VEELDGVIGHGRLVTEQDIRSLPYVEAIVKETMRLHPVTPLLAPRLCREDASTGSYDIPRGTLVFVNVWAIGRDPAVWGGDAEEFRPERFAGSAVDVKGQDLELLPFGSGRRMCPGYVLGLKMVQVTLANLLHAFAWRLPDGVAPEKLSMQEKFGLAVPRVVPLEAVAVPRLPAHLYAGP

SEQ ID NO: 39278 - protein, 76 aa, Sorghum bicolor
  Clone ID: SORBI-28MAY03-C11437_1.pep
LLPNFVGCDLALFRPRGPPSVAPPILDGDMLVQFLELTGEQQQAILAHTLPGKGPQKSLSVFEVLRTLERVHYALN

SEQ ID NO: 39279 - protein, 138 aa, Sorghum bicolor
  unsure (1)..(138): unsure at all Xaa locations
  Clone ID: LIB3478-029-P1-K1-C12.pep
SIQKAAFRYRLPFDDDTDPVLETVYDCIVASTMLGSLFVMIPLTSEEHQLLQDVQERLSVHPLTAPVLGNDHAEFRQRGTPSVAPPILDGDMLVQFLELTXEQQQAISAHTLPGKGPQKSLSVFEVLRTLERVHYALN

SEQ ID NO: 39280 - protein, 160 aa, Sorghum bicolor
  Clone ID: SORBI-28MAY03-C11486_1.pep
MAHRGHLDGLTAQAPALMHHGSFAAGKLSSHSPLQSSSTLEMLENKLAMQTAEVEKLIMENQRLASSHVVLRQDIVDTEKEMQMIRTHLGEVQTETDLQIRDLLERIRLMEADIHSGDAVKKELHQVHMEAKRLITERQMLTLDIENVIKELQKLSASGD

SEQ ID NO: 39281 - protein, 185 aa, Sorghum bicolor
  Clone ID: SORBI-28MAY03-C114886_1.pep
MQVALIGGTTAAAALYAGLISNYSAAVTELYTLGARKFAVINVWPLGCVPGQRVLSPTGACSDTLNEVAAGFNAALGSLLVDLAARLPGLVYSLGDAFGFTEDVLADPAASGYTDVAGTCCGGGRLGAEAWCSRNSTLCVNRDQHVFWDRVHPSQRTAFLIARALYDGPSKYTTPINFMQLAKSN

SEQ ID NO: 39282 - protein, 156 aa, Sorghum bicolor
  Clone ID: SORBI-28MAY03-C115282_1.pep
MATSSSSLTTLHSRFLSSTPSSPYMAALLPRRRSAGARRYPRIRAIDLDQNTIVAISVGVVSIAVGIGVPVFYETQIDNAAKRENTQPCFPCSGSGAQVCRFCTGKGIVTVVLGAGETEESQCVNCEGIGSLTCTTCQGTGIQPRYLDRREFKDDD

SEQ ID NO: 39283 - protein, 187 aa, Sorghum bicolor
  unsure (1)..(187): unsure at all Xaa locations
  Clone ID: SORBI-28MAY03-C115517_1.pep
LRTRVLPLPRTFPTRAATHGLLLPTSRLSLTTPLRSSTTXDTSEVNYLPRFTVAGATAAASTTASATTTAETTSATESSTTETTTNTKSATETHTTLTKATASTASSTSATASGTSTESTSASASASATGTSTGTSTGSASTSTEASSTTSASASASTTSVVNVNGGMVNRVSGGMLAIVLGAIAVL

SEQ ID NO: 39284 - protein, 218 aa, Sorghum bicolor
  unsure (1)..(218): unsure at all Xaa locations
  Clone ID: SORBI-28MAY03-C1187_1.pep
MASAVASMVAAPKPVFLMDLLASPSASSRHLFRTGDARPRSSSDGVKDSTGKDDAAAADGRPERDPSIPKLFTGDVLDLFPEAAKRDLLLALAEDGGGAGSMITGLAPRGWWISKKDGDALQLKVAMPGLGKEHVKMRAEKNVLVIKGEGDKDAEGDKDAEGDDDKVPVPVPVPARYIYRIGLPSXAFKMDQIKAEMKNGVLILTMPKIRARGAKDVF

SEQ ID NO: 39285 - protein, 138 aa, Sorghum bicolor
  Clone ID: SORBI-28MAY03-C119_1.pep
MPDAATTTSLLSTLPQLSSFSGKSSPPSVVHVARRAPTAVVAAKGYNVQILVDENEGEESIFRRFRREVMRAGVLQEIKRRRRYESKTDEKKRKAREAGRRNRRRRMMDEPRFPEEDADATSKARDEDDDNWEIDGIL

SEQ ID NO: 39286 - protein, 64 aa, Sorghum bicolor
  unsure (1)..(64): unsure at all Xaa locations
  Clone ID: SORBI-28MAY03-C1189_1.pep
CXDIHLKKEIGRSSFTEHQGSKHSDPVAFFFSLYGIENSGLTMSTTRMQDEQSQPGERAKGMQV

SEQ ID NO: 39287 - protein, 66 aa, Sorghum bicolor
  Clone ID: LIB3476-038-P1-K1-G8.pep
RKSDQFLFSGEYQSKRELSQDLGSGKHVGTSIASGEHVVVMLAIEKGSHAVEKGWPWRELRVMSEN

SEQ ID NO: 39288 - protein, 201 aa, Sorghum bicolor
  Clone ID: SORBI-28MAY03-C11909_1.pep
ARGCHPSSSSSTHATRVNSDRWTRHRPQLSSMIGSAKPLAAPLQPPSPTARCLAPSSCAPDSPPPLTRAVKSPAAQSQSQSQSDAAPAPPPPRPAEAAASSHVLRASPQLSRWSRARALRSGRRPGSESSDRAKLSSASVLPATKSPRPEDAAVAVEDGGDDDVCVAERDAAPGKAIYIVSDGTGWTAEHAVNAALGQFEH

SEQ ID NO: 39289 - protein, 87 aa, Sorghum bicolor
  Clone ID: SORBI-28MAY03-C126574_1.pep
FFTSNCQIFVWLLIPQLTNSRKWNYSTQLYKGWLCSLHQYYVSHQSTEFRNILALPRIRILLDPAKMSSFFNWVFTFKKKIRGGARY

SEQ ID NO: 39290 - protein, 96 aa, Sorghum bicolor
  Clone ID: SORBI-28MAY03-C115794_1.pep
MMYGGQLYHPADVAGYMGMGHMHVAVAMDKVASLGTILRQADELRMQALHALRQILTARQAARCFIAADDYFCRLRTLSTLWTTSRTANLARGPAG

SEQ ID NO: 39291 - protein, 171 aa, Sorghum bicolor
  unsure (1)..(171): unsure at all Xaa locations
  Clone ID: SORBI-28MAY03-C11591_1.pep
MQGISICGSVASPHGANCRRACIARNNVKLPCEVNSVSQGLYSLHWCVHKPQMRTNGRRMKAAVRTNARWLFGGDGRSNDARLERSESANEDILIFYFQMDLQTRIQYALNIEQFDVAKQLREKLTEIETEIIRQREAKSGILWTGSDYGTVNLXRVPADLQIAFDSGNYA

SEQ ID NO: 39292 - protein, 185 aa, Sorghum bicolor
  Clone ID: SORBI-28MAY03-C11611_1.pep
MPLPPLLPAMASTFSPTSAARALLPASTSRPLFLAAASSGRIQPSRKGLDFRRGRFTVCNVAAPTAAEQEATASSAAKESQRPVYPFAAIVGQDEMKLCLLLNVIDPKIGGVMIMGDRGTGKSTTVRSLVDLLPDIRVVVGDPFNSDPDDPEVMGPEVRERVLRGDAGLPVTTAKITMVDLPLGA

SEQ ID NO: 39293 - protein, 107 aa, Sorghum bicolor
  Clone ID: SORBI-28MAY03-C11612_1.pep
GRMESIRTMTPEDLDAAREERQLVDSLWITCYHEPSMLRNEGLLVLPGEESFEQPPDVAGRFFEPMRRASARRTPPVDRSDPGDETGGGMVLLLGPAPDGRSNSPRH

SEQ ID NO: 39294 - protein, 259 aa, Sorghum bicolor
  unsure (1)..(259): unsure at all Xaa locations
  Clone ID: SORBI-28MAY03-C116519_1.pep
HEAAAGVTTVPAKILVLPAHLCRQFSFAEMKAATNNFHWRLIVGEGAFGRVYRGKIDGGKTKVAIKRHSPNSRQGEHEFRTEIEMSSKVRHCNVAQLIGYCDEMGEMILVYEYMPRGCLRNHLYRTKQPPLTWNRRLEICIGAARGLHCLHASQVIYRNLRTEDILLDHAWVAKLTDLALCKTAGPSMDEITRVIGSGCLLDHEYVTTGRLTEKLDVYSFGGVLLQVLCARPILDISLLNEEGSTLVDWXLHCKQECRL

SEQ ID NO: 39295 - protein, 266 aa, Sorghum bicolor
  Clone ID: SORBI-28MAY03-C11649_1.pep
KNLLSFRGYCADGPERILVYDFMANSSLYAHLHGPHSAECLLDWRRRASIAIGTARALLYLHHHATPKIIHGSIKTTNVLLDSNFQAHVGDFGLIKLIPDGMDQEKITSESQRGYLAPEYIMFGKPTEGCDVYSFGIILLELASGKRPIEKSGSVKTYGIRNWVLPLARQGRYDEIADSKLSDKFSESELRRMVLVGLACTHSESEKRPTMLEVVPLLKGESKETLLKLERDELFSSDSMVSSQGTPTPDGSTDSVPKKDQELAGA

SEQ ID NO: 39296 - protein, 262 aa, Sorghum bicolor
  unsure (1)..(262): unsure at all Xaa locations
  Clone ID: SORBI-28MAY03-C11667_1.pep
MAELHFVLVPLVAQGHIIPMVDLARLLAGXXARASXVVTXARQRRXATGXVVDSARRAGLDVELAEVAFPGPGLGLPDGMENVDMVVEKDHFMPFFQALWKMDEPLDEYVRSLPRRPDCLIADWCNPWTAAVCARHGIPRLVMHCPSAYYLLATHSLSKHGVYDRVADELETFEVPDFPVRAVGNRATFRGFFQWPGMENYERDIVEAEATADGLLINTFRDLEGVFVDHYEAALGRKTWAVRPTCAFRGLDADAMAGRGKR

SEQ ID NO: 39297 - protein, 159 aa, Sorghum bicolor
  Clone ID: SORBI-28MAY03-C119823_1.pep
MTFPLVCYCNAVPRPVAALFKLLHAVALVFVLVLCFLGLYEFPYDPEDHAPVINGPPRRPRGDAPRPEAVKQRLPLVEFLELSSSSSSSGAAEPTCRVCLERLEATDEVRRLGNCTHAFHTRCIDRWIDLGEVTCPLCRSHLLPRRRAGILGMGMARLG

SEQ ID NO: 39298 - protein, 171 aa, Sorghum bicolor
  Clone ID: SORBI-28MAY03-C120078_1.pep
CHSHSTLSRSHVAFLPFFFNLVSFSFLLVLCWPPELGGLQVSNQAKQLQQIIITHHLLNFTTTRKETHAGLLCYALLFPFGAAAALEVQPLGCLSLVTTGSLVSVHPCLHRSIHCSKAPEGRILAGLLLGTVTTQNRNVVYPCFLCELFLATEQEQSSRSSLLLVARNKEE

SEQ ID NO: 39299 - protein, 220 aa, Sorghum bicolor
  Clone ID: SORBI-28MAY03-C1199_1.pep
TRPISGIAAARALSNASFKVTLLESRDRVGGRVHTDYSFGCPIDMGASWLHGVCNENSLAPLIRMLGLRLYRTSGDNSVLYDHDLESYALFDKHGQQVPQEIVSKVGETFEKILKETVKVRDEHANDMPLIQAMAIVLNRNPHMKLEGLEYDVLQWCICRLEAWFATDMDNISLKNWDQEHVLTGGHGLMVNGYDPVIKALAQGLDIHLNHRVTKIIQRY

SEQ ID NO: 39300 - protein, 256 aa, Sorghum bicolor
  Clone ID: SORBI-28MAY03-C120357_1.pep
TRDNYAESDIVIIGAGSCGLSAAYILGKKRPDLKIAIIEASVSPGGGAWLGGQLFSAMIMRKPADAFLREVGVPYEDEGNYVVVKHAALFTSTIMSKVLQMPNIKLFNATCVEDLITRPSEEGVRIAGVVTNWTLVSMHHDDQSCMDPNTINAPLIISTTGHDGPMGAFCVKRLVSMQRIEKLGGMRGLDMNLAEDAIVKGTREIVPGLIVGGMELSEVDGANRMGPTFGAMALSGLKAAEEALKIFDTRKKQNDL

SEQ ID NO: 39301 - protein, 302 aa, Sorghum bicolor
  Clone ID: SORBI-28MAY03-C1177_1.pep
ARRSAGFFDINLRGLDGIQGPVYVGTGCVFNRTALYGYEPPIKQKKKGGFLSSLCGGRKKTNKSKKKGSDKKKSQKHVDSSVPVFNLEDIEEGVEGAGFDDEKSLLMSQMSLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPLWYGYGGRLKFLERFAYINTTIYPLTSIPLLIYCILPAICLLTGKFIIPEISNFASIWFISLFISIFAIGIL

SEQ ID NO: 39302 - protein, 208 aa, Sorghum bicolor
  unsure (1)..(208): unsure at all Xaa locations
  Clone ID: SORBI-28MAY03-C11741_1.pep
TRIDEAAPGAENEKASIVNQQKLEKKFGQSSVFVTSTLLENGGTLKSASRASLLKEAIHVISCGYEDKTDWGKDIGWIYGSVTEDILTGFKMHCHGWRSIYCIPKRAAFKGSAPLNLSDRLHQVLRWALGSIEIFFSNHWPLWFGYXVWIKCLXERFSYINSIVYPWTSIPLLAYCTLPAICLLTGQFITPELNNVASPWFMSLFICI

SEQ ID NO: 39303 - protein, 174 aa, Sorghum bicolor
  Clone ID: SORBI-28MAY03-C11781_1.pep
WDRNIDDENRQTKDFLILESHEEAAEELPSKAKFFFSAAVETWDAEFYVKVEDNINLDLAGLIEMLEGRRGSQGLYMGCMKSGVVISEEGQQWYEPDWWKFGDSKTYFRHASGSLFILSKNLARYININSASLQSYAHDDISVGSWMMGLNATYVDDDRLCCSSSRQEKVCSNA

SEQ ID NO: 39304 - protein, 152 aa, Sorghum bicolor
  Clone ID: SORBI-28MAY03-C117977_1.pep
FQYGRARRDTVVESHDAAYEVKKGELLFGYQPLATRDERVFGHRGREFVPDRFAACSDDDERRRLLEHVVWSNGPETGAATEGNKQCPGKDAVVAVGRLMVAELFRRYDTFVATVEESPVEPVVTFTSLTRAAAASSAAAAGDHDSVVVVKP

SEQ ID NO: 39305 - protein, 264 aa, Sorghum bicolor
  Clone ID: SORBI-28MAY03-C118041_1.pep
TRAFSVVRRMAAAGTPPRLRSYGPALFAYCDAKDADGAKQVEAHMDASGVVPEEPELAALLRVNADKGKADEVYRLLHRTRALVRQVCDTTAQVVEAWFRSDAASQAGVDKWDPSKVKEGVVKGGGGWHGQGWLGKGAWSVGWTEMDKDGTCQRCGEKLVCIDIDPSETDNFANSLTELAIKREVKEDFLGFQNWLRRHGPFDAVIDAANVGLYNSKAFSFSQVNSVVNAIQRVTKSKKLPLIILHRNRVNGGPAKAPYNQKIL

SEQ ID NO: 39306 - protein, 185 aa, Sorghum bicolor
  Clone ID: SORBI-28MAY03-C118386_1.pep
MNNASRDFGQRYPMNQEQVRRPPPMGQRYDPEPYWRQEQSAPRQSRPQELSNGQTKEQFVAEMLARPSNVESGPGRPQARPRQHQDASPAQGRSQSAVSEKPAAQLDANSVRAKLELAKNAKLEATKRKLQEGYQEFDNAKKQRNIQMVDPQNLPKQGNNNRNFQPSGKPRNNSNVNTSNRNWSR

SEQ ID NO: 39307 - protein, 362 aa, Sorghum bicolor
  unsure (1)..(362): unsure at all Xaa locations
  Clone ID: SORBI-28MAY03-C11465_1.pep
HASEDLLEEFEEEAGDGDSIQSLALGALDNSFLVGGAGIQVVKNFRHGLHGKGASVKISGGRGGSGSAYSTPKKALLMRGETNMLLMSPGEAVRSNGVHHVDIETGKVVAEWRFEKDGADITMRDIANDSKGAQLEPSGSTFLGLDCNRLCRWDMRXTGDGSIVVGSVDGKIRLYSKSSMRMAKTAFPGLGSPITHVDVTYDGKWILGTTDTYLILICTIFKDKDGKEKTGFSGRMGNKIAAPRLLKLTPLDSILAGTDNKFHGGQFSWVTENGKQEKHLVATVGKFSVIWNFQQVKDSNHECYRDQQGLKSCYCYKVFLKDESIVDSRFMHEKFASSDSPEAPLVVATPMKVSSFSIANRR

SEQ ID NO: 39308 - protein, 172 aa, Sorghum bicolor
  unsure (1)..(172): unsure at all Xaa locations
  Clone ID: SORBI-28MAY03-C11483_1.pep
MAARSSMLVVVAITFLLAAPPPAFSARRSFRATMTRTEPAINLTRAAHKSHQRLSMLAARLDDAASGSAQTPLQLDSGGGAYDMTFSIGTPPQELSALADTGSDLIWAKCGACTRCVPQGSPSYYPNKSSSFSKLPCSGSLCSDLPSPQCSAGGAECDYXYSYGLASDPHRY

SEQ ID NO: 39309 - protein, 142 aa, Sorghum bicolor
  Clone ID: SORBI-28MAY03-C120571_1.pep
FVLPHAVHEDTTLDGYRVPAGAPVNFAVGDIGMDEEVWKAPAEFRPERFLPGGEGEDVDLTGSKEIKMMPFGAGRRVCPGMALAMLHLEYFVANLVREFEWREADGEEVDLTEKLEFTVVMKRPLRARAVPLRSPPPAVAAA

SEQ ID NO: 39310 - protein, 113 aa, Sorghum bicolor
  Clone ID: SORBI-28MAY03-C12074_1.pep
HMIIGGLPLLVISVLNHDPALSGHIQDLTLSDILALGYTSIFGSAVSYGVYFYNATRGSLTTLSSLTFLTPMFASVFGYLYLGETFSPVQLGGALLTLVAIYMVNYKSIIGEK

SEQ ID NO: 39311 - protein, 245 aa, Sorghum bicolor
  Clone ID: SORBI-28MAY03-C120943_1.pep
LLFSYCGLACIACVAIGKWLNRRHALQQRAQQGIPVPEDGVLVDMIRVPDWAFEAVGLEMRVGQDTAYHPGLYLTAAQREAVEALIQELPKFRLKAVPTDCSECPICLEEFHVGNEVRGLPCAHNFHVECIDQWLRLNVKCPRCRCSVFPNLDLSALNNLRSTSEPDHPSASASDVTTATAATRYVRSQPAGQSYLVRLQGLLLRPVRHESVESDGEPAVANSRLVGTEELPSIVVDDGHQLPDR

SEQ ID NO: 39312 - protein, 290 aa, Sorghum bicolor
  Clone ID: SORBI-28MAY03-C119488_1.pep
MKFSTTSVLLAAALGVSAHPSGHVHQRAHNSVQARGDFVMANKPAAAPTSTAAPVATPAPSSAAPAKDATSGSQGTGVATYTKFCQGGNSKRATAAEIAYKGNVGGSGQYGCNIMAVQNHLVDQYEYTMVFNNAGGDAECACWNKIGPDGGINGFFNGNEALKFSLPAGGKQTIAIDSNSQIGCTCGVGSIPLTPIGQFAGTWIEGDVGNLSNGGWSGWDASSLVAAAAGMDIPGLNVCGTGAQEGICSTINPGGSGKNAFVAGTAAMDGLGLNCPPGNQSVMVTVGYQG

SEQ ID NO: 39313 - protein, 158 aa, Sorghum bicolor
  Clone ID: SORBI-28MAY03-C11917_1.pep
MEESQIAIKDATQRNVVGTGTKDATESPPIGATIKDVIKDNKTAIDVIWPATIDPNSSHRDGTIYKQGKLYWTGYYNIDVTDRDETRVEPMRFAAATNCHPDPDNCYYHEPCLMMQIFSLKLAKASINSGLIQLYGYIAARDDIDSKLNYVFNRSRDD

SEQ ID NO: 39314 - protein, 114 aa, Sorghum bicolor
  Clone ID: LIB3478-036-P1-K1-B3.pep
FPALAQRDSAAASTILNRHLDHVFRLPLYGPWSIFGVKGENLSKRCYTTLKVKPSCDMEESQIAIKDATQRNVVGTGTKDATESPPIGATIKDVIKDNKTAIDVIMACNNRSEQ

SEQ ID NO: 39315 - protein, 349 aa, Sorghum bicolor
  Clone ID: SORBI-28MAY03-C11951_1.pep
TIKQGSVEVGKEVDACVDAKLRQGAKAHHTATHLLQSALKSVVGSETSQAGSLVAFDRLRFDFNFHRPLSEGELTRIELLVNQWISNAAHLETKVMALQDAKNAGAIAMFGEKYGEQVRVVEVPGVSLELCGGTHVSNTAEIRGFKIISEQGIASGIRRIEAVAGDAFIDYVCARDNYMRRLCSSLKVKAEDVNGRVETILEELRATRNEVSSLRSKIAVLKAASLASKATTVEPQNVRIVVENMGDVDADGLKSAAEYLIGTLQDPAAVILGSSPGDGKVSLVAAFSPAVVKMGLQAGKFVGGIAKLCGGGGGGKPNFAQAGGRKPENLPDALEKARAEIVAGVSSSS

SEQ ID NO: 39316 - protein, 142 aa, Sorghum bicolor
  unsure (1)..(142): unsure at all Xaa locations
  Clone ID: SORBI-28MAY03-C119748_1.pep
MAFAEEETKTTTAAAAAHRGKNLIESSCDSEDGCLAGWAPSGSCTLSAHAEDAPLPSLAATLAAAAADDDSDDEEVQQQRARKPSGRYVVAAHRASDTDGLCRALSRAPRPKVTYRVAGWXVGVGTAVEGSHAVHVEVRVDD

SEQ ID NO: 39317 - protein, 93 aa, Sorghum bicolor
  Clone ID: SORBI-28MAY03-C119801_1.pep
TVEQPSGRRTYQLAPKLQLRPPTEVKWLRARGRSRPWCPRPPTVARSTSACRTRSARYPAARAPGASESSSAAGTPSSESAAAPGTRTAPRLG

SEQ ID NO: 39318 - protein, 174 aa, Sorghum bicolor
  Clone ID: SORBI-28MAY03-C119832_1.pep
MEAYVLFARGKEEEEEVISRFEEQEEDIGCPSEPSALHSTSSSSDGVDLADDASSSGSNSHFEMASLMTHLPIKRGLSKFFDGKSQSFASLAAVAGLEDLPKPPLAKRLKTSRSCGVGLKDAHRGPPSAAGKKQASRARLTTPPALVSAPRRLVRARTLVTARPAAAGKSLLFA

SEQ ID NO: 39319 - protein, 159 aa, Sorghum bicolor
  Clone ID: SORBI-28MAY03-C112282_1.pep
ITPAPSSLPPTHLQVGPQHGIGISSWSPLWHIHIRHPPPPLPCRSVSLARVSEGNGTPPAPPLLLLLRRVLAPPPDDARARLRGRGRAAVATAAAFIGAADGGPPRLAAAGRAGAPQPDSSRERSSGGAAETSSDTRGAAGEAAREALPGADHGAAPGE

SEQ ID NO: 39320 - protein, 83 aa, Sorghum bicolor
  Clone ID: SORBI-28MAY03-C112355_1.pep
MDNISLEGSVADPNEAPEQEPALTRNFTVRTVAGSAHEKALSGAVDAVVAGAAHDQNWSGLDGVTRVNSLVQLPRFSEEKAIG

SEQ ID NO: 39321 - protein, 270 aa, Sorghum bicolor
  Clone ID: SORBI-28MAY03-C11246_1.pep
DIPDAKESGLFHLCEFIEDCEFTYLSTQILHFLGNEGPKTSDPSKYIRYIYNRVILENATVRASAVSTLAKFGALVDSLKPRIFVLLRRCLFDGDDEVRDRATLYLKLLGGEATVGETEKDVNEFLFGSLDVPLANLETSLRNYEPSDVPFDISSVSRETKSQPLAEKKSAGKKSAGPASAVSGPVSTVDASYEKLLSSIPEFADFGKLFKSSAPVELTEAETEYSVNVVKHIFDGHVVLQYNCTNTIPEQLLEQVVVFVDASEADEFLE

SEQ ID NO: 39322 - protein, 140 aa, Sorghum bicolor
  Clone ID: SORBI-28MAY03-C113055_1.pep
ADGARGGARAPARRGGRRRAPRAGPGRGRRPRPAPRRDGRRALVRGRPRRVPRQWRRRRRATPPPGGRRARAGEAGAHRRVVDGARGEPPGRRPRGGRGRPGPGPGGGMGRVLMSSFLIQPGPLLIRCCSCTVPSPTKKM

SEQ ID NO: 39323 - protein, 182 aa, Sorghum bicolor
  Clone ID: SORBI-28MAY03-C113127_1.pep
TRAPGRGPESARAGCCPRLATGGASARAARAAPDVEQRRRRGSARQATGLGPARARGTEVATRTDGGSARPRLLARRARSPRRWPPEGTHRGLFGAGGLGAAGVEARAAGGPPARDLAPAGDRQRPALRSRGRLGLASPRGARVARGAPAAAALARVFAQRSTRTGVIFQLFGLGIAYFSSF

SEQ ID NO: 39324 - protein, 201 aa, Sorghum bicolor
  unsure (1)..(201): unsure at all Xaa locations
  Clone ID: SORBI-28MAY03-C113147_1.pep
HEAGLATVNNISQIGGSLGYTTKETSTLVSLWSIWNFSGRFGAGFISDHFXRLRGVGRPFFIGVTLLIMRVGHAIISSGLPASLYIGSVLIGMCYGCQWALMPSITSEIFGLNHFGTIFNTVAVASPVGSYILSVRIVGYIYDIESSPDEHSCVGKQCFALSFMIMAGVCMFGSAVAFVLFIRTRKFYRRVIYARLQSFLD

SEQ ID NO: 39325 - protein, 170 aa, Sorghum bicolor
  Clone ID: SORBI-28MAY03-C11357_1.pep
ARGLFFLMADACGRQENNILDLKRQIPFSYRFWNLVATIVGFVVPFALFFATRRGTLQPQLPFIPFAVLLGPYLLLLSVQMLTEMLTWHWKSPVWLVAPVVYEGYRVLQLMRGLQLADEISAPGWMVQSLRGLVSWWVLVLGVQLMRVAWFAGLSFARNSRYGESDDMNQ

SEQ ID NO: 39326 - protein, 161 aa, Sorghum bicolor
  Clone ID: SORBI-28MAY03-C1138_1.pep
MANGDAAVEAGGNGKEEPAARQASTFAELGICAELVEACDAMGWKEPTRIQAEAIPHALQGKDLIALAQTGSGKTGAFALPILQELLSNRQAEQSFFACVLSPTRELAIQIAEQFEALGSAIGLRCSVLVGGVDRVQQVLSIGKRPHIVVGTPGRLLDHLT

SEQ ID NO: 39327 - protein, 149 aa, Sorghum bicolor
  Clone ID: SORBI-28MAY03-C113994_1.pep
SLGAKALSEGGFDKLYKQTFSSSPEEHLKKTFACYLSTATGPVAGTLYLTNMNVAFCSDRPLSFTAPSGQTAWSYYKVIIPLGKIATVEPVTMKENPPEKYVHIVTVDSHDFWFMGFVSYDKAVHNLVEAVSQRSQSQHGAGVTAAGTK

SEQ ID NO: 39328 - protein, 247 aa, Sorghum bicolor
  unsure (1)..(247): unsure at all Xaa locations
  Clone ID: SORBI-28MAY03-C11463_1.pep
TREVRDKFDALMEIMITAKEEKRRSQGDDGAETPTKDLLDILMDAAADENAEVRLTRENIKAFVLDIFTAGSDTTATSVEWALALLINHRSCMDKLRAELDAVVGASRLVGEQDVARLPYLQAVFKETLRLQPPAVIAHRETIEPVHVRGYVIPRKTTVFFNIFSIGRDPXWWEDPLEFRPERFMPGGAGAAVDPKGQHMHFLPFGSGRRXCPGMGPPMQAVPAFLAALVQCFHWAVPIPQGQSTAP

SEQ ID NO: 39329 - protein, 230 aa, Sorghum bicolor
  Clone ID: SORBI-28MAY03-C110865_1.pep
MANTTSFRSRLLVLPPPPAPRTAVSFRLRPCATTVSSSSQRRRRPRLAARAAQPGGAVAPASAASKEDEQEEIGSGGGLSAADAERLCEFLRADLPHLFDDVGIDRSAYDDRVRFRDPITRHDTIDGYLFNIRLLKLLFRPDFYLHAVKQTGPYELTTRWTMVMKFMLLPWKPELVFTGLSIMGVNPQNLKFNSHVVNTLAYQATPPLVWFASGRHKTLCSVPLFGTTLR

SEQ ID NO: 39330 - protein, 233 aa, Sorghum bicolor
  Clone ID: SORBI-28MAY03-C11087_1.pep
SNGLDARDHFDLHQLGARMLQHSHSANEMLLRRKLEEQQQQAAELQQAMELQSRRLMGLQLLDLKTRSSPSPIGMPFSPTRAVASATVESPPDSAGEHGPKGSSGFFLPQRGERPAVNGGDKEESAGDASPNADGDQSAEHNLPDSPFASPTKKSAAAAFSRDPFAPSDSEIAATAAASPGRNATAASFAGINNGGGLTGHLRPSALDIPSPKPYFFPMSRLSSDHGAGAIGM

SEQ ID NO: 39331 - protein, 141 aa, Sorghum bicolor
  Clone ID: SORBI-28MAY03-C110975_1.pep
ARGFPFHLTHTLRRIQASKASPWLRRRRPTWAGRGSASWLQRCRGRGSPWPPPPARTRGSSSSRSRHEAAAAATRRRRARRRGTSRGAAAPCPTPRSTCCSTGSRPTELTGPPWSPVVSVGACCSTLLYCTGGITARHGFV

SEQ ID NO: 39332 - protein, 177 aa, Sorghum bicolor
  unsure (1)..(177): unsure at all Xaa locations
  Clone ID: SORBI-28MAY03-C111011_1.pep
ARGTRLARYSQLWWPPPAPAAPHTLPHAAPPLAVAPASPDRAPVLTAGMAPXPCARGPAGPPPPRRPPPAAAPAPPPXPPGSPPSASPTTTPAPTRAPSPPTTPPTPPPPSPPPAPATSSAASPATAPAACRVCSTSCPAPSPSPPPARPAPTPSPPPARPTPMLPSPPRPPPPPPP

SEQ ID NO: 39333 - protein, 199 aa, Sorghum bicolor
  unsure (1)..(199): unsure at all Xaa locations
  Clone ID: SORBI-28MAY03-C111270_1.pep
CCRYHAIHHTKKEANFCLFMPLFDLLGGTIDQQSWDMHKKMSAGXTRLASFCLYXHPFGCLLSLHVPFVLRTFASTPFSVQLFLLPMWPFAFLVMLAMWVWSKTFVISCYNLRGRLHQIWAVPRYGFQYFLPFAKDGINKQIELAILRADKMGVKVLSLAALNKNEALNGGGTLFVNKHPDLRVRVVHGNTLTAAVILN

SEQ ID NO: 39334 - protein, 135 aa, Sorghum bicolor
  Clone ID: SORBI-28MAY03-C111389_1.pep
MRFLKSGRVCIVTHGRYAGAKVVIISVVDSGNKAHPYGHALVAGIERSPQKITRRMSKARQEKRSKVKPFIKVANYNHLMPTRYTLELEGLKGVVSGETFKEVSQREEAKKNVKKVLEERYVSGKNRWFFTPLKF

SEQ ID NO: 39335 - protein, 257 aa, Sorghum bicolor
  Clone ID: SORBI-28MAY03-C11150_1.pep
MGFFSLFLVASMPVVQVLLIRAIGAFLASGFCHAPTSCARGPLDLAGPPVSAPCWRPARLAMSVTLADVISWWFMPVNIGITFIIGGTLGWIACNILKPPQHFRGLIMAFCSAGNLGNLLLIIVPAVCDEDGSPFGKDPSICRSRGLSYSSLSMALGGIYIWTHTYSLMQKSGKLYHKMHSKSIQCPADSDEEHSSDYPDEEAPLPTSVKPGDHEHGEENQMEAPLLSCESEVADKVFWTNLKDAVHQFIEELMAPP

SEQ ID NO: 39336 - protein, 174 aa, Sorghum bicolor
  Clone ID: SORBI-28MAY03-C111509_1.pep
HEARLAPNASQPNASQLQAHRIRPPRHALSAAPRREPRPARTPLAAACPLPEPRLRRWPQTGRAPPPAASRAYAGGRAPSVASPRTHRWPPLRHREPAGRAHAGGRAPRREPAARAAAPVPAPLDLRWPSPRTRPRPPEPRLPPPRSAQQQRKELTMRMEGLLYSKGPPGEPFA

SEQ ID NO: 39337 - protein, 222 aa, Sorghum bicolor
  Clone ID: SORBI-28MAY03-C111893_1.pep
ARGLFLAATTTTTSSSSSILLIISPDSPVSVDPIRRGCAGLLPAGSGRRANHHARRHHAPHCSGGDSNLPLPLTTPVSWELDGRARSRGGGRSDRSINRPADRQSGRTGASVPPSGDADPGAGHLGAALHAAASAGAPDGAPRRRAAADLPRRRLPPGAAAHARPALEPPRPPRLRHRHALISVSLRSSSLRVHVHGWMDALPCPAALFFPFLNKKKGALLL

SEQ ID NO: 39338 - protein, 149 aa, Sorghum bicolor
  Clone ID: SORBI-28MAY03-C11208_1.pep
THLAFNCFSLNSIGPMVEMLTGPRRFLAVYFSSALAGSLMSYRCSASPAVGASGAIFGLVGAHAVYMWRHRRFFGNSRESLEHIGRVVVLNMGMGLLSRGIDNWGHLGGLLGGVAMAWFLGPAWQYQYVAKDGRAVFKDRAPVLRLIKG

SEQ ID NO: 39339 - protein, 187 aa, Sorghum bicolor
  Clone ID: SORBI-28MAY03-C109775_1.pep
PPLQRPSWASPPPAGSPSRSAPPPPAWPPARAATPAAAPRGPARTRLPPIPPPPAPPPFPRRPLPGRLRPPARTPGLPPSLGLGARVSHPPGKAPHPQMKHIFKIAAILIAISAIWIALLETSTVPRSYTWLLPIYLVVALGCYGLFMVGFGLMFFPTCPQEAVLLQQDIVEAKEFLAKKGVDVGSE

SEQ ID NO: 39340 - protein, 183 aa, Sorghum bicolor
  Clone ID: SORBI-28MAY03-C10985_1.pep
LSIETCPHYLAFSSEEVPDGDTRFKCSPPIRDDTNRENLWKALLDGHIDMLSSDHSPSTPDLKLMEEGNFLRAWGGISSLQFVLPVTWSYGRKYGITLNQLSSWWSEKPAKLAGQKNKGAILPGYHADIVVWKPETEFQLDDSHVIYHKHQNISAYLGKQLSGKVLSTFVRGNLVFAEDKHAN

SEQ ID NO: 39341 - protein, 120 aa, Sorghum bicolor
  Clone ID: SORBI-28MAY03-C110084_1.pep
TRGRPWQKTRSSALGRHRRIRRTLYGATAQRRWRSAASSSLAASATSCSGARRTGATSRLAAGLRDGSGDRPLASLPRCSNNVYVFHMCRISSALLVCYYYLTIRVEHANFIYCVKKSHL

SEQ ID NO: 39342 - protein, 145 aa, Sorghum bicolor
  Clone ID: SORBI-28MAY03-C110311_1.pep
TRQALAGDAVGRKGETDESAWQQGQDVRRPPAASAREGARRPAPGPAVAAKGRAATENIYGKGKGATGAFGEKMVMPTDVVERKRAEAAAGGGDGEAAAASPPAPGIGDDDVMLRVKEADQMTGQAFNDVGPMGEEGTGMPRRRR

SEQ ID NO: 39343 - protein, 150 aa, Sorghum bicolor
  Clone ID: SORBI-28MAY03-C110353_1.pep
HVPDARGAPRPRRRRRRRPPGGRRPPRRGPRRGGAARGAPPAAAPRRRPPPGLLRPPGPLPPLPRADGVGAPAAAALRRATIRRRCRRRRRERRLCGGRREEELRDGQGDGGAGGGGHSQRHVGRRGDGQGKGEDGQGKGEGSSLAARRC

SEQ ID NO: 39344 - protein, 244 aa, Sorghum bicolor
  Clone ID: SORBI-28MAY03-C110437_1.pep
MISPDAARNVVGIIGNVISFGLFLSPAPTFWRIYKARDVEEFKPDPYLATLLNCALWVFYGIPVVHPNSILVVTINGIGLVIEGIYLTIFFIYADAKKRKKAFAILFVEILFMVAVVLGVILGAHTHEKRSMIVGILCVIFGSVMYASPLTIMGKVIKTKSVEYMPFLLSLVNFLNGCCWTAYALIRFDLYVTIPNALGAFFGLIQLILYFWYYKSPPKKEKNVELPPVSRNVGGGNVTVSVER

SEQ ID NO: 39345 - protein, 152 aa, Sorghum bicolor
  Clone ID: SORBI-28MAY03-C110506_1.pep
MKAAEDATRCPEIPRRCHHCAGPLSKDMETSSWTVPPLVRDSFSMIGSALGGIAGAFYGFNHVMPVVRRHIKGPMWMHFFVGAPPVIVFSSACAGLAGGTIPATAQLVSSSYHAVSSHSFARSSSHVAKHAPSFAPSASHDDMHKKRSSSPL

SEQ ID NO: 39346 - protein, 206 aa, Sorghum bicolor
  Clone ID: SORBI-28MAY03-C11051_1.pep
RRPRPRPWRTSSRSSSGRITATPRRAPHRRPRESFDEGGGVGLGIVAAMSHACLTGAGAGVGAEPIAIGAAARRRRAREEDESYTCVITHVAGAGGGSVRKRVYFGFGDGGGWLVEADDEAPAPAPDFLSRCCLCDKRLDGLDIYMYRGEKAFCSSECRCQQMLMDDRADKCGSEALIRSGGDYSYSVSPHSTPSGLLAKRRSSLV

SEQ ID NO: 39347 - protein, 151 aa, Sorghum bicolor
  Clone ID: SORBI-28MAY03-C110665_1.pep
HEGGAAATQHNAAAQHALGPVAIVVLAVAATVAVAAIAAFGCAQGVKKPPRQNNNNAYYYGQGYPPPPAGAYGYPAQQPPPPGYAYPQQQQRPGRSGLGSGAAGLAVGAVGGLAAGAIIGSALDSGGGGCGGGGGCGGGGCGGGCGGGCGG

SEQ ID NO: 39348 - protein, 141 aa, Sorghum bicolor
  Clone ID: SORBI-28MAY03-C11085_1.pep
PKGYTIPSLDTLINQGSLNVQAGTAFVDYEFLGEINTGKLSATMVNKFSCIALAGVATEYLLYGLAEGGLADINKLDGLLKSLGFTQKKADSQVRWAVLNTVLILRRHEKARSQLAEAMSTGKSVGSCIQVIEECISTDDI

SEQ ID NO: 39349 - protein, 285 aa, Sorghum bicolor
  Clone ID: SORBI-28MAY03-C12226_1.pep
TRPDDDFPYLLDNPPDLLPSYIGLCDEFVSIDALMNMSSRCGAFPLIESATEASVDYKPCSSEVDLCFNSEVLEWLNPHLLEEDLPDLVDFAELNSNAAPAKKEQWTRKVTLVLDLDETLVHSTMEHCDDADFTFPVFYDMKEHVVYVKKRPHVHMFLQRMVEMFEVVIFTASQSVYADQLLDMLDPEKKLFSKRFFRESCLFTDNGYTKDLTVVGVDLAKVVIIDNTPQVFQLQVNNGIPIESWYSNPLDEALPQLIPFLETLAVADDVRPIIAKKFGNIIDSC

SEQ ID NO: 39350 - protein, 149 aa, Sorghum bicolor
  Clone ID: SORBI-28MAY03-C1223_1.pep
MGTPNEMMAYSSLSKMDTGQKGAALSNVVAGNNYPVQDYLYEPAYEPDFPEYDSRDDPFAPTQASPKVNLKTVLGGLVSIVTGVNKSEDDASQQEGFSTDISFLGSDKNGDVNVHPSVCVPSAPPLLEANALQYSAYREVLLADPPEWL

SEQ ID NO: 39351 - protein, 190 aa, Sorghum bicolor
  Clone ID: SORBI-28MAY03-C122467_1.pep
MYTWSALFMVTHIMQYTLCLFFYAVRPSVPAVIWAGHYSLPCGHSSWSFAGLGFLSWYLAGKIKVFDRKGHVAKLCIVLSPLLLAALVAVSRVDDYWHHWQDVCTGGLLGLTVASICYLQFFPLPSDENGLWPHAYFRHIGEPEGDNQVQPTYMSRRSSIHNGSFHSPDAVEMRSTSRALDSMEAGGRVQ

SEQ ID NO: 39352 - protein, 174 aa, Sorghum bicolor
  Clone ID: SORBI-28MAY03-C1229_1.pep
MSQHDDDLAGVHSEEGDRHGVVMDDSDYEDDELDQSTSKATEHITAMDVKKGKDIQGIPWDMMATTRDKYRQSRLQRYANFENVPNSGRISEKECMPAEKGQLYYEFQHSTRSVKSTILHFQLRNLVWATTRHDVYLMSNFSVLHWSALTCKKQEVIDLQAHVTPCEKHHGNYY

SEQ ID NO: 39353 - protein, 205 aa, Sorghum bicolor
  Clone ID: SORBI-28MAY03-C14531_1.pep
PKHVSVKEAVLPFEKFQGCDILLGPEMRSTGEVMGIDYEFSGAFAKAQIAAGQRLPVSGTVFLSLNDLTKRHLAEIGRGFRELGFNIIATSGTAKVLQLEGVPVEPVLKIHEGRPNARDMLKNGQIQIMVITSSGDALDSKDGLQLRRLALAYKVPIITTVDGARASIDAIKSLKNKSIETLALQDYFQTADTSADLQAAAQTTP

SEQ ID NO: 39354 - protein, 163 aa, Sorghum bicolor
  Clone ID: SORBI-28MAY03-C14554_1.pep
DISGAEYRGKEVPLFVLPTRYLLKLDTTMTSYCDMQRVLFEEEQSAYNQAMQQNICDGKIHPLTSIHHTSTYNSSLCKLMEYCLSPAVTTLQDRLKENELRLSMLQEEAKQLEADTQSMRNNSPRRLMNHGAGGNSSPMAQSRHPFSNQGSPRSPMGGSRRRA

SEQ ID NO: 39355 - protein, 200 aa, Sorghum bicolor
  Clone ID: SORBI-28MAY03-C14563_1.pep
TRLYHMSASFPSFVANESVSRLPLVGLISNCLGCISVQRESKSSDAKGVSGAVTERVREVCQDKNTPMMLLFPEGTTTNGDYLLPFKTGAFLASAPVQPVILKYPYKRFSPAWDSMDGARHVFLLLCQFVNHMEVVRLPVYYPSQQEKEDPKLYANNVRKLIATGGNLILSNLGLAEKRVYHAALNGSSLPGASRHQKDD

SEQ ID NO: 39356 - protein, 75 aa, Sorghum bicolor
  Clone ID: SORBI-28MAY03-C14577_1.pep
IAPYPIGFSVATLAPSSSSPEYISTKDPSINQVASPVAAPEPVGAILPKGVFPPDTIMRTQTSTSVGSSSPGGGR

SEQ ID NO: 39357 - protein, 258 aa, Sorghum bicolor
  unsure (1)..(258): unsure at all Xaa locations
  Clone ID: SORBI-28MAY03-C14608_1.pep
MGWAPRWLRGLLGGGKKSAETKPVKEKKRWGFGKSFREKTPAPAPARPPTPPVQPTATPRRGYAAAPDEGDDEQSKRAIAVAAATAAVAEAAVAAAQAAAAVVRLTSSGRCAPAAAAKREEWAAVRIQAAFRGYLARRALKALRGLVKLQALVRGNIVRRQAAETLRCMHALVRVQARARACRAIRSQRVAAHPDPPTPEKYDQAGAPRHGRSGSLKANASKTPGGERLGRERSESCGRNWLDRWVEEGHGDEKTXRS

SEQ ID NO: 39358 - protein, 187 aa, Sorghum bicolor
  Clone ID: SORBI-28MAY03-C14573_1.pep
KGNNFLPMWLMMKLISHISWKYRLMIFGGPGHVHVYICIVIYLFIMLHQFPEVNILQLPPGSRRMPFRGLLGSLPLRISCSVPSPASVPASTLTLALSERCPRSPSSSPLLPTVTPSPVLGRHEPDLGFRPFIGWQRRHRWPLPSPPPHTAWPRGMAPRSGRRGRHGFRAVARRGWRPPLAWPPPSA

SEQ ID NO: 39359 - protein, 194 aa, Sorghum bicolor
  Clone ID: SORBI-28MAY03-C124967_1.pep
MEAAAATALPFAAGSAAAFPAAAGRVRRAARCARPRTRRSVVAKLEGGLGKGVPTTNYVVPLDKATGMTRPLVEILRDLNKRVPDKIIDPDTDTVHWYHANRMLSFYAPGWCGEVRDVIYSENGTVTVVYRVILKGTDGEAYRDATGTAQVHEGRREDAVAAAEEAAFCKACARFGFGLYLYHEDDTHHEDHFH

SEQ ID NO: 39360 - protein, 256 aa, Sorghum bicolor
  Clone ID: SORBI-28MAY03-C12498_1.pep
MHGHPHRGGEETPEDRHHPGVVDADDSDSDSEGSEYDEERSVSPPPPPHAPSHHHVPAPVAQQPPPYFATAPHMLLSLGSGGAPGAAVAAAASAAQRLQAPAPQQLTPSSAPPGPGRVGAMPMPRKRFRTKFTAEQKQRMQELSERLGWRLQKRDEAIVDEWCRDIGVGKGVFKVWMHNNKHNFLRAAPNPRRRCCTVVIQPVQDHPSASRPHLFPDQRHRLQHQRRRLLGAHRRHRRPHGQRRQRSFIAAVRLNY

SEQ ID NO: 39361 - protein, 265 aa, Sorghum bicolor
  Clone ID: SORBI-28MAY03-C12551_1.pep
ARGGAPLDYETHVQYIQCLRKSGNIEKLRAAREEMNKCSPLTPKMWQEWAKDEISLSSSEESFGDIEKLYERGVQEYLSIKLWRDYLDYVEEHDQSVSQCTPSGLSKMRNLFESAITAGGLHITEGSKLWAAYREYEMAILITIADANDEEREKQVQRIRTLFHRQLSVPLADMESTLAEYKSWEAEQGNANDPGADFDGVPSNVVSAYKKANDMYNERKQYEDQLSNAGTSEADKLQEFVKYIKFEESSGDPARVQVLYERAVS

SEQ ID NO: 39362 - protein, 155 aa, Sorghum bicolor
  Clone ID: SORBI-28MAY03-C12604_1.pep
AGGNILPLQLPAPTTSRARRTAFHLLVALGEDGAASGELFLDDGESPEMAGSRGKWSLVRFSCAAGHDGVTVRSHVVRDAYGPTRKLAIGKVIFLGLHSPAAPQREFSVYVNGVKTANSIGGALGYQRNGAFGAAQVEGLSLAVGKEFELKVVML

SEQ ID NO: 39363 - protein, 69 aa, Sorghum bicolor
  Clone ID: SORBI-28MAY03-C1210_1.pep
QPHLFFWYFFLFSRLLGFLTYSLSLIFLLLFSCTHVSCLIHTLICLQWSFDLASCMYGFPDILIFFGTG

SEQ ID NO: 39364 - protein, 252 aa, Sorghum bicolor
  Clone ID: SORBI-28MAY03-C12120_1.pep
EQCNLPCQRVREPRCSHPCPLPCHLSDCPSCKVLVKRPCHCGAMVHAFECVYFNNLNAKEQIKVRTCGGPCHRKLPNCPHLCSEVCHPGICPSVDQCMKKVNIRCACNTLKQEWLCQDVLKEYRKSGRDPKEVPKSQFGVGLLACGEDCKKKLKAPDSELHLRKSQENKSPAVEVVNVPKRRKRRERGQEVKISKFQEVKTYVLRVLLIILLSIIVAAGLYLLWKGIFWLSDWMNEMEEQRARQRHPRGAML

SEQ ID NO: 39365 - protein, 212 aa, Sorghum bicolor
  Clone ID: SORBI-28MAY03-C121642_1.pep
MALTRLLVLLLGAAALPVLLFRTAEAREVGVNYGRVANDLPDPAAVVQLLRDNGITMVRIYDTDDAVLRSVANTGIKLMVMLPNENLADAARSPSYAADWARRRVAAYLPATRIHAVSVGNEVFDSRPDLTPLLVPAMTNVHAALAQLGLADAIKVSTPLSFAAVAVSWPPSAGRFRDDIAQPVMRPMLEFLQRTGSYLTINLYPYFAYAAQ

SEQ ID NO: 39366 - protein, 329 aa, Sorghum bicolor
  Clone ID: SORBI-28MAY03-C122_1.pep
MSMEAAAASSVGAEFGPALGFRNIHRRTLPYCWRPRSPRPASLSLCGGWGARPRGAIAAASGDQRRRQLGELEAEAEAGSALGPTRSSPREVREEMARCFDLVRRLGRGAVYLGSSRVPPTHPHFLQTTELAREIARLLDCTTWTGAGPGLMDAAIQGALEAGKPVGGLKIAKEAGEWTSSGFHPYLPPETYLTCRFFSARKHGLVDAAVRSSPTDRTAVVALPGGVGTLDELFEIMALIQLERIGSALPVPFLLLNYDSYYSKLLDFLNDCQEWGTVAPGEVESLWKVCDGNHEALEYLAEFYNVPADQRNYQISPQLKQHRTSYAAS

SEQ ID NO: 39367 - protein, 276 aa, Sorghum bicolor
  Clone ID: SORBI-28MAY03-C122083_1.pep
MAAGRETDEQLTEYEKQRLSRIRENEARLEALGLRSLAASPLLRNPSPGAAKGKQKKRSADEDEEYVPSDSGGVEEDDESSSESAQDEEVEGEGKSASRSRAKGKKKKLSKSGKSTKSTPTKGSASLADVVDDDAALQQAIALSLAEYSEKPATALGAETSSTVTGASESTPHKNNSKASVHDTAKNKKIKKLGKSRIQLTEDDVVAFFFSFDEVGKGYITPWDLERMATINDFIWTDSEISKMIRCFDSDSDGKINLEDFRSIVSQCNMLQEHEK

SEQ ID NO: 39368 - protein, 88 aa, Sorghum bicolor
  Clone ID: SORBI-28MAY03-C122243_1.pep
PAAVTASPAVFSHTPAPASAAGAASAPYVMTDDHSGRRVHHVSPAAALGRYPGMAAGPGMAVVAEPVVTGPEDALGLDLQLSLAPAGL

SEQ ID NO: 39369 - protein, 260 aa, Sorghum bicolor
  Clone ID: SORBI-28MAY03-C14302_1.pep
VIQVKEGVYEEYVTITRTMKNVTFLGDGSKKSIVTGKKSFADGITTFKTATFTAQADGFMAIGMGFQNTAGAEKHQAVALLVQSDKSIFLNCKMEGFQDTLYAHSKAQFYRNCIISGTVDFIFGDAAAVFQNCILILRRPMDNQQNIVTAQGRADAREATGFVLQKCEFQAEAALRDAGKPAIRNYLGRPWRECSRTVFMESEIPDFIDKAGYLPWNGDFGLKTLWYGEFGNTGPGANTAGRVNWPGFKKVISKADASKF

SEQ ID NO: 39370 - protein, 170 aa, Sorghum bicolor
  unsure (1)..(170): unsure at all Xaa locations
  Clone ID: SORBI-28MAY03-C1440_1.pep
MSGAAEEALLREYVIGEEIGRGRFGTVRRCYAASTGEPFALKTTPKAALRELEADPLDLALAEQEPKVHLLASAASRHVVALHAAFXGRRRRRYIXDLCPFGGAFGHVNARGHDPEPEAAGLVAQLADALAGCHRRGVAHRDVKPDNLLFDASGALRLGDFGSADWFGDG

SEQ ID NO: 39371 - protein, 175 aa, Sorghum bicolor
  unsure (1)..(175): unsure at all Xaa locations
  Clone ID: SORBI-28MAY03-C14414_1.pep
PRVRSSSQNDFPLNQSLHSAGCLDESGYAPCAENSEQANQQFATFVKVYKSGNVXRLLDITRFSSYDELRSEVGRLFGLEGQLEDPXRSGWQLVFVDREDXVLLVGDDPWQEFVNSVSCIKILSPEEVQQMGKPGIQLLSSAPSRRLSNGCDSYASMQESRSLSTGMAPVGSVEF

SEQ ID NO: 39372 - protein, 165 aa, Sorghum bicolor
  Clone ID: SORBI-28MAY03-C14426_1.pep
YTNALLGPSELIEMCLRRDRELSFKAFEVFALTSSSFRSSNRGLLEACWMNATDQDDWVKLSEASTLEGWSDELIEESLQATVLFKASRLCYSPDAVVYDGTFEDVLPVKKEDVHLRGLESKCLSVEEVLMQHKDFPDAGKLMMTAVILGKELTFTATEPVEMDS

SEQ ID NO: 39373 - protein, 235 aa, Sorghum bicolor
  Clone ID: SORBI-28MAY03-C123176_1.pep
MSCNGCRVLRKGCSEACVLRPCLQWIDAADAQGHATVFVAKFFGRAGLLSFISAVPDAQRPALFQSLLYEAAGRTINPVHGAVGLLGTGNWHLCQAAVDTVLRGGAIGPLPELGITGSAGDLYGPPGAGTGHGGGGGKRAGGWSTFSTAKRVRKAAATGAPPPPPAAEPEASCDLRLCLLSPGSPPPPAGDRRAPFMRPGTPSITSDDDSVTTTTTTTTTGGGGDREPVLLNLFA

SEQ ID NO: 39374 - protein, 241 aa, Sorghum bicolor
  Clone ID: SORBI-28MAY03-C123333_1.pep
ARGWIVTEKQLFGKSGTDYDFHSCEPHKAREELENLQAQQSSLEKRVNKKVMAMFEKAEDEYNDLMSKKNIIENDKAKIKNVIEELDEKKKETLKVTWLKVNKDFGSIFSTLLPGTMAKLDPPEGGTFLDGLEVRVAFGTVWKQSLSELSGGQRSLLALSLILALLLFKPAPLYILDEVDAALDLSHTQNIGRMIKAHFPHSQFIVVSLKEGMFNNANVIFRTKFVDGVSTVTRTVPSKQR

SEQ ID NO: 39375 - protein, 198 aa, Sorghum bicolor
  unsure (1)..(198): unsure at all Xaa locations
  Clone ID: SORBI-28MAY03-C123367_1.pep
TRLLYSCCRSICLSVCHHVGRAQNKHPPPHLVDLIIIIHCSCHFLVSLCVRVFICPCISIHLYTSPTTPTVPPASRRRRAWDRSDPRRRPLLTSHDQGWTPPPATSPTAAAPPPAPXTTTKPLTMFYNGGVAVFHLPQDKAEVVMNMAAGEDGGGGGRHLQPNHGDELLAKLRQGMPAASKISLQRFFQKRKERLYGP

SEQ ID NO: 39376 - protein, 193 aa, Sorghum bicolor
  unsure (1)..(193): unsure at all Xaa locations
  Clone ID: SORBI-28MAY03-C12378_1.pep
TRSNPKEVPDAWVNPLELEFRRGEEVTKGTYLAKWYGSKVFVKILDKDSFSDADSINAFKHELTLLEKARHPNLVQFVGAVTQNVPMMIVSEYHQKGDLASYLEMKGRLKPHKAIRFALEIARGLNYLHECKPDPIIHGHLSPKXSIILRAVVGLLQVAGFGSLSLTKVSEDKVQMVQPVTKLDNVYIAPEVY

SEQ ID NO: 39377 - protein, 178 aa, Sorghum bicolor
  Clone ID: SORBI-28MAY03-C12416_1.pep
VRRSRRPVPEVSPGGITGTVPCHRQNTHKNLSIKKNMAQSAKLLLLLPALLLLLLVQAQGARPAAAAASNATKLRPSSKCLASSVTVSQSNTGDKAGYDPVFEVTVRNTCRCAVRGVYLRSEGFASSVAVDPRLFRRDGRDYLVGDGRRIEAAAEVRFRYAWDRAFRMTTATVHDDCS

SEQ ID NO: 39378 - protein, 212 aa, Sorghum bicolor
  unsure (1)..(212): unsure at all Xaa locations
  Clone ID: SORBI-28MAY03-C12437_1.pep
VPDGTGGTLATVTEFMVNGSLRNVLLRKDRMLDRRRKLTIAMDAAFGMEYLHSKSIVHFDLKCDNLLVNLRDPXQRPICKVGDFGLSRIKRNTLVSGGVRGTLPWMAPELLNGSSSKVSEKVDVFSFGIVLWEILTGEEPYANMHCGAIIGGIVSNTLRPPIPEKCDPDWRKLMEQCWSANPDARPSFTEVTDRLRAMPPVLQSRGQAPANR

SEQ ID NO: 39379 - protein, 81 aa, Sorghum bicolor
  Clone ID: SORBI-28MAY03-C14055_1.pep
MVNLDEVRNVVGIIGNFISFGLFLAPLPTFLTIIKKRDVEEFVPDPYLATFLNCALWVFYGLPVVHPDSILVATINGDGPR

SEQ ID NO: 39380 - protein, 150 aa, Sorghum bicolor
  Clone ID: SORBI-28MAY03-C1409_1.pep
MMMACGLAVAQPAASLAPSGKRSLSGGRPPWLPSPRLFSDKLIRSRSVVAKAAQDSSESSGSIVKYVTSSFSTAEDIFGLAGIGFAAIAALWASVNLIEIIDKLPVLPLLFELVGILVAWLFIYNNLLFKPKREEFLKNIKNSVSQILGQ

SEQ ID NO: 39381 - protein, 209 aa, Sorghum bicolor
  Clone ID: SORBI-28MAY03-C14091_1.pep
GRVGTHSPGVAARKRLDTVTGATTSSQKAMGASATRKEKHKDPSMQIKGTKCINTTLSTEEHLHKELTDPVDLKSMEMTVPDQHEPSSNQPEQVFKDDEESKRHFSEGKVDAGTNGIHNGGQDINGGVKTIYECGIVEKEEADLSKKKEEADRSADKVVPRTEVAQVWRKDDPRGNDVIEETKSKLLEERKSRVKALVGAFETVLSFKE

SEQ ID NO: 39382 - protein, 139 aa, Sorghum bicolor
  Clone ID: SORBI-28MAY03-C14092_1.pep
PPVLCAVVNWGAVLAVFGWSWLSHLTSLSASSTAGPPLSMAPEGRRNVPASAKCGGPRPGAILWHLASCRLPSWGLCPLLLVGTLGFHNRRLDIPKDVDPQVASIISSCWDNDPSKRPAFSQLLSPLKQLQRLVVTESC

SEQ ID NO: 39383 - protein, 180 aa, Sorghum bicolor
  Clone ID: SORBI-28MAY03-C12697_1.pep
KKCHVCPAAASACQRIASSASLITEQMQLAALPCAAPLPCLGNGREAKASSLSSLDLPSSTVGRRCFCFTSTHTPAPPAAPSQTAVPGPLFSLASPRRGAQTLTGRQRAAGRFPSSLSPRMSPPICSARSSPPRFSPSSTVHSRLSCCPSGSDRPIPLPLPLPPRLCPPGSGRTERRAAA

SEQ ID NO: 39384 - protein, 208 aa, Sorghum bicolor
  Clone ID: SORBI-28MAY03-C14107_1.pep
ARGVKILTSYLDVLRANHVPSILVHKLFTQIFSLIDVQLFNRLLLRRECCSFSNGEYVRAGLAELKHWSDNATREFAGSAWEALKHIRQAVDFLVISLKPMRTLREIRTDVCPALSIQQLERIVSMYWDDVNGTNTISAEFTSSLKSAVREESNMATSFSILLDDDSSIPFSLDDITKTLPVIEVADDDFLPFVHENPSFAFLLQRGE

SEQ ID NO: 39385 - protein, 207 aa, Sorghum bicolor
  unsure (1)..(207): unsure at all Xaa locations
  Clone ID: SORBI-28MAY03-C14119_1.pep
FSRIAEKRSNFIMKLHEVTRRNIVMKSAQYAKLAFLGXRRVTFQPGDLVWLHLRKDRFPQQRKSKLSPRGDGPFKVLKKINDNAYKIELPPEYSNVSPTFNVKDLLPFVGEPESRTTPSQEGEADEDIPSIHSSSNETPLDISGPITRSRAKQLEKEIHSQVNANLMFNNQFMLNDPILLSSCFNVLRNDGGYEPAWDEDGFKPLDI

SEQ ID NO: 39386 - protein, 178 aa, Sorghum bicolor
  Clone ID: SORBI-28MAY03-C14207_1.pep
QLLDDDDDMADLYLSRKLAGASSPVSGSGGPNWFPASPTIGSKISRASRASAATVHGNENDVEELEMLLEAYFMQIDGTLNKLTTLREYIDDTEDYINIQLDNHRNQLIQLELFLSSGTVCLSLYSLVAGVFGMNIPYTWNDGHGYIFKWVVIVSGLVCAFMFISIVAYARHKGLVGS

SEQ ID NO: 39387 - protein, 188 aa, Sorghum bicolor
  unsure (1)..(188): unsure at all Xaa locations
  Clone ID: SORBI-28MAY03-C14101_1.pep
MMERSLLEVLATAAQGGTEGTSVLSMLKYAVLPXAKVFTVCFMGFLMASKYVNILQPNGRKLLNGLVFSLLLPCLIFSQLGRAITIEKMIQWWYIPANIVVGAVSGSLIGFVVASIIRPPYPYFKFTIIHIGIGNIGNIPLVLIAALCRDPSNPFGDSDKCNQDGNAYISFGQWVGAIIVYTYVFKML

SEQ ID NO: 39388 - protein, 91 aa, Sorghum bicolor
  Clone ID: SORBI-28MAY03-C14216_1.pep
LHPKNLSSQSFFLAPMLKVSSTTFVNQKAENWLWDGCAAMLISSQFPSSFTSISRGREARRERRARRRAWNTPPARKDRAARGTATCAQTL

SEQ ID NO: 39389 - protein, 114 aa, Sorghum bicolor
  Clone ID: SORBI-28MAY03-C138_1.pep
MLESQAVIGDTDMRQAMQQYALRLAGKALDDFEAADSTEIARFIKKEFDRSYGPGWQCIVGTDFGSFVTHHSGCFIYFGIGNLAILLFKGGAAPRGETVVEKARLTALKTAVEA

SEQ ID NO: 39390 - protein, 270 aa, Sorghum bicolor
  Clone ID: SORBI-28MAY03-C13758_1.pep
RRARATRGSHRSFGRGDLAAEMLAVFDRSVASSPEGLRQPGAAGGDSAACLADRFREARPDAVTVNLGGSGAMAYSSSKQSPLLPRLFGAVDNIFCMFQGTIANFAVLKQQYGLSKGTNEVNIIIEAYRTLRDRGPYPADQVVRDISGKFAFVLYDCTTKSVFMATDPDGNVPFYWGADTDGRLVVSDDIDLVKKACGKSSAPFPKGFFFTTSGGLKSYEHPMNEVKPVPWVDSKGEVCGTTYTVDASAKKETKTSIPRVGSAADWSSQY

SEQ ID NO: 39391 - protein, 222 aa, Sorghum bicolor
  Clone ID: SORBI-28MAY03-C13837_1.pep
HEAGASNRVCNALALLQCVASHPETRILFLNAHIPLYLYPFLNTTSKTRPFEYLRLTSLGVIGALVKVDDTEVISFLLQTEIIPLCLRTMEMGSELSKTVSTFIVQKILLDDVGLRYICATAERFFAVGSVLANMVVSLADQPSTRLLKHIIRCYLRLSDNPRACAALQSCLPDMLKDGTFNNCLRDDPATRRWLQQLLHNVTGGGMGGGPQPGMDPMNMGI

SEQ ID NO: 39392 - protein, 159 aa, Sorghum bicolor
  Clone ID: SORBI-28MAY03-C13845_1.pep
TRLVPTPMYSSGSSHSDPESIAESSPHPAPPMKKKKKVKKPAPPAPAASSDDNDGDADYEEGGERAEPQGGAVRRCTHCQIEKTPQWRAGPLGPKTLCNACGVRYKSGRLFPEYRPAASPTFVPSIHSNSHKKVVEMRQKAVRSGDPSCDLLQFIRRRD

SEQ ID NO: 39393 - protein, 225 aa, Sorghum bicolor
  Clone ID: SORBI-28MAY03-C13882_1.pep
LICVDGRLLCYVSYELGHEVPHELRRERLGALHVHVVAASAGAVAAAVGAGRGGAHEERRGLFGGAASGRAVREAERQRHPAVPGERERGGLRGELPVRPRREQRVPAAVVMVVVVPRSGATAAAALHELHEQLPVADLLVLLPRGRRGLRVQRGHVVHVVERRRRRLVPARLLEPPSHRVVAVVFIVVVEPRVRLLVVATAAELEQGGAMDALVGGRALRRPLV

SEQ ID NO: 39394 - protein, 161 aa, Sorghum bicolor
  Clone ID: SORBI-28MAY03-C13906_1.pep
NFQNESATHINIAWPRHLVPHHTTTKPPRHRASNSPPSQPANHQPRELASRHRPYPWLALPSSSPSPLSSSSPWPWRRWPLRRRSPPTPPPPMRRPMPAGRWVPLAPRASTACQATRTTTTTPPTEADRPSTSSDISSVLKTNGPVEFGTGHGRKSESNVI

SEQ ID NO: 39395 - protein, 115 aa, Sorghum bicolor
  Clone ID: SORBI-28MAY03-C13988_1.pep
LRLALRSGRLRIYNSLANVDREVPTTTTFLQPWLRFWANEERRGVQSRDSILVVSRGSSFLLVQYLHILTTATRLLVHELVWCRKFVLAVGLVILLDHFYSCFVVILYRDMGCNM

SEQ ID NO: 39396 - protein, 158 aa, Sorghum bicolor
  Clone ID: SORBI-28MAY03-C13980_1.pep
MRGLLAVEAAGAAASASVLNGAVDWWRDVNESPLWQDRIFHALAVLYGFVSVVALIQLIRIECRVPEYGWTTQKVFHFLNFLVNGVRSVVFVLRRNVQLVEPEIIQHVLLDMPGLAFFTTYALLVLFWAEIYYQARAMSTDGLRPAFYWINTVVYAIQ

SEQ ID NO: 39397 - protein, 171 aa, Sorghum bicolor
  Clone ID: SORBI-28MAY03-C13999_1.pep
SHFISPLIIMFISSSYAANTSTTENQENGKRKHNRVKKTFSSPSSPKVWYMPPYACILHHYLLLTTSLHKHQAVSYRRLCPTKPAPKEQNDLTSHQSPPYHDHRYIYAISSLTQHYLHLHLAKTPGSFWIKGTNTMLVSDSAQCHAASHSPRCSQCCSHWLCSNSDARATA

SEQ ID NO: 39398 - protein, 82 aa, Sorghum bicolor
  Clone ID: SORBI-28MAY03-C14008_1.pep
RADPLPRGPAPSPASRAAAAAHAPAPPPPPPLPPPSAAAPRARPPPPPPPRPTHLPLPSSHGCFRWGREPPIWTGGALLRCV

SEQ ID NO: 39399 - protein, 222 aa, Sorghum bicolor
  Clone ID: SORBI-28MAY03-C14292_1.pep
LTRNNQCKNETNMQVPSVSTGQDHELTPREIDRSVNRAVHPLPSIFMHDIHNPCMGSAAGAGQLSVSDDDELVVVGHVGVVVVAAVVVVAVGRGGGRLERHAGPFLLLVLRVVYRADAARLVVLGAGHALGLGRARRHRRRRRLLRGGRRGVGRPRLEQRARQHQHQHHHPRAHGRRRRHGWLVAHDRPPPGEINDSNNQENVGTNSERRSIDGRESDDGRS

SEQ ID NO: 39400 - protein, 128 aa, Sorghum bicolor
  Clone ID: SORBI-28MAY03-C13535_2.pep
SRPELPADCHLPGTLCMWTDCTTCFEGCATTAGECGGCLGGAGEAGLPLLLIMGVIVLGLFTVIGIFYSVLVATMVGQRIWQRHYHILAKRMLTKEYVVEDVDGERTDWCPPPLPAEHISQLKSLGLL

SEQ ID NO: 39401 - protein, 174 aa, Sorghum bicolor
  Clone ID: LIB3480-061-Q6-K1-G7.pep
AASAGYVSVLFDVGGIVGGVLAGFISDQLNARATTAAVFMYLAIPSLFLFHAYGSTSKATNIGLMMISGLFVNGPYALITTAVSADLGTHKSLKGDSRALATVTAIIDGTGSLGAALGPFITGFISRKGWDSVFIMLALCALVAAVSLSSHVKTEIPQIIQKWRNRSTNTQDGN

SEQ ID NO: 39402 - protein, 144 aa, Sorghum bicolor
  unsure (1)..(144): unsure at all Xaa locations
  Clone ID: SORBI-28MAY03-C13662_1.pep
KTERANKFYYCMPYYMPLNPPEDEDGTAVTAIYPLDPPIFCDFYLELDDYEVLAARIVRDEGLPEDEGEKIEEFLKEKAKQREIEVEQAEETRKKAIEDMDPKQREAFENIKFYKFYPVKTPDTPGVNIVKSXTSTNIISTHII

SEQ ID NO: 39403 - protein, 245 aa, Sorghum bicolor
  Clone ID: SORBI-28MAY03-C13686_1.pep
TRKKGWFGWGGKKGAKGDDKPPKVGSKDETSDPGKQKEKGSGKKKKGGSSAESLKHESEYKKGLRPVLWLTPDFPLKTDELIPLLDVLANKVKAVRRLRELLTTKLPTGTFPVKIAIPIVPTIRVIVTFTKFEELQPLDEFATPPSSPTQFQDAKAKESEGSGSWYSWVKGGRGTQSSDSGDSRNWKDEIDPFHIPSDYTWVDATEKKRRMKAKKAKSRRGTARKQFSKNTSEGGHHPMMDGFEE

SEQ ID NO: 39404 - protein, 130 aa, Sorghum bicolor
  Clone ID: SORBI-28MAY03-C13689_1.pep
MSSSVLRAAADRAIRRQALTLTDTAASRIRQLLSLRQRPYLRLGVKARGCNGLSYTLNYADEKGKFDELVEEKGVKVLIDPKALMHVIGTKMDYVDDPLKSEFVFINPNSKGECGCGESFMTTGSKGSTS

SEQ ID NO: 39405 - protein, 180 aa, Sorghum bicolor
  Clone ID: SORBI-28MAY03-C13699_1.pep
RADGGELRLAPFSDTCALVSVLFSSLGMAFRFVEIEYVTKVNDLIGAGKSYRTLSDILDKDIQNDCVKKQGSHSRNLRRVRLGLGLIKALFEQFLATEGSLYDAATTAYGQVCAPFHSWAIRKAVGAGMYTLPTREQLIVRLNETDFSVQKEMRRYIDASSPIIEYIDNLFLSRNISLDW

SEQ ID NO: 39406 - protein, 196 aa, Sorghum bicolor
  Clone ID: SORBI-28MAY03-C13718_1.pep
MPRDSRPLGMRLFGVTIAPAPAPEADPPERDPSPNPPVAAREDVMRKCKSMGNLAALGAGADGGGGGADGGGAGDGYLSDGGLMQSSGKRRRAQERKKAVPWTEEEHRTFLAGLEKLGKGDWRGIAKNFVTTRTPTQVASHAQKYFLRQTNPNKKKRRSSLFDMMPRELSPTPNCPILPPSMAKVHDVVAMTKQLQ

SEQ ID NO: 39407 - protein, 405 aa, Sorghum bicolor
  Clone ID: SORBI-28MAY03-C13720_1.pep
HEALAEMQQLVDGVITENMLYPSASTVDSRQGYHGEMLPITDNLDSRSFSHHDIARMLDGANIGLSDVSSTPFDSVPFNETFTNYSAGFREPTLHSSFACLEANNLDDSSCLQTFTSEALYTNHLSQKGAGALGFTGILTSEVNGDRYNDDSIKHPLLKQSSLDLLTIETPGLKKHDSFSRWMSKELEEVVDLGIKSTSDAFWSSIETVKVPDGSNVLSNEQLGAYVVSPSLSQDQLFSILDVSPSCAYIGTNTKVSVTGTFLVNKEHVENQKWSCMFGDVEVPAEVLTDGTLRCYAPAHQSGRVPFYVTCSNRVACSEVREFEYRDSDAQYMETSRSQANGVNEMHLHIRLEKLLTLGPDDHHMLAISSGNEKYEIVNAINALMLDGKWSNQESSVKEVVSTAG

SEQ ID NO: 39408 - protein, 115 aa, Sorghum bicolor
  Clone ID: SORBI-28MAY03-C13736_1.pep
MPPPREHHQPQEEEDDDDTAGVVKLISAEGFEFVVDKKAAMVSNTLRNMLTSPGGFSETRQGEVRFPEIPTHILEKICQYFYWSLHYSSGKETAEFQIEPEITLELMMAANYLDT

SEQ ID NO: 39409 - protein, 112 aa, Sorghum bicolor
  Clone ID: SORBI-28MAY03-C13752_1.pep
GIYTYIYRNINVRGRQKYDLLASLGPFCAWAAIASHLFSQLKTPSRLSSSHPALQSVTADAGVAASSAMSATSSSAATTRTVFLAAAAAIVEKLFPSFLVGLNLLASVPPAA

SEQ ID NO: 39410 - protein, 114 aa, Sorghum bicolor
  unsure (1)..(114): unsure at all Xaa locations
  Clone ID: SORBI-28MAY03-C13775_1.pep
MSTLKFCRECNNMLYPREDKETRTLLYACQSCEHEEIATDTCVYKRVXRKPVGEPKDVLKDAATDPSLPRTRSVRCYNCNHPEAAFFQAPTSGEQAMTLYFICCNPSCGHRWRD

SEQ ID NO: 39411 - protein, 210 aa, Sorghum bicolor
  Clone ID: SORBI-28MAY03-C13394_1.pep
RTRGRTRGQKLGADFLVASSHKMCGPTGVGFLHGKFEILSSMEPFLGGGEMIADVFQDKSTYAEPPSRFEAGTPAIGEAIGLGAAIDYLSCIGMEQIHEYEKELGTYLYESLLSVPNVQIYGPAPSQTVHRAPLCSFNIENVHPTDIAEILDLQHGVAIRSGHHCAQILHRTLGITASARASLHFYNTKDEVDTFIDALKATIDFLTSKY

SEQ ID NO: 39412 - protein, 186 aa, Sorghum bicolor
  Clone ID: SORBI-28MAY03-C13398_1.pep
TARALGESLFDKELGKPIGQLIVICGRNKTLSSSLQALEWKIPVKVRGFETQMEKWMGACDCIITKAGPGTIAEALIRGLPIILNDFIPGQEVGNVPYVVDNGAGVFSKSPKETANLVARWFGPDSEELKKMSENALKLAQPEAVFDIVRDIHGLSQEQGVISQISSSLTSSFFIPSPETTPLQLI

SEQ ID NO: 39413 - protein, 97 aa, Sorghum bicolor
  unsure (1)..(97): unsure at all Xaa locations
  Clone ID: SORBI-28MAY03-C134202_1.pep
RTLGQLLFFWSNCCPSSGTEGNLSLKRNKRKPSAFICCNSELIRGKMGGRHIKSAAVILHCSEKCLGDRLFQGFKLYGVYFTFXNISRKCVYNFGEK

SEQ ID NO: 39414 - protein, 218 aa, Sorghum bicolor
  Clone ID: SORBI-28MAY03-C13473_1.pep
DEPDPIICPDAVSQADDVNWWGHKFGFVTGGFLGAKSRKNKSSQKDPANVRQTFAEEDQENLYNLVQDKATSGKQGLGIKGLPMKVAGQRWKGNKTSFVDSDDDNSTQSDEYSEIEESDDKEEPISASESIDTDKNTEKELLVDARPKTKVKKLCKRILRQAPSQSMKLKDLKVAVEEHSNVVFSSFSCRREALLFLKKKLQGSRKFNVDGKKVHLVS

SEQ ID NO: 39415 - protein, 258 aa, Sorghum bicolor
  Clone ID: SORBI-28MAY03-C13411_1.pep
DVSAVAAAAAAAAAASALPAGNAQPLAGRVAIAAHLSSLGASVVLGYASRADEADALAASLPRAVAVRADVSDEAGVRSLFDAAESAFGVGGAHILVANAGVNDDTYPAVADTTTEAFDRVVAVNLRGAFLCLREAANRVPRGGGGRIVPVTSSVVGSLPPGYAAYTASKAAVEALVRTMAKELRGTRVTANCVAPGATASDMFFKGKSEDMVRRAVEICPMERLGEPGDIAPVVGFLCTDAAEWVNGQVIRANGGYV

SEQ ID NO: 39416 - protein, 150 aa, Sorghum bicolor
  Clone ID: LIB3478-057-Q6-K1-H8.pep
MADAGYLSDVAAAAAGVAWALSAGNAQPLAGRVAIVTGASRGIGRAIAAHLSSLGASVVLGYASRADEADALAASLPRAVAEPADISDEAGERSLLDAEESAFGVRGAHILVANTGVNDNTYPAVADTTTDAFDRVVDDNLRGALLCLRE

SEQ ID NO: 39417 - protein, 142 aa, Sorghum bicolor
  Clone ID: SORBI-28MAY03-C13489_1.pep
MDSNNLLAAWQVVGPGVAGAVFGAGWWFWVDAVVCSAAAVPFLHYLPGFFASFAALMFNAVNREDIGDGYYSPYDDSEWRVKLWLFISYVVSFVSLAGSVGFLVQDALTDTGPSAWTGTAGVLQCVFVLVSGLIYWTCHSED

SEQ ID NO: 39418 - protein, 176 aa, Sorghum bicolor
  Clone ID: SORBI-28MAY03-C13495_1.pep
MGGGKDSHDPSNADKGFHGGYPGGYGQYPAGYPVPPGGAYPPGPGQGYPVPPGGYPPPGGYPQPGGYPPSHGGAYPPGAGAYPPGAGAYPPSGYPHQPVYPQAGYPGHCPPMAGHGAMYGGGHGAGGSGGFGAMMAGGAAAAAAAYGAHKVSHGGGHGMYGHGHAHGKVKHGKVKH

SEQ ID NO: 39419 - protein, 142 aa, Sorghum bicolor
  Clone ID: SORBI-28MAY03-C13502_1.pep
LQEVRRGADRAEIYSLAFSNNLQYLSVSSDKGTIHVFNLKINVGSTANDKPMPAPDPEVPHISPPLSFIKGVLPKYFHSEWSVAQFRLHEGEQYIVAFGHEKNTVAVVGMDGSFYRCQFDPVNGGEMLQLECYNFLKPSDQP

SEQ ID NO: 39420 - protein, 208 aa, Sorghum bicolor
  Clone ID: SORBI-28MAY03-C13532_1.pep
GSSGSARRRRAARRRSAGTAGGVGDGDKVQGHHGREDAPGFRRRGGCRSGGEAFGGRGSRAAAAAQHGRLPGQGHGVRRREQLRERGRRVREGGRRRHRGVAGEQAGHDGVRVQRRGGAGPGQVHRRRRRRQALLRDVRQDGEGLRRGHRHGGLAADEAGVHGRGAQAEARHRRRHQQGVRRGGQGQDRQNPCCLRAGRRRGRCRRAS

SEQ ID NO: 39421 - protein, 206 aa, Sorghum bicolor
  Clone ID: SORBI-28MAY03-C13557_1.pep
KTGPSMDHTHVSTVVKGSFGYLDPEYFRRQQLTEKSDVYSFGVVLFEVLCARPALNPTLPKEEVSLAEWALHCQKKGILDQIVDPYLKGKIAPQCFKKFAETAEKCVSDQGIDRPSMGDVLWNLEFALQMQESAEESGSLGCGMSDEGTPLVMVGKKDPNDPSIESSTTTTTTTSISMGDQSVASMDSDGLTPSAVFSQIMNPKGR

SEQ ID NO: 39422 - protein, 93 aa, Sorghum bicolor
  Clone ID: SORBI-28MAY03-C13634_1.pep
QHSAVGIVEEIFEEGSAMLSERLGPHSDGRRTSSLFTCAICQLDLEPSEGISVHAGSIFSSSSRPWEGPFLCSDCRDKKDAMEGKRPSGVKVL

SEQ ID NO: 39423 - protein, 256 aa, Sorghum bicolor
  unsure (1)..(256): unsure at all Xaa locations
  Clone ID: SORBI-28MAY03-C13101_1.pep
MSASEEDAAPAAADGGSGGGSSGAGSSEGGARRRFDDKGLVARTSLILWHTHQNDVGAVRKLLEEDAALVNARDYDSRTPLHVAALHGWHDVAECLIANGADVNAQDRWQNTPLADAEGAKRQSMIELLKEHGGLTYGKTGSHFVPMTIPPLPIYEADLVGDNCELVFTKDDVIGKGSFGELLEANWRGTPIAVKRILPSLSDDRLVIQDFKHEVNLLIKLRHPNIVQFLGAVTETKPLMLITEFXLRGGDLHQYL

SEQ ID NO: 39424 - protein, 146 aa, Sorghum bicolor
  Clone ID: SORBI-28MAY03-C13143_1.pep
VNFYKETTGLDPIAYIDVVHQESTGSLSSVMPWDRSLREFAKDEPYLLAAVLFIILKVAAHFIPVVMSHLRAFLVVRVQNLNLGIRRGSNQLLERALNVLDMRRLWSKLRLSNKATDLRKGASNARAWASSFASVSLGEPSSSRQA

SEQ ID NO: 39425 - protein, 110 aa, Sorghum bicolor
  Clone ID: SORBI-28MAY03-C13059_1.pep
IDPYTAPLSLAPCHPLQPAGAGSAHRADYQGSRLLPACCSPHPSPTVTAAVARRVRPPHGRTCPPRPVSHALPSLVTTLALLPGAEPRPSLRGADPHCVLIAGEEGLLKT

SEQ ID NO: 39426 - protein, 91 aa, Sorghum bicolor
  unsure (1)..(91): unsure at all Xaa locations
  Clone ID: LIB3478-052-P1-K1-H8.pep
LPRVEATXCVLLATPEPDGHRSSGTPSPPAARPHLPTTPRVARPAVAGNYARAAARSRAAAVATRSRSTLVPGCAVATDAGERQIRMQIAK

SEQ ID NO: 39427 - protein, 303 aa, Sorghum bicolor
  Clone ID: SORBI-28MAY03-C1317_1.pep
HEDGIKILANTDGQRLLRMLESGAFEGSRGPPQQINTKPPIVALGPVSNVSSPIAVNAERPDRILPAVSTSGLAPMDPSRTPDVKPRIARGSEKVKTWKLADIVDNGHLRALHLTDTDTNPSKVVRLLYTNNGIALLALGSNAVHKLWKWQRGDRNPSGKSTASVAPHLWQPANGILMTNDTNDGNPEEATACIALSKNDSYVMSASGGKVSLFNMMTFKVMTTFMAPPPAATFLAFHPQDNNIIAIGMEDSTIQIYNVRIDDVKSKLKGHQKKITGLAFSQSMNVLVSSGADAQLCVWSIDG

SEQ ID NO: 39428 - protein, 237 aa, Sorghum bicolor
  unsure (1)..(237): unsure at all Xaa locations
  Clone ID: SORBI-28MAY03-C132050_1.pep
MAAMRTCLVAIVVALGFLFLEKPEVTAAATETTTGMSAEQRQEVESLLRRVNKTPLATIESPDGDIIDXYCVHVSKQPAFDHPLLKNHTIQMRPSYHPRSLNQNYNITSHPITQTWHQNGKCPENTVPIRRTMVQDVLRASSISRYGKKRPRSIPNLNSINGPDTPNVLNGHQHAVVAAQDNKCYGTKASFKFVGSNKLLGQNDFSLSQLWVTAGSYNGNDLNTIEAGWQVRPEVET

SEQ ID NO: 39429 - protein, 222 aa, Sorghum bicolor
  Clone ID: SORBI-28MAY03-C1322_1.pep
HASVEMVALLEAQIKDLSPNLDSIAEYRTKARLYGDRVDELNATTQERDDLKKLYDGLRKRRLDEFMAGFNIISLKLKEMYQMITLGGDAELELVDSLDPFSEGVVFSVRPPKKSWKNIANLSGGEKTLSSLALVFALHHYKPTPLYVMDEIDAALDFKNVSIVGHYVKDRTKDAQFIIISLRNNMFELADRLVGIYKTDNCTKSITINPGSFAERHESSVV

SEQ ID NO: 39430 - protein, 75 aa, Sorghum bicolor
  Clone ID: SORBI-28MAY03-C133272_1.pep
LSSNLSMHDSCLQACLCMTVAFKLVFSPACISETRRGRRVVNNRSTKSLNAKHKQAQHKYVHLCAYCAVNQGPSW

SEQ ID NO: 39431 - protein, 284 aa, Sorghum bicolor
  Clone ID: SORBI-28MAY03-C13354_1.pep
MRWKLNSSVYKRVPSRETAMEPDVETPMRMTDGGGGGGGGGGAGPSWRMSLPHVCVATLTSFLFGYHSGVVNEPLESISADLGFSGNTLAEGLVVSICLGGAFVGCLFSGSIADGIGRRRAFQLSALPMIIGAAISALTNSLEGMLFGRFLVGTGMGLGPPVASLYITEVSPPTVRGTYGSFVQIATCLGIIVSLLIGTPVKDIDRWWRVCFWVATIPATLQALGMEFCAESPQWLYKCGRISEAEMQFEKLLGPLHVKSAMAELSRSERGDDGESVKYSELFY

SEQ ID NO: 39432 - protein, 279 aa, Sorghum bicolor
  unsure (1)..(279): unsure at all Xaa locations
  Clone ID: SORBI-28MAY03-C133717_1.pep
HEEQVSLCYAPFSDPAFNATVQRHGVRMSDVACLPISLGWYGPTEENRRLIKIQCFSAEGTANFYMRPIEGLTVLLDMDTREVIRISDRGGGIPIPPAANTDYRYARHMQEDVGGDQTTSRSEAGFQKVRAPSMEPGPSSGPGVELVDGHTVRWGGWEFHLKADARAGMVVSRARVQDPGTGAHREVLYKGMASELFVPYMDPTEAWYFKTYMDAGEYGFGLQAMPLVPLNDCPRHARYLDGVFVAADGRPYVREKMICVFXERYAGEVAWRHSESPIT

SEQ ID NO: 39433 - protein, 196 aa, Sorghum bicolor
  Clone ID: SORBI-28MAY03-C13374_1.pep
MATVRGIRALYAVVALLLLMALHTPGRLAQAAFPYRSLLQTCQPSGSIPGRSGNCNTENGSECCKNGQSYTTYDCSPPVTGSTGALLTLNSFAEGGDGGGAAACTGEFYDDSKKVVALSTGWYNGGSRCSKHIVIRATSNGNTVRALVVDECDSTVGCDKDHNFEPPCRNNIVDGSPAVWDALGLNTDDGQAQITW

SEQ ID NO: 39434 - protein, 302 aa, Sorghum bicolor
  unsure (1)..(302): unsure at all Xaa locations
  Clone ID: SORBI-28MAY03-C15698_1.pep
RSVLLNARGILKTTLFPXKYGMELSSSIYSKWRFTDQALPNELVRRGMASMDXRTRDLKLLVEDYPYAVDGLXVWRAIDDWVRSYCAHFYSSDDAVATDRELQAWWAEVRLVGHGDRQRDPACWLKLETVANLAESLSTLIWIASALHAAVNFGQYGYAGFMPNRPTRCRRFVPLPGSPEMAQLEADPDRFFLDTVPDRFTTTLGLTLIEVLSNHTSDELYLGQRATASWTDDGEVLQLLDRFRDDLRRVEKRVTERNKDLRLKNRKGPAKVPYTLLFPDVGNVGAKEKGITGKGIPNSVSI

SEQ ID NO: 39435 - protein, 282 aa, Sorghum bicolor
  Clone ID: SORBI-28MAY03-C157_1.pep
MATAVRLQLVFRPTKPAASPCHRHLLSASPAWSRRRDHPRSTVAAAAAATGGGSSSPPPRRPQQLQSSSTAIRESKQQVTLKLPPLVRNSWVWEVQQQQQQQQGQEQAPVRILVDPLVVGNLDFGAPWLFDGAKKNPEVKALGVDDLLAPDARPDLLLITQSLDDHCHVRTLTQLSARAPDLPVVTTPNAQPVLDSLPTPFRRVTYLEPGQSTVVNQQVRVLATAGPVLGPPWQRPENGYILMPAGAGDGDESGPGLLYYEPHCVYDRSFLEDKRLQADVVI

SEQ ID NO: 39436 - protein, 115 aa, Sorghum bicolor
  Clone ID: SORBI-28MAY03-C15703_1.pep
TMPCQLMMGFFAYAKTLEIKVDKQELEDAQWHSREDIKKALTFAEYEKAQRTNAAKVNQICKGAEKGQSLSGDFKVESGEPAPMFVPGPFAIAHHLISAWAFEGVPKLPSSFSNL

SEQ ID NO: 39437 - protein, 83 aa, Sorghum bicolor
  Clone ID: SORBI-28MAY03-C15730_1.pep
PIPNYYYCRHRFKVAKVEMQTCLIYLCPLPSLLYFKLISYLLYAGIGFGMLGPQRLMHIWMLSVFVGGSNHVLHVTDFTTLDR

SEQ ID NO: 39438 - protein, 119 aa, Sorghum bicolor
  Clone ID: SORBI-28MAY03-C15747_1.pep
MTSHASGGVDRFRRQFAHLEEGTAKGEKPSPQLRQNVSLPRERVIGNKHGDGNAGDKLAHASVTDGISQPVLSARSLLKSESISASKCIGEKPKHEESVLESVDETVDDVTKKIPQLKT

SEQ ID NO: 39439 - protein, 143 aa, Sorghum bicolor
  Clone ID: SORBI-28MAY03-C18519_1.pep
MKKTSSQLRQLSSNPLLILLFLTVTAAAAAMAAEPEKQAAPAAVQETAVHIVYVDRPEDADPEEFHLRTLTPVLGSEQKARDAVLYHYKTAASGFSAKLTPQQVEDLKEQPGVLQVVPSQTYQLHGPGGSGARQGTTRTMGLM

SEQ ID NO: 39440 - protein, 106 aa, Sorghum bicolor
  Clone ID: SORBI-28MAY03-C18508_1.pep
AGRVGTGTCHVVEELEKIAIVHLLQQRAIISLIGNVRQMSLILEKTGHVLRKSGVNVQMISQGASKVNMSLIVHDSEAKALVEALHQAFFQDDVLAQVEVENLLVG

SEQ ID NO: 39441 - protein, 114 aa, Sorghum bicolor
  Clone ID: SORBI-28MAY03-C18367_1.pep
METCPSVKNILLLDSEGKRVAVKYYSDDWPTLSAKLAFEKSVFAKTQKANAGTEAEIVMFDGQIVDGGIVLETEGREIAEKVSGHGLEGASSAEQTLVNALTQAREHFAKSLLM

SEQ ID NO: 39442 - protein, 176 aa, Sorghum bicolor
  Clone ID: LIB5047-005-R1-XP1-B2.pep
METCPSVKNILLLDSEGKRVAVKYYSDDWPTLSAKLAFEKSVFAKTQKANAGTEAEIVMFDGQIVVYKFIQDLHFFVTGGEEENELILASVLQGFSDAVERLLKNMVDKRTALENLDLILLCLDEIVDGGIVLETEGREIAEKVSGHGLEGASSAEQTLVNALTQAREHFAKSLLM

SEQ ID NO: 39443 - protein, 149 aa, Sorghum bicolor
  Clone ID: SORBI-28MAY03-C1852_1.pep
RPGRAKILEKYQTNSGKILWDEKHKSLSAEIDRIKKENDTMQIELRHLKGEDLNSLQPKDLIMIEEALDNGLTNQNEKLMEHWERRVANNKMMEDENKLLAFKLHQQDIALSGSMRELELGYHPDRDLAAQMPITFRVQPSHPNLQDNN

SEQ ID NO: 39444 - protein, 75 aa, Sorghum bicolor
  Clone ID: SORBI-28MAY03-C18806_1.pep
MSVIYMPSLYYDIKKKKKKKKKKKKKKGSFNETHLSFYHSYLVQHPHIARAFNSLSFEHKFNWVAKHIADNYPGQ

SEQ ID NO: 39445 - protein, 90 aa, Sorghum bicolor
  unsure (1)..(90): unsure at all Xaa locations
  Clone ID: SORBI-28MAY03-C1883_1.pep
MAPVSALAKYKLVFLGDQSVGKTSIITRFMYDKFDNTYQATIGIDFLXMTMYLEDRSVRLQLWDTAGQERFRSLIPSYIRDSSXAVIVFD

SEQ ID NO: 39446 - protein, 88 aa, Sorghum bicolor
  Clone ID: SORBI-28MAY03-C15914_1.pep
RSGDNAALKHLIDHLSAEEMQEHVRIAKMQCLFNSYPWTLTLKSVRRLIFHLPTTWKGVYSDGDFMVHFAGLDDKQGWTNKILRERGN

SEQ ID NO: 39447 - protein, 150 aa, Sorghum bicolor
  Clone ID: SORBI-28MAY03-C15923_1.pep
GSMKIIARKKNIFKLSQGEYVAVENLENIFGQTPGVDSIWVYGNSFESSLVAVVNPNKQALERWAESNGVTGDFATICEDPKAKEFVLGELTKMGKEKKLKGFELIRAVHLDPAPFDMERDLITPTYKKKRPQLLKHYQSIIDGMYKSMK

SEQ ID NO: 39448 - protein, 207 aa, Sorghum bicolor
  Clone ID: SORBI-28MAY03-C1582_1.pep
MAITSSSSGQCNSCPWRFATVTLLLALAAGSLLPVPALARGSSEEQDHQQREDDLIRGLPGLPPNDDVPFDMYGGYITVDEQAGRALYYWFQEADRTEVEDPDAAPLLLWLNGGPGCSSIGGGALEELGAFRVHTDGERLLRNEFAWNRAANVLFLESPAGVGFSYSNTSSDLVVGDNRTAHDAYKFLVKWFERFPKYKYRDFYIAG

SEQ ID NO: 39449 - protein, 171 aa, Sorghum bicolor
  Clone ID: LIB5121-008-A1-PF1-F6.pep
MSSSGQYSSPRRAATATLLLALAAGSFLLLPALARGSSSSSSFEEDRISALPGQPNDGVAFDMYGGYVTVDEHAGRAFYYWLQEADRGEVEDPDTAPLLLWLNGGPGCSSVGYGAMEELGAFRVHTDGHRLLLNEYAWNKVANVLFLDAPAGAGFSYSNTSSDLLVAGDVS

SEQ ID NO: 39450 - protein, 176 aa, Sorghum bicolor
  Clone ID: SORBI-28MAY03-C15953_1.pep
DLQTPVGFDAYGFGYRDVDGAKVTKAWRDKYADEGYGEGDVLGFYISLPDGERYEPKQPDLIQYKGMPFHVQVPKEEQKTPEPVPGSEICYFKNGVCQGSAFKDIPGGRYYPAASLYTMPNEPNCVVKFNFGPDFEFFPQDFGGLPVPQPMSEVPHQAHEVKNEGPVENGVAEKTS

SEQ ID NO: 39451 - protein, 188 aa, Sorghum bicolor
  Clone ID: SORBI-28MAY03-C15981_1.pep
EFFAGEPCEIFHCVLESKSFLEKMIVIEHTLPFFLPIRELESDLLSSNSIKFIDHLEEILQAYIDRREQVRLIKELYGNQIGELFHSLPYNMIEFVLEDFECKVTISIRYSDLLQTLPSQARVLAWPLRSAKRISTRSSSASAAQPVPFHLSYAEEALKTLCLPEAYADIVLELPHALKRIFSSRDSD

SEQ ID NO: 39452 - protein, 187 aa, Sorghum bicolor
  Clone ID: SORBI-28MAY03-C15539_1.pep
PLPKAPGCSRAASSMGEEDDDPDWLRAFQAPSVAPVMLSSGSDGSREASPTRTSASREQEKGEKQASPDHAGDRGGASQNKSKISAATRRKTIGSKKEGSTMDKKQANTPRRSTPKKDTVTLSSDSDASLGNSPSRAGEDNHEEDSLSAAKRKDAQQTKTKKATVAGNKAGPETADGDAEDDMPDKL

SEQ ID NO: 39453 - protein, 81 aa, Sorghum bicolor
  Clone ID: SORBI-28MAY03-C15542_1.pep
MALCRRMAAPFFLVLLIIVAAETATARVVVEEKHCLSQSHSFSGMCFSHTNCDNVCKTEKFTGGKCKMDGTSRKCFCLKFC

SEQ ID NO: 39454 - protein, 98 aa, Sorghum bicolor
  Clone ID: SORBI-28MAY03-C15620_1.pep
FAPAGAGVNHNILITNIPLGSLLYGQIAAMVYDGNGQKMTVMDNRTGIVETMIVCMGMKCYSTTFFLWACITFLGLASSIALFIRTKPAYAAAASRSS

SEQ ID NO: 39455 - protein, 124 aa, Sorghum bicolor
  Clone ID: SORBI-28MAY03-C15536_1.pep
VVAGVVLGAHTHEKRSLVVGCLCVLFGTLMYASPLTVMKKVIATQSVEYMPFTLSFVSFLNGICWTTYALIRFDIFITIPNGMGTLLGLMQLILYFYYYGSTPKSSGTTAGMELPVKAGDGDSN

SEQ ID NO: 39456 - protein, 70 aa, Sorghum bicolor
  Clone ID: LIB3480-042-P1-K1-B1.pep
PESEIYIERMLRTFQTTNKSTSDKRVILARVVVAYVRRSTYTHRDGPPDIIVKGRQACRRRLSSNRQRTI

SEQ ID NO: 39457 - protein, 97 aa, Sorghum bicolor
  Clone ID: SORBI-28MAY03-C15671_1.pep
PLVMQYQPNIEARLQYLRANAGDILVFYLKNFTERGYDLFLRVLDYVRSQASKGSRTRRFFSFRGERAERPSFADDDYATGGDRRDGGRHRRPRSGY

SEQ ID NO: 39458 - protein, 105 aa, Sorghum bicolor
  Clone ID: SORBI-28MAY03-C15684_1.pep
MDDDAVEKSHQDPRTSETCSPAEPTDKVEKPGSADDVTENRPEKVPAVETSDTGFVFEPGSVLVEFMRKEAACIAAHSLHGRRFGNRTVHAGYAPYDLYLQKYPR

SEQ ID NO: 39459 - protein, 197 aa, Sorghum bicolor
  unsure (1)..(197): unsure at all Xaa locations
  Clone ID: SORBI-28MAY03-C16192_1.pep
MATSFQGTTTKCTACDKTVYLVDKLTADNRIYHKACFRCHHCKGTLKLANYNSFEGVLYCRPHFDQLFKRTGSLDKSFEGTPKVVKPERNVGNENAVKVSSAFAGTREKCVGCSKTVYPIEKVTVNNTMYHKSCFKCCHGGCTISPSNYIAHEGKLYCKHHHIQLIKEKGXTSASLRMITRRRHRLGHWRMKKSINH

SEQ ID NO: 39460 - protein, 149 aa, Sorghum bicolor
  Clone ID: SORBI-28MAY03-C16176_1.pep
MKAVPADSAASPAPATKINMPAASAAGGAEAALLGKGRYKVWALAAIALLALWSMSAASVSLRWSSSGDLASVYGDLDVPLADDLDSLEMEEREKLVGRMWDMYTRTSDEVRLPRFWQEAFEAAYGRLAGDDVQEEPELSNRGGSSSRH

SEQ ID NO: 39461 - protein, 58 aa, Sorghum bicolor
  Clone ID: LIB3480-055-P1-K1-B3.pep
CHGFSAKQSSGPQATDICGTTNSPLTCHLCCSRHSLPHSHSVSARVQVCGLTFGQSQR

SEQ ID NO: 39462 - protein, 212 aa, Sorghum bicolor
  Clone ID: SORBI-28MAY03-C1633_1.pep
MAAPPVQPVPPAAAAAVNGDAFRLGFVGAGNLAESIARGVAASGVLPASAIRTAPHRRPERGEAFASFGACLLQTNAQVVDDSDVIVISVKPQIVKQVLLELRPRLSEEKLLVSIAAGIKMQDLQDWSGQRRIIRVMPNTPSAVGQAASVMCLGEMATQDDENRVRKLFSAIGKVWTAEEKYFDAVTGPERSGPAYIFLAIEAMADGGVAAG

SEQ ID NO: 39463 - protein, 114 aa, Sorghum bicolor
  unsure (1)..(114): unsure at all Xaa locations
  Clone ID: SORBI-28MAY03-C16398_1.pep
KKTETRAPSXDEKERERCMSKCKREEAKITAWENLQKAKAEAAIRKLEMKLEKKRSSSMDKILGKLRSAQKKAQDMRSVVSSSEDQCSTRTTKKKSSFVKTGKPFSCCFTYRAC

SEQ ID NO: 39464 - protein, 181 aa, Sorghum bicolor
  Clone ID: SORBI-28MAY03-C16445_1.pep
MQTEDDYKQLGLKVVSNLGDELQNVRKAAILDADQLTMSVASLGHKLGKAKEFLNTSMKSLDEDSRFHHKLKHFAEQSQTDVALLLEEEKKIRSLVRGTVDYFHGSTGKDDGLRLFVVVRDFLAMLEKVYKEVKEASKVAPKKTKTPQPPQASFNDPRRKLFPAIQDQRTDSSSSSSDEDD

SEQ ID NO: 39465 - protein, 194 aa, Sorghum bicolor
  Clone ID: SORBI-28MAY03-C15728_1.pep
MAAADPVKKPSAGGKATAAPPKSSDSGIMRRLPRLAFVFLLALVYRQLQAPPPKIPGTPGGPPVTSPRIRLKDGRHLAYHESGVPREQAKYKIIFMHGFDSCRYDVLRVSPELAQELGIYLLSFDRPGYGESDPHPGRSEKSVALDIEQLADALELGPRFHLVGFSMGGEIMWSCLKYIPHRLSGVAILGPVGN

SEQ ID NO: 39466 - protein, 308 aa, Sorghum bicolor
  Clone ID: SORBI-28MAY03-C15807_1.pep
HGAGASWLRRRAALLVGVARSGNLPRALPPPSGCRSCLSAPCPLLSVGLCLCPLAVWLPPLPRLPAALAVRGRCWGLPVEPLPGGGFPQLRAGFRQGWPGARGRRRAALVLPGFRWWAGRVAPPPLFCTQIPDATPMQSALIWAVLSIVVLISLSVLFGSPYSAGVEWKLLKATMITSISIGLGLMSIINFATAQLGALIVIPMCLFSRPLKASEMNFLPRAVLLASNIAFAVLGFPPAALLIMKGVSKGSWSWTIDIGDFWVWMEFLWEWSSATYLYLFLVHLPCWLLCILVLLHPCRQSESKMKQE

SEQ ID NO: 39467 - protein, 209 aa, Sorghum bicolor
  Clone ID: SORBI-28MAY03-C15775_1.pep
PTRPKTFFAAGQETTATLLTWAMFLLAVHPEWQHKVREEVVREFSCTSDGDGDEVPHADVLAKLKLLYMVLLETSRLYPPIVYIQRRAASDAVLGGIKVPQGTVISIPIAMLHRDKQVWGLDADEFNPMRFEHGLTKAAKDPKALLAFSLGPRVCTGQSFGIVEVQVVMAMILRRFSFSLSPEYVHKPKYLLSLTPKLGMPLIVRIVDG

SEQ ID NO: 39468 - protein, 193 aa, Sorghum bicolor
  Clone ID: SORBI-28MAY03-C15854_1.pep
MEVDGGKKKMLATLVGCNYAGTEYELQGCINDVHAMRAVLLDRFGFAPANVTVLTDDHDDSGGGTIPTGAGVRRALSDMVARAAPGDVLFFHFSGHGTLVPPVVTGSGHGDRDDEAIVPCDFNLITDVDFRELVDRLPRGATFTMVSDSCHSGGLIDQEKEQIGPTTAAADSYLHGGARAARFLPYAAVLGHL

SEQ ID NO: 39469 - protein, 76 aa, Sorghum bicolor
  Clone ID: SORBI-28MAY03-C15903_1.pep
MQIEGLKRHPRYGARIESSTYKGMYHALKEIVAKEGFGGLYKGLFPSLVKSAPAGAVTFVAYEYISDWIGSKAGVE

SEQ ID NO: 39470 - protein, 150 aa, Sorghum bicolor
  Clone ID: SORBI-28MAY03-C16885_1.pep
PAGLSKVGDWTLPFHGKVEYVPQLKLWFGLSAGAQQLAAVDLSGMLDSSPQPLRLVGGPWKELVHLPQEWKECRDPQFVSLGSGRFCIARLFTQEAEAGSGCDQMVLNNFTVLTGVEINSSGKGGTGKLELQMTTHISRRVNNTSIETLF

SEQ ID NO: 39471 - protein, 188 aa, Sorghum bicolor
  Clone ID: SORBI-28MAY03-C1681_1.pep
MPCSSRPMRIGPAASRKNTGGVVQERVPNSQGAQSENDPNNTTIFVGGLDPNVTEDTLKQVFSPYGEVVHVKIPVGKRCGFVQFVTRPSAEQALLMLQGALIGAQNVRLSWGRSLSNKQAQPQQESNQWGAAAAAGAGGYYGGYGQGYEAYGSGYAQPQDPNMYGYGAYAGYPNYQQQQAAQQPQQQQ

SEQ ID NO: 39472 - protein, 393 aa, Sorghum bicolor
  Clone ID: SORBI-28MAY03-C169_1.pep
MEEAGSTGSSSGSRRLPPPVPSSSSKKLRSLSALDARPVSSSKRTPDDLEEGEIAMSGDSHMDLQQSGSWNHERDDGEDEQVLQPKIKRKRSIRLRPKPNAEKQEDRSGEGVFPQHAARQQDTVHPIVKQKRNMPSRKVSPASRSGKLTYMSGSGEGSAERSKENWNSKAIDSTPPEFRGTKMSDSMQRKCKNVISKLWRRIDKEGHQIIPNISSWWRRNENSSFRGPAGSTLDLQKIEQRVDGFEYGAVTEFIADMQQMLKSVVQHFSYRHEVRIEAETLHNLFFNIMKIAFPDSDFSEAKNAMSFSNPGGAASGAAAQSSKHTASVHKRRASASEADQHGSGHSRHNQSSEVPSRPHSSRSERDPRHSGSSSRDQLQDGAGLLHPSDMFIV

SEQ ID NO: 39473 - protein, 68 aa, Sorghum bicolor
  Clone ID: SORBI-28MAY03-C17013_1.pep
MTTSRRLADRKTAKFQKNITRRGSVPETTVKKGNDYPVGPVVLGFFIFVVIGSSLFQIIRTATSGGMA

SEQ ID NO: 39474 - protein, 119 aa, Sorghum bicolor
  Clone ID: SORBI-28MAY03-C15995_1.pep
CMFAGMIFRKEPFFYGHDNHDQLVKIAKVLGTDGLNAYLNKYHIELDPQLEALVGRHSRKPWAKFINADNQHLVSPEAIDFLDKLLRYDHQDRLTAREAMAHPYFLQVRAVENSRSRPQ

SEQ ID NO: 39475 - protein, 131 aa, Sorghum bicolor
  Clone ID: SORBI-28MAY03-C16052_1.pep
VDASGLVKLADFGLAKEMSILSQAKSSKGTVYWMAPEVAKAKPHGPPADIWSLGCTVLEMLTGKVPYPDMEWTHALLKIGRGIPPEIPKTLSEDARDFIKKCVQANPNDRPSAAQLFEHPFVQRPLQQYST

SEQ ID NO: 39476 - protein, 97 aa, Sorghum bicolor
  Clone ID: SORBI-28MAY03-C16154_1.pep
GPLHWELLQRARAADNQLFVATCGPARDTSAGYVAWGHSTLVGPFGEVIATTEHEETTIIADIDYSLIEQRRQFLPLQHQRRGDLYQLVDVQRLGSN

SEQ ID NO: 39477 - protein, 85 aa, Sorghum bicolor
  Clone ID: SORBI-28MAY03-C15996_1.pep
LMGHRRYMYGGHAKTIKPDKRKLVQLFDNPNIRWDRFKHYMEDMRRHSEMKGLGLRKPQESMYNLPMPDCMCQQAEARSRNTARN

SEQ ID NO: 39478 - protein, 87 aa, Sorghum bicolor
  Clone ID: LIB3480-051-P1-K1-H5.pep
IQNKEILKSLCTKYNKLWSTFFTHILHSLMNLCFLGKGFISTAIQFEISIFSSMLEPIFIFPFAYCYMVWLLTSYKGGTCLVPCRVP

SEQ ID NO: 39479 - protein, 144 aa, Sorghum bicolor
  Clone ID: SORBI-28MAY03-C16182_1.pep
TKQLQNSNLEGASSSNAANVASQVGRDLPPVPSFKATNMDSSFSKFSHMERYWRTPYPFRPISRAPEGTSSSTPVAANIAVPASQANLTACTSTFLSQRGDTSSLPPKGDPPSEEDLELTVAPPSQQNMTNMSSQNAVGVIQVI

SEQ ID NO: 39480 - protein, 161 aa, Sorghum bicolor
  Clone ID: SORBI-28MAY03-C17431_1.pep
MGKFRKLGRGYSHRLSMLRTMVSQLVKHERIETTVAKAKEVRRKADQMVQLGKEGTEHAARRAAAFVRGDDVVHKLFTELAYRYRDRAGGYTRMLRTRIRVGDAAPMAYIEFVDRENELREAKPATPPPPQRVPLDPWTKSRASQQWAGPKITKTSESDGL

SEQ ID NO: 39481 - protein, 199 aa, Sorghum bicolor
  Clone ID: SORBI-28MAY03-C1755_1.pep
RERMFKPSLSTIISENPKVVTVAPSDTVLTASKKMLELKVSSAVVAIENKPGGILTSRDILMRVIAQNLPPESTTVEKVMTQSPECATVDMPILDALHTMHDGKFLHLPVLDRDGNVVTVVDVLHITHAAIATVGNSGAAGSEATSAMMQRFWDSAMSIGPLDDDDDSRSEGSTKVASEATDIGRSAFFPASGLSNTFG

SEQ ID NO: 39482 - protein, 270 aa, Sorghum bicolor
  unsure (1)..(270): unsure at all Xaa locations
  Clone ID: SORBI-28MAY03-C17559_1.pep
MAVVRLRGNGANGVVRPRPRDRGARGGGGSMAGRVAVLAFCVAGIWSAYIYQGVLQETLSTKRFGPEGRRFEHLAFLNFAQNVLCFVWSFIMIKLWSGGGSSNGRAPLWKYWGVSVTNTIGPTMGIEALKYISYPAQVLAKSSKMIPVMLMGTLLYGVKYTLPEYFCTFLVAGGVSSFALLKTGSKTIKKLANPNAPLGYTLCFLNLAFDGYTNSTQDLIKSRYPKTNPWDIMXLGMNLWGTIYNACIMFAAPLTVSNWAYANGFEEFEI

SEQ ID NO: 39483 - protein, 197 aa, Sorghum bicolor
  Clone ID: SORBI-28MAY03-C17578_1.pep
MASGGANTVPLATPYKMGKFDLSHRVVLAPLTRQRSYGNVPQPHAILYYQQRTTKGGLLIAEATGVSDTAQGYKDTPGIWTNEQVEAWKPIVDGVHQKGGIFFCQIWHVGRVSNSSFQPNGQAPISSTDKPLKPQVRANGVDVATFTPPRRLETDEIPLVINDFRVAARNAIEAGFDGVEIMELRLDLISSKDQGHD

SEQ ID NO: 39484 - protein, 109 aa, Sorghum bicolor
  Clone ID: SORBI-28MAY03-C17564_1.pep
RIGTACPICNRNAGTALYRSIGSKDCRDRQHGSIGAEDCGAVDASLRVVRYSYPPGMIRIAACQKKNYKREEKKRKTQKSCGVVEQTVACRAMTRLSAWCLGYLSNLQL

SEQ ID NO: 39485 - protein, 164 aa, Sorghum bicolor
  Clone ID: SORBI-28MAY03-C16549_1.pep
PRLDRSSRDRDRDQDRSSRDRYRSSRDLDRDKDARDYHRHERDSRDREYYRSRRSEERRDDRRDHESSRHRRSNSRHRSRSRSRSRSRSRRSRSRSRSRSRNEQRLSPFRDANKEKAATVSSNLAKLKDLYGDITEKARGSDAEKLHRDSCAEEVIRLGGPRWR

SEQ ID NO: 39486 - protein, 119 aa, Sorghum bicolor
  Clone ID: SORBI-28MAY03-C16708_1.pep
KATSNRDLHTIDEYESVIKQLRDENLSLKERLSKVEESLLQELVVERDKNKSLTERVEDLQRQFESATKEQEALIDIFSEERNRRDQEEESLRKKLKDASSTIQDLLEQLNAARKGRKV

SEQ ID NO: 39487 - protein, 159 aa, Sorghum bicolor
  Clone ID: SORBI-28MAY03-C1670_1.pep
MAVRSRPRRSAGHLYHLRLPRLLFLLPLALLLILFLGHLPALLRGANAHGRRCLPDATDHLLPFSHPLPDPRLSIAIVTLADEDAGRPGGRRSFRGVLAASARNKRAYAEAHGYGLVVLPASAVDPSRPPSWSKVLALRSHLRHHHWLFWNDADTLVTN

SEQ ID NO: 39488 - protein, 295 aa, Sorghum bicolor
  Clone ID: SORBI-28MAY03-C16746_1.pep
ARGKQGREVQFSHYPYRARILPWKRKIFCQNFRGSYSSLLNTSSIGIMRKLLQTRKRSTIYTVSTDGFSLRKSGVLSIGGSSLKWSRSLEKHSQKVNEEATQAVAEVERKKREKRKRQSLRNKGRNDRYSASVAANQLTNSSRASSEYVRVNKGNQLVRNPKKVIRMLASEKVRWSLHTVRRRLAKKQQYCQFFTRFGECKKSGGKCPYIHDRAKVAICTKFLNGLCSSTRCKLTHQVLPERMPDCSYFLQGLCTNTACPYRHVKVNSNAPVCEDFLKGYCADGDEVFMISLDLY

SEQ ID NO: 39489 - protein, 164 aa, Sorghum bicolor
  Clone ID: SORBI-28MAY03-C16801_1.pep
LTQFIDTLNNQPANMKNIVDQLFEQASPTVISAVTLYSYPGPQLLGLAIRFLPLDLLIFLYFISTNFTITLHALLLLPLLSLPFLNLLLVQTGFFHLIFQTTLTLLFPLLVNLLIFQTTLTLLFPLLVNLLTVIGRNRSALPLLFLCLHLNFFLHHNILLNLLL

SEQ ID NO: 39490 - protein, 154 aa, Sorghum bicolor
  Clone ID: SORBI-28MAY03-C15416_1.pep
MDEDWELLLASPKAAVAAEPYAGGGGGGGEDDAGAIKHDYFDLGSDAKYPRRASLSKGNDEVDEEEGVDEGLLGASDNSSWVEPDPDDLLFPGRDRAALWSDSSSDGERPEVEATDPVERAREEDGVTVAAAADGGEGAVAKGGGRPVPWWKLS

SEQ ID NO: 39491 - protein, 262 aa, Sorghum bicolor
  Clone ID: SORBI-28MAY03-C15485_1.pep
HEVDLTLPGQQQTLIESVANAAKKPVILVLLCGGPVDVSFAKTNPKIGAILWAGYPGEAGGIAIAQVLFGEHNPGGRLPVTWYPQDFTKVPMTDMRMRADPATGYPGRTYRFYRGPTVFNFGYGLSYSKYSHRFVTKPPPSMSNVAGLKALATTAGGVATYDVEAIGSETCDRLKFPAVVRVQNHGPMDGKHPVLVFLRWPNATDGSGRPARQLIGFQSLHLRATQTAHVEFEVSPCKHFSRATEDGRKVIDQGSHFVMVGD

SEQ ID NO: 39492 - protein, 119 aa, Sorghum bicolor
  Clone ID: SORBI-28MAY03-C15395_1.pep
SSGSPTEDVVGSTGLGRIEDRRPSPQRPRLDQGQTTLLHHVPLPHHLPLGIEAWSDLSSHSQLVADGSTTTESSPPYLPRTLEPCVNTSDGQGRSATPVDLGHATREKAAASGEEGPRA

SEQ ID NO: 39493 - protein, 108 aa, Sorghum bicolor
  Clone ID: SORBI-28MAY03-C15534_1.pep
MEHGSLDDSSSSTFSIMEEDHTLANSVRFVLNQDPRVAFCGYSIPHPAENKVNIRVQTTGDPAKDVLKDALQDLMVMCQHIRGTLDTAVADFRGNKTAEAMDIDLNKK

SEQ ID NO: 39494 - protein, 111 aa, Sorghum bicolor
  Clone ID: SORBI-28MAY03-C17652_1.pep
MAAASGRAPAACALLLLLLALGVVAAAVDASQEEELSPGSPSPAPSPASSIDCGSACAARCALSSRQKLCRRACGSCCARCNCVPPGTAGNHDVCPCYAAITTRGARPKCP

SEQ ID NO: 39495 - protein, 115 aa, Sorghum bicolor
  unsure (1)..(115): unsure at all Xaa locations
  Clone ID: SORBI-28MAY03-C1711_1.pep
MEDWLFYSLTTLLCLLCSLLLRARTPGSKDRHADSSSALPPLPPGPTPLPVLGPLLFLARRDFDIEPVLRRIAREHGKVFTFAPLGPARPGIFVADRAAAHXALVQRGAVFASRP

SEQ ID NO: 39496 - protein, 116 aa, Sorghum bicolor
  Clone ID: SORBI-28MAY03-C17171_1.pep
FQTKLSNQNLTGKNIFHCNQALVKEENDSQKGEEYSKALSAIPAFSTAATESPVPMMVETTFVVIYSASFLAIASSDQRHLLESATTVAPLRRPEQGKRRNGLAPIHPPRGEGKRR

SEQ ID NO: 39497 - protein, 110 aa, Sorghum bicolor
  Clone ID: SORBI-28MAY03-C16909_1.pep
MDANRRQSGIQQLLAAEQEAQQIVNAARAAKSARLRQAKEEAEREIAEYRAQMEAEFQRKVAESSGDSGANVKRLEEETTAKIEQLSQQAASISPEVIQMLLRHVTTVKN

SEQ ID NO: 39498 - protein, 110 aa, Sorghum bicolor; identical to SEQ ID NO: 39497
  Clone ID: LIB5047-008-R1-XP1-F5.pep

SEQ ID NO: 39499 - protein, 171 aa, Sorghum bicolor
  Clone ID: SORBI-28MAY03-C1721_1.pep
DPFFVLSFPHFFPSFLDIENPIHLGRSPRRRGPARASSPWRPSSPTGPTRTAAPRRPPRRPPWPWRRREPTTLSASVVRGCRCRSGSRARWRWGIIIHTTSCGGQRRSRRAAQVQCLQCAALLSAATATSTSGSTAPAARWPAAPRRAAPSCAAASPASWWRSWCSPRCAR

SEQ ID NO: 39500 - protein, 193 aa, Sorghum bicolor
  Clone ID: SORBI-28MAY03-C17313_1.pep
AGRAGLDGKSSVAAPILQERNGTEVDSSDDEDDFYMNRQLSPIPPSPVSRESSFQQETLVGVEVQTMNGHLYPKPLAQVRPEPPSWQLSRRPVEEPRGEIWRFSRRPSEDGTSDAMEAHAIAPRESKKPEIHGDNRFSIPRCIEVMSAMAELSPVEKSLAPDVFLDASNREIFLSLSVDIRPMWLRRKMKSLV

SEQ ID NO: 39501 - protein, 177 aa, Sorghum bicolor
  Clone ID: SORBI-28MAY03-C17371_1.pep
MSPREWIHDVGNGPFIGVMIFIVMITVGSVLFAKCCVGDRAFMRTGYDFEGYVMRKCPVCVGLPKPTHPRVKEVDPLQMTEITVEEARTSEPPAPPPATAAPPPPPAAATPAPPPATSAPPPAAAATPAPPPTVTGAVPVATKEDEEDEINEDEEEDDEEEEFDFDAYEEAEALGRL

SEQ ID NO: 39502 - protein, 102 aa, Sorghum bicolor
  Clone ID: SORBI-28MAY03-C1677_1.pep
MYSANSNRCLQEAMRDPHVAADGFTYEGDAIRGWLDGGNDASPVTGQPLAHRELAPNLALAAVIQDYTVMMMKKRRQYRFGDSHDNTVAALQFLSSPVGSER

SEQ ID NO: 39503 - protein, 115 aa, Sorghum bicolor
  Clone ID: LIB3478-009-P1-K1-E5.pep
SVIQSPYEFDEDRVPSYFLCPILQEAMRDPHVAADGFTYEGDAIRGWLDGGNDASPVTGQPLAHRELAPNLALAAVIQDYTVMMMKKRRQYRFGDSHDNTVAALQFLSSPVGSER

SEQ ID NO: 39504 - protein, 148 aa, Sorghum bicolor
  Clone ID: SORBI-28MAY03-C15052_1.pep
TRVAACDIRCCSRDATFVLKEVDMAIVADLGALQRLPRIVGYGNAADLALTGRKITAMEAKEMGLVTRVFDSKKELDAGVANIAKEIAEKSAWAVMGTKAVLLRSRDVTVEQGLEHVATWNAGMMRSNDLKEAIKAFLEKRKPVFSKL

SEQ ID NO: 39505 - protein, 160 aa, Sorghum bicolor
  Clone ID: SORBI-28MAY03-C15027_1.pep
MAEQTEKAFLKQPKVFLCSKKAAKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 39506 - protein, 131 aa, Sorghum bicolor
  Clone ID: SORBI-28MAY03-C15058_1.pep
MSWQTYVDEHLMCEIEGHHLTSAAIIGHDGTVWAQSTAFPQFKPEEMTNIMKDFDEPGFLAPTGLFLGPTKYMVIQGEPGAVIRGKKGSGGITVKKTGQALVIGIYDEPMTPGQCNMVVERLGDYLVEQGL

SEQ ID NO: 39507 - protein, 147 aa, Sorghum bicolor
  Clone ID: SORBI-28MAY03-C15063_1.pep
QAEILLNADRIVVQTDGPIDNAAGLQRYADSLMKRTDIEFNVVVTQMNGKDYSSNSVHVFHIGKLRIKLRKGWSTKARESYSTMMKLCGSRGGGNAAARAVFWQARKGLSYTLAFETDRDRNAAIMIARKFASNCNIALAGPGDQGT

SEQ ID NO: 39508 - protein, 90 aa, Sorghum bicolor
  Clone ID: SORBI-28MAY03-C15115_1.pep
ELGRRYFPHCSDVLDKFLNEESTDLIFLETGTPEDQRVKRMRFSELKEDVRKAFTKDKAAVAAIASSASSSSSPRCEGRGRSNRKLRPSR

SEQ ID NO: 39509 - protein, 102 aa, Sorghum bicolor
  Clone ID: SORBI-28MAY03-C15246_1.pep
DENPKFLMAASTLLLPFQPLMVSAVHTGIMEVSFAKRASIDPELKTAHNLHKMSSLLGGALFIADDVFPQASYLHAAWHLAAALGVGTCNKLLEGRSRRDAR

SEQ ID NO: 39510 - protein, 142 aa, Sorghum bicolor
  Clone ID: SORBI-28MAY03-C15225_1.pep
DMQRSVFCLCPLGWAPWSPRLVEAVVFGCIPVIIADDIVLPFADAIPWEEIGVFVAEEDVPKLDSILTSIPTDVILRKQRLLANPSMKQAMLFPQPAQAGDAFHQILNGLARKLPHGDNVFLKPGERVLNWTAGPPGDLKPW

SEQ ID NO: 39511 - protein, 140 aa, Sorghum bicolor
  Clone ID: SORBI-28MAY03-C15292_1.pep
APTRPAAAMSKHPVWVMNVVPANRTENTLGVSTERGLIGTYTDWCEAFSTYPRTYDLIHGNGIFSSHIHKCGIIDILVEMDRVLRPGGAVIVRDRADVVLKVKKDADRLKWSSRVVDTENGPLDPEKLLIVDNSLPLRGS

SEQ ID NO: 39512 - protein, 136 aa, Sorghum bicolor
  Clone ID: SORBI-28MAY03-C15319_1.pep
NTPVKHHGTEDKTNSNWWAHAPAYPSGPQGSFIEPPEFGNRYMTDPHSSNHSGDTSEGSMEDLEQSNRRSSSVWRSPQALSKTRYMDDSDIEEGLSLHFADVHQKDEDDRHLVMDHQDPAPAGLPVRIIPRSSDPV

SEQ ID NO: 39513 - protein, 87 aa, Sorghum bicolor
  Clone ID: SORBI-28MAY03-C15320_1.pep
MATAQAASAAPTHHRASPGTSPSQPPYPSARTRADSACFPQYTASLKCLEANQDKSKCQQQFDDYKECKKKEREARLERNKTRSLFG

SEQ ID NO: 39514 - protein, 159 aa, Sorghum bicolor
  unsure (1)..(159): unsure at all Xaa locations
  Clone ID: SORBI-28MAY03-C14642_1.pep
EDQDDLKNIRKTIQRIAAIQYTIPDNIHISDDCRQLISRIFVSNPLRRITMREIKNHPWFLKNLPRELTEAVQLSYFRRDNSVSAFSEQTTEEIMRIVKEARTLPKSLRSGYGYSEECSDVEENEEESEPKEVEEEHEQQXRVREVCESGELDMTSLHI

SEQ ID NO: 39515 - protein, 238 aa, Sorghum bicolor
  unsure (1)..(238): unsure at all Xaa locations
  Clone ID: SORBI-28MAY03-C14609_1.pep
MEYSGGGATLSEMYQSARRLLLSARDGVARVERLASAPTSSSYSSAPLVGGGAAGDPAVAEEVRREVAQIQGLCAQMDRLWRSIPAKGQRDLWKRKVEQLSEEVDSLKETLDKHSLRQKKRILEAKERAELFERANGESSHVLRIFDDEAQAKQSARNSSRMLEEAYETGVAILHKXADQRDRLKSAQRKALDVLNTVGLSNSVLKLIERRHRVDKWIAYAGMIITVVVMIAFWRLTH

SEQ ID NO: 39516 - protein, 406 aa, Sorghum bicolor
  Clone ID: SORBI-28MAY03-C1466_1.pep
ARGSGEEMVVKVRKPYTITTRRERWTEAEHKRFLEALKLYGRAWQRIEEHVGTKTAVQIRSHAQKFFTKLEKEAMTNGTSPGQALDIDIPPPRPKRKPNNPYPRKSGLSSETPTKDFPNDKSAKPNMPLSNGNVQMAGDASLQKFQRKELSEKGSCSEVLNLFRDAPSASFSSVNKSSSNHGAPRGVEASKTEIRDMTIMENNSLNPNMQEDVKEISDHEMERLNSIQISSKCEHSHEGYLDLSMQQMKLKPKSVETTYVDKQTARASHSHAEKNGTASILVTATEGTHSDQTSDQVGINGSINPCIHPMLSSDPKFDSSATPQHFPHNYAAFAPMMQCNCNQDTYRSFVNMSSTFSSMLVSTLLSNPAIHAAARLAASYWPAAEGNTLIDPNQENPADDVQGRNI

SEQ ID NO: 39517 - protein, 141 aa, Sorghum bicolor
  unsure (1)..(141): unsure at all Xaa locations
  Clone ID: SORBI-28MAY03-C14807_1.pep
QXQQHXXNQLLQEVKNTNGRTLPQQPRPDTPNANSGITSGGANTNSAATGEQAQRINSSAEKGAATVGTGPSNVINNSTASIVPSRSNSFKSVSSNPAAAAAASAAGGNAATSKAEPFHEFDDFEQLLTNELVGNEFLWDN

SEQ ID NO: 39518 - protein, 202 aa, Sorghum bicolor
  unsure (1)..(202): unsure at all Xaa locations
  Clone ID: SORBI-28MAY03-C14895_1.pep
FMALKTVLLLPYEALRLQCLQMVEAKMREGIVSTSSNADDHELLALVLSSETMQKITIEEAYXQIFSYICHLVGHLARSFQTALLVQWNDEATSKINRSLLFGRVLFPCFVSELVLRGQYXLAGFVISRWMHTHPSLGLMDITETSVRRFLQGQVAQAELVGGSDAAFTDGEVCVRHTISNLQSKLVSLLQSALAALPNQEL

SEQ ID NO: 39519 - protein, 143 aa, Sorghum bicolor
  Clone ID: SORBI-28MAY03-C14924_1.pep
VKGLSPKVLTLVEQESNTNTAPFAQRFAETLDYYTAIFESIDLALPRDDRERINIEQHCLAREIVNLVACEGEERVERHEVFGKWKARLMMAGFRPSPLSALVNATIKTLLQSYSPDYKLAERDGVLYLGWKNRPLIVSSAWH

SEQ ID NO: 39520 - protein, 185 aa, Sorghum bicolor
  Clone ID: SORBI-28MAY03-C14937_1.pep
TRAASAAAAAVTSQQQQQQHVYRPVPRAGGVVVLPVAPPLAPRPPSPPPPPPPQQQPPPATSLSLSLSLPGLDQQPEPSPATAPPQPPVQIHQHQAAPPQMPPPPPQAQPSPRLPFQLQPAPATNLTSPQPAAAAPFSSEFLLMMQEMIRIEVRNYMSGSGFDPRADGASVHAVTKRMMGMAKIE

SEQ ID NO: 39521 - protein, 185 aa, Sorghum bicolor
  Clone ID: SORBI-28MAY03-C14958_1.pep
ARGLDSQVVTVTRFQGGGAFNVIPDSVTIGGTFRCFSSEGFLRLKRRIEEVVVAQSAVHRCAASVDFGAGGSPLLPPTVNAASLHAHFEAVAAETVGAGAVRGAMEPCMGSEDFASFSEAVPASHFYFVGIGNEAIGAVHAAHSPHFFIDDGALPYGAAMHANLAIGYLRNHAAASGPVGPHDEL

SEQ ID NO: 39522 - protein, 104 aa, Sorghum bicolor
  Clone ID: SORBI-28MAY03-C14971_1.pep
NAMDNELKIWDLRPYAPENRNIKTLTGHQHNFEKNLLKCSWSPDNRKVTAGSADRMVYIWDTTSRRILYKLPGHNGSVNETAFHPTEPIIGSCGSDKQIYLGEL

SEQ ID NO: 39523 - protein, 164 aa, Sorghum bicolor
  Clone ID: SORBI-28MAY03-C14986_1.pep
PTRPVQITRLEHINALSSNVEYLASRDATIMGSRNGHAPIFLWYTLNRKGYRGFQKEVQKCLRNAHYLKDRLKEAGVGAMLNELSSTVVFERPKDEEFVRRWQLACEGNIAHVVVMPSVNIDKLDYFLNELVEKRATWYQDGISQPPCIARDVGVENCLCGLHK

SEQ ID NO: 39524 - protein, 77 aa, Sorghum bicolor
  Clone ID: SORBI-28MAY03-C18082_1.pep
RPDPPRTLCVALYPFHIPFSSVLILWRYFNGSVHVVSKTYNPANALDMSCYGHVQKRHEAKGCLFACVLLLLLLRDL

SEQ ID NO: 39525 - protein, 67 aa, Sorghum bicolor
  Clone ID: SORBI-28MAY03-C18239_1.pep
MTTSRRLADRKIARFEKNITKRGSVPETVKKANDYPVGPILLGFFVFVVVGSSLFQIIKTASNAGFF

SEQ ID NO: 39526 - protein, 213 aa, Sorghum bicolor
  Clone ID: SORBI-28MAY03-C18478_1.pep
CWSTHARTYCTGVHLFTYLCGCNNENTPTHTHTHRHAYASPLERTTCSWTSVRAVVLVRARPGVRTSPGGARAVRQANRPVLVLGIIGDLAAVARPQQADELRRHLVLHQAPPPLLLPPPLVKSTASRDDDRRCPWCADDDHPATVILVVVGGGGGHRNGRCGDKKGDGGGEDEGGEGQVGATHRVHWFSLLLRSYYLLLSQALVRPGLGPAA

SEQ ID NO: 39527 - protein, 220 aa, Sorghum bicolor
  unsure (1)..(220): unsure at all Xaa locations
  Clone ID: SORBI-28MAY03-C2348_1.pep
MDSGYNPRTVEEVFRDFKGRRAGIIRALTTDAEDFFKQCDPEKENLCLYGFPNESWEVNLPAEEVPPELPEPALGINFARDGMQEKEWLSMVAAHSDAWLLSVAFYFGARFGFNRNDRKRLYSLIDDLPMAFEIVSGKSETKAPAPPPPTPNSSNHSNIKSKSNNKKKPSEPKVKQTKPRAPAEEGPGGEEEDGSASEGEHXETLCGACKESYGPDEFWI

SEQ ID NO: 39528 - protein, 190 aa, Sorghum bicolor
  Clone ID: SORBI-28MAY03-C23589_1.pep
PPGLELPASPRRPLSTGGRGLPRGPVFRSPAARPHRRYEQRRRRRSRRRLPRCGRSSRRLSRRPQPPVQSRALPGGLGSRWDHIHHSAKPRSQRRARHGILSPPHGCRAPASALNGCCGSALAGDGGGSPRVPSRGHVLARIRRGTPAITILLLCLVFSSRCLPFCVVCVIYMRLEYLCVHNVWIVRLLL

SEQ ID NO: 39529 - protein, 160 aa, Sorghum bicolor
  Clone ID: SORBI-28MAY03-C23698_1.pep
RNDEFCSSDVEVCLLGTVAPCVLYGSNVERLAAGQGTFANSCLPYTGLYMLGNSLFGWNCLAPWFSHPTRTAIRRRYNLEGNFEAFTRQCGCCGSLVEDEERREHLEAVCDLATHYLCHPRALCQEGRELRRRVPHPGFNNGHSVFVMMPPMEQTMGRGM

SEQ ID NO: 39530 - protein, 280 aa, Sorghum bicolor
  Clone ID: SORBI-28MAY03-C23737_1.pep
MGPARHAAVGTLLAAVVLLLSAAVPGARAQAETEHEEGFSYIPGAPNGPENWGKIKPQWANCSVGRMQSPIDLSHELAKLVQSLGYLKTFYRPAEATIVNSGHDVMVSFKGDAGSLVINGTTYHLRQLHWHTPSEHTIDGRRYDMELHLVHQTLANKTAVIGVLYEIGPIRDPFLQMLEPFIRSIENTKDQPKDIGVVDPNGARGSGSAYYRYMGSLTTPPCTEGVVWTVVRKISPVAKDQVKLLRDALQDGNTMNARPLQEVNNRDISIFRPKPHHHYH

SEQ ID NO: 39531 - protein, 157 aa, Sorghum bicolor
  Clone ID: SORBI-28MAY03-C23850_1.pep
MAKLYVQAVPPPDLNRNTEWFMYPGVWTTYILILFFCWILVLSVFGCAPGTAWTLVNLGHFAITYHFFHWKKGTPFADDQGMYNTLTWWEQMDNGKQLTRNRKFLTAVPVVLYLIASHTTDYQHPMLFLNTLAVIVLVVAKLPNMHKVRIFGINAGS

SEQ ID NO: 39532 - protein, 129 aa, Sorghum bicolor
  Clone ID: SORBI-28MAY03-C239_1.pep
RKLQLDSDGDGGGPFSRFRDEVAAVRQFLYRTQKELAACTDEMCLTMDGSASSYQLLGNFAAGQQLYRLELEAEEDGACSSILFSAPNNNKGDGASQGAQAHHPQRVKLPTLRATEQHLAALQCTYEYT

SEQ ID NO: 39533 - protein, 306 aa, Sorghum bicolor
  Clone ID: SORBI-28MAY03-C23937_1.pep
MATVSLLRAAALGLVVLASALPAARSWSKEGHMLTCQIAQDLLEPDAAHAVRNLLPDDVGGDLSALCVWPDQVRHWYKYKWTGPLHFIDTPDKACSFDYSRDCHGPDGAKDMCVAGAIANFTSQLLHYKHGSADRRYNLTEALLFLSHFMGDVHQPMHVGFTSDQGGNSIELRWFRHKSNLHHVWDREIIQTALADFYGKDMDAFRKQLEHNLTKGTWSDDVSAWTDCEDLSSCPTKYATESIELACKWAYSGVREGETLSDDYFDSRLPIVSRRIAQGGVRLAMFLNRIFGAHNRDVPPAAAAAS

SEQ ID NO: 39534 - protein, 90 aa, Sorghum bicolor
  Clone ID: SORBI-28MAY03-C23366_1.pep
MSSRRSSSSRGNISEDEINELISKLQALLPSSRRRGSGQASTTKLLKETCSYIKSLHREVDDLSDRLSDLMSTMDHNSPGAEIIRSILRS

SEQ ID NO: 39535 - protein, 210 aa, Sorghum bicolor
  Clone ID: SORBI-28MAY03-C23402_1.pep
MTERRELRLLLALLGVLHLVRLVPLAASQSFIGINYGEVADNLPPPSSTARLVQSTTITKVRLYGTDPAIVSAFAGTGISLLLGATNGDIANLASSPAAAASWVAANLPAKSPAVSTVSVGNEVLFADASLASQLVPAMQNLYDALPPNSSVKVSTVNAMDVLASSDPPSSGSFKPELATALDPLLAFLSKTGSPFLINPYPYFAYLSDP

SEQ ID NO: 39536 - protein, 216 aa, Sorghum bicolor
  Clone ID: SORBI-28MAY03-C23431_1.pep
MATAARALVAARPARPLLPSRRLPSSSSIRPPRQRGGGVGSVRCMARRPDSSYSPLRSGQGGDRAPTEMAPLFPGCDYEHWLIVMDKPGGEGATKQQMIDCYIQTLAQVVGSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 39537 - protein, 189 aa, Sorghum bicolor
  Clone ID: SORBI-28MAY03-C23462_1.pep
AGGIGVPQDASVLRTSVSSVGGWWHEAYGCRLYPPGGFSNFLHSYPFANHPNGNENFHFVGAGMSQSTVPPIERGATRTPSPAQQPHDTVDDIVDDLDAQEDETINVDDDCRTEKRLNWKVPDDIRLAFAWLRCSKDPVDGNDKKTDAYFLVQSYTADGISYIRLVILLRCRGGSHGSIPQLISFVCVA

SEQ ID NO: 39538 - protein, 149 aa, Sorghum bicolor
  Clone ID: SORBI-28MAY03-C2334_1.pep
KRARRVTKMSNRVANSILSGVLKVTGFVTSTVLNSKPAQKFFKLMPGEVILASLDGFGKVWDAVEVSGKNVMQTSSVVTTSVVTHRYGEQAGEATHNYLHATGNALGAAWAVFKIRKALDPKGNLKKSSFVSQAAHTVAKESIARQKKK

SEQ ID NO: 39539 - protein, 135 aa, Sorghum bicolor
  Clone ID: SORBI-28MAY03-C1766_1.pep
DGSLPVGPCRWRLTDRAPDRNCGEFSCLPKAHSWSHSLPSVSLLVQVIVASVIAHRTEFLFLSRTGTRTYFVQPGWALNGHQHVELRRRGKPPIPRKRVCVRLELEVTSHVFSFHSPAQHLTKRTLHCILLYYLC

SEQ ID NO: 39540 - protein, 160 aa, Sorghum bicolor
  Clone ID: SORBI-28MAY03-C17789_1.pep
MVGSDALQSIVYARGSLRLLDQRKLPLDMDYIDVKNSVDGWNAIRDMVVRGAPAIAIAAALALAVEVSDLDFIGTPGEAASFVSKKLEYLVSSRPTAVNLSDAATKLQTLVSKAAETAKDSKAIFQAYIEAAETMLVDDVADNKAIGSHGAEFLQRQLAN

SEQ ID NO: 39541 - protein, 277 aa, Sorghum bicolor
  Clone ID: SORBI-28MAY03-C17908_1.pep
MEFWGKEVKPGATVSCEVGKAGVIHLSQAALGEPKKASENVIVSVKIDDKKLVLGTLSVEKHPQISCDLVFDKDFELSHNSKTASVFFCGYKSPVPQFESYSGEDSSDEELETDHQIPRNEISAAKVPVKGGIKVESSSSDDDDDDFTDSEMSDEDDSSDEDDVSTGDDSSDDSGSEEQTPTPKKTDVVVGKKRAIQAEAPSGKKAKSEQSAQKTGDKKVSTHSAKQSSKTPDKSTKTPTADKKSPKSGSHACKSCNKSFSSATGLESHQKAKKHEA

SEQ ID NO: 39542 - protein, 263 aa, Sorghum bicolor
  Clone ID: SORBI-28MAY03-C17886_1.pep
MATTTTANRLGLLLLFAVVATTAAPAVAAGPAAAAAATPPSPLFRRVYAFGDSFTDTGNTHSTTGPYSFGHVSSPPYGATFFHRSTNRYSDGRLVVDFLAETLALPTYLPPYLVTSNSSGNTTAVGVNFAVAGATAIEHDFFARNNLSIDVTPQSIMTQLDWFDAHLRSASAGTGERTAVADALFWVGEIGANDYAYTVIARDTVPPKLVRTMAVQRVTAFVEGLLQRGAKYVIVQGLPLTGCLPLAMTLARADDRDAVGCAA

SEQ ID NO: 39543 - protein, 141 aa, Sorghum bicolor
  Clone ID: SORBI-28MAY03-C1796_1.pep
SRTRRVGLEGLGRSKEGKAGVGALIRSSTSSESLRPIFRGKKKALAAGQRRRHGAPFVGPPWAWWSRRQARARVMSTGCPGLCHALPGTEEGRRRVLPGLSSPVDVDGGGGDFVSVVVLVEAQTAASMELRGSELHARSPS

SEQ ID NO: 39544 - protein, 245 aa, Sorghum bicolor
  Clone ID: SORBI-28MAY03-C18028_1.pep
MTTTTGPRNGECIPRRPPPPSRTPNSPRPSVSPEPQDNATNKTQRASERGEGSSARGAARQPGPGEREAQLAWSREAAEGAREQPGMEEPVPADPPRIFWKSRRSANGRSLQQEPDKDATEETNEQAQEEPMKTDDATDTTATAEDVQPDPKANLSEKRKALFEPLEPINGKRSAEMLLPPPDFEPASYPKGWLVGKKRKLVNVDVVESMRRIAIQEMNRKVYKISSGLMLHTYMISMRHAMLFF

SEQ ID NO: 39545 - protein, 137 aa, Sorghum bicolor
  Clone ID: SORBI-28MAY03-C22231_1.pep
AAAGDIGAARRPPELKRSSHQDQEELLDRLKEKHRSIDPPTARSVVGQQSWYWASLGGCCGGVAAVSPAAGGKQSGGDPEAKQRQKRGAGEGKMNKGGEQGAAAGGKDKERRKRRDDSKAPPIVVHQFPFHSRPGLL

SEQ ID NO: 39546 - protein, 201 aa, Sorghum bicolor
  Clone ID: SORBI-28MAY03-C22547_1.pep
REHKYTFRDSPVRKSHLGVRRITSSLTERYRNDLQEARKISYEGHLDLVLTVTTILPPTGAQPTTWLLATLRRWRWGFSCNKPLAAHESQTSWLSSDVEAAIPIPKRNTVIMGSDVGAKATVEEEEEEEEEEEEEEEATPRDVWISLRRRGSTSRRRRESGRDKCACRPEGSETAGRVGGPRGGGGRGGGAGRGGWARVPA

SEQ ID NO: 39547 - protein, 144 aa, Sorghum bicolor
  Clone ID: SORBI-28MAY03-C2237_1.pep
RAVNNSFTIECGDVTDASFQEYRLSRGSIAGILTLDTVADYLPRRGPLKQRRTGIAYIANVAVRKEERRKGIAKMLVQEAEARARSWGCRSMALHCDVNNIAALRLYKNQGFKCIRVPEGAKWPEPKIAKGVQYNFMMKLVPKA

SEQ ID NO: 39548 - protein, 236 aa, Sorghum bicolor
  Clone ID: SORBI-28MAY03-C22789_1.pep
MASDAAAEPSSGVTQPPRYAIGYALAPKKQQSFIQPSLVAQAAARGMDLVPVDASRPLAEQGPFHLLIHKLYGDDWRAQLVAFAARHPAVPVVDPPHAIDRLHNRISMLQVVSELDHAADQDSTFGIPSQVVVYDAAALADSGLLAALRFPLIAKPLVADGTAKSHKMSLVYHHEGLAKLRPPLVLQEFVNHGGVIFKVYVVGGHVTCVKRRSLPDVSPEDDASAQGSVSFSQVST

SEQ ID NO: 39549 - protein, 140 aa, Sorghum bicolor
  unsure (1)..(140): unsure at all Xaa locations
  Clone ID: SORBI-28MAY03-C2263_1.pep
NXGPGRAYFYWVTREQGSXEWFKGVMNEVAESDHSNVIEMHNYLTSVYEEGDARSALMRPVQSLQHAKNGVDIVSGSKIRTHFARPNWRKVFSDLANAHRNSRIGVFYCGSPTLTKQLKDLSKEFSQTTTTRFHFHKENF

SEQ ID NO: 39550 - protein, 262 aa, Sorghum bicolor
  Clone ID: SORBI-28MAY03-C2270_1.pep
MEQGKRAKVLCLHGFRTSGSFLKKQISKWHPSIFQQFEMVFPDGIFPAGGKSEIEGIFPPPYFEWFQFNKEFTEYTNLDECISYLCDYMVKNGPFDGLLGFSQGATLSALLIGYQAQGKVLSDHPPIKFMVSISGSKFRDPSICDVAYKDPIKVKSVHFIGEKDWLKVPSEELASAFDEPLIIRHPQGHTVPRLDDVSVKQLSEWSSCILEDPKNANVPEALDSGKPSDKEATGAEFEALHSGKPSDKEATGAELAENLVKA

SEQ ID NO: 39551 - protein, 223 aa, Sorghum bicolor
  unsure (1)..(223): unsure at all Xaa locations
  Clone ID: SORBI-28MAY03-C229_1.pep
IXXYXPGRIXFFLVNCHLTPRPILLTRHGECVVIVRGRIXXETGGGGDCCFLYSRKLASFVEKRLKSERTASIWTSTLQRTILTAHPIIGFPKIQWRALDEINAGVCDGMTYDEIKKSKPEEYESRRKDKLRYRYPRGESYLDVIQRLEPVIIELERQRAPVVVIAHQAVLRALYAYFADKPLEEVPNIEIPLHTIIEIQMGVAGVQEKRYKLMDAIHPTAGL

SEQ ID NO: 39552 - protein, 201 aa, Sorghum bicolor
  Clone ID: SORBI-28MAY03-C23029_1.pep
MASGGAAISAGPTPPSATATAVEWHQRPPNPKNPVVFFDVTIGSIPAGRIKMELLADIAPKTAENFRQFCTGEHRKNALPQGYKGCQFHRVIKDFMIQGGDFLKNDGTGCTSIYGTKFDDENFIAKHTGPGLLSMANSGINSNGSQFFITCAKCDWLDNKHVVFGRVLGDGLLVVRKIENVATGANNKPKLACIISECGEM

SEQ ID NO: 39553 - protein, 209 aa, Sorghum bicolor
  Clone ID: SORBI-28MAY03-C23344_1.pep
MATHFVLNTGAKIPSVGLGTWQSDNGLVGDAVYAAVKAGYRHIDCAQAYNNEKEVGFGLKKVLDEGIVKREDLFITSKLWNTNHAPEDVPVALDGTLKNLQTDYVDLYLIHWPVRMKKDAGFGPQSVVPSDIPATWAAMEKLYDAGKARAIGVSNFSSKKLADLLAVARVPPAVDQVECHPVWQQGKLRAFCVGNGIHLSAYSPLGVAG

SEQ ID NO: 39554 - protein, 223 aa, Sorghum bicolor
  Clone ID: SORBI-28MAY03-C23040_1.pep
MGRSRTRGGKAASGAVAGDSGLKAGLSISFLLYSSVSFDFREGVVRVRWCAMGICRLEASASESGDSGLKRKQAKVKEEEDRKILMLKSEEGKILKLKKEAMAANEEMSEATREELSLYMPVVRAAEPSGKKTKKVLVRKLVPMEEIYCLLAMPCPIKANHLTEEQLAEHPKRFQDWYHEEMNIAKKLRDYHQALIDQYSEYGYAVDESETEVTDDEDEDGDN

SEQ ID NO: 39555 - protein, 141 aa, Sorghum bicolor
  Clone ID: SORBI-28MAY03-C21377_1.pep
TGLGLPYTPILSASNSSLLGSVGNSGLPPLCSSLCSCPLWDDCSPCYSFFFFFFSSPSHTSTALPFSFTLPPSTFQCSDISPVRARRQRRSQWTYRHLKQGGAAAAAGRLRTREREYAGGARERARDGKRERRRDANGTRA

SEQ ID NO: 39556 - protein, 198 aa, Sorghum bicolor
  Clone ID: SORBI-28MAY03-C21562_1.pep
GFGDYFVGPGLEQLIEQLAENDPNRYGTPPAAKSALSSLPDVVVTHTMVAAAEGAECAVCKEDFSPGEVAKQMPCKHIYHTDCIVPWLELHNSCPICRFELPTDDPDYEGRKGSNPPQPAVGIAAAAAASGSSTAADGQMEERQDNPRVVERRFNVSLPWPFSGLSGQTSQQDGNNGGSGSNSQGSGSQDGGPPSSKN

SEQ ID NO: 39557 - protein, 193 aa, Sorghum bicolor
  Clone ID: SORBI-28MAY03-C21591_1.pep
MAAPLARRAGRSAAAALWGAARGFASVGSDIVSAAPGVSLQKARSWDEGVATKFATTPLKDIFYGKKVVIFGLPGAYTGVCSQAHVPSYKKNIDKLKAKGIDSVICVAVNDPYVLNGWAEKLEAKDAIEFYGDFDGSFHKSLDLEIDLSAALLGRRSHRWSAFVDNGKIKSFNVEEVPSDFKVSSAEVILDQI

SEQ ID NO: 39558 - protein, 122 aa, Sorghum bicolor
  Clone ID: SORBI-28MAY03-C21642_1.pep
GDVAVSYRSCQLLCMCYMNPGTRFAAEICSVFLLPVVTLQLFPRQQAGKLATSKGAAQTNNSKCDHPLIHLANKPARRPSIFLISDVPFGNAATHRSSRDGDEEGRLRRPCRCRLGHRGSRR

SEQ ID NO: 39559 - protein, 306 aa, Sorghum bicolor
  Clone ID: SORBI-28MAY03-C21674_1.pep
MIAMILEVTQQLCQDRLLTLSTNNLPPIHHLLVFLLITVVTVKYLIRHPRRVYLVEYTCFGPDSKYRVAPASMIEYFHLANLLDDDNISFLSNIYRRSGLGDETCLPSSYHYIPFIPSLSMARMEAELVIFTVIDDLFAKASIEPSKIDILIVNCSAMTMVPSMTDMIINRYKLRRDIQNMQLSGMGCSAGLIAVGLASNLLQIMPYGANALVVSTENVTCNYYVGKKRSMQLTNILFRMGGAAVLLSNSSANARFQLLHTVRKSTAAQDNAYHCVFHEEDDEGNLGLNLSKNLVAVPGEALKANI

SEQ ID NO: 39560 - protein, 172 aa, Sorghum bicolor
  unsure (1)..(172): unsure at all Xaa locations
  Clone ID: SORBI-28MAY03-C21782_1.pep
MQSLQDKASEWSGVAAADAFAIDDVNLFESLGGTPQPFVDLSTNFYTRVFEDEEEWFREIFAGSKKEDAIQNQYEFLIQRMGGPPLFSQRRGHPALIGRHRPFLVTHRAAERWLHHMQQALDTTESIDVDSKTKMMNFFRHTAYFLVAGNEMTGQHGHGSXPSNHATSKPAE

SEQ ID NO: 39561 - protein, 109 aa, Sorghum bicolor
  Clone ID: SORBI-28MAY03-C21721_1.pep
MAEAEGKAKQMAEGPSKIESMRKWVVDHKLRAVGCLWLGGISSSIAYNWSRPNMKTSVKIIHARLHAQGLTLAALVGSACVEYYDNKYGSSGPKVDKYTSQYLAHAHKD

SEQ ID NO: 39562 - protein, 164 aa, Sorghum bicolor
  Clone ID: SORBI-28MAY03-C21979_1.pep
MANLQSQPSLASTLPTNLPVTFMKEITSDFSVERILGQSVFGKVYQGVLPEGGRMIAVKRLAENAPVPSGITFETEVTNLMALKHQNIVELVHYCHESQKKVVQHNGRYVIVDVIESCLCYRYLPKGSLDNYLLYADTATSINWDIRFKIVKGICQGLHFLHKN

SEQ ID NO: 39563 - protein, 206 aa, Sorghum bicolor
  Clone ID: SORBI-28MAY03-C22071_1.pep
MGSPTRPRRTTGFALLLVLLFLSPLASAGQPKGVCVSPGGRFPAFSSEGKPPGRAPKGRRDLALCRIFRQNTCCDVTQTFPALVSVRNLALTGEGSQECIHLWELLECSICDPRVGVRPGPPVVCASFCDMVFKACSESYFSVDMKTQALSPCGLGDILCGKAHKWVSNGTELCRLAGFSVQVSETALMELMTLSAMVGKASWIHL

SEQ ID NO: 39564 - protein, 212 aa, Sorghum bicolor
  Clone ID: SORBI-28MAY03-C22113_1.pep
GKKKLIIIKGGCANAFIAAWMHFLVVCTTYNHKSSLYTFMKLITYRNNNTTLPHFFMSTTTKAPACRGSYMQERTQLCAKITRTSPHQCSPHFIGQANQDCQRMHTAMQRILTLGSAASCRCRSSVSWQALPTGCLQCRVLKNFLLDLNARPIQRNASTAEMGVDPFGRASWHLWVRGLGLAAQGWLVREVQLGLNWRGTQCCSLPDLVFSS

SEQ ID NO: 39565 - protein, 126 aa, Sorghum bicolor
  Clone ID: SORBI-28MAY03-C22155_1.pep
MSRGGSSGGGRSSLSYLFEPEETILYRTHTTAKSNLETKKSPDTNSSSVKDDNKAIGAEAVHSPPKREVSNPILSSHKPPCNIYHTSQLSHNNSGLLITDRPSTRVRCAPGGASSLGFLFGEEHEK

SEQ ID NO: 39566 - protein, 183 aa, Sorghum bicolor
  Clone ID: SORBI-28MAY03-C20779_1.pep
MIDLRPLLAFPSLSQPVKMLIPKADRKKIHEYLFRGGVLVAKKDFNLPKHGEIDTKNLYVVKACQSLTSRGYLKTRFSWQWYYYTLTPEGLDYLREWLHLPAEIVPQTHIKQQRSAPPRGMLGGDDRERRGGGRGGRGGDRGGDRDGYRRRDAGEKAEGGAPGEFKPEFRGGFGRGRGAAPAS

SEQ ID NO: 39567 - protein, 337 aa, Sorghum bicolor
  unsure (1)..(337): unsure at all Xaa locations
  Clone ID: SORBI-28MAY03-C2081_1.pep
HEDPNAPRFVLWEGKVRPVPSKPADLPFFDLMSIPGKLRAGLGALGIRPPPPGREESVEEFVRRNLGAEVFGPRIEPFCSGVYAGDPSKLSMKAAFGKVWRLEEAGGSIIGGTIKTIQERGKNPKPPRDPRLPKPKGQTVASFRKGLAMLPNAITSSLRGAVXYHRYSRAVLXSSGKGYVLEYDTPEGVVLVQAKSVIMTIPSYVASDILRPLSGDAADALSRFYYPPVAAVTVSYPKEAIRKECLIDGELQGFGQLHPRSQGVETLGTIYSSSLFPNRAPAGRVLLLNYIGGATNTGIVSKTESELVEAVDRDLRKMLINSTAVDPLVLGVRVWAQ

SEQ ID NO: 39568 - protein, 188 aa, Sorghum bicolor
  Clone ID: SORBI-28MAY03-C20858_1.pep
MVDAGDTPAGAPPRAHEEEQAGTPAYGSVVLGGTFDRLHDGHRRLLKASADLARDRIVVGVCTGPMLAKKEYAELIEPVDKRIKGVEDYIKSIKPELIVQVEPIEDPYGPSTTDEKLDAIIVSKETLNGGLAVNRKREEKGFPLLKVEVVDLLSGGVEGGKLSSSALSKLEAEQAQQSETKTASLEVS

SEQ ID NO: 39569 - protein, 268 aa, Sorghum bicolor
  Clone ID: SORBI-28MAY03-C20871_1.pep
MSFDESKALAQALQEKMEALMLFSQEQERYLLEKQRDLIVIEELQKNLSQVKDEKVKVLMELAKLKEQYLLLKGSAVKEGHDTGDSSKVIPGHDQQGMLKTMLKRTSLRHWMRKESSTIGHGSSDGNDHTVCKEHSVDVARLRVENSTLLEGVGTVERLTSSVHRLHIVLLKAYDDIKSADSLESTFEALNSLITEANVMKTALNVVLPVSWSGDSSDAITYEALCEPSDSPKSKSGKVDPLSSAGMEMVELLILAAEILKESFLVKK

SEQ ID NO: 39570 - protein, 175 aa, Sorghum bicolor
  Clone ID: SORBI-28MAY03-C2098_1.pep
MPAMVEEEVVRGAAAAPEPEPHFLVVTFPAMGHINPARHLARRLLRATGARVTVSTSVFALRKMFPGAAAETEPEGHRDASGVWYVPYSDGYDDGFDKAVHDATHYMDQIKLEGSRTLGNVLDRLRDAGRPVTLVVYTLLLSWVADVARAHAVPAALYWIQPATVLAAYLHFFRA

SEQ ID NO: 39571 - protein, 142 aa, Sorghum bicolor
  Clone ID: SORBI-28MAY03-C210_1.pep
MQTVRGVVLQHLRLRAAPAIAARGGSGRPALYGFARGMSAPAGQEDSKGSSSPDPERDIRTRVVNLVKKFDKIDADKVTETADFQKDLSLDSLDRVELVMAFEQEFSIEIPDDKADKLTCCADVAKYIISESQISDKSAGGS

SEQ ID NO: 39572 - protein, 345 aa, Sorghum bicolor
  Clone ID: SORBI-28MAY03-C2114_1.pep
LGQAMVDFSGMVDDEFLQRLSIEKGTRKVINHEERGRVLRAMDGCSYKAAAGGSLPNSLVALARLGSSQSAGYPELKIAMAGSVGSDPLGSFYRAKLRRANVHFLSKPVKDGTTGTVIVLTTPDAQRTMLAYQGTSSTLSYDSDLASLVSKSNVLIASGYLFELPHTIEAIRQACEDAHKNGALIAVTASDVSCIKRCYNDFRDIVGNYADILFANANEARAFCELPSTESPMSATRYLSHSVPLVSVTDGMHGSYIGVKGEAIYIPPPSCIPVDTCGAGDAYASGILYGILRGASDLKGIGLLASRVAAVVVGQQGTRLRVQDADRLAESFAHHLDSLEFCSDV

SEQ ID NO: 39573 - protein, 227 aa, Sorghum bicolor
  Clone ID: SORBI-28MAY03-C21191_1.pep
RSISIQRSFEAFFLKAYVLADSGVDPSYSATVISLLEDALKCPSDRLRKGQALNNLGGVYVDCGKLDSAADCYTSALKIRHTRAHQGLARVHFLRNNREAAYEEMTKLIEKAKNNASAYEKRSEYCEREQTMTDLQTVTQLDPLRVYPYRYRAAVLMDSHKENDAIAELSRAISFKADLHLLHLRAAFHEHIGDVPSALRDCRAALSLDPNHQEMLELQKRVNSQEP

SEQ ID NO: 39574 - protein, 182 aa, Sorghum bicolor
  Clone ID: SORBI-28MAY03-C21227_1.pep
RHSVERLDQADVYSPGAGRITRLTSHKFPILNLIQMSAVRVDLYQDAILSPFWNFNAHSAMYTIRGCARVQVASDNGTTVFDGVLRAGQLLIIPQGYLVATKAQGEGFQYISFETNQNSMVSHIAGKNSLLSDLPVGVIASSYGVSMEEAAELKNSRKHELAVFTTPPGGSYDQGHVGSAQQ

SEQ ID NO: 39575 - protein, 97 aa, Sorghum bicolor
  Clone ID: SORBI-28MAY03-C2137_1.pep
MASRSFLIRSPKEEESNAAVREAVLLGAKNGAIAGTVVAVPTLVGCRVLPWAKANLNYTAQALIISAACISGFFITADKTILRNARQNTIGKLDKST

SEQ ID NO: 39576 - protein, 122 aa, Sorghum bicolor
  Clone ID: SORBI-28MAY03-C19862_1.pep
GLLLLVLWRLSSMAASNSEAMAGKWSRGPMKATSSASSSTASGRRECPFCHVALVHIRSKKPATRGFCSSSCICRFYRCDDWCGCCWYLEVIRLYQVILGSNVLCVLNVPRIELNECMVLIE

SEQ ID NO: 39577 - protein, 282 aa, Sorghum bicolor
  Clone ID: SORBI-28MAY03-C19906_1.pep
MPPASSLSADQLSFFEANGYLVMDSFSSAEEVREMRDRMAELVAGFDGANSAVFSTKDHRQLKDDYFFKSAENISFFFEEKAFGDDGCLKQPKELSINKVGHALHELDPVFKKFSFSESVASLFSSLGYKRPAVIQSMYIFKQPGIGGEVVPHQDNTFLYTEPRTCTGLWLALEDATMNNGCLWAIPGSHKKGLVRRMIRDENGTHFDRPSPAYDQKEFVPLEVKSGDLVVIHGDLIHQSFENLSPASRHALSLHVVDTEGCEWSKDNWIQRKTAPEPLYVS

SEQ ID NO: 39578 - protein, 134 aa, Sorghum bicolor
  unsure (1)..(134): unsure at all Xaa locations
  Clone ID: SORBI-28MAY03-C1994_1.pep
MADHKEEPVLESVMDKITEKFHGGDSTSSSDSDDEKKKKGSSSASAAEAVKAKMYRLFGRERPVHSVLGGGKPADLVLWRNKKISGGVLAGATAIWLLFEVMEYHLLTLLCHCLILSLAILXLWSNAXTFINKS

SEQ ID NO: 39579 - protein, 96 aa, Sorghum bicolor
  Clone ID: SORBI-28MAY03-C19956_1.pep
MRGIFKETIASTSRMCTPGQSGTCSPVMGGVPIHHDVQMVDGAPDDFAFGSSSNGNNESPGLVKAWEGERIHEECASDEHELELTLGSSKTRADPS

SEQ ID NO: 39580 - protein, 119 aa, Sorghum bicolor
  Clone ID: SORBI-28MAY03-C20074_1.pep
SGLLLVSGPFKINGVPIRRVNRTYVIATSTKVDISGVDVAKFDDKYFAREKKQKAKKTEGELFETEKETSKSLPDFKKDDQKAVDAALIKAIEAVPELKTYLGARFSLRDGDKPHEMVF

SEQ ID NO: 39581 - protein, 170 aa, Sorghum bicolor
  Clone ID: SORBI-28MAY03-C20151_1.pep
VAEDENKLEEVPQSEAEKGKEGEPTEAEEPEDKEMTLEEYEKVLEEKRKALLGLKPEERKVEVDKELQSMQQLSVKKGADEIFIKLGSDKDKKKENTERDERAKKSVSINEFLKPAEGERYYSPGGRGRGRGRGRGDRGGFRGGYSPREVAAAPAPAIQDQAQFPSLGGK

SEQ ID NO: 39582 - protein, 121 aa, Sorghum bicolor
  Clone ID: SORBI-28MAY03-C20562_1.pep
MTGKAKPKKHTAKEIAAKIDAATTNRGGGKAGQADRLGQDKGGHAKLACPLCRTPAPDIKSMQIHHEARHPKLPFEPEKLLNLHSSAPAAAAAAAAAEATTSKPKPGVRGSLQKQLAVLPA

SEQ ID NO: 39583 - protein, 87 aa, Sorghum bicolor
  Clone ID: SORBI-28MAY03-C20039_1.pep
MQASDRFNINSQLEHLQAKYVGTGHADLSRFEWAVNIQRDSYASYIGHYPMLAYFAIAENESIGRERYNFMQKMLLPCGLPPERDED

SEQ ID NO: 39584 - protein, 87 aa, Sorghum bicolor; identical to SEQ ID NO: 39583
  Clone ID: LIB5048-011-R1-XP1-A11.pep

SEQ ID NO: 39585 - protein, 117 aa, Sorghum bicolor
  Clone ID: SORBI-28MAY03-C20597_1.pep
PAGSGISLPPHHRRVPFPVFPPSPAAPQKSPPAHRLIISRHTAGERDDSGGDRGGAAGGVHGAGGAGAGAAAPRRALPAPHALPHAPEPPLRRAAAPAAAATARAPRRHPRLTEPAP

SEQ ID NO: 39586 - protein, 48 aa, Sorghum bicolor
  Clone ID: SORBI-28MAY03-C19529_1.pep
RGCKNKTDIVQVHIPYACKLLFQELMAMAIAPRMLTHDMKTGKDQKKR

SEQ ID NO: 39587 - protein, 185 aa, Sorghum bicolor
  Clone ID: SORBI-28MAY03-C1955_1.pep
QKLSTKQPSLESRQLVLQEIAAEKGITVRIYEPPCDDSGRSNHNHRKTKHGDERISRTAPVDDRDEDISGDSAQRYKDVEAAAQAAFESAASAAAAAKAAMELSRGEPRGPGDRRRMQMDPEIEKQDGPLDGRRSEKIGLDRNCSSEVEIVPEDEANHGNVAVNELKQQEPAKGKPASVRTKWGF

SEQ ID NO: 39588 - protein, 175 aa, Sorghum bicolor
  unsure (1)..(175): unsure at all Xaa locations
  Clone ID: SORBI-28MAY03-C19288_1.pep
MTTGSTPGSPPSQGSQRKRGSTKDSVGLYAVQCYKCYKWSTVPKXRENFTKDPWFCSRRPDCSCADDADIEYDSSRIWVLDNPNIPKPPPGTERLVILRSDYSKMDTYYVMPNGKRARCAGDVDKFLEANPEYKNSISASDFSFAPPKVVEETVSHNSAWKAAKAKKQKARHKSD

SEQ ID NO: 39589 - protein, 125 aa, Sorghum bicolor
  Clone ID: SORBI-28MAY03-C19650_1.pep
PARPPGPPVPSSKKKKKITAKNTNTSRVRKAPPPPPPPRPPPPSPSPASAAASRSSLLSCLPAWGNSLRFQSHPSTRSIINQTTDLWTLVRWPLPQSACGVLLVYCCFSLLYCWYMCYVIYVSTI

SEQ ID NO: 39590 - protein, 170 aa, Sorghum bicolor
  Clone ID: SORBI-28MAY03-C19562_1.pep
MDEIMNKVGAYWLGQRANKEISSASDDLESLSTSVGDGAKWLVNKLKGKMQKPLAELLKEHGLPVGLFPREATNYELSPETRRLTVYIPSPCEVGYRDGSELRFDATVSGTLGEGRLTEVEGIKTKVLVWARVTAVKADAAKVHFTAGIKRSRSREAYEVVRGGITVDEF

SEQ ID NO: 39591 - protein, 76 aa, Sorghum bicolor
  Clone ID: SORBI-28MAY03-C19657_1.pep
ERKHKSSNSKKKEGRRTTFDSGDEYSKDETSNGHDAEQGNWSAFQNFLLRAEERTRSSETELEQAIHEEESWHELT

SEQ ID NO: 39592 - protein, 74 aa, Sorghum bicolor
  Clone ID: SORBI-28MAY03-C19680_1.pep
VFYYEILNSPDRACSLAKQAFDEAISELDTLGEESYKDSTLIMQLLRDNLTLWTSDMQEDGSDEMRDASKPDDE

SEQ ID NO: 39593 - protein, 110 aa, Sorghum bicolor
  Clone ID: SORBI-28MAY03-C19728_1.pep
MSASSAPVDASGEPIPTSSVLMAASKHIAVRCRPENVAFLNCKKKDPNPEKCLEKGRQVTRCVLSLLKELHQKCPKEMDEYAGCMYYYTNEFDFCRKEQQAFEEACPISE

SEQ ID NO: 39594 - protein, 145 aa, Sorghum bicolor
  Clone ID: SORBI-28MAY03-C19809_1.pep
MVLLFKLFTATPNKSTALPTFIRFLQGVLAIGIIAGIVLLIVLTSFTIADLFASALAFIATGWCILCLAVTWKKVVKTLRLWDSVREIARMYDAGMGAIIFVPIVFFSWFPFVSTFQSRFLFNQAFSRGLEISLILAGNKANQQT

SEQ ID NO: 39595 - protein, 186 aa, Sorghum bicolor
  Clone ID: SORBI-28MAY03-C19825_1.pep
MGGQMPDADEKARSADTSSSSYGYPPSAPPQHQHQYGTFGPPSGASGQFPQPAVGFPQPAPPPGMQHYPQQPPASYAVYPPPQQPYAAAAPYYAQGYQVAQGYIPVVEGRPVRMRPLPCCGLGMGWFLFILGFFFAAIPWYIGAFVLICVRVHDYREKPGYVACTIAASLAAIAVLLGATKGAEVW

SEQ ID NO: 39596 - protein, 183 aa, Sorghum bicolor
  Clone ID: SORBI-28MAY03-C18865_1.pep
MSRSLSMRGSMRSRRDLPPPEKTIERLESMVDGGNFYEAQQMYKSTSARYITAQKYSEALDILQSGALVQLKHGQVTCGGELAVLFVETLITGEFPYGEQIFDRIRKMYEAFPRITVPHFLGDDYDDEGHQLSEAISAAKVRAESCSSFLKAAIRWSAEFGTSRNGSPELHVMLAEYIYSESP

SEQ ID NO: 39597 - protein, 211 aa, Sorghum bicolor
  Clone ID: SORBI-28MAY03-C1895_1.pep
TREVASDLLDRQGPIYREDTAVPRVRSGETADTLMALDYALENGALCVGITNTVGSTLSRKTHCGVHINAGCEIGVASTKAYTSQIVAMAMMALAIGSDQISTQARRETIISGLTNLSSNVSEVLKLDVEMKELASSLIDSESLLVFGRGYNYATALEGALKVKEVALMHSEGMLAGEMKHGPLALVDENLTIIVIATRDACFRKQESVIQ

SEQ ID NO: 39598 - protein, 136 aa, Sorghum bicolor
  Clone ID: SORBI-28MAY03-C18887_1.pep
MRNVYLTSAIFLIIMIIYSTTPSCQGQDQLDDWHYHHSSPPPPPTGSTLPRSLSEMSHHHHHHGSPPPMPPSPPRSLIQTLHHHHHRSPPPPSVPSSPPRHLFETLHHHHHKSPPPPPVTSLPSRPHVPSSPPHLV

SEQ ID NO: 39599 - protein, 125 aa, Sorghum bicolor
  Clone ID: SORBI-28MAY03-C18965_1.pep
HGSRPTNNLRYRTGRLVPSGEVVVVEVGAVEAVEEPGEEEGPAGLATAATAARAVRSQEHLPVPVLLVEESGPRGAERRVVDVHERRDGVFLHGLVRTVDEGGGGGGGVARVLAVVRGRVSRPAA

SEQ ID NO: 39600 - protein, 230 aa, Sorghum bicolor
  Clone ID: SORBI-28MAY03-C18968_1.pep
MAVPRGCLLRLLAVAVFLAFLCCRGEAAVRELKVGYYAETCPEAEDIVRETMARARAREARSVASVMRLQFHDCFVNGCDGSVLMDATPTMPGEKEALSNIDSLRSFEVVDEIKEALEERCPGVVSCADIVIMAARDAVVLTGGPNWEVRLGRDDSLTASQEDSDNIMPSPRANASSLIRLFAGLNLSVTDLVALSGSHSIGEARCFSIVFRLYNQSGSGRPDPTWTPPT

SEQ ID NO: 39601 - protein, 211 aa, Sorghum bicolor
  Clone ID: SORBI-28MAY03-C18995_1.pep
MASGGASLALAALLLVSCTSAAAATKYTVGDASGWTTTGDYATWASGKKFKVGDTLEFKYAGGAHTVDEVSAADYAACSSSKALSSDSAGSTTVTLKTAGKHYFICGVAGHCSSGMKLVVDVAKAVSAAPAPAPAEAPAPAASADTTPDAPDATPSTPSSSGVTPKTKSPVTDLSPPGKKSTSTSGATGLSAAAWAGLGLAGLVALHLGAF

SEQ ID NO: 39602 - protein, 178 aa, Sorghum bicolor
  unsure (1)..(178): unsure at all Xaa locations
  Clone ID: SORBI-28MAY03-C1900_1.pep
THLRNGGGSESSKCAQICKVXEDAYKSEFSIIMVEEVERLLEYVAIGPRFSNLISQTLLVLLKRVPPKGKNLLVIGTTSEVGFLESVGMCDVFSVTYHVPKLKKEDAKKVLHRLDVFDDGDLDAAAEALDDMPIKKLYTRGGMAAQGPTGGSAEAIYTGEDKIDINHFFSILSDIIRY

SEQ ID NO: 39603 - protein, 160 aa, Sorghum bicolor
  Clone ID: SORBI-28MAY03-C19042_1.pep
MQIFVKTLTGKTITLEVESSDTIDNVKSKIQDKEGIPPDQQRLIFAGKQLEDGRTLSDYNIQKESTLHLVLRLRGGMAKKRKKKNYTTPKKIKHKRKKVKMAILKYYKVGSDGKIQRLRRECPAPTCGAGVFMAWHKDRQACGKCGLTYTFEPGTKPTAA

SEQ ID NO: 39604 - protein, 103 aa, Sorghum bicolor
  Clone ID: SORBI-28MAY03-C19123_1.pep
PADVIGLDWTVDMSDGRRRLGNGISVQGNVDPAFLFSPLPVLTDEIHRVVKSAGPKGHILNLGHGVLQKTPEEAVAHFFDVTRSLRYDTLFQGSVAEELQPVA

SEQ ID NO: 39605 - protein, 137 aa, Sorghum bicolor
  Clone ID: SORBI-28MAY03-C19129_1.pep
WRSSPWRWPCSSAPAARRRRKRQAAAAPARSRASCLSCACSRRSTGRTPCPRCSSSWPGTARRRSSPAPRRLPPASLLTPPPTGPPSRRSSTAAAARTARTPPSPPCSSLSLPLGAPRSTCRPCARDRSNESARAWT

SEQ ID NO: 39606 - protein, 161 aa, Sorghum bicolor
  Clone ID: SORBI-28MAY03-C19250_1.pep
MAEKVSTLVVTLNHGCCRCFTKIRKTVCKLQETEDIRVISYDEVSGTVTISGAFDPLVLPCKLRRKAGCVIRDIQLVAAELRLTPQPPPRPAQRPAMLLPNPSCSCCCGICWCRNYGCCYCGCQPCACFVNHPPCYGLPLGQYPKMVVACEEVSSPACMIM

SEQ ID NO: 39607 - protein, 199 aa, Sorghum bicolor
  Clone ID: SORBI-28MAY03-C19194_1.pep
TRQPAGDAGPNYWLIRHDSFLKKKLPIYQRSEMARLHHLSLVPATSLLLLLLLPVVLAAASAAAEEPQIRISVQYPTEEEARWLDRWSEKYQAQGAASGFSVHPATDEESAYLNSIFDNGKKRAASGDHSHGGGGGGGGAPAGFDGHIEFDDDDHPFGRIVVDTVHSRASSSETNDGDLQNHHEPHSHAEYNADDVKDL

SEQ ID NO: 39608 - protein, 343 aa, Sorghum bicolor
  Clone ID: SORBI-28MAY03-C2446_1.pep
AERLAASAATLRASAAAAATPSARRAARASRAFFPPSPASSARARVGLRAAPSPLPQKARAVRCAAVAAASDVAQVKAAREDIRELLRTTHCHPILVRLGWHDAGTSSENIEEWPQRGGANGSLRFDVELKHGANAGLINALKLIQPIKDKYPSITYADLFQLASATAIEEAGGPKIPMKYGRVDVTGPEQCPPEGKLPDAGPSSPADHLREVFYRMGLDDKEIVALSGAHTLGRSRPERSGWGKPETKYTKNGPGAPGGQSWTVEWLRFDNSYFKDIKEKRDQDLLVLPTDAALFEDPNFKVYAEKYAEDQDAFFSDYAEAHAKLSNLGAKFQPPQGFSLDD

SEQ ID NO: 39609 - protein, 235 aa, Sorghum bicolor
  Clone ID: SORBI-28MAY03-C24507_1.pep
FVETKREADSLRYFLQSKGFPATAIHGDRTQQERESALKSFKSGTTPIMVATDVASRGLDVPNVAHVINYDLPSTSEDYVHRIGRTGRAGKAGIATAFFTESNHPLAKGLLELMTEAKRDVPEWLVEYANRPCYGGSSYGGRGRRGGGGFGGRDYRRSSDYGYGVDDSGYSSRGGSYSGGGGYSSRGGSYSAGGSRGGRANYSGGGASYGSSAPPPRYYPSYPMGTTDISASGWD

SEQ ID NO: 39610 - protein, 186 aa, Sorghum bicolor
  Clone ID: SORBI-28MAY03-C24399_1.pep
APPFALRAGRRPRVGAVVGFIRGAPARASQPGRRPPPPPRRPRRPPRSRPSPARCAPSPPPSSAPPSGASGCPAPPPAPPAAACPSRASAPAASAWRRSWSWPGSPPRRPAVAGPRPPPRHPAPAGCPRSSLLPRPPGCPRSFRSVPSPRRLRHRRSVPPPRRLCHRSTLGAAMGFSSDLAPVDLG

SEQ ID NO: 39611 - protein, 85 aa, Sorghum bicolor
  Clone ID: SORBI-28MAY03-C24590_1.pep
PLPLRPPPRVCMHCTPVPPFSVSLFSEEEICDYCVLVYEISCFAEYVLGYCAEFVCRSCFFLLIKVSPVNEQKVVIPPPEVCDHA

SEQ ID NO: 39612 - protein, 228 aa, Sorghum bicolor
  Clone ID: SORBI-28MAY03-C24591_1.pep
MCTQKPPHDYSQQLYEKYRGSCEEYITSMVLPSLREKHDEFMLRELVKRWSNHKVMVRWLSRFFHYLDRYFISRRSLPPLREVGLSCFRDLVYQEIKGKVKSAVISLIDREREGEQIDRALLKNVLDIFVEIGLGTMECYENDFEDFLLKDTADYYSIKAQSWILEDSCPDYMLKAEECLKREKERVSHYLHSSSEQKLLEKVQHELLTQYASQLLEKEHSGCHALLR

SEQ ID NO: 39613 - protein, 92 aa, Sorghum bicolor
  Clone ID: SORBI-28MAY03-C27218_1.pep
EVARPTKAYRAVLQRLPSVFVGRDDRLRLLVAAAADAARASLKKRGLHLPPWRKLEYMRAKWLSPYDREAPPPPEATTGELAGNGEGGGPSA

SEQ ID NO: 39614 - protein, 154 aa, Sorghum bicolor
  Clone ID: SORBI-28MAY03-C29880_1.pep
KTKERLQAVEELKGQADAGTVVDANIAEKLAQLKNQIATLEKREERYKAVFAERISVFRKACCSLFGYKIVMNDQQQSNGIPVTRFILQSVYAQSDDEKLEFDYESGSTNIVVNDYTSQHEIAQQVDIFIRRMNSIPAFTANLTMESFNKRSIC

SEQ ID NO: 39615 - protein, 155 aa, Sorghum bicolor
  Clone ID: SORBI-28MAY03-C29858_1.pep
TTMLKGETEEIGKLVEKTARRKYGVENVNDHFMAFNTICDATQERQDAMYQLVKEKVDLILVIGGWNSSNTSHLQEIGELSGIPSYWIDSEQRIGPGNMISYKLNHGELVEKENWLPEGPITIGVTSGASTPDKVVEDALQKVFEIKRQEILQVA

SEQ ID NO: 39616 - protein, 199 aa, Sorghum bicolor
  unsure (1)..(199): unsure at all Xaa locations
  Clone ID: SORBI-28MAY03-C2992_1.pep
AKLKNLXNRLEQVSKDDKAAKLEAMNRKNRADNFKNASEMKPVNTSLKAGEAGYDPFSRRWTRSRNYYASKPGGDNAEETANGSSSDVVPINEDIKSKAQTGTAATTAAQVAAADAGKLTDTNAPVDLGTESNVLHTFELPISLSALQEFGGAKGLFDGYMARRQKIEATMGYKVPDNDGRRHALTLSVSDYKRRRGLL

SEQ ID NO: 39617 - protein, 97 aa, Sorghum bicolor
  Clone ID: SORBI-28MAY03-C2993_1.pep
MDKVLAFSILSASPADISAGAGSGGSWARLSWRRCADDQQAAAAAVAGRQREEQEEDKDKRGSCSRSRGGGRAAPAAAPRFAPEFDGIDCFETIVSH

SEQ ID NO: 39618 - protein, 132 aa, Sorghum bicolor
  Clone ID: SORBI-28MAY03-C29956_1.pep
MASPALGSQVAAAASVPVGSDCCFKGTALKGNSNLNFRNKPCIGMALAWKNKTQQSRHLNKVFCMSVQQASRSKVAVKPIELENAKEPPLNLYKPKEPYTATIVSVERIVGPKAPGETCHIVIDHGGNVPYW

SEQ ID NO: 39619 - protein, 364 aa, Sorghum bicolor
  unsure (1)..(364): unsure at all Xaa locations
  Clone ID: SORBI-28MAY03-C29991_1.pep
ARGPCGPRDKYLKKEALWPYLQEFVDGALAHILNMSKALGEQVGNGKPVLPYVIHGHYADAGDVAALLSGALNVPMVLTGHSLGRNKLEQLLKQGRMSKAEIDSTYKIMRRIEGEELSLDASEXVITSTRQEIDEQWGLYDGFDVKLEKVLRARARRGVSCHGRFMPRMVVIPPGMDFSNVIPEDIDGDGDSKDDIVGLEVASPKSMPPIWAEVMRFLTNPHKPMILALSRPDPKKNITTLVKAFGECRPLRELANLTLIMGNRDDIDEMSAGNASVLTTVLKLIDKYDLYGSVAFPKHHNQADVPEIYRLAAKMKGVFINPALVEPFGLTLIEAAAHGLPIVATKNGGPVDITTALNNGLLVD

SEQ ID NO: 39620 - protein, 73 aa, Sorghum bicolor
  Clone ID: SORBI-28MAY03-C25243_1.pep
GIYKRCCHIFHMIIHINFPPGDSSAVWLLYYLSRDWIQQDSSVDSTTEMTSPHLEGNPMRCQMCRAVVRLLGS

SEQ ID NO: 39621 - protein, 279 aa, Sorghum bicolor
  Clone ID: SORBI-28MAY03-C25259_1.pep
ARGNPVAIQTIKGYLLVASHDKILVFNTSSQYYGRVGAPRPLFATSIKDIKSVFAGSGGVLPTESAGKPVIAADREKLVILGLGDGHIAIYRSNFPVYKPESNAVVWSGPALLFLLFLIGIWQVYVKKKDSLGWTPEETFNTSVTAPTGSLLNHPTSDRAFADSAARSSDRGYVDGTSRASDRSYVDATTRTTDRGYSDTTRAVDLRGGALRSAPRRYVSPTRYAGTSGIQYRPASAEPGLRGTPEIKYRGPGMEPPGFPKKREPLFSNNQAGVDDHVD

SEQ ID NO: 39622 - protein, 137 aa, Sorghum bicolor
  Clone ID: SORBI-28MAY03-C25318_1.pep
TKRSPWGSRRIVRTGDLPVAGVLPCSHVYHAECLERTTPKGQKHDPPCPVCDKLAGKDTEQWSICRLKNGFPRLRSLGEGPSRVWSCAHAGDCVAGAVQIPRSNSIKLLSRSGHKRHASSKGEPSKDWAETSKNDYM

SEQ ID NO: 39623 - protein, 115 aa, Sorghum bicolor
  Clone ID: SORBI-28MAY03-C25280_1.pep
ATGGVSSVTGRIMVAEVVAEVAQHVELMSATRGLTMLDMLVVVVAAQQLLVPLQNEGQHSCCTSLESVWWPSDYFEVGIELHQLVECGITRKAWIQIIRVPVLDHYFCRQQKRKK

SEQ ID NO: 39624 - protein, 197 aa, Sorghum bicolor
  unsure (1)..(197): unsure at all Xaa locations
  Clone ID: SORBI-28MAY03-C25835_1.pep
MASSLKFTVRRRPAVLVAPASPTPRELKRLSDIDDQDGLRFHIPVIQFYRRSALMGGRDPAPVIRDAVARALVHYYPFAGRLRELQARKLAVECTGEGVLFIEADADVRLDHFGDALQPPFPCLDELIFDVPGSSQVLGSPLLLFQVTRLACGGFILGVRLHHTMADAQGLVQFLGAVAELARGAAAXTVRPVWCRE

SEQ ID NO: 39625 - protein, 167 aa, Sorghum bicolor
  Clone ID: SORBI-28MAY03-C24123_1.pep
VSQGISGSLVDVAGGLGGATQAIAKAFPHIECSVLDLPNAVAVAPTDTDVKYIAGDMFESVPSANVVFLKWVLHDWGDAECVKILKNCKKAIPSEGGKVIIMDIVVGAGSSDQKNVETQVLFDLFIMTINGAERDEKEWKKIIFEAGFRSYKIMPVLGVRSIIEVYP

SEQ ID NO: 39626 - protein, 240 aa, Sorghum bicolor
  Clone ID: SORBI-28MAY03-C24372_1.pep
LALSESEAKVSLQSDIDRFINEKIIVADKVIVSHAVTKIRDDDVLLTFGSASVVEMIFDHAHELGKKFRVVVVDSRPNHEGQILLRQLVAKGISCTYTHINAVSYIMHEVTRVFLGASSVLSNGTVYSRVGTALVAMVAHAFGVPVLVCCEAYKFHERVQLDSICFNELGDPDAISRVPRDASLSHLKNWAENENLHLLNLKYDITPSDYVSMLITDYGMLPPTSVPVIVREYRREHVWI

SEQ ID NO: 39627 - protein, 164 aa, Sorghum bicolor
  Clone ID: SORBI-28MAY03-C24254_1.pep
EKCIGDAPVESEKHGDSESLSRDGKSISGNVNAKNQISREDLKEAFKKFGTVRYVDFSIGDDSGYLRFEDSKAAEKARMSAVLADEGGFIIKDHIVTLEPVTGEAEKDYWNRIRGIQGKYKDSRSYKGRALKNQRGGKHFNGKRDRNPDSEKNSNKAQKVEAAA

SEQ ID NO: 39628 - protein, 205 aa, Sorghum bicolor
  unsure (1)..(205): unsure at all Xaa locations
  Clone ID: SORBI-28MAY03-C2424_1.pep
AKSEVHVFIRQKKVLRGFDEEVRDFVAEQMSLRGITFHTEESPQAITKSNDGLLSLKTVFGNEPTKPDYRTIPSAVFSQPPIGQVGFTEEQAIEEYGDVDVFVANFRPLKATLSGLPDRVLMKILVCATSNKVVGVHMCGDDAPEIIQGIAIAVKAGXTKQDFDATIGIHPTSAEEFVTMRSATRKIRKKSADQVESKDEVVSKQ

SEQ ID NO: 39629 - protein, 148 aa, Sorghum bicolor
  unsure (1)..(148): unsure at all Xaa locations
  Clone ID: LIB3481-009-Q6-K1-A1.pep
RVRFHTEESPQAITXKSNDGLLSLKTNKETFGGFSHVMVATRSQTKYKNLGLEEVGVEMDKNGAIVVDEYSRTSVDSIWAVGDVTNRVNLTPVALMEGGAFAKTVFGNEPTKPDYRTIPSAVFSQPPIGQVGLTEEQAIEEYGDVDVF

SEQ ID NO: 39630 - protein, 300 aa, Sorghum bicolor
  Clone ID: SORBI-28MAY03-C24377_1.pep
RPASLREGGAPNQPANGSCAAAGGDEAQGRRRRGRGEAFFLLYTPFWLTLCLGVVVPFKLYERFTELEYLILGLVSTVPAFLIPLFLVGKADSVRNFKDRYWVKANIWIIIFSYVGNYFWTHYFFTVLGASYTFPSWRMNNVPHTTFLLTHACFLFYHMASNMTLRRLRHSAAHLPQSIRWLFEAAWILALSYFIAYLETLAIANFPYYEFVDRDIMYKVGSLFYAIYFIVSFPMFSRIDEKDEKWNLSRVAVDSLGAAMLVTIILDLWRIFLGPIVPIPESRQCGQPGLAWFQVQNEST

SEQ ID NO: 39631 - protein, 192 aa, Sorghum bicolor
  Clone ID: SORBI-28MAY03-C24395_1.pep
MAKIAAVAATAALCLAALVAVAVGQGVVERQRLKDLQCWQEVQENPLGACRQVLDRQLTGGMRYGIGPFRWGTGLRMRCCQQLQDVSRECRCAAIRSMVRGYEETMPPLEKGWWGQQPQPGYDYPCSQAGEGYGYGESGQQQMYPPCRPGTGQKIARVKLTKARQYAAGMPMMCRLSEPQECSVFSGGDQYY

SEQ ID NO: 39632 - protein, 124 aa, Sorghum bicolor
  unsure (1)..(124): unsure at all Xaa locations
  Clone ID: SORBI-28MAY03-C25476_1.pep
MGKKRKLEPKSAAAVKPVKASQTTTKASSAAATAKAAGLSAVLAPAEVAMEKLPQGAGGEGEEVEEEIEEEVEVEEEVEVEEEDXEGDPXSIQALLDSFPKDQLVELLRDAAVAHGDVLSAIRH

SEQ ID NO: 39633 - protein, 214 aa, Sorghum bicolor
  Clone ID: SORBI-28MAY03-C25489_1.pep
MAEDGRMPEGEKKQAAMDGRKDGVAREVIRMEREAVIPILKPKLIMRLAYLIEHEADRNEFLKLCKKVEYTIRAWYLLQFEDLMQLYSLFDPVSGEKRLEQQNLTSEEIETLEFNFMTYLFQVMEKSNFKLLSDEEYDIAQSGKYLLNLPIKVDESKLDKKLLTRYFKEHPHDNLPEFADKYIIFRRGIGIDRTTDYFFIEKVDVMISRAWSSL

SEQ ID NO: 39634 - protein, 179 aa, Sorghum bicolor
  unsure (1)..(179): unsure at all Xaa locations
  Clone ID: SORBI-28MAY03-C25494_1.pep
MLCRFGTFHTDDFDLRLVAFCGSCALASTASVLAFSWVRRGSIYRGLGLMVAASPCALAVAPLAYATAISSLASKGILLKGGHVLDALSSCQSIAFDKTGTLTTGKLMCKAIEPIHGHLGVKNGHSNPSCCTPNCESEALAVAAAMEKGTTHPIGRAVVDHSVGKDLPVVAVESXECLP

SEQ ID NO: 39635 - protein, 370 aa, Sorghum bicolor
  Clone ID: SORBI-28MAY03-C25499_1.pep
MEDAGGAAAGHAARPPLAGSRSGFRRLGLRGMKQRLLVVANRLPVSANRRGEDHWSLEISAGGLVSALLGVKDVDAKWIGWAGVNVPDEVGQRALTKALAEKRCIPVFLDEEIVHQYYNGYCNNILWPLFHYLGLPQEDRLATTRNFESQFDAYKRANQMFADVVYQHYQEGDVIWCHDYHLMFLPKCLKDHDINMKVGWFLHTPFPSSEIYRTRSSRGGPLRSVRRAGLAGFHTYDYARHFVSACTRILGLEGTPEGVEDQGRLTRVAAVPIGTDAVRCQRASRPPAVLWPFCHSPQRFAGRKVMLGVDRLDMIKGIPQKILAFEKFLEENPDWNDKVVLLQIAVPTRTDVPEYQKLTSQVHEIVGRIN

SEQ ID NO: 39636 - protein, 187 aa, Sorghum bicolor
  Clone ID: SORBI-28MAY03-C24632_1.pep
MHLALLLPRIRLSPAAMSSTRSASASRLLVRADLNPVVREVKRESSVSFDISKPEATASVKRKRVKRELELNGEHHKKQFGVVPDIEDFRYEKAKTLTASSKATASSVKVEKKVRVSSVIKVGAPDNWEAVLGGIKSMRLSGEAPVDTKGCEKAGSLLPPKVCRFAVLISTMMSSQTKDEVTHAAVE

SEQ ID NO: 39637 - protein, 288 aa, Sorghum bicolor
  Clone ID: SORBI-28MAY03-C24646_1.pep
MDPKFNGDWSANEIEMVRSIIASHDANSSCTNNRNAKHYGIVDELHARFPRKNKRQVIDLYVDLVVEMLNAMEMSSNQLPMMSNDLVVDNFGVMVENPGMHSMDLFPSYLIDEMKAKRTVEEQHHRQVVVPQEDKQRARRFWTLAEHRNFLLGLRAYGRGNWKNISKDFVTTKTPVQVSSHAQKFFRRQESTTKKQRYSINDVSLYDAKLWVQDNSSSWEAFTSNAYNPYSYGFGGQLTMDNLTQVYSASQASNNQTLTWTGDQQTSSPSAAPTTEEDGTQMEWTNYY

SEQ ID NO: 39638 - protein, 286 aa, Sorghum bicolor
  Clone ID: SORBI-28MAY03-C24652_1.pep
MAGDRLSWAGLLKWSLSYVDGAGPSRAVSEEERRWLAEAVERHMMMDVVSRMREIALLMSTPPAVLEAQGITHDDIEDLLSELQVHVESIDMANDLHSVGGLVPVIKYLRNSNARIRAKAADVVTTVVQNNPTSQQLVMEASGFEPLLSNFRSDPDLTARIKALGALSSLIRNNKPGVSAFRLANGYTGLRDALNSESARFQRKALSLTHYLLSESHSDCSVFAQLGFPHLMMRLASSDDSGVREAALGGLLELARDTTLGNRSLLAEHDRLRRLLCGRMESIRTM

SEQ ID NO: 39639 - protein, 145 aa, Sorghum bicolor
  Clone ID: SORBI-28MAY03-C2475_1.pep
AKGDKLTGSSGFNNVTGYIFGNNASSEKIPMTTPVFTQASDDTLSDVSIQIVLPMNKDLDSLPAPNTAVTLRKVEGGIAAVKKFSGRPKEEIVLQKEKDLRSQLLNDGLKPHPGCLLARYNDPRTKSFLMRNEVLIRLIDFTLEL

SEQ ID NO: 39640 - protein, 170 aa, Sorghum bicolor
  Clone ID: SORBI-28MAY03-C24843_1.pep
DAIVRTDETTLANLIKPVGFYQRKAQFIKEASKICLDRFGGDIPDSLNELLALRRGGPSLAHLVMSIAWKNTQGICVDTHVHRISNRLGWVFREGTKQKTTTPEQTRISLEKWLPKDEWEPINPLLVGFGQTICTPLRPKCDNCGINNLCPSAFKESSSPNPKQKKTRSP

SEQ ID NO: 39641 - protein, 143 aa, Sorghum bicolor
  Clone ID: SORBI-28MAY03-C2497_1.pep
PGYLLSVKAYTVFATHMERLSELATMYPNVKILHFEVDLRNDRLDFKFRLKDGVRRVPHYGLLLARVAGIPTSVIDTSTSITSQITEQEMTRMDANCEEYRSLQMTYQVVQRLICLKYSNHDEDYIREALQNLKESYAAGRLT

SEQ ID NO: 39642 - protein, 179 aa, Sorghum bicolor
  Clone ID: SORBI-28MAY03-C25725_1.pep
MSPSGELLASISSALAVAFVLLACVELGDAAAAVGVYRLIQYDLAGAPLGSRAAVINHHAAALPLPAGADLSRSALVAPLLDLPLSFLREYLVEKKHLGGLLILLPTNRGGDKDSADDKGKVKGVLTELEKLLVHEQLPYPVYFALHDDSFDNLLADIHKIASSGQPASATTGGYKLVV

SEQ ID NO: 39643 - protein, 226 aa, Sorghum bicolor
  Clone ID: SORBI-28MAY03-C25750_1.pep
ARGLNADLVGFHTFDYARHFLSACSRLLGLDYQSKRGYIGIEYYGRTVTVKILPVGIDMGQLRSVVSAPETEDVVRRVTETYKGRRLMVGVDDVDLFKGIGLKFLAMEQLLVEHRELRGRAVLVQIANPARSEGRDVQGVQDEARAISARVNARFGTPGYTPIVLIDGPVTPQEKAAYYAAAECCVVSAVRDGLNRIPYIYTVCRQESTALGDDAPKRSVIVLSEF

SEQ ID NO: 39644 - protein, 71 aa, Sorghum bicolor
  Clone ID: SORBI-28MAY03-C25773_1.pep
MCGGAILSDIIPPPPRRVTAGHLWPESKKPRRGAGAGRRRAGPPVEEEEEEEDFKADFEVFEVESGESELE

SEQ ID NO: 39645 - protein, 197 aa, Sorghum bicolor
  unsure (1)..(197): unsure at all Xaa locations
  Clone ID: SORBI-28MAY03-C25803_1.pep
MANRDAAAGKLTVAETFSSLREQGKIAFIPFITAGDPDLATTSKALKILNSCGSDVIEVGVPYSDPLADGPVIQASATRALKKGTTLDSVIEMLKGVTPELSCPIVLFTYYNPILKRGVGNFMATIRQAGIHGLVVPDLPLEETALLRSEAIMHNIELVLLTXPTTPTDRMKEIAKASEGFLXLVSAVGVTGARSNG

SEQ ID NO: 39646 - protein, 99 aa, Sorghum bicolor
  Clone ID: SORBI-28MAY03-C25336_1.pep
PKSVENQNTTKDLENIKNMILESLSKIEHVPSTQFHDRPSDPEAPEEKEEDMDKRPAQRSRLWSGGAYDSDTEDPDNLKSESKDVTANLQMKDEPKNDL

SEQ ID NO: 39647 - protein, 80 aa, Sorghum bicolor
  Clone ID: SORBI-28MAY03-C25359_1.pep
FWDVMSNEEVCEVARKRILLWHKKNGTSSSSAPRVGDSADPAAQAAAECLSKLAVQKGSKDNITVVVVDLKAHRKFKSKT

SEQ ID NO: 39648 - protein, 309 aa, Sorghum bicolor
  unsure (1)..(309): unsure at all Xaa locations
  Clone ID: SORBI-28MAY03-C25402_1.pep
MAEAVAAAAGWPADEEARPLKVVFGSPAKYFTDAAPIGNGRLGAMVWGGVESERLQLNHDTLWTGGPGNYTNPKAPAVLSKVRSFVDNGKYPEATAAAYDLSGDQTQVFQPLGDIDLVFGKNIKYTNYKRELDLHTATVTVTYTVGEIVYSREHFSXSNPHQVIATKISANKPGNVSFTVSLTTTLNHKIRVTHANEIIMEGSCPGERPQEGNTAADPPIGIKFCAILYVQINGANSTVEVLNDNMLKLDCADSVVLLLAATTSFESAFIKPSESKLDPTVSALTTLSIARSTSYSQLTAYHIDDYQTL

SEQ ID NO: 39649 - protein, 173 aa, Sorghum bicolor
  Clone ID: SORBI-28MAY03-C25434_1.pep
MASDPAPDDAAAAENGHGNDNGHGNGNGNGNGNGPSPKRARSVISADEIRTEFAHHDAAVARVNNGSFGCCPASVLAAQAHWQGLFLAQPDAFYFHGLQQGLLRSRAAVAEAVGAGDVSEVSLVDNATTAAAIVLQHAAWSFAEGRFASGDAVLMLHYAYGAVKKSIHAYVAR

SEQ ID NO: 39650 - protein, 112 aa, Sorghum bicolor
  Clone ID: SORBI-28MAY03-C2538_1.pep
MVRPRAVAVATAGSRHGHGGHAFSCSFLKACFLCKRELSPDKDVYMYRGDQGFCSEECRWQQILVDEREAATATSKQELQRRGQAAGQARHYSPHPTPIRGRPPPRKTLAVA

SEQ ID NO: 39651 - protein, 71 aa, Sorghum bicolor
  unsure (1)..(71): unsure at all Xaa locations
  Clone ID: LIB3481-011-Q6-K1-B3.pep
FAMPHLSFPCXTKXSTXCNFVTRACYSTALASRLQHAKKALEKTPNQLLSLLVAKSLFISNPTSQLMHHYI

SEQ ID NO: 39652 - protein, 198 aa, Sorghum bicolor
  Clone ID: SORBI-28MAY03-C2547_1.pep
MNQLSLLHRALHLHRLPPGRGHGLTATAVVRARLSSSEPTPHQHAKRHLAVARPHESIAAATDQESHHHPRQELAAGGGGGRTRTCALPTWALIGGITAGVAVALALSAGPGAGPALALGPPEGPLVEEFWDNMRRYALYVVTVSTGVAYAVLQPIVELLKNPVTALLIVAVLAGSGFLVSQVLNAMVGNSDFIYRYE

SEQ ID NO: 39653 - protein, 83 aa, Sorghum bicolor
  Clone ID: SORBI-28MAY03-C26029_1.pep
GKRQKGKTRTRKGDEAECGWRPGALTAWITAAAVKKVYRKATLCIHPDKVQQKGANLQQKYIAEKVFDLLKEAWNKFNSEELF

SEQ ID NO: 39654 - protein, 332 aa, Sorghum bicolor
  Clone ID: SORBI-28MAY03-C26035_1.pep
MFAHIILQLQIPSNQTLCLDFKAQWNTTYLMLLAALDYKQAFTMLEKCNDNYNQAPSAVDWEKVEVACRYLKLLYDSANSIMATEDPTSHIFFHEAWTIQREISNATDDQDSISGTITKGMHEIFDKYWRDCNVVLAIAVVMDPRFKMKIVEFSYSKIYGLMKGSKYVKLVDDAVHELYKEYVRQPLPSTPAHVEQEVTGALPDNKNNIPTDPTSTGNLLSGFDTYLSEVALSQISKSELDQYLEEALVPRMLEFDILMWWKVNAVRYPTLSRMAQDVLAIPVSTVGRGSSVFAAGTEAKMLDDYQSSLHPETLEALFCAKDWLQHSSPAAP

SEQ ID NO: 39655 - protein, 64 aa, Sorghum bicolor
  Clone ID: SORBI-28MAY03-C26064_1.pep
RLSILSASQSSIGRNKAAAANKQDGMDIIHVAIIHVAKTIPFHFQAIKLVIASLVHALNLSTNT

SEQ ID NO: 39656 - protein, 138 aa, Sorghum bicolor
  Clone ID: SORBI-28MAY03-C26069_1.pep
PTDVCASSIITQGKPPTLLDLAAPCPRHTSCFGRGDSRLLLPRPLEVPADYGISARVLYKRADSPSTIRPSKLHNGVLRALSRNRPSGRNMMLLGTCQDGEPCVVDQDQAFEDQQAQESFEQGYDNEDDWNEDYRYEY

SEQ ID NO: 39657 - protein, 185 aa, Sorghum bicolor
  Clone ID: SORBI-28MAY03-C26078_1.pep
KEIALMEVKMKRLCELLDEAFVRTKENAEKKLTLTYEEMEAEREEEEVQADSESDDEEQQIYNPLKLPMGWDGKPIPYWLYKLHGLGQEFKCEICGNHSYWGRRAYERHFKEWRHQHGMRCLGIPNTKNFNEITSIDEAKALWEKIQARQGVNKWRPDLEEEYEDQEGNIYNKKTYTDLQRQGLI

SEQ ID NO: 39658 - protein, 306 aa, Sorghum bicolor
  Clone ID: SORBI-28MAY03-C25521_1.pep
TRVIMISQASSEHSVCFAVPEKEVAAVSAALHVRFREALAAGRLSKVEVIKGCSILAAVGLRMASTPGVSAILFDALAKANINVRAIAQGCSEYNITVVLKQEDCVRALRAAHSRFFLSKTTLAVGIIGPGLIGGTLLNQLKDQAAVLKENMNIDLRVIGITGSSTMLLSDTGIDLTQWKQLLQKEAEPANIDSFVHHLSDNHIFPNKVLVDCTADTSVASHYYDWLKKGIHVITPNKKANSGPLDRYLKLRTLQRASYTHYFYEATVGAGLPIISTLRGLLETGDKILRIEGIFSGTLSYIFNNF

SEQ ID NO: 39659 - protein, 100 aa, Sorghum bicolor
  Clone ID: SORBI-28MAY03-C25590_1.pep
MVRIGGGVFPVIKEPDYLVNGEYRIDKGAAPKMLNCLMYKLCYYRFGELTTEYGKPPGYDRVRGVEIGNKDIKLEYLEEAFTTSNWIVRIYKVKPPKNRS

SEQ ID NO: 39660 - protein, 139 aa, Sorghum bicolor
  Clone ID: SORBI-28MAY03-C25616_1.pep
LDLTDRKFDALAVSSSGHWHIASGVQRDSLTQVPVYNLSKRLYLESWTTLILRLKFLPSNMQHNLGILFTPIVSIPLTQSNVGTLRPVWLSCQNRLASQPAGVKNSSALCCIHIHCNGQQFIHLRSLRRCRIYWLPLES

SEQ ID NO: 39661 - protein, 66 aa, Sorghum bicolor
  Clone ID: SORBI-28MAY03-C25617_1.pep
GEVRKTSCRLFGFSLTEKILPADDDGVKEVSYEPECQNPRMLDLFGYNCSTPSAALPALCAAPIGM

SEQ ID NO: 39662 - protein, 114 aa, Sorghum bicolor
  Clone ID: SORBI-28MAY03-C2555_2.pep
VRDVDGIFDPPYYEWFQFDKSFMEYRNFDKCLAYIEELMIRDGPFDGLMGFSQGSYLSAALPGLQEQGLALTRVPKIKYLIIIGGGKFQSPTVAEKAYANKVACPSLHFIGDND

SEQ ID NO: 39663 - protein, 253 aa, Sorghum bicolor
  Clone ID: SORBI-28MAY03-C2555_1.pep
MGSLGADAEPQGARRRPRFLCLHGFRTSAEIMRKQVLGKWPADVTARLDLVFADAPFPAEGKSDVDGIFDPPYYEWFQFDKSFMEYRNFDKCLAYIEELMIRDGPFDGLMGFSQGSYLSAALPGLQEQGLALTRVPKIKYLIIIGGGKFQSPTVAEKAYANKVACPSLHFIGDNDFLKVHGEKLIESFVDPFLIRHPKGHTVPRLDDESLAVMLRFLEKIEGEVLEYSSKDKIEGEVLEYSSKDVNENEEVCL

SEQ ID NO: 39664 - protein, 162 aa, Sorghum bicolor
  Clone ID: SORBI-28MAY03-C25675_1.pep
RTHQSVAPEESSEGNIIRRRGRFQVTSDSISQKVATSACSSSSRINLPIEAAQSNPKSPAILPTLQFLMQQNTMQKEVLSRLISSIEETSDDSLARTSSSYQSSGGPAREKELHSYVLQLQRSVTELAEEVQRLKLQNNQLEQQINVLSRKDERSQTQDNRQ

SEQ ID NO: 39665 - protein, 142 aa, Sorghum bicolor
  Clone ID: SORBI-28MAY03-C26423_1.pep
VELDSEIMLVGYNDSSFSHILVLRLADLVLGRTVPVKSIGDHVFFVGARSLCVSPNWLPSIGGNSIVCFHAGENYLAQYHLGCGTWSVASDGHLMLNPPPRPCSLIHHIFTCCDRQFWNKGLMFCFKIEPKWWAMSRMRVGA

SEQ ID NO: 39666 - protein, 66 aa, Sorghum bicolor
  Clone ID: SORBI-28MAY03-C26363_1.pep
ERNQESNRLEYLIPKKTSLRHRLPMADQGFIEFVAYLLEVNPKKRPSASEALKHPWLSFPYEPISS

SEQ ID NO: 39667 - protein, 135 aa, Sorghum bicolor
  Clone ID: SORBI-28MAY03-C26498_1.pep
TRRQRATAPPWPCAPAAPLRPAGPAPALHSPARQRGSHARARRIEHPVPPALGAPAPAHASPVPPALGTAAGGGRRRRVVGLVRVTRRPRSSSSALRVFLHRIDSPLHRLSTAPLPLPHRHHRPRTRGWLRSCET

SEQ ID NO: 39668 - protein, 116 aa, Sorghum bicolor
  Clone ID: SORBI-28MAY03-C26641_1.pep
ALFAELTDRIVPVAINTKESMFHGSTVRGFKLMDPYFFFMNPRPTYEITFLTQLPKDLTCSGGKSPIEVANYIQKTLSGQLGFECTTITRKEKYGILAGTDGRVPSKNKDKEKEKN

SEQ ID NO: 39669 - protein, 143 aa, Sorghum bicolor
  Clone ID: SORBI-28MAY03-C270_1.pep
MPVPLAPYPTPPVPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGAEQKPSS

SEQ ID NO: 39670 - protein, 83 aa, Sorghum bicolor
  Clone ID: SORBI-28MAY03-C25875_1.pep
MAGKGGPTNLEKEQMFGMAEKEMEYRVDLFNRLTQTCFDKCIEKRYKEAELNMGENSCIDRCVSKYWQVTNLVGQMLGNRPQM

SEQ ID NO: 39671 - protein, 81 aa, Sorghum bicolor
  Clone ID: SORBI-28MAY03-C25921_1.pep
SESKSLFADQAEAVCATSKNQFKENVDDNLISGVLDGFALTSETEGDGILSGSKNQDVADVTCHDILDALHDGKALLGRRM

SEQ ID NO: 39672 - protein, 160 aa, Sorghum bicolor
  Clone ID: SORBI-28MAY03-C25935_1.pep
LCTFDGTHGVSAGIRSVVDVEAGKSNGLFNDAMCNACETAVVWMQSQLAQNQTQDLVLQYARRLCERIPSPMGESSVDCSRLASMPDIAFIIGGRKFALKPEQYILKVGEGAATQCISGFTAMDIPPPRGPLWILGDVFMGAYHTVFDYGNLKVGFAEAA

SEQ ID NO: 39673 - protein, 79 aa, Sorghum bicolor
  Clone ID: SORBI-28MAY03-C26027_1.pep
AHRVHADPLSGVVFTNESILTICREGLVKIWVRPDQSENNQQSNPSEFVLGPVSKDRAITSSNKASSSSFKKPSSVLVA

SEQ ID NO: 39674 - protein, 159 aa, Sorghum bicolor
  Clone ID: SORBI-28MAY03-C25994_1.pep
SFPRGTPPPPARPSNPALGLHSDRHRAVEGDLRQWQHPRLLACHSSRSARSCAAPRSPLLVTPSGARACAAPALACSLSLPCCAPHPETSQGTGRSGFWPWSHRGSRRCHRQARMDPSPMRRSSRAPGCPHFAPRCSRVKLPAAGMRTCRRWGCEQATL

SEQ ID NO: 39675 - protein, 90 aa, Sorghum bicolor
  Clone ID: SORBI-28MAY03-C26892_1.pep
GGTTAKPKTSMLLAPPPGAAGKLRSPLPPPPNDPAAARMNSGHTAGIRAPKEPTKRNNDPFSDLSAIKQNLPSSAEPGQTKSTGAGWAAF

SEQ ID NO: 39676 - protein, 115 aa, Sorghum bicolor
  Clone ID: SORBI-28MAY03-C26933_1.pep
QQVDWEGFGIGSSVLSSEPSAIQVPSKEAEPDPHLEVERSTSPAPSAAISHNVAAPHWFQRHVDPFELMGFAARGLIKNDKFFEEGYRELQQSATTMNTWWISRANNAAHRWSTA

SEQ ID NO: 39677 - protein, 91 aa, Sorghum bicolor
  Clone ID: SORBI-28MAY03-C26934_1.pep
GGDEIEVKDIVERLMTDTTKADKDRLPKTGCDPNWEHGLSSIFIEVQTDQGLYGTRSTAVLSVNYDGEASLYEKYLESGIWKDHTVNYQIE

SEQ ID NO: 39678 - protein, 102 aa, Sorghum bicolor
  Clone ID: SORBI-28MAY03-C26993_1.pep
MTKQGVVVPVPEAAVAVPPNTAPLFQYPPPRAAPGIAVRKKYLQMGAAAGAGAGARIGGGGWVESMRASSPTHARAAAALAAGVDEERYAEWMVKHPSALGM

SEQ ID NO: 39679 - protein, 237 aa, Sorghum bicolor
  Clone ID: SORBI-28MAY03-C26096_1.pep
ARGSILNLDLDHPFLAQAIQAFDHLRIRLGGSLQDRVVYDARGESPCSPFTNASNGLFGFSVGCLGMDRWDKLNDLFQRTGALVTFGVNALYGRYNVRRSIWAGKWNSTNAYDFVKYTISKGYPVGSWEFGNELSGHGIGAKVDAKLYGKDVIEFKSILRQLYKAPLSQPLLLAPGGFFDQQWYSQLLETSGHGVVNALSHHVYNLGGGNDVHLIRKILDPKYLDRAEDTYRDMQLT

SEQ ID NO: 39680 - protein, 156 aa, Sorghum bicolor
  Clone ID: SORBI-28MAY03-C2611_1.pep
NADFTLEVFFVRKNHTVYVRKRPYLKMFLEKVAQMFEVVIFTASQRIYAEQLIDKLDPDGKYISRRIYRESCIFSDGCYTKDLTILRIDLAKVAIVDNTPQVFQLQVDNGIPIKSWFDDPSDQELIELLPFLESLVDSEDVRPIISKTFHDKLEQN

SEQ ID NO: 39681 - protein, 214 aa, Sorghum bicolor
  Clone ID: SORBI-28MAY03-C26138_1.pep
MPPPSLLHLHSRAPLQPRPFRMNSRAAPSRVVVCSVASAEGFISAAPILLPDGPWKQVEGGVTAAKGFKAAGIYGGLRAKGEKPDLALVTCDVDATVAGTFTTNVVAAAPVLYCKHALSTSKTGRAVLINAGQANAATGDLGYQDAVDSADAVAKLLNVSTDNILIQSTGVIGQRIKKEALLNSLPRLVGSLSSSVQGANSAAVAITTTDLVSK

SEQ ID NO: 39682 - protein, 260 aa, Sorghum bicolor
  Clone ID: SORBI-28MAY03-C26144_1.pep
MAAMATKATVSLDLAAGPRHHHRPSSAARPSARPAASAAVRGLRARGLRVVPLAAAAAPAVQAGAEEIVLQPIKEISGTVKLPGSKSLSNRILLLAALSEGTTVVDNLLNSEDVHYMLGALNTLGLSVEADKVAKRAVVVGCGGKFPVEDAKEEVQLFLGNAGTAMRPLTAAVTAAGGNATYVLDGVPRMRERPIGDLVVGLKQLGADVDCFLGTDCPPVRINGIGGLPGGKVKLSGSISSQYLSALLMAAPLALGDVEI

SEQ ID NO: 39683 - protein, 159 aa, Sorghum bicolor
  unsure (1)..(159): unsure at all Xaa locations
  Clone ID: SORBI-28MAY03-C26300_1.pep
XERDARLKEKEEIEKVRNMTEEERREWERKNPKPLRQTTKQKWKFMQKYYHKGAFFQEGADDVIQSAGKDDIYTRDFSEPTGEDKMDKSILPKVMQVKHFGRSGRTKWTHLVNEDTTDWNAPWSTNGPLRAKYNAKMAGMNAPIAKPKGSKKLKDWDTK

SEQ ID NO: 39684 - protein, 301 aa, Sorghum bicolor
  Clone ID: SORBI-28MAY03-C2632_1.pep
VRPRVRSDVKKSMKIAMDNKEAILGSIPAEHKEEGAKLYTSLLEEKGGFQTLLKYIKENDPDKLSIALASSLDIVAELELLQAPGLSFLLPQQYLEYPRLTGRGVVEFTVEKGDGSTFFPTGGGEPKSVATIQVIIDGYSAPLTAGNFAKMVLDGAYDGVTLKCASQAIIADNETGKNGYTVPLEVKPAGQFEPLYRTPLSIQDGELPVLPMSVYGAVAMAHSVDSDEYSSPTQFFFYLYDKRNSGLGGISFDEGQFSVFGYTTDGRDVLSQIKTGDKIRSAKLVQGRERLVLPSIAPEES

SEQ ID NO: 39685 - protein, 101 aa, Sorghum bicolor
  Clone ID: SORBI-28MAY03-C24225_1.pep
IPHGEAVTVESFLAWRERFEADLALQRAKLMPDSALTAPKEKKLTGRQYFESGRHAVKGASTVADEDEEEEEDIEFDEDFEDDEEDMLEHYLAEQSGKSTA

SEQ ID NO: 39686 - protein, 207 aa, Sorghum bicolor
  Clone ID: SORBI-28MAY03-C27027_1.pep
MVASYRSRRFKPIEECCSEGRSEQTVAADLDGTLLISRSAFPYYLLVALEAGSVLRAVLLLLSVPFVYVTYIFFSESLAISTLVYISVAGLKVRSIEMVARSVLPRFYAGDVHPESWRVFNSFGKRYIITASPRIMVEPFARAFLGADKVVGTELEVGKNGKATGFMVKPGVLVGDHKKKAVVKELGDAVPDVGMGDRETDFDSCPS

SEQ ID NO: 39687 - protein, 175 aa, Sorghum bicolor
  Clone ID: SORBI-28MAY03-C2708_1.pep
PGKTSQQSDVADREPSPANPVTNSDLDVVSQTTDEVKAETPATEKAGQVEKIVSGKGKENKGKDIVRNSYKTELARQILLSFIVKSVHDSLGSAQAEPDRKSSGSDEASNEQSSNLGKNASGRKDSDKQEKAMEVPKGLKDTEGFTVVSKRRRRPQPFMNPINGLYSQPSITSVS

SEQ ID NO: 39688 - protein, 239 aa, Sorghum bicolor
  unsure (1)..(239): unsure at all Xaa locations
  Clone ID: SORBI-28MAY03-C26656_1.pep
RTRGRLYEPNSRSKSSGGRDDVEHLEGHIAGLEPMNFITFASPHLGSSGNKQILPPXPFLCGLPFLERRASETAHLIVGRTGKHLFLTDNDDGRRPLLLRMVDDSGDLQFRSALRSFKRRVAYANANFDHMVGWRTSSIRRQHELPKHRLLVRDEKYPHIVYVEKEVTDNNGTEAHADLYDPEEEMIRGLTQVPWERVDVSFQKSSQRLVAHNTIQVKSYWLNSDGADVINHMMDNFIV

SEQ ID NO: 39689 - protein, 104 aa, Sorghum bicolor
  Clone ID: SORBI-28MAY03-C26723_1.pep
VVVLREGHQDIGSIATDPSAIAIVCWKGKTNLCVMVSPLDGKELLERISLRFGLKIPKGDKEKPSEEIAGSDELLDCATEVDDQECFPESKASDIEISDAKDAD

SEQ ID NO: 39690 - protein, 147 aa, Sorghum bicolor
  Clone ID: SORBI-28MAY03-C26672_1.pep
WSRSGASFLSDSASSSSTTTTSSCSSSGSFSPFLRLDSPPFGGFDLGLGEGLFSHLLPLPLPRPPSKNHCGVQKTPQWRAGPEGAKTLCNACGVRYKSGRLLPEYRPACSPTFESSIHSNSHRKVLEMRRKKEGDMVANAAPAVASF

SEQ ID NO: 39691 - protein, 211 aa, Sorghum bicolor
  Clone ID: SORBI-28MAY03-C2676_1.pep
YWNRKAVRDMGAGGELDAFDAGRCADGYALGLAVGRRFAEVIRSRMRQDLVLREQLLPFASTAEAQPLLAALQSANRERYPRYWDELVGTADGSGVPLLHVILVNFRKEVLPFIPKEEGGDRTREEEEAEADGDCSDVLIVSDSTAIAAHNEDGNVALLGHTYLVRATLPDGASFTAYTYAGELPSCAFGFNTNGVAFTLDSVPPVNDEIV

SEQ ID NO: 39692 - protein, 197 aa, Sorghum bicolor
  Clone ID: SORBI-28MAY03-C26792_1.pep
MVCIRQATIDDLLAMQACNLMCLPENYQMKYYLYHMLSWPQLLFVAEDYGGRIVGYVLAKMEEDPSEPCHGHITSLAVLRSHRKLGLATKLMSAAQAAMDQVFGAEYVSLHVRRSNRAAFNLYTSTLGYQIHDIEAKYYADGEDAYDMRKPLRQPQPKKHHHHHHHHHGPGGCCSHDAPAAATGSQSSSSPDKKANT

SEQ ID NO: 39693 - protein, 146 aa, Sorghum bicolor
  Clone ID: SORBI-28MAY03-C26814_1.pep
LVATEDQLGLSIFVLLPQFVLMGLADAFLVVGKLEFFYDQAPEGMKSLGTAMSLTAYGIGNFLSSLLLSTVTRITRKRGNAWVKNNINDSNLDYYYAFLTVLGGVNFAAFLVLSTMYRYKAESTDTIDIVIGLETEKAKLQAEPLG

SEQ ID NO: 39694 - protein, 150 aa, Sorghum bicolor
  Clone ID: SORBI-28MAY03-C27373_1.pep
MASSSRAVRFFKLLLLACLLSLCELSQGKDKKPFFTLKNLPPLQKASSYPAGCATTYDYIIVGGGTAGCPLAATLSLRYKVLLLERGGSPYGNRNVSYMENFHIGLMNMAPDSPSQAFISTDGVINARARVLGGGTCINAGFYSRASSSF

SEQ ID NO: 39695 - protein, 220 aa, Sorghum bicolor
  Clone ID: SORBI-28MAY03-C2754_1.pep
GTRLFISRTLIAEAEKAADALETAAAMNPFAQASLIEARKLVTEARISLECVDDEGPQETASNDASGSSALLNRHRHGLETQNGSNLLNQENKPVNGMEFPPSNVNGLGFHFDVSELSGTKQLYQRIENSMERAFLLPSASSKLKSANGDFGIIDLHVRQSMVNDTAKHDGTAAESAETRPPRTQELEADPRSEEKLEQGKIALGGHSKKTHPHLKKRLR

SEQ ID NO: 39696 - protein, 173 aa, Sorghum bicolor
  Clone ID: SORBI-28MAY03-C27569_1.pep
ARGEAIQAEIEESCPRGNGDFGQSGYSPVVFIDRDVSSVEKIAYYTIAECVVVTAVRDGMNLTPYEYIVSRQGAPGSESVSEVSGPKKSMLVVSEFIGCSPSLSGAIRVNPWNIEATAEAMNEAISMPEQEKQLRHEKHYRYVSSHDVAFWSRSFILDLQRACQDHFKRTCWG

SEQ ID NO: 39697 - protein, 329 aa, Sorghum bicolor
  Clone ID: SORBI-28MAY03-C27594_1.pep
MQSLHLSPAPPRPPLPTLRRRPVSSAVASAPAPKPHFFSAPSLAAAVGGTSFYAAAGISLPPRDLTAAAAAGAGAAASSPSDPRPLAAEAESDPSPLSAEAVAELAKLAQVSKKLEKTARHFKNLGTLGFWSQLVCTFVSAGILSFSAVATGNVTAPFTFCATAVGIVMAFISVFQSYGYIRLSERLKRTANEPSKAPARADVVKNLRNSIVLNVVGMAAAVLGLQATVGTLVGKALTTSAVPYYQGIAPGQSPVLALDIFLVQASANTILSHFLGISSSLELLRSVTLSQTEAAPVPKPALRSVTLSQTEAAPVPKPARAWLQSPPES

SEQ ID NO: 39698 - protein, 333 aa, Sorghum bicolor
  unsure (1)..(333): unsure at all Xaa locations
  Clone ID: SORBI-28MAY03-C27661_1.pep
LLIWPVNSGSESXSLADGSVESYGGEGSMAPSSYFMTARSDLLVKFSVREQDSTMLPNEQLTYAGAGQTDLLPGDTLSRDKLCENLLELQRLQNNSNLQSNLVAPGVLQHNSTPGVFHPQLNTPGLSELPHALSSSIDSNGSEVSAFLADVNAVSSAPTLCSAFQNASSFMEPVNLEAFSFQGAQSDSVLNKTSHSNGNISVFDSATLASLHDSKEFITGRLPSFASVKEANLASSGFKTQKQEQNAMCNVPLPAFTARNQMSVAATQGALIPQKIPSWINENKSEGPVSHPSDVQTQPNSAGNGVGVKPRVRARRGQATDPHSIAERLRREK

SEQ ID NO: 39699 - protein, 208 aa, Sorghum bicolor
  Clone ID: SORBI-28MAY03-C2868_1.pep
MGSGMSSARRRGSGLEASRGMLPLLALQVLIEYGRAGASRPPVTAALLAANSLIYLRPGALDGVLPSLSRVSFNPQLIVEYGDLVRFFLSPFYHLSESHLFYNMTSLLWKGIQLETSMGSTEFASMSAVLLGLSQGITLLLSRGLLLLGDDTAYYDQHAVGFSGILFAMKVVLNAWSDDFVYLHGMILPSKYAAWAELILIQVFIPGT

SEQ ID NO: 39700 - protein, 281 aa, Sorghum bicolor
  Clone ID: SORBI-28MAY03-C33630_1.pep
HGGRAPPGWTPGGLWSSLLGRGIAAPSATQWDGIAVGFGAWQSVARRSFPAQRLWPCPSGGPVFECGGACRPSPRWPPPDAPLAIAGAPTDSASSPPLPQPSPAPRSGASALRAARGAAREEQRQPRVAIYEQRRSSTAQVLVDPPRCAWYARPPAGPRPVPALNSKEIGGLPCKLEGILESPVVNGYRNKCEFSVAFSVVRTLALAFWLSYCWGGLAAGGVPVDCPCVAGISCVFPRTFLVLLLSAGLPLPGKIDNSGFWRQLTRRTARWLCFLRGEGWL

SEQ ID NO: 39701 - protein, 162 aa, Sorghum bicolor
  Clone ID: SORBI-28MAY03-C33629_1.pep
MPLYDCMLLVKPTVTREVVADLVTRVARRACQRNGVVTDVKSFGKVNLGYGIKKLDGRHFQGQLMQMTMMVPPSFPQELHYLNKEDRLLRWLVVKHRDAVYGLEFINEDDGRNELSGYSQAHTKDDYDIEFDSDDDRWDDDDSDDDDEYAIEEEEEKEEKQK

SEQ ID NO: 39702 - protein, 193 aa, Sorghum bicolor
  Clone ID: SORBI-28MAY03-C33643_1.pep
MPATAEDSPAIRKLGQLFRLTEVYLWDDSYGAGPHDGRKNWRSAEAALVDSHTDKTCNEASNGTDKGHLFVEDLELANLMGSLGLPVSFSTSKVNKNTGNKGKKKGRQALLKAAKTQINDAVRICANTEDRESAVESLDVMAHMHSCNLSGTPLGHNEPCHDDTDKMLREDSPCVEEQEESGCSTIYSSDKAP

SEQ ID NO: 39703 - protein, 189 aa, Sorghum bicolor
  Clone ID: SORBI-28MAY03-C33648_1.pep
MQRAIRKAAAAARRALSAAAARASSAPPRGGHLAPGWGATTRWLCSGREALSYDVVIVGAGPAGLAAAIRLKQLCRAADADLSVCVLEKGSEVGAHVLSGNVFEPRALDELIPNWRQEDSPIRVPVSSDKFWLLTKNQAWTLPSPFDNKGNYVISLSQLVRWMGTKAEELGVEVYPGFAASELQESQPM

SEQ ID NO: 39704 - protein, 87 aa, Sorghum bicolor
  Clone ID: SORBI-28MAY03-C27836_1.pep
MTQKQTLFKGQSKKKTIPPNRHGKAPHVRKGKRAVKPTKFTKDMDADKELTKFINQCNEIKAANLASKEGGDLNILKADGDQSKSKK

SEQ ID NO: 39705 - protein, 162 aa, Sorghum bicolor
  Clone ID: SORBI-28MAY03-C27858_1.pep
ARGIDVFRGVYSEGGARALYRGVGPTLMGILPYAGLKFYIYEGLKAHVPEDYRSSVTLKLSCGAAAGLFGQTLTYPLDVVRRQMQVQSQQHHEQFGGPRITGTFQGLLSIKQTQGWKQLFAGLSLNYIKVVPSVAIGFTAYDTMKHLLKIPPREKRSGHGPA

SEQ ID NO: 39706 - protein, 128 aa, Sorghum bicolor
  Clone ID: SORBI-28MAY03-C27866_1.pep
DIMPISIASPYKSTTSSHKTVIIVQKHYYIPHQHTAKELLVAFEESGHYNLVQADEDIMVHWIDGSKHHLQSRLHLPRQLHGRRRLRGHLHARSHLRSHLHGIFVFRVGGVKINLTVDAEATASDSAA

SEQ ID NO: 39707 - protein, 151 aa, Sorghum bicolor
  unsure (1)..(151): unsure at all Xaa locations
  Clone ID: SORBI-28MAY03-C27867_1.pep
FPILDQTTSNSVISTTPNDLSNWSRLSCLWPLLFXYGTCCCFIEFASGLRFYFDHYGLVPRRSSPRQADLNLIFTAGTVTMKMAPSLVRLYEQMPEPKYVIAMGACSITGGMFSTDSYSTVRGVDKXIPVDVYLPGCPPKPEAVIDALTKL

SEQ ID NO: 39708 - protein, 270 aa, Sorghum bicolor
  Clone ID: SORBI-28MAY03-C27256_1.pep
MSSTRVGKSCMDSPDDSADLVSPKETTAFQKNVKLSHENKENLNGITDQGENEGNAKHSTGILTKSSVDNHNTPKHGPNFQSQGLNTSAQVSNSKDIIFSRSKPSELLVDKSAACVDADYEYVNILADTPGIKRGLESPSAWKSPLFTPFPDAYFMSPASRAFDALGLVKQINEQSAAAVEEAHEVLASGGPWKRHNKENSDKENIENTTLKHEHVTSKPPSILMAEARVLDFNECSTPVRKKEDKKSEIALGGSSSSPVTSSYLRMNLR

SEQ ID NO: 39709 - protein, 124 aa, Sorghum bicolor
  Clone ID: SORBI-28MAY03-C27287_1.pep
MRAAQIDPSLAAPPKSRLKRLFERQVLRVSPAERLPSAPPGGGEKQDEVSEPSSLCLDGMVRSFLEDGGGAAERGAAARCCNCFHAGDTSDDEDGPAAADAAAADIAETIKGLVHCASLRERNS

SEQ ID NO: 39710 - protein, 228 aa, Sorghum bicolor
  unsure (1)..(228): unsure at all Xaa locations
  Clone ID: SORBI-28MAY03-C27301_1.pep
MSSMAYRAWNFTGLALPNDLINRGVAKGDAKKPETLELVIKDDYPYAADGLEMWAAIKDWVADYCAIYYGDDGTAWTXLRAAPHAATGCAQRRRRRLCPIGPPLASRPVPDPEVTVTVAESDFLESVTPVAEALGFMSISSGPLGLVGTEVYLGQRPDTEQWTSERSAAEALAVFRARLEEVAGNIERRNADPALKNRTGPVEVPYTLLKPTAQPGPVLRGIPNSITV

SEQ ID NO: 39711 - protein, 219 aa, Sorghum bicolor
  unsure (1)..(219): unsure at all Xaa locations
  Clone ID: SORBI-28MAY03-C27357_1.pep
CGAVLLPPSQTQASSSSPTSPLPSPNPTPRPPAXPSPSPAHRRPNPIPQRQRQRQTVPCRAVGRARGRPPPTAPPPAAAAFDVSHLRPRLPLAPVAEELLPRGHPRSGRFRRPAIGLPTAAEMSGGGGEKMLLFGSFTEDETKLFQGQPLKSPTKSTSKECERMEIQFGTLNFSVLNLEKISISSVVLPAKSANGDTSAITKENPCGNEKKAAGSSLPN

SEQ ID NO: 39712 - protein, 201 aa, Sorghum bicolor
  Clone ID: SORBI-28MAY03-C27369_1.pep
RCRCCRRHGTRRCRSSSCLDARGAAAAAGGTGRGGGAGPRGRAEAGRRRRRAGADAAGAPARAPQAHQVRGGGEDSEQGGQAEARNLHHRLKVRRRGRKRRRRMLKPETPGGNSRQARRFANPRGDGRNRRTSASEAGGRDGSRTQALRDGNKKFRGTSRAGSLDDAGEIWCGSAAWGWGDCRRHSSCGEGKGREEKVGLV

SEQ ID NO: 39713 - protein, 232 aa, Sorghum bicolor
  Clone ID: SORBI-28MAY03-C28601_1.pep
MAATAASSAAADAASNSDEEANYEEYIPVAKRRAMEAERLRQLRLNKSAPTSAASTLPLPPPPPLLPAQASVPDAAAKPSLLVKATQLKRAAPEVTATALRVLPEGALGENLSDNKSLRSVREIAKGIIYTDSIQTGWKPPLRLRRMPLAKANELRRKWHIIVDGDDVPPPARDFRDLRLPEPMLRKLRERGIVQPTPIQVQGLPVVLSGRDMIGIAFTGSGKTLVFVLPLI

SEQ ID NO: 39714 - protein, 233 aa, Sorghum bicolor
  unsure (1)..(233): unsure at all Xaa locations
  Clone ID: SORBI-28MAY03-C2861_1.pep
PALARFDLQGIRRKSDVLKERFNQMFARIIEQRISAERAGGEPPAPDFLEYMLKLEKEGGDGKTSFTMTNVKALLMDMVVGGTETTSNTVEWAMAELMQKPELMAKVRQELDAVVGRDAVVEESHLPQLHYLHAVLKETLRLHPALPLMVPHCPSADATVGGYRVPAGCRVFVNVWAIMRDPAVWKDPQEFIPERFLGGGXRRKWDFNGSEMDYLPFGSGRMIFAGNAMADRM

SEQ ID NO: 39715 - protein, 190 aa, Sorghum bicolor
  Clone ID: SORBI-28MAY03-C28630_1.pep
MSASASSPPAGEENKQEAAPVRHCKGVNDLDKVVLREVRGSSAEVYLYGGHVTSWKDEHGDELLFVSNKAIFKPPKAIRGGIPICFPQFSNFGNLEQHGFARNRTWCVDDDPPPFPVPTSNTAFVDLILKPTEEDLKIWPHSFEYRLRVALSPGGDLMLTSRIRDTNADGKSFSFTFAYHTYFKISDISE

SEQ ID NO: 39716 - protein, 271 aa, Sorghum bicolor
  Clone ID: SORBI-28MAY03-C28675_1.pep
MASPSIPAALRHPHLPAGGGLLFHSSGDPTSRSALSFRIGDMPMRRCQTDVGPVLAARSPGLGNVDNLHQSSSLSRSWDLNRKIDDDHDVLIECRDVHKSFGDKHVLRGVSFKIRHGEAVGIIGPSGTGKSTILKVMAGLLAPDKGDVIICGKKRHGLVSDEDMEGVRIGLVFQSAALFDSLTVRENVGFLLYENSSLPEDHIGKLVTETLAAVGLKGVEDRMPSELSGGMKKRVALARSIIFDDTKDVVEPEVLLYDEPTAGLDPIASTV

SEQ ID NO: 39717 - protein, 219 aa, Sorghum bicolor
  Clone ID: SORBI-28MAY03-C27718_1.pep
INQDLTMTAILERRESTSLWGRFCNWITSTENRLYIGWFGVLMIPTLLTATSVFIIAFIAAPPVDIDGIREPVSGSLLYGNNIISGAIIPTSAAIGLHFYPIWEAASVDEWLYNGGPYELIVLHFLLGVACYMGREWELSFRLGMRPWIAVAYSAPVAAATAGFLIYPIGQGSFSDGLPLGRAGSLDLHSFDLELKQERLGPCQLSPVTQCGILLLQTR

SEQ ID NO: 39718 - protein, 250 aa, Sorghum bicolor
  unsure (1)..(250): unsure at all Xaa locations
  Clone ID: SORBI-28MAY03-C27727_1.pep
MSNRLNMIMTPDGKFVQGFNTLWLLNLEDNHIDSWDEIVKLSYLRSLEQLHLNKNRLKHVKYPSNLSPDGPLDDTAAVPFENLQVLLLGSNDIDDFSSVGALYPLPCLRDVRLSDNPIADPAKGGAPRFLCLXARLGKVGILNGSEVCPRSRKESQGRYIRLVMGKIESNDLEEIKRLHPRFAELKSFHGIEDEKPTSSTSLPQKMASGLMSVTLKCVGPSMGEKQPLTKKLPATTTVTREVEIFVRKLP

SEQ ID NO: 39719 - protein, 134 aa, Sorghum bicolor
  Clone ID: SORBI-28MAY03-C27777_1.pep
MAAAALRPAILRRIRLSPTPSLALAAAGAGASSHPHALARWLARPMSSHDAHLTREEVVDRVLDVLKSHPKVDPSKVTPEAHFEKDLGLDSLDTVEVVMAIEEEFKLEIPDMEADKIDSLPLAIEYVANHPMAG

SEQ ID NO: 39720 - protein, 191 aa, Sorghum bicolor
  Clone ID: SORBI-28MAY03-C27801_1.pep
MPGLTAPSDYAEEPPRHPALKINSKEPFNAEPHRSALVASYITPVDFFYKRNHGPIPKVEDLSRYTVTISGLINKSIQLSMGDIWALPKYNVTATLQCAGNRRTAMSNVRKVRGVGWDISALGTATWGGAKLSDVLELVRIPKLSSVTSLGGKHVEFVSVDKCKEEKGGPYKASIPLKQATDPDADVLLAY

SEQ ID NO: 39721 - protein, 74 aa, Sorghum bicolor
  Clone ID: SORBI-28MAY03-C27816_1.pep
TRLYFTRIVVYALKTVASYKYRWVSVLAEEMATLAFYLFMFYTFRPAEKSHYFSLDEDEEEAAEMVLREEEFEL

SEQ ID NO: 39722 - protein, 113 aa, Sorghum bicolor
  Clone ID: SORBI-28MAY03-C27822_1.pep
RKPLLVAEFGKSRRDPGYSGDGQRDAVFAAVYAKVYNSARAGGPAAGALFWQLLTEGMDSYGDGYEVVLRQAPSTTGVITTQSRRLQGLVRAFVRARKVQRGKTGKGAKGGGN

SEQ ID NO: 39723 - protein, 140 aa, Sorghum bicolor
  Clone ID: SORBI-28MAY03-C28816_1.pep
HEASPHFHSAPPPVELHDPRAMAAKHQQQHHFLIVTYPAQGHITPARHLARRLASACPGGARVTICAPLSAFRKMFPGAAAAVAVTGEECGGDGDGDGDESVAYVAYSDGYDGGFDVAVDSYARYMEEARAAGSRSLARV

SEQ ID NO: 39724 - protein, 337 aa, Sorghum bicolor
  Clone ID: SORBI-28MAY03-C28861_1.pep
MGPRSAMGCSSLPSSRALWLTTAVVAALAAGAQASLSPGFYDATCPGLQPIVRRVVARAVQMEPRMGASLLRLLFHDCFVNGCDASVLLDDVPGSFVGEKNAGPNANSLRGFEVIDAIKAQVEASCNATVSCADIVALAARDAVNLLGGPRWSVPLGRRDARNTSANAANANLPPPDASLPTLLSMFGAKGLDARDLTALSGAHTVGRARCVVFRSHIYNDTATTNATFAAELRSTVCPYTGGDANLAPLKLQAPDVFDNGYFRDLVTRRVLLRSDQALYDGGNGTTDALVRAYAANGTAFAADFAAAMVRMGNLGPPAGSAAAAATEVRLNCRRVN

SEQ ID NO: 39725 - protein, 141 aa, Sorghum bicolor
  Clone ID: SORBI-28MAY03-C2889_1.pep
TRSTSTPSSSPTPRCAGWSPPAPASGSSVCVTAAACAASTSATSGCPTSGASPSSTAPAPPSCGSRSRSASGPSASAAPSSPATSSLAPRALLSISTSALAGQRPAFPQPTCCTQFLAYRTSLSSPSAALPSSMFLPQPRL

SEQ ID NO: 39726 - protein, 277 aa, Sorghum bicolor
  Clone ID: SORBI-28MAY03-C2894_1.pep
MATQLATRGLPLASRGRSSCAASCSSCPPSSPRLGRRPSRRFRCSSPQVDAAAAPPAKGGEYRPSFADDLLLAFFRSKMVEEVGWDSEKPGYAGLMEVANRLMVKGKSAMETEQAAVRVLQSLFPPVLLVLYKALLSPIANGQLAAMMLARATALSCQWLMGPCSVNSVTLPDGKSWSSGVFVEKCKYLEESKCLGICINTCKLPTQTFFKDHMGVDLYMEPNFEDYSCQFNFGVPPPPLDTDKALKEPCLDICTNARRRRELGRNSSPDELSCPQV

SEQ ID NO: 39727 - protein, 84 aa, Sorghum bicolor
  unsure (1)..(84): unsure at all Xaa locations
  Clone ID: SORBI-28MAY03-C28991_1.pep
CSLTGMDSQSSMHPLDPAFCRPMNSQHPFLNGVSDAASQVXLSGKTTFKAXFTWISGKVRRSLPPLRIATTVXANSPHENGALT

SEQ ID NO: 39728 - protein, 231 aa, Sorghum bicolor
  Clone ID: SORBI-28MAY03-C27877_1.pep
MAPPAEPRRPYKRPAISDQQRRRELALQAQSARRADAQARARALATSLLTTQAPAAATRRHEEEEYDEHVEEDQEHELTVAGVAAAAAASRLRGADARRWFARQIMLPEWMVDAPPHLSTDWHVFARPSGKRCLVVSSNGMTISRVRNGSILHRFPSALPNGSKRDISGPASSYSILDCIFHEPDETYYIIDMICWRGYSLYDCTAEFRFFWVNSKIAETSAGDPPSTYHR

SEQ ID NO: 39729 - protein, 123 aa, Sorghum bicolor
  Clone ID: SORBI-28MAY03-C27880_1.pep
PSSCLPAFLYTVIAAHLITHKLYYILILYTTYCTTYEDHDQGGGSRVLLCTCRVHYKSLADLPSNGSSLRDLDCTHSNYQTLTRPVLLFIVTTSPCQDWVICAPAAFLGCGSRFSGSLSGIEP

SEQ ID NO: 39730 - protein, 125 aa, Sorghum bicolor
  Clone ID: SORBI-28MAY03-C27985_1.pep
DERELKRERRKQSNRESARRSRLRKQQECEELARKVADPTTENSALRAELDNLKKACQDMEAENSRLLGGMAHSQGPSVTTTLGMSIDPPKVQHHDDEGQLHKKSSNNSNGNYAGVSHKPEANTR

SEQ ID NO: 39731 - protein, 75 aa, Sorghum bicolor
  Clone ID: SORBI-28MAY03-C28373_1.pep
FPDFHGAVVSRILTTHRIALLQTSMPCLLREASKLIPGARDKTKRRSICFCKIALTNLILLAILLASSSRKEHAR

SEQ ID NO: 39732 - protein, 330 aa, Sorghum bicolor
  Clone ID: SORBI-28MAY03-C28471_1.pep
KENLNILLKDDDGQALAGGSALLHRETGAHIIGTSRSTEERSGECNHLRDKAITLDLLLGTGNSITNSDIGDLYKENTDDILIDNQGANEACEQFYKAKQPSGSSSKDQNISAAAEMKNNSPPVELKNTSAAVKVESIYAPVEVDSTSAPALEQESFLEKSPSRKPVSPGNKQELEPKTRQKKKVSFFTKKQRKEASRTPDAKEKTEGMSSAAKNQRSTASDVAKEKTESTPSAATGPGGKKRKSGIEPANAEKPSSAVKKQKTGKPSSAATRAPKAKNAGPATKKQETESSSSTEKTASAPLKLQVEKAVLVVNSRRSQRVRKPKVFAE

SEQ ID NO: 39733 - protein, 104 aa, Sorghum bicolor
  Clone ID: SORBI-28MAY03-C2845_1.pep
AEGIKFTAGYLQSTGLNLQELCVRAALAGLCFHGYQKLSYLILSRVSPVTHSVANCVKRVVVIVSSVLFFSTPISPVNALGTGAALAGVFLYSRLTRTKKPKDA

SEQ ID NO: 39734 - protein, 168 aa, Sorghum bicolor
  Clone ID: SORBI-28MAY03-C2922_1.pep
VRPRVRTTYFKPFAGYYFSGDGCSRDKDGYHWLTGRVDDVINVSGHRIGTAEVESALVSHPKCAEAAVVGIDHEVKGQGIYAFVTLVDGVPYSDDLRKSLVMTVRSQIGAFAAPDKIHWAPGLPKTRSGKIMRRILRKIASRQLDELGDTSTLADPGVVDQLIVLSDS

SEQ ID NO: 39735 - protein, 153 aa, Sorghum bicolor
  Clone ID: SORBI-28MAY03-C29251_1.pep
QMERIEKWNSGEKIGERAASEWLFIVPWGLRKVLNYIVKKYNNPVIYITENGMDDEDDQSATLDQVLNDTTRVGYFKGYLNSVAQAIKDGADIRGYFAWSFLDNFEWAMGYTKRFGIVYVDYKNGLSRHPKASALWFSRFLKGEAAENKPDTN

SEQ ID NO: 39736 - protein, 187 aa, Sorghum bicolor
  Clone ID: SORBI-28MAY03-C29296_1.pep
IKKDEKAYHVNLLNYHSNMVETLKNWRKRWLSCGDTENFFRDNPGNQMQGVMQLKATKSVMPMKVAQRIDVSKFMSYIKVSRTQLNHIKRLKQSGDGIQTKHVSRVIGGLDKSHVKPYGALLEDEQRRLREHWLKMSCNDLPAFFEVLRERKVLMEKSRKLLGLELEQKNVSVLRKVRCDLPFKSLS

SEQ ID NO: 39737 - protein, 119 aa, Sorghum bicolor
  Clone ID: SORBI-28MAY03-C29387_1.pep
CPPRGGRGGARTDWAMHEYRLLPAGLNLHGCAANAPPPTNVSSLAGGGAAADWVVCRIFRRARPAHRARLVGGREEEEEHAAEESPSSPSSCVTDASEAMDQEEDDGDEGSSCSVASSN

SEQ ID NO: 39738 - protein, 165 aa, Sorghum bicolor
  Clone ID: SORBI-28MAY03-C29347_1.pep
MSGHHGYDHPHPEKQNYRMPPNEARDGTANSNEGPNVSSSMMDAMKKINKDKVKAALEKRRKSKGDLSRKADVMDDDDLIERELEHGVELAVEDEKIKQERRQGWPHPAHRVDHQSTNRENTEEGELSMDSQEYHSPEHDNRKRKDAHEHRNYDRDERDLKRLRS

SEQ ID NO: 39739 - protein, 232 aa, Sorghum bicolor
  Clone ID: SORBI-28MAY03-C28692_1.pep
MSSAQDPFYIVREEIQDSIDKLQSTFHRWEQTASNTGEYVHLTKELLTSCESIEWQVDELEKTISVASRDPAYYGLDEVELSRRRNWTGSARKQVGTVKRAIEKGKSNAATSKYQDTSRPNHYSAQDNDDFISSESDRQLLLMRQQDEELDELSESVQRIGGVGLTIHEELSGQERILNDLSLEMETTSNRLDFVQKRVAMVMKKAGIKGQIMLIAFLVVLFIILFVSVFLT

SEQ ID NO: 39740 - protein, 279 aa, Sorghum bicolor
  Clone ID: SORBI-28MAY03-C28741_1.pep
HEGREDWSADEFQRNVVKEREGKRPLLTGDVSLTMRDGRAPGGELQFTDNSSWVRCRKFRIAVRAVPGTTCGDGARIQEAMTEAFMVRDHRGELYRKHYPPVLADDVWRLEKIGKEGAFHRKLKRSNVGNVQEFVRMLMVKPDELRAILGDGMTDRMWEATTNHAKTCLPGDQVYAHVTQHGTIYLNSIFDILRVDTSGVEWPLQQLNRGQTMMVQQMLLDAYEHRHSLQEAEAFMLHGHAANNNVPLLQNAAAHVALPAPADTPLWFPNAAEMDFPVD

SEQ ID NO: 39741 - protein, 84 aa, Sorghum bicolor
  Clone ID: SORBI-28MAY03-C2876_1.pep
DISCLLTVELFRIPKTTIPSVWLKQHEKLALTLNQQKSHLTGYELVLFPCHHSRCSLLNTFCYWREEISYCPLKRHMMVWSYLC

SEQ ID NO: 39742 - protein, 179 aa, Sorghum bicolor
  Clone ID: SORBI-28MAY03-C28796_1.pep
SGTRTVDQNVWGEIRNFKKCLLKMFAQQDKDVVFMETVISLARQRRHCMIECIPVPSEVSSNAPMYFKKAIDEAEEEWTQHEMKKVIPTSASRNLRQVIPENFAYFHVEFGLDRGFVHVIDDESKFSAGFGLNVIRGMLQLPEEDMHRRRRHESMDNQRQAVASFMKDWEPFDWTKQLD

SEQ ID NO: 39743 - protein, 234 aa, Sorghum bicolor
  Clone ID: SORBI-28MAY03-C28798_1.pep
MQIFQVTTMILQPRLLSWFFSTLLLTQLMMASTAAAESTVKVSTTPIFPQIPLGQARKDFQVLLRVEAPTAAVRPEARVPIDVVAVLDVSGSMNDPAAVPPERRPTTSRLDLLKTAAKFMVAKLEDGDRLSIVAFNDRPVKELSSGLLYMSADGRRKAMKSVDQLEARGGTALVPAFEEAVKVLDGRVGDGRNRLGFIVLLTDGEDTSGFTLSERRREVIRGALGRYPVHTLGL

SEQ ID NO: 39744 - protein, 191 aa, Sorghum bicolor
  Clone ID: SORBI-28MAY03-C29556_1.pep
HAATSSILRVFNHKRSSANVITSSSGLSLSVLTIQSLLACGAVFLHAYAEGLALGVAARKAYGLGRYMVLPASLHGLPRGAAAASCVYGATDSWRGALAAAALTGFAAPSAAISAILAKIDYDGLDYWMVIACGALIPSFGRVFRRSLRLGMRKSIVGLLIGIAFASVCLMSTRFICLHTPYCNSAPEAVT

SEQ ID NO: 39745 - protein, 195 aa, Sorghum bicolor
  unsure (1)..(195): unsure at all Xaa locations
  Clone ID: SORBI-28MAY03-C29538_1.pep
FRRTDESLLQESTKGNWQDGATAVCVWILGQTVVVANAGDAKAVLARSVSTEGEGMXSRAXRRLCALVLPCVLNALFPLGPSPLPKAGGSVGSNGRLQGRIEVSRAFGDRQFKKVGWVQLPPSRFLSPTXYVHFIILGCDGFWGVFGPGDAVEFVQNQLKETSSATLAVRRLVKEAIRERRCKDNCTAVLVVFKH

SEQ ID NO: 39746 - protein, 95 aa, Sorghum bicolor
  Clone ID: SORBI-28MAY03-C29595_1.pep
QDYDAVMNKGFFHGYSFITVLMILNHALSGIAVSMVMKYADNIVKVYSTSVAMLLTAVVSVFLFSFRLSLAFLLGSTVVSVSVYLHSIGKLQPQK

SEQ ID NO: 39747 - protein, 95 aa, Sorghum bicolor
  Clone ID: SORBI-28MAY03-C29598_1.pep
NKLQQKGSFMYLCQHPVIHPPEPNKSSIIAPAICTSHQTCSFFSPLSQHADNGSMVGRFIPVCAANSDFNHPRGHAHSRKYHLWKILHCFVIDCG

SEQ ID NO: 39748 - protein, 201 aa, Sorghum bicolor
  Clone ID: SORBI-28MAY03-C29627_1.pep
FDPYKVTIGSEELKANHAIVQHVEILSESQKYNKLVNLLEDIMDGSRILIFMDTKKGCDQITRQLRMDGWPALSIHGDKSQAERDWVLSEFKSGKSPIMPATDVAARGLDVKDVKYVINYDFPGSLEDYVHRIGRTGRAGAKGTAYSFFTAANARFAKELISILEEAGQKVSSELAAMGRGAPPPSSGYRDRYRGYGGGRS

SEQ ID NO: 39749 - protein, 83 aa, Sorghum bicolor
  Clone ID: SORBI-28MAY03-C29018_1.pep
KKAVSFLYYDLDVYRTQKLVMKMSKQKAELHVFTQPVLLLSPFRHTTHQFASPKRRCSDSYIYMQLILGSRACRTPFYKNQAD

SEQ ID NO: 39750 - protein, 136 aa, Sorghum bicolor
  Clone ID: SORBI-28MAY03-C2912_1.pep
NLNLCSSRQPCFCDTPFVLVLNKYDLFEEKINRAPISSCEWFNDFCPVRTNHNNQSLAHQAYYYIAMKFKDLYFAQTNRKLFVWQARARERQTVDEAFKYVREVLKWEEEKDENYYQEESFYSTTEMSSSPFIRAE

SEQ ID NO: 39751 - protein, 95 aa, Sorghum bicolor
  Clone ID: SORBI-28MAY03-C29032_1.pep
DPADATLFANRSLCRLRMGDGRKALTDAVACKSMRPGWSKACYREGAARMVLKDYEKACGAFLDGLKLEPGNAEIESALWEALESLKISHKKEKE

SEQ ID NO: 39752 - protein, 156 aa, Sorghum bicolor
  unsure (1)..(156): unsure at all Xaa locations
  Clone ID: SORBI-28MAY03-C29141_1.pep
PRAPPWHPRRPCGGPGRVPAPGGRVRVGPARVRRPGGCPPHPGAVPLYQLSPPEDLTLGLMLIKPANAFSTGNPDDEAVTRDEKLLTEEGYGSARRVFVVVEEDARXPAEFQRRMVAQSPGVEVRTEITGADHMAMLSRPVELVQLLVSIADQSEE

SEQ ID NO: 39753 - protein, 169 aa, Sorghum bicolor
  Clone ID: SORBI-28MAY03-C29145_1.pep
ARGGLPPKYQATIASQDSLSTVGKKPNSAFKAIVEEHSPSSSIPSSGEAISSVTAASPPSSSLAHRTATLGPAGDQSILGRAASRANSMGDVERKMMQEMPGVFTKGLPNGNRVEGFLYKYRKGEDVRIVCICHGSFLTPSEFVEHAGAGKVDNPLRHIVVNPTPTPNL

SEQ ID NO: 39754 - protein, 314 aa, Sorghum bicolor
  Clone ID: SORBI-28MAY03-C29216_1.pep
TRITAAQSIRQAGSTRDLVILVDETISDHHRRGLEAAGWKVRIIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDSQAMKAKKTQLFGADPPILYVLHYLGLKPWLCFKDYDCNWNNAGMREFASDVAHARWWKVHDKMPRKLQSYCLLRSRQKASLEWDRRQAEKANSEDGHWRRNITDTRLKTCFEKFCFWESMLWHWGENNNRTKSIPMAVKTASLARS

SEQ ID NO: 39755 - protein, 150 aa, Sorghum bicolor
  Clone ID: SORBI-28MAY03-C29774_1.pep
KTKKESTCPSYTKAKKYCAANLFPFREHYVYQKTVLPWPRGKKGPFSHLYSLLSNWIHTAQSHPLQTEISTSSALKPPYLQRIRPRLWKDNACLKNCCSVTNSSLGKHYSAQNFCLSSCHFLTEPSNSGNAERTSSSRSSNASCFKQTGD

SEQ ID NO: 39756 - protein, 268 aa, Sorghum bicolor
  Clone ID: SORBI-28MAY03-C2980_1.pep
KIDPDDTTGLKPPNVYGSIEFKNVDFSFPARPDILVLSNFNLKVSGGQTVAVVGVSGSGKSTVISLIERFYDPVSGQVLLDGRDLKSFNLRWLRSHMGLIQQDPVIFSTTIRENIIYARHNATEAEMKEAARIANAHHFISSLPHGYDTHVGMRGVDLTPGQKQRIAIARVVLKNAPILLLDEASSAIESESSRVVQEALDTLVMGNKTTILIAHRAAMMKHVDNIVVLNGGRIVEQGTHDSLMDQNGLYVRLMQPHFGKGLRQHRLM

SEQ ID NO: 39757 - protein, 74 aa, Sorghum bicolor
  Clone ID: SORBI-28MAY03-C29805_1.pep
RQHRNYEFARKMLLRSLELCPGYAPASNNLGLVFVAEGRWEDARSCFEKALQSDPLLDAAKSNLSKVLALSKKQ

SEQ ID NO: 39758 - protein, 136 aa, Sorghum bicolor
  Clone ID: SORBI-28MAY03-C29839_1.pep
TGSAYIEFLHKESAEQALTLNGTSFMSRILKVVRKSSTEATQLPGLARPSWGSPFASRLIRTAYPRPTFPGAIRGRLPLRGVARSLQWKRGAADSADAGKPSQTAPAAPANQSVTPTIRSFTYTRTEPKPNDGAMA

SEQ ID NO: 39759 - protein, 186 aa, Sorghum bicolor
  unsure (1)..(186): unsure at all Xaa locations
  Clone ID: SORBI-28MAY03-C29393_1.pep
ARGTSPWFLPFAYVAVAAYFCSLVESLQCGDTAKXLEWWNAQRMWLFRRITSYLLAAIDTIRRLLGITESGFTLTAKVTDSQALERYKKGMMEFGSFSAMFVIITTVALLNLACMMLGVTKVLLHKGAMSLGAMFVQAVLCALLVALNFPVYEAVFLRKDSGRLPASVSLISLCIVMPLCILPTNF

SEQ ID NO: 39760 - protein, 163 aa, Sorghum bicolor
  Clone ID: SORBI-28MAY03-C29452_1.pep
VLRDPWARHAQPQEPIEETWPESQDHQWTNPPFHTGRYSTDPYGASGSRPPPQFDAGRYSDASYAFTNDYYQEAGAFFTRTENTLLDIQNTQAEHGRLLEEQQKWNQDHAAAVQELRQDTTTTHARSGTGTRGKTDVNIQLGGVPPNLSSKFLFALLIYSIFG

SEQ ID NO: 39761 - protein, 114 aa, Sorghum bicolor
  Clone ID: SORBI-28MAY03-C29490_1.pep
ETFQIKEGDFLTFDALRQAAQCVGRVIRSKADYGMMIFADKRYSRHDKRSKLPGWILSHLHDAHLNLSTDMALHIAREFLRRMAQPYDKTGSGGKKTLLTEEDLQNMAQDGMEM

SEQ ID NO: 39762 - protein, 85 aa, Sorghum bicolor
  Clone ID: SORBI-28MAY03-C29473_1.pep
YAGETATSKKKRRTPAWCDRILWHGDGIAQLSYFRGESQFSDHRPVCGTFIVDAERLDGKSKRRSSNTNIRIGAEELLPTSNKHN

SEQ ID NO: 39763 - protein, 170 aa, Sorghum bicolor
  Clone ID: SORBI-28MAY03-C29491_1.pep
IYEEGIAELVPGVLFIDEVHMLDIECFSYLNRALESPLSPIVILATNRGICNVRGTDMTSPHGIPVDLLDRLVIIRTETYGPAEMIQILAIRAQVEEIDIDEESLAYLGEIGQQTSLRHAIQLLSPASVVAKTNGREKICKADLEEVSGLYLDAKSSARLLQEQQDRYIP

SEQ ID NO: 39764 - protein, 253 aa, Sorghum bicolor
  Clone ID: SORBI-28MAY03-C29997_1.pep
MECNGCYALKSRRFVAIADAGFEDAADGDTDFGDTMSLAHKEKVVEETVEMEEEEQGLVGKSNQLPYKDDDDFDFVLPGSSKQRASTSGEMPLSGKMDPRLDRSGSNGTSKVPRLGSMLGTASMAGFGKAVEILDTLGCLMTTLSSDGGFVSRSKTKGCKISILAFEVANTILKGASIMQSLSEDTVTYFKRVVLPSEGVQNLVSSDMSEVMRITANDKREELRIFSQEIVRFGNRCKDPQWHNLDRYFVKLE

SEQ ID NO: 39765 - protein, 158 aa, Sorghum bicolor
  Clone ID: SORBI-28MAY03-C30004_1.pep
MASSAAASSSASALVRLPGPGHLRALPRSGWRDHRRPRRAIVRCSFAPVETARIKVVGVGGGGNNAVNRMIGSGLQGIEFYAINTDSQALINSQAQYPLQIGEQLTRGLGTGGNPNLGEQAAEESREAIATALRDSDLVFITAGMGGGTGSGAAPVVA

SEQ ID NO: 39766 - protein, 135 aa, Sorghum bicolor
  Clone ID: SORBI-28MAY03-C30010_1.pep
MAIKMDKTSIIVCSVIGSLGLLSAILGFSAEGTKLTPYTTLLYRDDCLYPRNPSSGLGLSAASFLVVLKLTFAALSSSSGCSRSPSISSQSKGIVPILFAVLSSLAAVFPAPPCLLGAAWTPIVMLHMHAAIYHT

SEQ ID NO: 39767 - protein, 155 aa, Sorghum bicolor
  Clone ID: SORBI-28MAY03-C30028_1.pep
MEYRRVKDQEIYDDLSQKDVESLSGRTLSSANTSGLSSTGGAKGKSSWKLKSVVTLALTLLTSSQAILIVWSKRAGKYEYSVTTANFSVEALKCLLSLAALFRTWNRHGVTDDNRLTTSFDEVGVYPIPAVLYMVKNLLQYYIFAYVDAPAYQIL

SEQ ID NO: 39768 - protein, 72 aa, Sorghum bicolor
  Clone ID: SORBI-28MAY03-C29641_1.pep
YDGLIGIDKQHHTTGTGFIKVERPNGGTFSATTNGYSSASFVRCTSNPATNDWIPSSETVIPASNKPSRSDS

SEQ ID NO: 39769 - protein, 96 aa, Sorghum bicolor
  Clone ID: SORBI-28MAY03-C29659_1.pep
AYSLKNTINEGKLSISDDDKQKIQGKVEEIISWLDNNQTAGKDEYESQQKELEAIANPIISAAYGGAAPGGAPEGAAPGGGARSADEVEEKPEELD

SEQ ID NO: 39770 - protein, 185 aa, Sorghum bicolor
  unsure (1)..(185): unsure at all Xaa locations
  Clone ID: SORBI-28MAY03-C2969_1.pep
RHSKIFLKFPSKFWPVGEGKXFFVYASSRRGYYGCGSRSSGDPGANVLLVTVTDDESRRIEQQSDNHTKAEVAAVLRDMFPDADVPAPEEIDIYVPRWWSNRFFKGSYSNWPIGVSRYEYDQLRAPVGRVYFTGEHTSERYNGYVHGAYLAGIDSANILINHIFKNEEYKVRGKYEPDDQIAKAK

SEQ ID NO: 39771 - protein, 173 aa, Sorghum bicolor
  Clone ID: SORBI-28MAY03-C29702_1.pep
VTASDPIHYATAADKITHALRLHEVRTTSPPSMVPARLQHAQTIPPGLPWSTRPRLCRRPCCTRSSTICCRRSRCSCSGSPPSPTSAPRTATTRGSRKAPGRLAASPPLPSVVCPSCLACTPRSPGWPGTQQRRGCRALSRRRRRRLRPRTQALAGRTGPPRRTRPGGPSWRG

SEQ ID NO: 39772 - protein, 186 aa, Sorghum bicolor
  Clone ID: SORBI-28MAY03-C29720_1.pep
ILVQTDDGHKHRRGSHGDIIFLTSRGEVTSYSPGLLGHDAVWRWQVSSGATWSNLPSPSGMMENIVVPTLKAFSLRAYDPKEVIIAGGDQEAVVLSPSGSILAMIELPAPPTHALLLEDFSGDGLTDIILVTSGGIYGFVQTRQPGALFFSTLVGCLIVVIGVIFVSLHLNSSNGGKPRASSAEYR

SEQ ID NO: 39773 - protein, 122 aa, Sorghum bicolor
  Clone ID: SORBI-28MAY03-C29736_1.pep
LCLLIHSSCKITKLGIGGPLVTLDGDVVGMNFYDKKIGTPFLLWPDIAEILASFEKRSKTGEIFNDISGVPLWKLDGDHSNRFNRWPVPMPCWRCPDYVDEDKFDANDREYCYVKGVKFRLL

SEQ ID NO: 39774 - protein, 210 aa, Sorghum bicolor
  Clone ID: SORBI-28MAY03-C33734_1.pep
MKSGSCRHVFLVGSRQLLLVAPWQGETAAAARALNFTRQDFPRAFVFGAGTSAYQYEGATDEDGRSPSIWDTFTHAGRMPDKSTGDLGADGYHKYKEDVELMSDTGLEAYRFSISWSRLLPRGRGPINPKGLQYYNNLINELIKRGIEIHVTLYHLDFPQILEDEYHGWLSPRVVEDFTAYADVCFREFGDRVKHWTTMDEPNVISIAAY

SEQ ID NO: 39775 - protein, 300 aa, Sorghum bicolor
  unsure (1)..(300): unsure at all Xaa locations
  Clone ID: SORBI-28MAY03-C30250_1.pep
LLGLRRSVQSPPPRRPPPHLLPFLPRSTLLAHPPLWAPFDSSYLLLLAAVFATAGVGEAVYIPYNTSAGVVPGKLNVHVVPHTHDDVGWLKTVDQYYVGSNNSIQGACVQNVLDSLIPALLKDENRKFIYVEQAFFQRWWRNQNDMIKDTVKGLISSGRLELINGGMCMHDEAAVHYIDMIDQTTLGHRYSMAVVGLVPRLGRPLLPLAHSALLAHLLAALVGWVPFYFFRIDYQDRDTRKGTKELEVVWRGSKTLGSSADIFAGIFPKNYEPPPGEFYFEVDDNSPVVQHDPXLFDYNV

SEQ ID NO: 39776 - protein, 239 aa, Sorghum bicolor
  unsure (1)..(239): unsure at all Xaa locations
  Clone ID: SORBI-28MAY03-C30268_1.pep
MLRAVARCCGHWPPGAAAADGMLWQTELRPHAAGEFSMAAAQANVTMEDQAQVLASPAATLVGVYDGHGGADASRFLRSRLFPHVQRFAREQGGMSAEAIRSAFGAAEEEFHKQVRQEWTKRPRLAAVGSCCLLGAISGDTLYVANAGDSRAVLGRRVVGGGXVAVAERLSTEHNAASEEVRRELTALNPDDAQIVVHARGAWRVKGIIQVSRSIGDFYLKKPEYSLDPLFRQVGAPIP

SEQ ID NO: 39777 - protein, 170 aa, Sorghum bicolor
  Clone ID: SORBI-28MAY03-C3036_1.pep
RPSFAQLGACGGHAHAAASASRGAAGRRPPSVAAMSSSTPPPGPVQKSEEEWQAILTPEQFNILRRKGTEYPGTGEYDKFFEEGIYKCAGCGTPLYKSSTKFNSGCGWPAFYEGLPGAIKQTPDPDGRRTEITCTACGGHLGHIFKGEGFKTPTNERHCVNSISLKFTPS

SEQ ID NO: 39778 - protein, 209 aa, Sorghum bicolor
  Clone ID: SORBI-28MAY03-C30400_1.pep
ARGYSQEIITTRELKNLVNDILQHYPDLMEGFNEFLEHCENIDGFLAGVFNKRPTARVVKTEDKEKDRDRDREDREGDREKEREKERERLDKGSTFNSKEGSSHKPPMFSGKEKYNLSKPISELDLSNCQRCTPSYRLLPKNYPMPPASNRTDLGASVLNDHWVSVTSGSEDYSFKHMRKNQYEESLFRCEDDRFELDMLLESVNAATK

SEQ ID NO: 39779 - protein, 170 aa, Sorghum bicolor
  Clone ID: SORBI-28MAY03-C30420_1.pep
ARGDLRALAAPGCFRAPRTSCLEVAVYYLGTRGASSRCGGVVAAACRRKRLVGVFRVELASSEWRDGKPVLLHHGWAGIGKGEASARPELHLRVKLEADPRYIFQFDDDIALNPQVVQLHGSIRQPVFSCKFIRDRRPSQSDPLGGGGQYWSSSSSEEKDMEMVRRERKG

SEQ ID NO: 39780 - protein, 167 aa, Sorghum bicolor
  Clone ID: SORBI-28MAY03-C36574_1.pep
TRAPPARTHPSDSFSIRFAHESALRFQTLASSHPPRTLDPKSNPRHPLIAVLDASLCSRYRRGPPGLILLYPRSRGRMGEAKDNEVYEEDLVDYEEEVENVVDGAATNGSADVVKKGYVGIHSSGFRDFLLKPELLRAIQDCGFEHPSEVQHECIPHAILGMDVICQ

SEQ ID NO: 39781 - protein, 146 aa, Sorghum bicolor
  Clone ID: SORBI-28MAY03-C36596_1.pep
MEAGGAGNGSNGAAQTKGSGGDGSTKTPPPLPPCCVKARAAAPESEAKCHATVVSGWFTEPRSHCGKASKVQYYNNPMWPGEAHSLKVEKILYQGKSPYQEVLVFESSTYGKVLVLDGIVQLTDKDECAYQEMITHLPLCSIPSPK

SEQ ID NO: 39782 - protein, 274 aa, Sorghum bicolor
  Clone ID: SORBI-28MAY03-C36612_1.pep
MADGNSRFGHVLTSLPKPGGGEYGKYYSLPALNDPRIERLPYSIRYLLESAIRNCDGFQITEKDVENIIDWENTAPKLVEIPFKPARVLLQDFTGVPAIVDLASMRDAMAQLGDDPGKIDPMIPVDLVIDHSVQADVVKSENALQANMQREFDRNKERFAFLRWGSTAFNNMLIVPPGSGIVHQVNLEYLGRVVFNTDGILYLDSVLGTDSHTTMIDGMGVAGWGVGGIEAEATMLGQPMSMVLPSVVGFKLTGKLRDGVTATDLVLTVTHILR

SEQ ID NO: 39783 - protein, 112 aa, Sorghum bicolor
  Clone ID: SORBI-28MAY03-C36613_1.pep
TEGSQEEHKKNQSAGLHPTSWAIFFLLAIRSKQSNRCEDPIPFGGSHEVDFSVWSVRTVMGMVHPRFLVACSGSKLCFISSCCSSRAKMMISFLRRRPECSCTLPILIEFSR

SEQ ID NO: 39784 - protein, 262 aa, Sorghum bicolor
  Clone ID: SORBI-28MAY03-C3664_1.pep
HEGQENMEESTKTENGSLRSSLNDSTNTKAPKEDTLGEEQTGLVLESLPEDKSVDAVSEQAPLLTESGMTDANDLSSDTASVQNPVSAKEDKPTESANIEATCSTDIQLENEEVDKNEEEQHANTATDEVSEENVESSHVNLQKITSSEVTSNELATQITEPVCDTQTILAHEKEISEENFPTAVEIQADGPNLQINQDKQDEVADNESAMELEKVGESNFQEHQEIGTEQKSPEEIDEGGQQLLAKKEILTHELDVHETVE

SEQ ID NO: 39785 - protein, 163 aa, Sorghum bicolor
  Clone ID: SORBI-28MAY03-C30553_1.pep
MQERPKDSGGTDAAVHATFRLVPQGTNSTAAATLEPLDMPGMVVTDTLTVSAEKSSGALFNVVPGLAGAPGSVSLELGSRPGCFLVAGGSGEKVQVGCTGGVKKHGNGGGDWFRQAASFARAEPMRRYRPMSFAARGVRRSFLLEPLFTLRDEFYTIYFNLVA

SEQ ID NO: 39786 - protein, 106 aa, Sorghum bicolor
  Clone ID: SORBI-28MAY03-C30559_1.pep
TLHLPWLCMISYHTRVRASVIVSHVGPYINSLTIYISGILFELSCNLRPPHHASGLPSAVPSLLPFTSTSVFPFSAVPFLLELASSTLVFSLCSASSAVLLLPPSA

SEQ ID NO: 39787 - protein, 78 aa, Sorghum bicolor
  Clone ID: SORBI-28MAY03-C30589_1.pep
PIPSPELRQEETGEGGTTATPNFLQYTTDNCPETPIIHHQQAAARRSVQLVQVKSKNSPHPRVVTRPVDDNISAVSRV

SEQ ID NO: 39788 - protein, 246 aa, Sorghum bicolor
  Clone ID: SORBI-28MAY03-C30641_1.pep
MLVASLRPGPSPAAFPASARRSPVPFLPFPARLHHRSLLLSATAEGTGAPAGQGDASDAPVDEARLPQFAVDWEAARTYKDQGNILTLPVLRANSGGLIVRFNSLQGFVPNPLLSPAHWCEDPKRPIQDITKDLVGTSISVKVAEVNEEERKLVFSEKDASWSTYSSLIKIGDIYDGIVGSVFPYGAFVHLRFPDGPYHLTGLVHISEVSWDLVQDVQDFLNEGDAVKVIVVNIDTAKSRIALSIK

SEQ ID NO: 39789 - protein, 194 aa, Sorghum bicolor
  Clone ID: SORBI-28MAY03-C30672_1.pep
ASSRGRRRRGPSDRPRPARRGQPGPARPRRRGCRRGARASGGRRRPTRSARGRPARGAGPRRGTRPAARPGTAHPCASASWAPLPSRAQRPPSRTRASATGRRREPHRLCIPGTKTCQAAKDQERRRRSRSFAPRTPEARSETKKRKRSSSSTGSEGGFRGRRPNPIAYRDREKMAEEPEGRVGGSGRRGWASC

SEQ ID NO: 39790 - protein, 478 aa, Sorghum bicolor
  Clone ID: SORBI-28MAY03-C30019_1.pep
HEAEVHANAAEILCAVTRCAPPSLAAKICSPSFVGRLFHHALEESRPKSVLVHSLSVCISLLDPKRLASASYQAFRSNLTHGALVTASPETVDGMLESLGNLLKLLDTSAAESLVPTTYGCLRPPLGKHRLKIVEFISVLLTIGSETAEKELIRQSAIKRSIDLFFEYPYNNFLHHHVENIIVSCLEGKRPEVVDHVLHECDIVGKILVSERLSSLSIESNGPTVPSEGKTPPRIGNVGHMTRIANKLIQLGNSNNTIQAHLWENNEWVEWQTSARVKRNEVENVYHWACGRPTSLHDRGRDSDDDDFRDRDYDVAALANNLSQAFRYGIYSNDDIEEAQGSLERDDEDVYFDDESAEVVISSLRLGDDQDGSLFTNSNWFTFDGERGIDDRTSASVPSSSPNSEEISPETEEADDGKVIGTEDEMETVYLGNGSAEEVKDVAECTEQANCCTEDERLKNTEGMERHPDASNNDTDIC

SEQ ID NO: 39791 - protein, 166 aa, Sorghum bicolor
  Clone ID: SORBI-28MAY03-C30036_1.pep
MGAEAGHTQQQPPSSLRPGREAAAAAAPPAVLGLQLSALIDHVARVDWSLLDRVSGDRGGSQQVSIEELNHILDEVNAHILPSRNDLTPITTIAGGSVANTIRGLSAGFGISTGIIGACGDDNQGRLFVNNMSFSGVDLTRLRAKKGHTAQCVCLVDASGNRTMRP

SEQ ID NO: 39792 - protein, 167 aa, Sorghum bicolor
  Clone ID: SORBI-28MAY03-C30053_1.pep
MASPGLVAAALLVAALAAFCGTDPLRMGSMVDFPGFEAHFVHLPDPAEMPPHADERERLRGAEVRFRGEVQGPESVAFDPQGRGPYTGVADGRVVFWDGERWVPFATASPRWTQELCGGPKASPLEYLPNEHICGRPLGLRFDKKTGDLYIADAYFGLLKVGPEGGL

SEQ ID NO: 39793 - protein, 325 aa, Sorghum bicolor
  Clone ID: SORBI-28MAY03-C30086_1.pep
HEGPKEAGFCLWLLHPDPCSRPKAKEMLGGDLINEGRDLSLLDQAPVSISEDDTESSLLFNFLSQLKEEKEMLAAKLSAELGSLETDITEVERRHSARMRLSLEDTDVLPSSGVLSGASVSAVQGALLSGLLPTSCKSSVYEERVMRDLVQLENAYYSMRSSVDTSETNAIKRPDNEALRVRENFHQLHSDFDAKGEKTDRLGCFFDGLCKYARHSRFEVRGILKNADILNSPNVICSLSFGRDEEYFAAAGVSKKIKIFEFDALLNDRVDIHYPLVEMPSKSKLSCVSWNNYIKNYLASTDYDGTVQLWDASSGQGFTQFTEHR

SEQ ID NO: 39794 - protein, 264 aa, Sorghum bicolor
  unsure (1)..(264): unsure at all Xaa locations
  Clone ID: SORBI-28MAY03-C30184_1.pep
MSGRGSLPEGSLFLGLDSSTQSLKATVLNNELTIVASEIVNFDSELPHYKTEGGVYRDPADDGHIFSPTIMWVEALELLLEKLKPKINFGKVVAVSGSGQQHGSVYWKKGSHAVLSSLDASKSLLSQLKDAFSTMNSPIWMDSSTTKQCREIENAVGGALELAKLTGSRAYERFTGPQIRKIYQTEPDVYEDTERISLVSSFMASILVGSYASIDETDGAGMNLMDINQQIWSKSVLXATAPGLEAKLENLAPAYSAAGRIAPY

SEQ ID NO: 39795 - protein, 242 aa, Sorghum bicolor
  Clone ID: SORBI-28MAY03-C30212_1.pep
ARGYIFRDPRWGRGQETPGEDPLLTSKYAVGYVTGLQDAGSGSGSLKVAACCKHYTAYDVDNWKGVERYTFNAVVSQQDLDDTFQPPFKSCVVDGNVASVMCSYNQVNGKPTCADKDLLSGVIRGDWKLNGYISSDCDSVDVLYNNQHYTKTPEDAAAISIKAGLDLNCGNFLAQHTVAAVQAGKLSESDVDRAITNNFITLMRLGFFDGDPRKLPFGNLGPSDVCTSSNQELAREAARQGI

SEQ ID NO: 39796 - protein, 359 aa, Sorghum bicolor
  Clone ID: SORBI-28MAY03-C30777_1.pep
MAEARNYDSIVNRNEITDAAASAFANPEQIPEKYVRTEEVLDGVVVGEDERYELPVVDMARLLDPELSASEIAKLGDACRNWGFFQLTNHGVDEEVVQRMKDSARRFFSLPLESKAKVAVRGNGFEGFGHHYSRASSGKLDWAESMILVTQPVHDRNMEMWPTNPPTFRDALEVYSVEMIDLAMKLLGFMAADLGVEQEALLDAFTGKRQSMAIHSYPPCRHREKVMGITPHTDGLGLTLLLHVDDTPGLQIRKDGRWFPVRPLPGAFVVNVADILDVLTNGAYASVEHRVLPDAERGRTTVVIFQEASVGGLVAPLPGLLLEEGGAHARYRSIEIEEYIKGNFNALEHGTRFIESLRI

SEQ ID NO: 39797 - protein, 106 aa, Sorghum bicolor
  Clone ID: SORBI-28MAY03-C30844_1.pep
ISKAWESFHDVKISDRSLIWNSDLIETIELENLLINACITMYSAEARKESRGAHAREDFSTRDDESWMKHTLGYWENEKVRLAYRPVHMNTLDDEVQSFPPKARVY

SEQ ID NO: 39798 - protein, 130 aa, Sorghum bicolor
  Clone ID: SORBI-28MAY03-C30866_1.pep
GVVKVTGYFTSSLANSKAGKKFFNMLPGEIVLASLDGFGKICDAVEVAGKNVLSTSSTVTTGLVSHKYGDKAAAATNEGLDAAGHAIGTAWAVFKIRQALNPKSVLKPTTLAKSTIKANVAELRAKHGSK

SEQ ID NO: 39799 - protein, 251 aa, Sorghum bicolor
  unsure (1)..(251): unsure at all Xaa locations
  Clone ID: SORBI-28MAY03-C30875_1.pep
HEALTPEARGLMLRALGYRRDVHIYVASGEIYGGARXLAPLKALFPNLHTKETLSSQEELAPFSXFSSRMAALDFIVCDESDAFVANNIGNMAKILAGRRRYFGHKRTIRPNAKRLYPLFLNRGNMSWDAFASQVRTIQKGYMGEPMEITPGRGEFHANPAACICEKSGRNSVIVKSISGSTQEPVTDTRIRKAIDIGRPPYPVYTDEEADGSDTEEDPDSSGRGEVIDTEPDDDSVVRQEDPELEEILSD

SEQ ID NO: 39800 - protein, 137 aa, Sorghum bicolor
  Clone ID: SORBI-28MAY03-C30922_1.pep
FGVLGVRNAWYDPSKVTDHVIQGYTKPLKSKGWETALLEHTISMIIDSASASRAPVSKRLSEISCPVLVVTGDTDRIVPAWNAERVARAIPGATFEVIKSCGHLPQEERPEEFLSVLEKFLRTMFANPNEQVFQAAV

SEQ ID NO: 39801 - protein, 172 aa, Sorghum bicolor
  unsure (1)..(172): unsure at all Xaa locations
  Clone ID: SORBI-28MAY03-C30440_1.pep
MSLLRRRKQPQPPPPPSDGDGSDHDDSDKGKKPSSSSSSAPPSKEATRRTKAKWSCVDSCCWLVGCVCSAWWLLLFLYNAMPASFPQYVTEAITGPLPDPPGVKLQKEGLRVKHPVVFVPGIVTGGLELWEGHQCAEGLFRKRLWGGTFGDVYKRPLCWVEHMSXGHETGLD

SEQ ID NO: 39802 - protein, 209 aa, Sorghum bicolor
  Clone ID: SORBI-28MAY03-C30419_1.pep
MAAANGDASHGGGGVPRPTNPMVTPLLTDLYQFTMAYAYWKAGKHLDRAVFDLYFRKSPFGGEFTIFGGLEECIRFIANFKFTEDEIKFLRSVMPTCEDGFFEYLRSIDCSDVEVYAIPEGYVVFPKVPLMRIEGPVAVGPRRGTPFLSLVNYASLVTTNAARHRLVAGKSKNLLEFGLRRAQGPDGGISASRYCYMGGFDATSNVAAG

SEQ ID NO: 39803 - protein, 275 aa, Sorghum bicolor
  Clone ID: SORBI-28MAY03-C30461_1.pep
ARGGNLDNIKLMEALVKYLHRFGHLSCSASDVEIYLHMLSNNELSELLDEITRSFDASSISVNTLGSTHEVFKVQELLGTLFTKSTSELQGIAKRMVDTFYKNLPLSNDLDPQESMYGEELLSMASSILVQLYWRTRDLGYLLEAVLILEFGLTVRKYVWQYKITLVHLYSYLGALPLAHKWYTTLEVKNILLESVLHHILPQMLNSPFLQHAADLVKDYLKFMDDHLKESADLTCLAYRHRTYSKVIEFVQFKDRLHRSMQYLSVKSDSVMLHL

SEQ ID NO: 39804 - protein, 309 aa, Sorghum bicolor
  unsure (1)..(309): unsure at all Xaa locations
  Clone ID: SORBI-28MAY03-C30505_1.pep
HEADDGADKSTLGFGPAGGRPGPGLAAFFFLAGLTFAAVSIRSSGNHAAAKMQNLPAETAATESYSDYHSHKEDDAISVREEDAQASLPTDWEENNDSLDETKSTDEFLAPLLQSNEEVPGVQAEHEVGHPARGTEPVTNGNHLVGEEVQQFDNLIASDGNQNPASPPLPISSEYAQVSFAPSSTLDAADPSEGIPNVEETSDLKMALPENEHLDETLTSDAMVLDSDGVVLIQDIADSAVAAAFHPEDKGVEQNPQTHDKDEFSPSGLPDYMEHXXAEEMHPLGSNELSMATGTSEPGDGEETIVEDL

SEQ ID NO: 39805 - protein, 186 aa, Sorghum bicolor
  Clone ID: SORBI-28MAY03-C3055_1.pep
MSTFSGPKEAPANNPGLQTEVDPATKGYFLQQTMLRVKDPKVSLDFYSRVMGMSLLKRLDFEEMKFSLYFLGVRDVTSAPDNHIKRTEWTFRQKATLELTHNWGTENDPEFKGYHNGNSDPRGFGHIGVTVDDVHKACERFERLGVEFVKKPDDGKIKGIAFIKDPDGYWIEIFDHTIGTVTSSAS

SEQ ID NO: 39806 - protein, 168 aa, Sorghum bicolor
  unsure (1)..(168): unsure at all Xaa locations
  Clone ID: SORBI-28MAY03-C3132_1.pep
RSGSRSTTRPGGGGMDAMPPAFKAEAXRGRCHVTAWCPQEQVLRHPAVGCFLTHSGWNSTCESVAAGVPMVCWPGFSDQYTNCKYACEVWGVGVRLESAVEREQATMRVRKVMATEEMRKSAARWKEVAEAAAGPGGSSRENLLSMVRALSRPPNATHQTLDQELKDQ

SEQ ID NO: 39807 - protein, 201 aa, Sorghum bicolor
  Clone ID: SORBI-28MAY03-C31320_1.pep
MERDATAFCPPPQPAPAAPVSVPPATVLGAGGGAVAAAAGHGRGGGGGGGGGGGGRQYRGVRMRKWGKWVAEIREPNKRSRIWLGSYSTAVAAARAYDTAVFYLRGRSARLNFPDQLDGAAVADNPEGHRDGGAGAGLTAAAIRKKAAEVGARVDALHCGVGVGLAGGGAASPQPLSSHHRRRPKNPDLNREPTPDTSDDE

SEQ ID NO: 39808 - protein, 228 aa, Sorghum bicolor
  Clone ID: SORBI-28MAY03-C31378_1.pep
EPKVARGFLSLYKTAGEKVKSLSDEVMEEVRRLMDKYKGEELSITIVGHSLGAALALLVADEVATSIPDAPPVAVVSFGGPKVGNAAFVDRLASSGKVNVLRIVNAGDVVTKVPGVAPRLPHKKEQYQHVGAELRIDSKNSPCLRPDAGPACRHDLEAYLHLIDGFTGTGRPFRHDARRSVIRLLQLQRGNVKKEYVNRARELGVDPAAPADVGRSMAYGNCAVASPS

SEQ ID NO: 39809 - protein, 252 aa, Sorghum bicolor
  Clone ID: SORBI-28MAY03-C3172_1.pep
TRVGVLDAMPSSNLKPENEDEELDEKRIYRTTYMFSATMPPAVERLARKYLRNPVVVTIGTAGKATDLITQNVIMVKESEKMPRLQKILTDLRQKTAIVFCNTKKTADMRAKDLDKAGFRVTTLHGGKSQDQREISLDGFRNRRFNVLVATDVAGRGIDIPDVAHVINYEMPSSVDTYTHRIGRTGRAGKKGVATSFLTLENTDIFFDLKQMLIQSNSPVPPELARHEASKFKPGSIPDRPPRRNDTVFANH

SEQ ID NO: 39810 - protein, 128 aa, Sorghum bicolor
  Clone ID: SORBI-28MAY03-C3201_1.pep
TKVQADGVIVATPTGSTAYSTAAGGSMVHPNVPCMLFTPICPHSLSFRPVILPDSARLELKIPDEARSNAWVSFDGKRRQQLSRGDSVRISMSQHPLPTVNKSDQTGDWFRSLIRCLNWNERLDQKAL

SEQ ID NO: 39811 - protein, 244 aa, Sorghum bicolor
  Clone ID: SORBI-28MAY03-C30680_1.pep
LEIVPFIPHPLGRSCHARPASLRLRQVLAAAARGAQPLPRRRAADAPRLLPAAPRPLAAAPRWPAPSPSSQPTGPSQATPGCPLRPCPTPHLAPSIMSERGRLARRLSDDRRAYHEGLRVDDPRGYPEVLVVGDRRGYSDIRVVQERRGYPDPRLLEERRGYPGVRMVDDHRGYPGSRGLDERRAYPEIHEGPRMRGAPHPHPAVLEDELELQEVELRRLLAHNWALVQDREVLSREIPAGKDE

SEQ ID NO: 39812 - protein, 132 aa, Sorghum bicolor
  Clone ID: SORBI-28MAY03-C30681_1.pep
MGRRRRFAQLDDDDDDDEEDVPIKFKPSGGASSSGANPRKPQPQPQQRRRVAADDDEDEEEVELEEEEDDEKDLEAMRRAEEEERREQEAETKTRRRRGRPKRRRDPESEEEEPDKVAPHEEEPREEENTEA

SEQ ID NO: 39813 - protein, 124 aa, Sorghum bicolor
  Clone ID: SORBI-28MAY03-C307_1.pep
LCPSANFANNITLGVLATWLVAPKLACRHILPPYNEDCWKRLHTGEAYLQSMGGCNRCQMINLYQSSGQVIKSKEPLATLASYRRKQGKILFGVLLNYEDGMEGEDDAIVERWLKVGQEVYPST

SEQ ID NO: 39814 - protein, 186 aa, Sorghum bicolor
  Clone ID: SORBI-28MAY03-C30724_1.pep
ETGVQGRIINVSSIAHKRSDGTCFELNKLNDKDRYQPFIAYAHSKLANILHANELSRRFQEEGCNLTANSLHPGVIITNIIRYVAGNNSALISVLSPVANLFLKSVPQGAATTCYLALHPNVKDVTGKYFADCNEATPTAVARDSELAKRLWSFSEELVGTNADMSQTTQASEEEDVQAKDVFQDQ

SEQ ID NO: 39815 - protein, 385 aa, Sorghum bicolor
  Clone ID: SORBI-28MAY03-C30730_1.pep
MTTSSDPAATPAPQSPGVGGVALSSCIGDLLRFVLSSHTGACPGDDLAAFPLSPSYCVRLVNDGELFGKLEASIQRCLEEGRLPGPPAVVGIPAAEEGPEERGWELLLLEKGAELKRMYDAVDFELHVQEPYFTQLRAGAKKVEGRLATGNYNRITQGSLLLFNKCLLLNIEAVRKYSSFSEMLEAEIISNVLPGISSIVEGVKVYRKFYTEEKENSSGVLAISVSKPTSQPYITMTDILAGLGYDGLGRLLGMAKTAGTVPDGLPPPRSALLSSCLPPLQPSLAPCSGTVGARAWSKPVLWRRVRGRGPFMGTGAGKDRGASVTGVALLRASCCSSVQRSRPYGPVFEIRVHEGYGARWSQDGSKFIGFLEPYTPEGYAKGWKH

SEQ ID NO: 39816 - protein, 265 aa, Sorghum bicolor
  Clone ID: SORBI-28MAY03-C3074_1.pep
MRSPVPERSLIIESDDDDDTQSAVATNWTGHGHGHDEEEPEREPGSDSDSSSSSSSCATPRRGPSSPAYTQQWPQSYRQSIDILSSVHSSNLSFLGTPTLSRLSNSFLAITDSFRGKAPETISNFVKPLLGPTSSDEQQQQQHEDTRKSSQYIMPSRKSSLEQIPEDQKPLVVGHEASRNRNCSYTQGVMNGINVLCGVGILSTPYAIKQGGWIGLVILCLFALLAWYTGVLLRHCLDSKEGLETYPDIGHAAFGSTGRIVISII

SEQ ID NO: 39817 - protein, 124 aa, Sorghum bicolor
  Clone ID: SORBI-28MAY03-C32350_1.pep
HEDDFQKFNSGEYQVILRKELTKSDVANSGRIVLPKKDAEAGLPPLVQGDPLILQMDDMVLPIIWKFKYRFWPNNKSRMYILEAAGEFVKTHGLQAGDALIIYKNSVPGKFIIRGEKSIQQTNP

SEQ ID NO: 39818 - protein, 308 aa, Sorghum bicolor
  Clone ID: SORBI-28MAY03-C32411_1.pep
GNVIDICPVGALTSKPFAFKARNWELKGTETIDVTDAVGSNIRVDSRGPEVMRIVPRLNEDINEEWISDKTRVCYDGLKRQRLNDPMIRGPDGRFKAVTWRDALAVVAEVLHQVKPEEITGVAGKLSDAESMMALKDFVNRMGSDKVLCEGNGPNPPADLRSNYLMNTSIAGLEKADVFLLVGTQPRVEAAMVNARIRKTVKATQAKVGYIGPPADFNYDHDHLGTGPQTLVEIAEGRHPFCSVLQSAKNPVIIAGAGLFEREDQDALFSTIETVAKKFNVTRPDWNGLNVLLLHAAQAAALDLGLVA

SEQ ID NO: 39819 - protein, 113 aa, Sorghum bicolor
  Clone ID: SORBI-28MAY03-C32790_1.pep
QIVKMSQQKFASNVVEKCLTFGNPEQRQIVINEMLGTTDENEPLQAMMKDQFANYVVQKVLEICDDQNRELILSRIKVHLNALKRYTYGKHIVARVEKLIAAGERRIGAPSSC

SEQ ID NO: 39820 - protein, 178 aa, Sorghum bicolor
  Clone ID: SORBI-28MAY03-C32798_1.pep
TRLIFNTDKNHSVVQTRNGTLYKSCDYNDSGPDDTVEWSAAAPEFSKDAVTVAVPLLKEGRAYFFSGNYDGEQCESGQRFAIDVAHGQGLPPDLRPPVADAPAPSSSAGTADGGAAALDFSHPKNVTTPSSADDDGGGEPSGGGTTSGSSSTCRTLASQLRSPLAVTVTLLITLLFVM

SEQ ID NO: 39821 - protein, 117 aa, Sorghum bicolor
  Clone ID: SORBI-28MAY03-C32875_1.pep
ALPRLAIRLLACLVEHRQRQHAPRRVRLRRRRHRQRYLVTVAGSDASAAAAAAVAIGSHRFGVARQQAEPVQELRVWHEEVMLVLVLVQVMVLLVPGVRHVRPHVGPLGHHVRQGRR

SEQ ID NO: 39822 - protein, 130 aa, Sorghum bicolor
  Clone ID: SORBI-28MAY03-C31152_1.pep
GCDASVAASPCPAAIRAALTAPLRLLLQRQERGGGGRRRASSPDGQQPTPPPRGLTSLATSPPYDAFAAASPLPSVGPHGLNGSPALAPPASSRRGDMRKKSRSRPGDLEWGRDRGGVTAHDVGERSSLV

SEQ ID NO: 39823 - protein, 127 aa, Sorghum bicolor
  Clone ID: SORBI-28MAY03-C31214_1.pep
QKDHLTKYPSPQRSGSTLSISLKSSRFQSKNLQMQTSRLPKIWKLYLHFGVGWGGAQNCSKICWPSCFATTNNLLGFFTKQLTCCVPTYKVLLQKEVALPHNGQTKITSTEEHGTADISMQPWQFWY

SEQ ID NO: 39824 - protein, 162 aa, Sorghum bicolor
  Clone ID: SORBI-28MAY03-C31255_1.pep
HEASLESFLDRMVSQLRSTCKYYTGYPKDLGPSRIIPFTSERQFVQLLHEGRPVVVAFTIKCTYTQHLDKVLEEAAAKFYPHIKFVRVECPKYPGFCLTRQRNEYPFVEVFYNPEQAASQGKSVDPNITKYSVKVLPFNYDQSVYGFREYFRKHGFKYSETN

SEQ ID NO: 39825 - protein, 122 aa, Sorghum bicolor
  Clone ID: SORBI-28MAY03-C31233_1.pep
VEIVFQNTENFVQSWHIDGYAFWVVGMDGGQWTPASRQGYNLRDAIARYTLQVYPQSWTAIYMPLDNVGMWNVRSESWARQYLGQQFYLRVYSPANSWRDENPIPKNALLCGRASGRRTRPL

SEQ ID NO: 39826 - protein, 98 aa, Sorghum bicolor
  Clone ID: SORBI-28MAY03-C31257_1.pep
ARGALFQREIEKERERERARMASLLSLYGSGGRRRMSRSSGTAAPVRRLLRRLRSSFGRSAARPRRRSAVRFGYDLHSYSQNFDDGVASSAPAAMACA

SEQ ID NO: 39827 - protein, 109 aa, Sorghum bicolor
  Clone ID: SORBI-28MAY03-C33061_1.pep
MAVKVWVFVVALMFIGVVVVVGLGADDGSSRDGAGSLSRCRLSSPNYHGALAKAILFFEGQRSGRLPANQRVKWRGDSALTDGQPENVNLTGGYYDAGDNRKFGFPMAF

SEQ ID NO: 39828 - protein, 269 aa, Sorghum bicolor
  Clone ID: SORBI-28MAY03-C33113_1.pep
MQRQGRHLERSNSKRALDHGAGGDDDDRPSKRPRVPALASVLVEALKVDSLQKLCSSLEPILRRVVSEEVERALAKLGPAGPARIQGRSSPKRIEGPDGRNLQLQFRTRCSRPLFTGGKVEGEQGAAIHVVLLDANTGHVVTSGPESSVKLDILVLEGDFNKEEDEGWTEEDFESHIVKEREGKRPLLTGDLQITLKEGVGTIGELIFTDNSSWIRSRKFRLGLRVSSGFCEGIRVMEAKTEAFTVKDHRGELYKKHYPPALKDEVWRL

SEQ ID NO: 39829 - protein, 136 aa, Sorghum bicolor
  Clone ID: SORBI-28MAY03-C33114_1.pep
MATFAKPENALKRAEELIHVGQKQAALQALHDLITSKRYRSWQKPLEKIMMKYVELCVDLRKGRYAKDGLIQYRIVCQQVNVSSLEDVIKHFMQLSNEKAEQAKSQAEALEDALDVEDLEADKRPEDLMLSFVSGE

SEQ ID NO: 39830 - protein, 140 aa, Sorghum bicolor
  Clone ID: SORBI-28MAY03-C33244_1.pep
KAERVERELVSPREGSFPSFPTLPSTPHHPLTSDCALSLCGSRHPRFGWPAGGGSRSGTKTGFFRPWRRGLIRSGPGGGVASSPGLIRIGSNDLGGLIGCFSFRFRRGIGARAVVSWPAGGFVGLGSWGLLVQHTSRRSA

SEQ ID NO: 39831 - protein, 260 aa, Sorghum bicolor
  Clone ID: SORBI-28MAY03-C3327_1.pep
RPAEHYFNMMKEEYKIEPVVDHYGCMIDMFVRLGQLDDAFSFIKRTGFEPNEAIWSSLVAGCRSHGNMDLAFYAADRLLELQPKGVETYVLLLNMYISNERWHDVARVRKLMKQEDLGILRDRSWITIKDKVYFFRANDKTHELSDELYQLLENLLEKAKTIGFEPYQNAELSDSEDDEKPPAGSVKHHSERLAVALGLIQTPPGATVRVTKNITMCRDCHSSIKFFSLLVNREIVVRDSKRLHKFKDGRCSCGDFGALL

SEQ ID NO: 39832 - protein, 159 aa, Sorghum bicolor
  Clone ID: SORBI-28MAY03-C3145_1.pep
TLMSLELIIERKKYVRERKKARGAGRADRRKVGDDDGFGAEKREAYHGGKVGSKAADPDEALCGRKGLKAAAGKQRPTDPEAGRQPASRRTQNGRRAEGLAQTGQSGLGSREARADKTRVTSETSSVCKNCCFSLHVSVSLYKDDAIKNMFNIEINVKL

SEQ ID NO: 39833 - protein, 168 aa, Sorghum bicolor
  Clone ID: SORBI-28MAY03-C32033_1.pep
WTCPKYRVTFDASVIWGLIGPGRLFGRHGLYRNLVWLFLVGAVLPVPVWLLSRAFPEKKWIALINVPVISYGFAGMPPATPTNIATWLVTGTIFNFFVFRYRKAWWQKYNYVLSAALDAGTAFMGVLIFFALQNAHHDLKWWGTEVDHCPLASCPTAPGIAVKGCPVF

SEQ ID NO: 39834 - protein, 154 aa, Sorghum bicolor
  Clone ID: SORBI-28MAY03-C3211_1.pep
SACYVQEECSNDKMRELLSADLTKLDEAIWDTAVEMRNNIMAWSWTDDSSSCDIHKVSHSIVSYTKVLWANCKSVNRILHAAVLRGEFVSENKNLNHVTNLITQMVSSLEREPSTNSSPGSFPDESLRFLFLINNFKEGLSLYFDQGTHPLQTS

SEQ ID NO: 39835 - protein, 62 aa, Sorghum bicolor
  Clone ID: SORBI-28MAY03-C32140_1.pep
MGKVHGSLARAGKVRGQTPKVAKQDKKKKPRGRAHKRMQYNRRFVTAVVGFGKKRGPNSSEK

SEQ ID NO: 39836 - protein, 98 aa, Sorghum bicolor
  Clone ID: SORBI-28MAY03-C3225_1.pep
NIQHITNLLFPMILPNTTGHKRNPQKAPLIPTHHQKNRLSQLNELILLFLCTNAHRATINITIISVVNKQAASLCAFTQERPVHSCRTLQARAPIGTI

SEQ ID NO: 39837 - protein, 150 aa, Sorghum bicolor
  Clone ID: SORBI-28MAY03-C3234_1.pep
PAGSGAMAWPGTMYIGTFLVGLGYGAHWAIVPAAVSELFGVKHFGAMYNFLTVANPTGSLIFSGLIASNLYDYEAEKQAQRHQITALTSPRLLHNMGFLADGPLTCEGAVCFFVSSLIMSVFCVVGAGLSLMVIYRTKRVYTHLYSSNRT

SEQ ID NO: 39838 - protein, 423 aa, Sorghum bicolor
  Clone ID: SORBI-28MAY03-C33462_1.pep
HEGNAESSGYEMGQEHSNQVFASDGSQSLKSSVWGRIASKRKPGGSNTAKSTSTSITGNQKSDYDEMTLSSARVKSAAKDTNGQPNSRIYGDVGRQSNRAAQKASRTLYVHGIPQESNRWDALLSHFQKFGQVIDIYIPSNSEKAFVQFSRREEAEAALKAPDAVMGNRFIKLWWANRDRILDVGEGRISGKSSQLPTMLANSFPNRVKENVQSTAPRPSSGSSAEPLSSGTPGSKMLPASNTKPVPPHAPKRQESLELLEELRKKQEILAQKRDEFRRQLEKLAKQKGSANSVKHAEAGGKEIASNDASEVTDARSMRAEGAQEIAGSLEKRSSGEFASCSQKSAATSTQKSAVVTKQTTLPAPPQNRFKLDNRTTSFRILPPLPLEIANESVLADHFSSFGELSSVVLEDTEAHNHDATLK

SEQ ID NO: 39839 - protein, 138 aa, Sorghum bicolor
  Clone ID: SORBI-28MAY03-C33478_1.pep
HEDRLRGDAARLNFPDNAASRAPLDPAVDAKLQAICATIAAASSKGGARAKQSKAMPINAPVLEATAACPSNSSSDEGSGSDEEMSSRTTTTPVVVAPPVVADMGQLDFSEAPWDEAESFVLRKYPSYEIDWDALLSN

SEQ ID NO: 39840 - protein, 270 aa, Sorghum bicolor
  Clone ID: SORBI-28MAY03-C33553_1.pep
HEVPADATGSTPHFGRRGSELGPTHVLVVRGLDENADEEMLRYEFAKHEAIKDIRLVRDKFTHVSRGFAFVHFHSVEDATKALEATNGTTLEKNGQVLRVAYAKSTHGPASGGSQSNSLAAAAIEAASFAQQYDAIGWAPKEYNPDDKQNSNSESQKDGGTTQSGFVWDEKSGYYYDSASGFYYDGTTGLYYDSNSGVWYSYDQQTQQYVPCNDQNNTKAAGEAASENTKTSDSNSGKKVVISAPAATTKQSEKTSLPDAVQAAANAALA

SEQ ID NO: 39841 - protein, 131 aa, Sorghum bicolor
  unsure (1)..(131): unsure at all Xaa locations
  Clone ID: SORBI-28MAY03-C33579_1.pep
MAAPGKGPAAPSAALFFSPLRKLALKYHPDKNPDNEEANKRFAEINNAYEVLTDQEKRKIYDRYGEEGLKQFQGGRGGGGGMNIQDIFSSFFGGGGGGMEXXEEQIVKGNEVIVELDASLEDLYMGGSLKV

SEQ ID NO: 39842 - protein, 127 aa, Sorghum bicolor
  Clone ID: SORBI-28MAY03-C33587_1.pep
CMPGGALCPLAKSSSFSLHSSASAPTSWWPFSKATFPIPNTSLREGPSMPAWQALPISLIRREREHCSGWFVQLEGVHRWWSTSYVSIKNAYAESKYEYVSGLEEIILKPRRPKSVASDSKQRIWYE

SEQ ID NO: 39843 - protein, 185 aa, Sorghum bicolor
  unsure (1)..(185): unsure at all Xaa locations
  Clone ID: SORBI-28MAY03-C32843_1.pep
EADAFFPGFHXDGSGWPDYSNLVMGHRLYKTPSGITYRPDRKIIAALFEDVNDHRYHPPRNWTIAAREHLNRSASVEGIVSSAMLSRPVSFLAHPLPECSCRTPKSPGVQPVKDSNGRFLFGGEEECPDWMARSLATASARNNEPQNEDYEDELPEDGSRSDTQESDRTDSNKSSEQDEEMDPDD

SEQ ID NO: 39844 - protein, 257 aa, Sorghum bicolor
  Clone ID: SORBI-28MAY03-C32923_1.pep
HEGRAPTLQTSLSPPRAASPEQVGSPPDMQEPLSNSDGGHDSATESASSRETWPREPGKSGGAGGPPVAAAPITALRIADSKEKEVVGNGVAEMQAIWSRMPSASRMTIREVARERVDLVAEKMKGMSDELLDETKTELRSILEGSGGPHQIQEFMYLQKLVQGRVDLTLPVLLMAHHVQLEILVAIKTGIQAFLHPSVDIPQSCLAEIFLYKRCRNIACQSAVPAEECKCNICSNRNGFCNLCMCVICNKFDFEVN

SEQ ID NO: 39845 - protein, 184 aa, Sorghum bicolor
  Clone ID: SORBI-28MAY03-C32981_1.pep
SKYYTLSFSLPSRLHFSSPLAVREKRVNRRLSSVSPWSQLAAVDAAVTLGNCWNIEDLLMADAVTMDDSAASTSGLGDKDHSVSADSLSEWRSREHVDNGIPSTSPPFWDTDSEDDDPGPRPSDLFGRYTWKIENFSKEKKREMKSEPFEAGGYKWYILVYPQGCDVSNHLSLFLCVADHEKLL

SEQ ID NO: 39846 - protein, 202 aa, Sorghum bicolor
  Clone ID: SORBI-28MAY03-C33031_1.pep
MLPRRARDPAAGVLTILPAILLLAVAAAMAMAAAEEALPMPMEVYFTPAELARIAGYGEEPVSSVSVSGQLTCELCLRPGSQLLALDMPGAKVAVTCKSDRTPSNQLDSFAFATTDEYGNFTIDLPPQLHATPDLEKACTVKVLQLPADSCRLRHRTGDTYGLRLSSVEDGVRAYTAGVIRLQDSDTPSDHCVGVEHMSERR

SEQ ID NO: 39847 - protein, 167 aa, Sorghum bicolor
  unsure (1)..(167): unsure at all Xaa locations
  Clone ID: SORBI-28MAY03-C33017_1.pep
MFGRAPRRSNNTKYYEVLGVSNTASQDELKKAYRKAAIKSHPDKGGDPEKFKELSQAYEVLSDPEKREIYDQYGEDGLKEGMGGGSDYHNPFDIFEQFFGGGAFGGSSSRVRRQKRGDDVVHSLKVSLEDVYNGATKRLSLSRNVLCSKCKGKGTMSGAPXTCYGCH

SEQ ID NO: 39848 - protein, 227 aa, Sorghum bicolor
  Clone ID: SORBI-28MAY03-C33036_1.pep
PSLRSPPLFSLSLRPAISSSDCGLRSSPQSAAAAAAHEARNQTAPDPPSSSDRSPGSGKAEHRELKRLSLVSVNWHPTTKQSKMGGFVDPFVPESAWPQDTMFIGSSWPAAGPAGTYLGGAGAAAPDQLHLQNVSSSSTGALLNGSAKEIVSLSPVEELHEQFLSAHLPLPADDVAPQGLNFEVDSVVLSTPCAISLADSAPVVCCSSNDSSGSEQSGLPPFLLLGV

SEQ ID NO: 39849 - protein, 152 aa, Sorghum bicolor
  Clone ID: SORBI-28MAY03-C33679_1.pep
MVHFKNRYMVVEVFIDAARGEQDPVILTQFNITKVIRDSIQLNFGECGLAGSLGSLQVKYVNPVTKLCIVRVSREDHQKVWAAMTMVRCIGKIPVAFNLLDMSGSIRACKKAALECDEAKFEQYKVAAGDRITAEIIQSVESCFEKIRGLES

SEQ ID NO: 39850 - protein, 344 aa, Sorghum bicolor
  Clone ID: SORBI-28MAY03-C33736_1.pep
DVESKIICLKYLPKEKVLPFGSKDNLWEMGDTGPCGPCTEIHFDRARGRDAASLVNNDDPTCIEIWNLVFIQFNREADGSLRPLPAKHVDTGMGFERLTSILQNKMSNYDTDVFMPIFDAIHQLAGDGIQPYSGKVGSDDIGKVDMAYRVVADHIRTLSFAIADGSQPGNEGREYVLRRILRRAVHFGHQKLKAKQGFFSSLVNVFVQLMGDVFPELKDNEKKIKDIIRDEEESFENTLAKGYEKFKKAADAVKDNGGTVLSGQDAFVLWDTYGYPIDLTEVMAIDYGLTVDKEGFNASMEEARQKARNARNKSGGKSIALDANATAHLRKQGLASTDDNPKFL

SEQ ID NO: 39851 - protein, 76 aa, Sorghum bicolor
  Clone ID: SORBI-28MAY03-C33752_1.pep
VGGAGDVHAVAVKGERSAGWQALSRNWGQNWQSNTLLDGQALSFRVTTSDGRSVVSNNAAPRGWAFGQTFSGAQFN

SEQ ID NO: 39852 - protein, 94 aa, Sorghum bicolor
  Clone ID: SORBI-28MAY03-C33830_1.pep
SRFRREGNDLHATVTISLVQALVGFEKTIKHLDNHLVEIGTKGITKPKEIRKFKGEGMPLYQSNKKGDLYVTFEVLFPKTLTDDQKAKLKDVLV

SEQ ID NO: 39853 - protein, 224 aa, Sorghum bicolor
  Clone ID: SORBI-28MAY03-C33252_1.pep
MASKQAVASEALAAQIYGMSRSEMYDMMSKMKTMIDHDQETVRRMLVNNPDVTRALFRAQVVLGMVKTPKTAQSSDMVPPTAVATAPPSVKTTAPDHVSLPPPPLPANQQSVAQLSAPFPSGLSNVGTTMDIPTISANPPQPIQAKGYPIHQMPSSAPQPSQHPNMALPHAPPQYSNLPSHIPIVHSQPQQPLQSPAIYNQQLQPPLPQMSRPLSMQPFSHQMH

SEQ ID NO: 39854 - protein, 216 aa, Sorghum bicolor
  Clone ID: SORBI-28MAY03-C33325_1.pep
MAASPVLLVAAALCLCALLFGAGEAATKGAEEAAAAASSAFRSRATDPNMEVKFDFSPFLIQYKSGRVQRFMGTTFVPASMDSRTGVASRDVVVDHGTGLAVRLYRPSRRAVAAGAGGGRRLPVLVYFHGGAFVVESAFDPVYHNYLNALTAKAGVIAVSVNYRLAPEHPLPAAYDDAWTALSWVLDNARRGGDPWLAKHGDASRLFLAGDSAGGN

SEQ ID NO: 39855 - protein, 245 aa, Sorghum bicolor
  unsure (1)..(245): unsure at all Xaa locations
  Clone ID: SORBI-28MAY03-C33355_1.pep
MESSSARSNVSERNHLGYARSTSMDSTGPPLAGRSGSMLSRRSSRQSSRGSISLSREMGDSILSSMRHSLQSADQLLGDIDSSVLAQLIESGRVLSPEGDVDEDTARISEHNKIGPLPDEAIKQNNEKFASALVSSAETKDTISNILADSSTKVEPYKLSLRLDYAAYMIHLAVFGFLGVFTRYGLQKLFGPDCLALTSDQSPLYPDLPSNMLGSFLMGWFGIIFKADIRYIXDHLIVGITTGYM

SEQ ID NO: 39856 - protein, 179 aa, Sorghum bicolor
  unsure (1)..(179): unsure at all Xaa locations
  Clone ID: SORBI-28MAY03-C33356_1.pep
ARYVSAHRPAERAPRVLRAAPRSGAAIIAGNLCRGVSAWAGGRAVATAASWLSLDSPSLPSHCGRVSAVVGWSTSWKFGGAGCHFVRRXGAVWMVIPPLAPNTLAKIPGGXGAPLLACAATPWHYSRPLFVAPAMNTLMWNNPFTERHLQTINQLGIILIPPVTKRLACGDHGNGAMDE

SEQ ID NO: 39857 - protein, 207 aa, Sorghum bicolor
  Clone ID: SORBI-28MAY03-C33364_1.pep
MTRDGVPPAAPPPVAGSGSGGAVAAAGDGPRRCSQCGHHGHNARTCTARPVKLFGVRIGDKPIRKSASMGNIAHLAAEGSGGGGGGGGSREEGYGADGERPHKKRGEAWTEEEHKKFLLGLNKLGKGDWRGISRNYVISRTPTQVASHAQKYFNRQTNVHRRKRRSPLVQVAGAASPDQLPLSRSSSQEVEQQHLDDPQPVAALPAP

SEQ ID NO: 39858 - protein, 113 aa, Sorghum bicolor
  Clone ID: SORBI-28MAY03-C36788_1.pep
LKRGDVERGQVVCKPGSLKTYKKFEAEIYVLTKDEGGRHTHFMTNYSPQFYFRTADVTGKVELLGETKMVLPGDNVTANFELISPVPLEPGQRFALREGGRTVGAGVVSKVIS

SEQ ID NO: 39859 - protein, 195 aa, Sorghum bicolor
  Clone ID: SORBI-28MAY03-C34028_1.pep
MSIVPKETIEVIAQARGIPSLGADVAVALAPDVEYRLREIMQESIKCMRHAKRTVLTADDVDSALGLRNVEPVYGFASGDPLRFKRAVGHKDLFYLDDREVDFKEIIEAPLPKAPLDTSVVAHWLAIEGVQPAIPENPAIDAIVPSTENKRSEHGKDDGLTIDVKLPVKHVLSRELQMYFDKIAELTMSRSDTSL

SEQ ID NO: 39860 - protein, 186 aa, Sorghum bicolor
  Clone ID: SORBI-28MAY03-C34059_1.pep
MAGAILRRLTPTAATSPRVAPLLPLLVARGVSDSTDAITVETSVPFKSHIVDAPSREATTTARELLSFFRDMSLMRRAEIAADSLYKAKLIRGFCHLYDGQEAVAVGMEAAITRADAIITAYRDHCAYLARGGDLVAAFAELMGRRDGCSRGKGGSMHFYKRDANFFGGHGIVGAQVPLGCGIAFA

SEQ ID NO: 39861 - protein, 194 aa, Sorghum bicolor
  Clone ID: SORBI-28MAY03-C34111_1.pep
MPPAAAMALPSQAPSNSGDPLYPELWRACAGPLVTVPRVGDLVFYFPQGHIEQVEASMNQVAGNQMRLYDLPSKLLCRVLNVELKAETDTDEVYAQIMLMPEPEQTDVAAEKASSASAASPRPAVRSFCKTLTASDTSTHGGFSVLRRHADECLPPLDMTQSPPTQELVAKDLHGMEWRFRHIFRGQPRRHLLQ

SEQ ID NO: 39862 - protein, 353 aa, Sorghum bicolor
  Clone ID: SORBI-28MAY03-C34127_1.pep
MTIPSAEGFLQASSCLPCTAAEEREVVDALTREAEKNVKHGDLRYLVSQSWWMEWQGYVGIFSHGENGTEQFPQAMNRPGEIDNSKLVSAERINGSEEPELQRTLREGEHYTLVPQEVWQRLYEWYKGGPEIPRKVIFDNPIDKTYIVDVYPLCLKLIDGRDSCQKVFRISRKAKVHELAPGVCSLMSVEQSEIVIWDYYQRSKGKKLLNQNETLEEAQLTMDQEILLEMKLGESSSGFSTRSTNDELALIPLEPSTSSFSIAGGPTFSKGFSSGIGSSFSQDNSFSPLLRDSEDGYNSLSNGTKDGTHGLSGLHNLGNTCFMNSAIQSLVHTPPLVQYFLEDYTCEINTENP

SEQ ID NO: 39863 - protein, 200 aa, Sorghum bicolor
  Clone ID: SORBI-28MAY03-C34124_1.pep
ARAPGADDPLDSSPSASAAAAAAGGVCSAPAPALRPRREPFEYGLLPIPKLVFPEGTLTQTLSQLKERLAPGGPRVGAAALADALQIPAEQAALALGTLAAVLPAEDPELGEDGAGNADLRDLLLFIYIQSYKRLVPRAHKDSPAVADVWPSTSAFDGYLSALSPIQFVRSNSRRFMPSQADEESHQLSYLQKHMANILT

SEQ ID NO: 39864 - protein, 99 aa, Sorghum bicolor
  Clone ID: SORBI-28MAY03-C40105_1.pep
RPSQGPTSEGPVQPIGSAGQRRTWLRQHPKRTGLMGKQRLRQKRPPRAPQLRHTIHRDGGKPGRVRMERNGTDHRDQDLQEMHGQTRQVGQAIHVPAKQ

SEQ ID NO: 39865 - protein, 109 aa, Sorghum bicolor
  Clone ID: SORBI-28MAY03-C40257_1.pep
LEGSVKTTKLKITWLADIEELVPLSLVEFDYLISKKKLEEEDDFLENLNPCTRREIPALGDANMRNLKRGEIIQLERKGYYRCDAPFIRSSKPVVLFAIPDGRQQASLN

SEQ ID NO: 39866 - protein, 127 aa, Sorghum bicolor
  Clone ID: SORBI-28MAY03-C40304_1.pep
VQDDADKTLPFCMKADFPVRSVDDVKHFFKPLSLQFEKRFFFSRTFNIRPEDYLVISDKGNVCLGVLDGTTIGYDSVIIVGDVSLRGKLIAYDNDKNEVGWIDSDCSNPQQSRIPSFLRRALHNQLL

SEQ ID NO: 39867 - protein, 127 aa, Sorghum bicolor
  Clone ID: SORBI-28MAY03-C40400_1.pep
CQRSRIIRRHDDGSFDAELEIGFKFLVESYVSHVEMEKPRYIKTTASESGLFDHLINVWEFKPGPVPGTCDLYFLVDFKFQSPLYRQVASMFFKEVVSRLVSSLNDRCFRIYGPAVPVLENTYGQGR

SEQ ID NO: 39868 - protein, 108 aa, Sorghum bicolor
  Clone ID: SORBI-28MAY03-C4041_1.pep
AMRMRAAISRPIDNCRWASTMLNHYTRTDKKYGGLSLSYEDVGSSSCSHRLSSSTIGKFVPLCLRRLACLLFCMAKAGCLMELVGSFLMYNYTRVVNVFNLKNNPYTM

SEQ ID NO: 39869 - protein, 344 aa, Sorghum bicolor
  Clone ID: SORBI-28MAY03-C34320_1.pep
MAPAFFLLPLLLGQILLCAAVDSINSSTPLSGAQKIVSKGNKFTLGFYTPPQGTTTSSNPSNYYIAIWYSNIQLQTTVWMANPDVPVADPTTAALTIGSDGNLVLQSQNRLLWSTNVSISSNSTVAVLQDIGSLDLIDATNSSMVYWRSIDHPTNTWLPGGKLGLNKTTGVSQRLVPWSNTANPLPGPFSLELDPRGTTQYFIQWNDSITYWTSGPWNGNIFSLVPEMTSGYNYNFQFINNVTESYFIYSMKDNNIISRFIIDVDGQIKQLTWVPASQSWILFWSQPRTQCEVYALCGAYGSCNLNALPFCHCIRGFSQKVQSDWDLQDYSGGCRTSVREHLPC

SEQ ID NO: 39870 - protein, 165 aa, Sorghum bicolor
  Clone ID: SORBI-28MAY03-C34321_1.pep
MDSARSWLQKLQPRDKDRERGAKAPASASPNGGGGGSARMAAAAAGEEEALSSATKQKVAAAKQYIENHYKSQMKSLQERKERRWMLERKLADADVSQEEQNNILKDLEKKETEYMRLRRHKMGVDDFELLTIIGRGAFGEVRLCREKATSNVYAMKKLKKSEML

SEQ ID NO: 39871 - protein, 214 aa, Sorghum bicolor
  Clone ID: SORBI-28MAY03-C34370_1.pep
HEGRSEPPPSASLPPPAAAAMALRRITPRRRPVLPVPRAFFSSSPPFPPPPPPANGDPDAAHSPSSSPPPNPGAPRNPSPSLFRDIKDRLRLSPTSRGAPSSKPSVQDVRRLLGEFRPTGSPPIPPSPSAPGADPSFMDLLKKNSVAQGANAGQRVTDLGAIRESLKRSPPRTPRRPPTPYLTPQSNIFNPELQRNLKAVGAGKEEKDSTIALL

SEQ ID NO: 39872 - protein, 215 aa, Sorghum bicolor
  Clone ID: SORBI-28MAY03-C34401_1.pep
MSSATPAVASPASEHSKSKKKKHKSKDDPAAAAAADPPSLAEAEEKTDGYLIKPQSLVPSLDTSTWPLLLKNYDRLNVRTGHYTPLPSGHSPLKRPLAEHLRYGVINLDKPSNPSSHEVVAWIKRILRAEKTGHSGTLDPKVTGNLIVCIDRATRLVKSQQGAGKEYVCVARFHAAVPDTARVARALEALTGAVFQRPPLISAVKRQLRVRTIYE

SEQ ID NO: 39873 - protein, 311 aa, Sorghum bicolor
  Clone ID: SORBI-28MAY03-C34430_1.pep
MKEQDLQELYGVLESGTERDLLSSSTDSRNLTIDETSKISCKDAGQCSDYIDKNYSYAGMHNGAQCITGKSGDHEKTGGALWDIFRREDSDKLQDYLRKHAKEFRHINCNPVKQVIHPIHDQIFYLTEEHKRKLKEEYGVEPWTFEQRLGEAVFIPAGCPHQVRNLKSCIKVAMDFVSPENVDECIKLTGEFRRLPPGHRAKEDKLEIKKIALHALNQVINFLDPFSEGLKSGAAQPKNKKEADADAEAQKKPKRGRPCRKSNDEATDDKPKKKPGRPRGEKSGDGKSKDGAVDEKPPKMQGNRLKGSSKR

SEQ ID NO: 39874 - protein, 172 aa, Sorghum bicolor
  Clone ID: SORBI-28MAY03-C3444_1.pep
CATVDRKKQPWLIFIAHRVLGYSSGYFYGRDGSFAEPMSRQSLQKLWQKYRVDLAFYGHVHNYERTCPVYEEQCMSSEKFHYSGTMNGTIHVVVGGGGSHLSNFTIQVPAWSVYREMDYGFVKLTAFNYSSLLYEYKRSSDGEVYDSFTLHREYRDVLACVKDSCPPTLKST

SEQ ID NO: 39875 - protein, 163 aa, Sorghum bicolor
  Clone ID: SORBI-28MAY03-C33843_1.pep
TRTPPPASRRARNGFAPSCPGFYEILSLTGSYNLAEGSQAQGQGQQSGGLSVTLCSPERNVIGGVLGGPLVAASTVQVVLGTFHQGGSRSKSKKAGKLQQQQQAATATAAAFSSDSLTGGQEASPSSGHNQNLTPPPSVTGGWPTSGIFDTRSSSIDINSSRG

SEQ ID NO: 39876 - protein, 209 aa, Sorghum bicolor
  Clone ID: SORBI-28MAY03-C33883_1.pep
AKKREAAYIVTFAKREQEIAELKSAVRDLKTQLRPPSMQTRRLLLDPAIHEEFTRLKNLVEEKERKIKELQDNVAAVNFTPSSKLGKMLMAKCRTLQEENEEIGAMASEGKIHELGMKIAVLKSQNNELRNQFDVLYKHMDGVTNDVERSNEMVSILQEQLEAKDLELARLKETLSQKEGTQDAPVEERDEAGDDQKAASDPLQVKVES

SEQ ID NO: 39877 - protein, 166 aa, Sorghum bicolor
  Clone ID: SORBI-28MAY03-C33886_1.pep
ATAFTRCPKYPRTRTTLLLPGPRLREVLRREPAGRGRAAHEWLHGLPRRRAARHRRRLRPCVAAVPPSRRRRRRPRCRRAALSLPTSRCENGGTGVIVVQQLASAPAGVFCPYQPRLFRLHGGSDKIRQEKWKGKRLTSDDSAATTANRGENNDISAHRMASFYTF

SEQ ID NO: 39878 - protein, 109 aa, Sorghum bicolor
  Clone ID: SORBI-28MAY03-C33947_1.pep
MGIATRTTNVSIILRYTLIHLANSDQEPLQLFLSYQQYKCSCIDIEGEPSRQHANSFLVQQTPFPSLQNCPLEAICNEFYKASQVHPVLLAVFLESLEPSIARSMSVYE

SEQ ID NO: 39879 - protein, 112 aa, Sorghum bicolor
  Clone ID: SORBI-28MAY03-C33980_1.pep
IQENGYGAFFNDSIHDHERAEYLSGYIGSALAALRNGANVKGYFVWSFLDVFELLAGYISRFGLYHVDFQDPALPREPKFSAQWYGKFLRSEIGINMENIISTDDARSHAEQ

SEQ ID NO: 39880 - protein, 143 aa, Sorghum bicolor
  Clone ID: SORBI-28MAY03-C34548_1.pep
VAHIQLIIVTKFIEKVQQDIPGHGVKEQLQTLCNVYALYILHKHLGDFLATGCITPRQGALANEQLVGKLYAQVRPNAVALVDAFNYTDHYLGSVLGRYDGDVYPALYEEAWKDPLNQTVVPEGYHDYLRPLIKQQLLKLSRL

SEQ ID NO: 39881 - protein, 106 aa, Sorghum bicolor
  Clone ID: SORBI-28MAY03-C3459_1.pep
MFLRSKTQEVILRRRSRSMNSAGAQRSHVPDQAASSSTVPCDGDSGGAGADAAGSKSAAARALFASPRLLHSSSLPAGTLAFAKSPARDAESDTAFLMSPTSVLDA

SEQ ID NO: 39882 - protein, 108 aa, Sorghum bicolor
  unsure (1)..(108): unsure at all Xaa locations
  Clone ID: SORBI-28MAY03-C34605_1.pep
SLSTDDPLXIHLTKEPLVEEYSIAASLWKLSSCDLCEIARNSVYQSGFSHRLKSHWIGRNYYRRGPEGNDIHQTNVPHIRVEFRHTIWKEEMELIHFGNVKLPEEIDR

SEQ ID NO: 39883 - protein, 159 aa, Sorghum bicolor
  Clone ID: SORBI-28MAY03-C34726_1.pep
MQRYDDEAYAAYDELFSYACPKFITPSPPVLDQPLTNYNQDAYRLQLKLFLYEVKQQQLLSGIRSYLKLYSTITISKLAQYMEMDEATLRSILMTYKHKMHAVDSDGKIVSSADFDFYIVEDVIHVVESKPTKRHGDYFLRQILKFEEMIGELEKVQLD

SEQ ID NO: 39884 - protein, 153 aa, Sorghum bicolor
  Clone ID: SORBI-28MAY03-C34763_1.pep
SAVSIIETDCEVDFAPPLDYKEPEKPRQPTVPAGKAPAEDGNTVVEDEPKFKPFTGSGKRLDGKASKLQSSVGPSTALSAPSDSNKRGNQQMSAPAASGASNYSRQKTGKLVFGSSASNNKEPQKAPVKEEEPAKKDEPRFQAFSGKSYSLKR

SEQ ID NO: 39885 - protein, 124 aa, Sorghum bicolor
  Clone ID: SORBI-28MAY03-C3479_1.pep
FRDSRLCLGVILGQRPNIFERKFEAPIHPPLVAVFGPSIPIKPVPEPTEHLLQKQLLYHHACQLTKGLQFTARHMDKLLFSNVGLASLLYYMEALMEVKDPFRGSGRRPLFSTVAVMVAESHFV

SEQ ID NO: 39886 - protein, 240 aa, Sorghum bicolor
  Clone ID: SORBI-28MAY03-C34132_1.pep
MADADAAPPTPPPEVLVPEEHLAAVESAVAAVQEEVAATAEVDNKRKLEDVSADAEANGTGEDAKRLRVDGEPDVATGAGVELQKDGSSVNVEEPAAAEDKVAPTDGAAMDGDNGAAAAPAPDSASDEKPLEAAAEAPQQEGDAATEAPQQEGDAATDAQDISRKIEVPNSKVGVLIGKSGETIRNLQSSSGAQIQITKDADVDPNTLTRSVELVGTLGSVDKAEQLIKCVIAEAEAGGS

SEQ ID NO: 39887 - protein, 211 aa, Sorghum bicolor
  Clone ID: SORBI-28MAY03-C34138_1.pep
ARGSITAFGDVLQLARSSQEALAATGVSARGHDVGGKNSSDRSFMADLVYWIAQNPPPVHFFLISGDKDFANILHRLRMSNYNVLLACPSSATSVLCSAATIMWPWDGLVRGEDLSPKRFNHPPDGLHGSWYGHCQGALDDPSLEKESKEPINVASDPKHFSVPSDTKPSSAPKYVTNAILEVLRSYPEGMRISELRGQLIKNSIDLDTDF

SEQ ID NO: 39888 - protein, 225 aa, Sorghum bicolor
  Clone ID: SORBI-28MAY03-C34161_1.pep
ETKGNEGSGEVVQDWQGSLRFLAATVGTQHRLHHCRKVQPQNKSWSFSGAPSEPKHGNKLETGFDVEATTSSTGTKHDKKTWSQVAKEQPRSRSASPGAGMTSPPSPALTATAWHSPSLATSSPITPHCRAPGSNLMKDKAVKRDVGAPKKDFTYDIWGDHFPGNLLVIAREAAPCKMPDASEGASYSLFAREPQTLMMKPSAPPPMSRGRGSPPSDVASGYGIK

SEQ ID NO: 39889 - protein, 181 aa, Sorghum bicolor
  Clone ID: SORBI-28MAY03-C34193_1.pep
PNLYVDGKVCLSLLNTWTGRGNEVWDKSSSSILQVLVSLQGLVLNEKPYFNEAGYEKQVGTVEGEKNAVPYNENTYLLSVKSMLYILRRPPLHFEDFVKSHFRKRGHYILKACEAYLQGNVVGTLTDDACPTERSKEHSSSVGFKLALAKILPRLITALKDTGADCDQYEPLGKTETVRES

SEQ ID NO: 39890 - protein, 88 aa, Sorghum bicolor
  Clone ID: SORBI-28MAY03-C34305_1.pep
YEATKQGPWWILKRYQADRFNLRTSEASRLFCKWQQMFNCATLRPVLFADCPRRSQLAYPAHCLPQSPTRKSTAYAIVLKTFEPFLRP

SEQ ID NO: 39891 - protein, 235 aa, Sorghum bicolor
  Clone ID: SORBI-28MAY03-C34998_1.pep
AMSQHGSLTWEARIKILLGTAKALAYLHEAIEPKVVHRDIKSSNILIDDEFESHVADFGLAKLLGAGKSHVTTRVMGTFGYVAPEYANTGLLNEKSDIYSFGVVLLEAITGRDPVDYGRPPNEVNLVDWLKMMVASRRSEEVVDPTIETRPSTRALKRALLTALRCVDPDSEKRPKMGQVVRMLESDDPIPRGDRRSKHHRGGSTEMDSQRDNSDTEKSDNPDSKPSRSRASSSK

SEQ ID NO: 39892 - protein, 285 aa, Sorghum bicolor
  Clone ID: SORBI-28MAY03-C35055_1.pep
MALNDRLNKFKQQQERCQNTLSSIFASQTSISTSKHVPGIQPVNAPLAPIKPLHPIKFSNDTERLQHINSVRKSAVGVQIKLVVELLYKTRQSFTAKQVNEATYVDIHGNKAVSDSLRNNPKVLFDGTRFSYKPKHILTGRDELLGLIKEKECGLPVEDIKDAYPSVLEDLQALKASGDVWWLSSTQSQEDMAYFNDPRYNITVDNDLKELFLKTELPRDMLDVEKEIKKSGEKPMTNTTKRRALAQILDAAPKTKTKGSKKKQRRLTGKSKGLTNIHMPELCDA

SEQ ID NO: 39893 - protein, 120 aa, Sorghum bicolor
  Clone ID: SORBI-28MAY03-C35073_1.pep
PRPPVPIFHPAPAARGDHGQHGVQQPRPVSMMGLLEVASRPLDNYMKQNGLTSLVGEQGGGSSSTATVPPGPVESEERTSNEGRVTSASAEREPDAMAIDEAGENQQDKAADDAAAPAAT

SEQ ID NO: 39894 - protein, 85 aa, Sorghum bicolor
  Clone ID: SORBI-28MAY03-C35147_1.pep
KPYDSSRPRAEQHLVRWATSQLYDIDAIAKMVDPSIRGQCSEKALSRFADIISSCIQHEPEFRPPMSEVVQDLTRMVSSVSRASM

SEQ ID NO: 39895 - protein, 238 aa, Sorghum bicolor
  Clone ID: SORBI-28MAY03-C35150_1.pep
ARGDKKMQEMFDDSYYDADDVDPEFGSGVEMDLEKPDFDKEDELLGLPKGWASDQSKEESTAADAKGAKGKISLKDKVELEKEMEEYYKLDYEDTIGDIKTRFKYKQVKPNSFGLSACDILTSDDKDLNQYVSIKKLAPYREDEWKVTHHKMQSKDLILGGQKEGKKDKSVKKSRSEEGGPSSSKTEKDRLTNGQESTDDKKKTTRSERRKRRNADLKISDDRLAAFGKTNSKRHKSH

SEQ ID NO: 39896 - protein, 215 aa, Sorghum bicolor
  Clone ID: SORBI-28MAY03-C35218_1.pep
ARGDEIEKADPAVFNVLLQLLDDGLLTDGKGRIVDFKNTIIIMTSNLGAEYLMEAISGEKTMEAARDLVIKQAQKHFRPEFLNRLSELVVFEPLSQDKRREVANIHMKGIIARAANKGITLSASDAALDVVLSESDDPHYGARPIRRWLQKNVMTKLSEMLFKGEIDADTAVIIDACDDKKCLKYEVVKNVPTSEALHRRLVVEIPSDSDSDDDL

SEQ ID NO: 39897 - protein, 444 aa, Sorghum bicolor
  Clone ID: SORBI-28MAY03-C34463_1.pep
TRTLRAFVVSALLAVMFSVIVMKLNLTTGIIPSLNVSAGLLGFFFVRMWTAAVERMGFLRQPFTRQENTVIQTCVVSAYGIAFSGGFGSYLFGMSDKIANQATEAKDANNIKDPHLGWMIGFLFLVSFIGLFALVPLGKIMIVDYKLTYPSGTATAYLINGFHTPEGAKLAKKQVKTLGKYFVFSFFWGLFQWFYTAGDECGFKNFPTLGLEAYNNRFYFDFSPTYVGVGMICPYIVNVSVLLGGILSWGVMWPPRAKKKGSWYPANLEDSSLHGLQAYRVFISIALILGDGLYNFIKVLIRTIAGFISMVQQNSKIMLPVSDNGSSMSSTEAVSFDDERRIEIFLKDQIPKSVAYGGYVAVAAISIGTLPQIFPQLKWYYILVAYVVAPVLAFCNAYGSGLTDWSLASTYGKLAIFVFGAWAGLSQGGVLVGLAACGVMMSIV

SEQ ID NO: 39898 - protein, 296 aa, Sorghum bicolor
  unsure (1)..(296): unsure at all Xaa locations
  Clone ID: SORBI-28MAY03-C34480_1.pep
PAPPPPAPPPPAAPPPFAPAPGLPPAAPPPAAVPDAPNSVPVPLYPLVRHLYRHVRHQIVDGGLQRLAGRLLRLAPRPSPDAPAPSADAVPACRDRDHVFLLLYRELWYRHAHARLSPLTAAHRAESWTNYCDLFSVVLHGVVNMQLPNQWLWDMVDEFVYQFQSFCQYRAKLKTKTEDELSQLKQFEKAWNVYGVLNYLKALVEKSMITQILEREKEGLEQFTATDGYDYEGGSNVLKVLGYYSMIGLLRIHCLLGDYHTGLKCLAPIDLNQQGVYTIVIGSHIXTIYHYGFANL

SEQ ID NO: 39899 - protein, 154 aa, Sorghum bicolor
  Clone ID: SORBI-28MAY03-C3451_1.pep
PESKATTESVYSAALALGIANQLTNILRDVGEDATRGRIYLPQDELAQAGLSDEDIFKGVVTNRWRNFMKRQIKRARMFFEEAERGVTELSQASRWPVWASLLLYRQILDEIEANDYNNFTKRAYVGKGKKLLALPVAYGKSLLLPCSLRNTQT

SEQ ID NO: 39900 - protein, 320 aa, Sorghum bicolor
  Clone ID: SORBI-28MAY03-C3452_1.pep
MAGWLKALAYSAGGVAVAGLAALVALQERLVYVPVLPGLPRAYPITPARLGLIYEDIWLRTVDGVRLHSWFIRHSPTRPGPTFLFFQENAGNIAHRLEFVRLMMQRLQCNVFMLSYRGYGESDGYPSQKGITYDAQAALDHLAQRKDIDTTRIVIFGRSLGGAVGAVLAKNNPDKVAALILENTFTSILDMAGIMLPFLRWFIGGSSSKGPKLLNCVVRSPWNTLDIVGQVKQPILFLSGLQDELVPPPHMKMLYDKASDHNRNCRFVDFPSGMHMDTRMSGGDRYWRTIQLFLDQYAPGVQNRDVSFKSEITEDDEAAD

SEQ ID NO: 39901 - protein, 213 aa, Sorghum bicolor
  Clone ID: SORBI-28MAY03-C35357_1.pep
MAAAARRSPTRAAAAGGPAAAPTQQRSVLRVASSAASASSSSARTRRGAAAMQPAKAVAAEAASPAVEMGNGAAVAGMQRPDAMGRFGKFGGKYVPETLMHALTELENAFHALATDEEFQKELDGILKDYVGRESPLYFAERLTEHYKRADGTGPLIYLKREDLNHTGAHKINNAVAQALLAKRLGKQRIIAETGAGQHGVATATVCARFGLQ

SEQ ID NO: 39902 - protein, 191 aa, Sorghum bicolor
  Clone ID: SORBI-28MAY03-C35378_1.pep
MRAPAPPPPRLPRPAGPPPSPPAPRPRPRPRGAAPPRPGIPALLGVAAPPLAARPPEPRLPPARLPCRSVCSPVRAPGRCDDPAATASYLHCVDTGSGAWAGGVFDVPIRKDIVHRVVRWQLAKRQQGTHSTEAFCAPGGTGAAPYKPAGAARARHGPRRGPHRRGAAPAHGPWPRTPAITPRSPVRRLGL

SEQ ID NO: 39903 - protein, 156 aa, Sorghum bicolor
  Clone ID: SORBI-28MAY03-C35391_1.pep
MELAWSCCCFLLATCARALRRLLQLPALLCCEAMVWAVTFLAFPLRMLTAVDRERKLGRLVAEMQAQMDDLAWENTALEDRLRAALRDQEALAAVLDEMEDEHDDALARIHVLETQLKALRQENMRLNEHKGKSKWDKLAGQAAARHGSGGGNRAS

SEQ ID NO: 39904 - protein, 202 aa, Sorghum bicolor
  Clone ID: SORBI-28MAY03-C35394_1.pep
MDLYDKREDMALQDGDYCLAPRASRGGCEVDLQWADGLVEGAGRKRCALEDFEDEVQEMDEVDGGGKRSKPPSPQPHTPDIREAHAPSRRRRTVVAGGGEHSGGGGDLIGEIGRDLSINCLLRLSRSEYGSVASLNHDFRSLVRGGEIYRLRRQNNIAEHWVYFSCNVLEWDAYDPYRKRWISVPKMPPDECFMCSDKESLA

SEQ ID NO: 39905 - protein, 148 aa, Sorghum bicolor
  Clone ID: SORBI-28MAY03-C35499_1.pep
MPYCEVGSYADGDKWEGVRLFYRRYGRGATKVLLIIGLAGTHDSWGPQIKGLTGSLEPADDEAVRPDEEAGVGAAGAAEAAPAEADEAAGGGDGIEVCCFDNRGVGRSSVLPNKSYYSTAIMATDALALMDHLGWKKAHVFGHSMGAM

SEQ ID NO: 39906 - protein, 195 aa, Sorghum bicolor
  Clone ID: SORBI-28MAY03-C34830_1.pep
RKGDPFLLHYSQPNGFMPRRKPGHLKKAGVVWGQLKGGYSWEKGRSQMMRAAVADATILNSCSSNSINGGLGGGCKGAVRQNVLHHATFLESTSSIGCCCHRTIFHLLLFPRVDCLLLLGAAITTLSLLLLVLAFCISSCRGSSRSTHCNATSTAHPLLDAGDILQMGGIAAIPVVAAAFAISLPQRHGRTCTSC

SEQ ID NO: 39907 - protein, 123 aa, Sorghum bicolor
  Clone ID: SORBI-28MAY03-C34820_1.pep
ILVELCTGEALFQTHENLEHLAMMERVLGPLPYHMLKRADRHSDKYIRKGRLNWPEGCTSRESMKAVMKLSRLQNLVMQNVDQAAGDFIDLLQGLLKYDSADRLTAEEALRHPFFTEGFGQRR

SEQ ID NO: 39908 - protein, 144 aa, Sorghum bicolor
  Clone ID: SORBI-28MAY03-C34879_1.pep
TAPAQAASLLVLGPFVDFWLTNKRVDAFNYTSIVTFFIVLSCIIAVGTNLSQFICIGRFTAVSFQVLGHMKTVLVLTLGFLFFGKEGLNFHVALGMLLAVIGMIWYGNASSKPGGKERQVYSTPSEKTQKHGVLSSQSELDQKV

SEQ ID NO: 39909 - protein, 120 aa, Sorghum bicolor
  Clone ID: SORBI-28MAY03-C34839_1.pep
RSSSVTATPHVSEANVATKALAASDNVKLSAASSGTSNGMKEEASPTKEALDVTSFRQRAEALEGLLELSADLLENQRLEELAIVLKPFGKNKVSPRETAIWLARSFKGMMSDEAGRTSL

SEQ ID NO: 39910 - protein, 204 aa, Sorghum bicolor
  Clone ID: SORBI-28MAY03-C34899_1.pep
TREREVLEVHIEKGMQHGQKIVFQGEADQAPDTVTGDIVFVLQVKEHPRFKRKYDDLFIEHTISLTEALCGFQFILTHLDGRQLLIKSNPGEIIQPGQHKAINDEGMPQHGRSFMKGRLFVEFNVEFPESGALSPDQCRALEKVLPQRPRAQLSDMEVDQCEETIMHDVNMEEEMRRRKHQRRQEAYNEDEEDAGPSRVQCAQQ

SEQ ID NO: 39911 - protein, 239 aa, Sorghum bicolor
  Clone ID: SORBI-28MAY03-C34021_1.pep
DKGKKGSPAAAKGKGKGEKRQRQPRFAFMTKSEVDHLEDGYRWRKYGQKAVKNSPYPRSYYRCTTQKCPVKKRVERSYQDPAVVITTYEGKHTHPIPATLRGSTHLLAAQLHGGHHHHHHLGGAFPPPAPLPQQMAGAPFGRAGGGGGGVIDMLGLLPPRNNNHAAMPPPVGLASSRGMSGGGPMSTVAGATAATAAATTTSSSSPPSLQMQHFMAQDFGLLQDMLPSFVHGNGGNVQP

SEQ ID NO: 39912 - protein, 163 aa, Sorghum bicolor
  Clone ID: SORBI-28MAY03-C35856_1.pep
STRFTPYQPQGLVADEFPHLDIINDLLDEEQSDRRRVLQPGFVQQFSMPNGASTPEYGLFSEPYLFDQSEQYFDEEPPRFYSPLSSAPRRLRDRSYSHFDLPSYSSSSQFDDLMMSQWPYSRTDISMPSFESDTSGYPYQAQDFPSSANRASRYPSYRPANGH

SEQ ID NO: 39913 - protein, 361 aa, Sorghum bicolor
  unsure (1)..(361): unsure at all Xaa locations
  Clone ID: SORBI-28MAY03-C3564_1.pep
VRPRVRPRVRESYSSGVDVLLSLRDLQLGARGDLKVIVPGRXRQFILGEQETSLYCYKAILLDAKKQTETFVYHCGVFIVPKARAQEWLFSSEEGQWHVVESARAARLIMVFLDSRHANIDMDIIKKDXSPLVKELEPGNPEEEAPIPFMMAGDGAVAADLWRSPREATSEITGPMVVEDVVYENADGDQGSMSEKMFRRLIFGRSSGLVQSEALLIRDPPSDEIDRKNKSASATSKKRRNQKKGSKNSLRIDHRFLGSSYHSSIISGLSLVASSLSVAASSGGKVSTTVIGLGAGCLPMFLRGCLPSVDVEVVELDPLVAELAKKYFGFSMDEQLKLHLGDGIKFIEDSVAANHSVNGSA

SEQ ID NO: 39914 - protein, 326 aa, Sorghum bicolor
  Clone ID: SORBI-28MAY03-C35869_1.pep
MSGWSWLCCGRSKAGGSDVRLPEPFQLPAPLPDWPQGGGLASRPTRRRALGGLRFAVRPDWWSCPVAAVSEPLRMPVAVPCLARFALPRGRPLQGFLLVAREVASHQVINSKPALEKPLDYSLVWTSADLNEDGNSECGCIWLPCPPNGYKALGYVVTKGPKKPSLEAVRCVRDDLTDTCDNFRSIVNMDNACQIWKTRPCHRGVRGHGIPVGTFSCATDSTDSDESSTPCLKNVDPNLRSMPNLEQINALIKHYGPTVFFHPQETYLPSSVSWFFENGATLYKKDAKMGDAILPGGLNLPVGGTNDGEYWIDLPDDDRKELVRDG

SEQ ID NO: 39915 - protein, 131 aa, Sorghum bicolor
  Clone ID: SORBI-28MAY03-C35870_1.pep
MGADSEDAVKQLSLLMEQVEAPLKRSFQNMHQGYLKETLVRFLKAREWNVSKAHKMIVDSLNWRIQNEIDSVLERPIVPVDLYRSIRDSQLIGLSGYTKEGLPVFGIGVGHSTYDKASVHYYVQSHIQINE

SEQ ID NO: 39916 - protein, 164 aa, Sorghum bicolor
  Clone ID: SORBI-28MAY03-C35885_1.pep
MGAATTNGSADPAPAPVPALKFLIYGRTGWIGGLLGGLCAARGIPFAYGAGRLESRASLEADIDAASPTHVFNAAGVTGRPNVDWCETHRAETIRANVVGTLTLADVCRGRGLVLINYATGCIFEYDEGHPLGSGLGFKEEDTPNFVGSFYSKTKAMVEELLKN

SEQ ID NO: 39917 - protein, 148 aa, Sorghum bicolor
  Clone ID: SORBI-28MAY03-C3525_1.pep
HLEKGDNVSALITAEFYSRDQFPGFGRPFVFNAEILKRVGRTSEAKDSARVALKSPWWTLGCSYEEAAELAGWEDEQLEFIREKVTEEGKREDLKKGKAPEQVVLDEAAFLMDLASVDGNWDEVVDRIAECYREAGLHDIANFIAYRE

SEQ ID NO: 39918 - protein, 198 aa, Sorghum bicolor
  Clone ID: SORBI-28MAY03-C35262_1.pep
MHRGIEHAPEMVEPPRVAGCSTNWREEADERLRRLHSLLFGADAALEHGDVMLAQALALRLLGFLDCQALAAGAGPEDAAFVAPIRAAASARLAAASRARVPDSDRAAFELARTDVGCVFAKQGDNNVERIQCSKYFQALLQKAKANASEQLNATCQEFSVQWAPCVDESQADMENEKLSIRDSKLMLQTKLASLYSS

SEQ ID NO: 39919 - protein, 180 aa, Sorghum bicolor
  Clone ID: SORBI-28MAY03-C35327_1.pep
MAEETQPEAAAAAAAAAPPAAEVVVTEAVAAEVEVPAAAEAEAEPETEKKADEAAVTADDAGEGTGSFKEESNLVEDLPDPEKKALDEFKQLIAAALAAGEFNLPPPPPPPKAKEEPKAEETKTEEAKTHEAKTEEAKTEEPVKEEPKAEAEAAAEEPKAEVAADAPAEEVKTEVPPPEE

SEQ ID NO: 39920 - protein, 148 aa, Sorghum bicolor
  Clone ID: SORBI-28MAY03-C35355_1.pep
MDGGAGAGRRSVSSSSGSRRRLPPAENGHGHDAPPPSRRASVSLSRGPSTTLTSERTVKRLRLSKALTIPDHTTVHEACRRMASRRVDAVLLTDSNALLCGILTDKDITTRVIAREMKMEETPVSKVMTRNPVFVHADTLAVEALQKM

SEQ ID NO: 39921 - protein, 110 aa, Sorghum bicolor
  Clone ID: SORBI-28MAY03-C36324_1.pep
GNAAFKEKQWQKAVNFYTEAIKLNGKVATYYSNRAAAFLELTSYRQAEADCTSAIDLDPKSVKAYLRRGTAREMLGYYKDAVDDFNHALVLEPMNKTAGVAINRLKKLFP

SEQ ID NO: 39922 - protein, 261 aa, Sorghum bicolor
  unsure (1)..(261): unsure at all Xaa locations
  Clone ID: SORBI-28MAY03-C3636_1.pep
AVVSRAPSRLPSSPPASWPPRRRPPPPPPSSPPRRRSRPPPRPPPPRPPSPPRRRHPRRPPSSSSPGRGRCACGRWPRRRAGAAPRPPAGRCAHPPAAGAPCRATRDGWLQRMHPNNGSWERWRFVGGTGLRGVAPSADGTMLVCDADKGLLRVGEEGVTLLASEVEGTTIRFADAAIEASDGTVYFSDASTRFGFDRWFYDFLESRVTGRLLRYDPRNGETSVVLDRLSCANGVALSRDETFVVVCETXRFMCLKVWLXG

SEQ ID NO: 39923 - protein, 104 aa, Sorghum bicolor
  Clone ID: SORBI-28MAY03-C3638_1.pep
NGNPAAASPEDEEEEAGGALRLCSQALCGRPETRRHEFRRCSVCGVVNYCSRACQALHWKMAHKAECTPADRWLDVAVGGGVGGGAAVQPNANANADAAAAPAP

SEQ ID NO: 39924 - protein, 128 aa, Sorghum bicolor
  Clone ID: SORBI-28MAY03-C36394_1.pep
VEDAVVVALGQHRRPSIVRQFTSDFKSPGEPKYLEAFDLSPEEAEDVSFKQAWLIYFWRRAKTHGVEEDIADDRLQFWIGRNAQAPNSHDAIDVERGLTELRKLGIEQQLWEGSRADIDQASLAMENQ

SEQ ID NO: 39925 - protein, 386 aa, Sorghum bicolor
  Clone ID: SORBI-28MAY03-C35510_1.pep
MACPRGRTSLPLCFFLMICLMAQLGASNVVLMANNTTLSFDDVEATFTPAVKGSGVNGVLYAVEPMDACSPLRTKAIEGSASPFALVIRGGCQFDDKGRNAQNAGFKAAVVYDNEDNGILVSMAGSSSGVHIYAVFVSKASGEELKKYSSQTDAELWIIPTYENSAWSIMAISFISLLAMSAILAACFFVRRHQIRRDRARLPQVRHVHGMSSQLVKAMPSLIFTKVQEDNCTSATCAICLEDYSVGEKLRVLPCRHKFHAACVDLWLTSWRTFCPVCKRDANAGTSNLPVSESTPLLSSSAIPLPESTALASFRSTVAASPPRPISRHPSSQSISRNYSISGSSIPRTPNPRFYANSSPFCTLANMSSSWSRTSHLASAHSLCGG

SEQ ID NO: 39926 - protein, 147 aa, Sorghum bicolor
  Clone ID: SORBI-28MAY03-C35584_1.pep
LLKNYENVCTLRVRMPISSDLSNPRNFITKITRYDKVVNIPNSMTILDELLPISIEMAKRNLTGIWNFTNPGVVSHNEILEMYRDYIDPSFSWKNFNLEEQAKVIVAPRSNNELDQTKLKREFPELLSIKESLIKYVFEPNCKTSKA

SEQ ID NO: 39927 - protein, 162 aa, Sorghum bicolor
  Clone ID: SORBI-28MAY03-C3562_1.pep
NVSDARFFICSLIVLISSSRWVVEKLTFLILLILLHTKIRLRLGDSVLRLGENTASRQILGVRSSTNKTNKDDDEASQNDGSTRRTRSPTWEAEKITNPIDRIVAHLLIHRNCYKVATPTNKEIISSTPFKIEPDPKLTLGTPRLPTQDPGDVRANVWPLPQ

SEQ ID NO: 39928 - protein, 279 aa, Sorghum bicolor
  unsure (1)..(279): unsure at all Xaa locations
  Clone ID: SORBI-28MAY03-C35625_1.pep
MPPPLEARDFLGAGATSSCCSSSCSSGGDGTVPHLALRLGLPGSDSPGRGAQAEHAHVDAALTLGPAPAPAPPRGGAKRGFADSLDRSAKRDGAAADDDAAGGVTGEDKXVAAAAAGAPPAAKAQVVGWPPVRSYRKNTLAASATKTKVEDEGRSEAGCCYVKVSMDGAPYLRKVDLKTYSSYENLSLGLEKMFSCFITGQNSSCKTSRRDRFTDGSRADALQDQEYVLTYEDKDADWMLVGDLPWDLFTTICRKLRIMRGSDAAGMAPRSLEQIARNK

SEQ ID NO: 39929 - protein, 162 aa, Sorghum bicolor
  Clone ID: SORBI-28MAY03-C35671_1.pep
APPFGFRRGPWIFRPVSHHSTHMSGGASFGEEFPGVVNPLDGVEWIQDNSNGLTGMYQYFVKVVPTIYTDIRGRKIYSNQFSVTEHFREAIGYPRPPPGVYFFYEFSPIKVDFTEENTSLLHFLTNICAIVGGIFTVAGIIDSFVYHGHRAIKKKMELGKLG

SEQ ID NO: 39930 - protein, 170 aa, Sorghum bicolor
  Clone ID: SORBI-28MAY03-C35684_1.pep
NTTAAAIAPATATNPRAEAWEAAPLPAGATVGAPVGEEETEEVGVTATDGAGPSAVGGAGGDASGDGAAAVGGLAAGAGAVAGDRAGGGGSGAILGAGVGVAAGACAAAVTARRATMAAATTAKRAIGIVAAVEKGEIGGSGEADGDWRVCLRAADSAASSAAECGLEPR

SEQ ID NO: 39931 - protein, 114 aa, Sorghum bicolor
  Clone ID: SORBI-28MAY03-C36801_1.pep
LIIKKKYQGTNDCFVFTNVDGRPVICHPTGANNYFTFCSPDYLAMGGGGHFALYLDGDLVTGSSSTSETFNNPCLSHTQEFKIKDVELWGFVNASKYEEMLTVCRTEKQGIWNL

SEQ ID NO: 39932 - protein, 154 aa, Sorghum bicolor
  Clone ID: SORBI-28MAY03-C36819_1.pep
GAGIQGIFMLVSGYFRLPHDIPKPFWRYPMSYVSFHYWALQGQYQNDLKGLLFDNQDDELPKIPGEFILENVFQIDVNRSKWLDLAVLFSMIVIYRLLFFVMIKISEDVTPWVRRYIAQRRVQNRRQRKVELATRTPSLRGYVVDVASLPADHP

SEQ ID NO: 39933 - protein, 119 aa, Sorghum bicolor
  Clone ID: SORBI-28MAY03-C37000_1.pep
MRVSGGRLRRLLAVTVVLSVALSLATAAAGGGEHNFRRDFDVVWGAGNARFRDGGRTVELSLDERTGARLQSKQRYLFGKFDLEMKLVPGESAGTITSFYGKKENALDGWMASLQLGRS

SEQ ID NO: 39934 - protein, 179 aa, Sorghum bicolor
  Clone ID: SORBI-28MAY03-C3704_1.pep
EGIGYLPVCTSELLESATQKSIDTWVASEGADSVAEAESVVLESLSSHVRTVVATLGGKQGAASRFDRWQYLHSGFTVWLSVSDASDEATAREEARRSVSSGSVSYAKADVVVKLGGWDPEYTRAVAQGCLVALKQLTLADKKLAGKKSLYIRLGCRGDWPNIEPPGWDPESDAPPTNI

SEQ ID NO: 39935 - protein, 154 aa, Sorghum bicolor
  Clone ID: SORBI-28MAY03-C35990_1.pep
MWRGCVSRGLRKVKAAASASRLFSTSSSYTVVDHTYDAVVVGAGGAGLTAAIGLSEHGFNTACITKLFPTRSHTVAAQGGINAALGNMSEDDWRWHMYDTVKGSDWLGDQDSIQYMCREAPKAVIELENYGLPFSRTEDGKIYQRAFGGQSLDF

SEQ ID NO: 39936 - protein, 175 aa, Sorghum bicolor
  Clone ID: SORBI-28MAY03-C3611_1.pep
RPVKYRDLEEKMERYEMERSSMLVDEDPDTKVKEKEIAAAAEKLAECQETILILGRQLQAMRSPAESLGSSPNRQRMEEFLQDAVGTTAGEYSQKPSGQPDTDQEILGTGNVSPVNGYKTHMIPSDADGSPFLSPNSSKRPKHRSRSSSSSSFTNHPLPDKQSRGFSRFFAKTKE

SEQ ID NO: 39937 - protein, 323 aa, Sorghum bicolor
  Clone ID: SORBI-28MAY03-C36170_1.pep
HEENMKILAKDEYERNFISAVVPPNEIGVKFDDIGALEDVKKTLDELVTLPMRRPELFSHGNLLRPCKGILLFGPPGTGKTLLAKALATEAGANFISITGSTLTSKWFGDAEKLTKSLFSFASRLAPVIIFVDEVDSLLGARRGAFEHEATRRMRNEFMAAWDGLRSKENQRILVLGATNRPFDLDDAVIRRLPRRILVDLPDAQNRMKILRILLAKENLESEFRFDDLANATEGYSGSDLKNLCIAAAYRPVHELLDQENKEDMGSTKTSLRALKLDDFVQAKAKVSPSVAFDASSMNELRKWNEQYGEGGSRSKSPFGFGS

SEQ ID NO: 39938 - protein, 210 aa, Sorghum bicolor
  Clone ID: SORBI-28MAY03-C36202_1.pep
MGEACRDAAAAGRQDEAGGGGGRHHAENEVVGDLAASAKLYEDVPAFPMMALNHISRLCESVDASVRFYVKALGFVLIHRPPALDFSGAWLFNYGVGIHLVQRDDARRAPDVRPETELDPMDNHVSFQCEDMGAMERRLQELHIRYMKRTINEEEGSPIDQLFFRDPDGFMIEICNCENLELVPAGALGRLRLPRDRHNPPVRTGTGGAE

SEQ ID NO: 39939 - protein, 116 aa, Sorghum bicolor
  Clone ID: SORBI-28MAY03-C36242_1.pep
TSIDALAVCIGNVHGKYPPSGPNLRFDLLKDLRALTLKKGVSLVLHGASGLPHELVKECIDLGVRKFNVNTEVRNSYLESLRKPEKDLIQVMASAKEAMKAVVAEKLRLFGSSGKA

SEQ ID NO: 39940 - protein, 247 aa, Sorghum bicolor
  Clone ID: SORBI-28MAY03-C36317_1.pep
MYLPRKRKHFPVFTCLYNEVMCISCHFFHCAILILPSVAILLFFLQVCQCADRLIVVCIVWYNILAFNSQYIICCRGYLAPEYALLGQLTKKADIYSFGVLLLEVISGESSSKSTWGPDMHVLVEWTWKLREEGRLLEIVDPELENYPEEQMLRFIKVALLCTQATSQQRPSMKQVVNMLSNQSEIDLQNVVPPGVLKEPRPRTGGFGGLTADTSSSQSTKGNPAESYSTQTNMNSCQFSTTDVSPR

SEQ ID NO: 39941 - protein, 180 aa, Sorghum bicolor
  Clone ID: SORBI-28MAY03-C37238_1.pep
YKGDLTPAQALDKVTTQDYVLIDVRSDKDKAKAGVPQLPSNAKNQLVSVPLEDLPSKLKGMVRNAKKAEAEIAALKISYLKKIGKGSNVIIMDSYNDVSKTVAKTLNSVGFKNCWVMAGGFSGRKGWAQSRLGTDSYNLSVVEVVTPSRVIPAVAGRTGTTSARIASRATTRKLLPGSVD

SEQ ID NO: 39942 - protein, 123 aa, Sorghum bicolor
  Clone ID: SORBI-28MAY03-C37296_1.pep
FYQFLVIWYLQTEGKWLVALLGVLALLVRFSPIFTCFVAGQVFNEMSSREMERINVFEGILNNNVFIAVLGSTVIFQFIIIQFLGDFANTTPLTLNQWIACICIGFIGMPIAAIVKMIPVGSS

SEQ ID NO: 39943 - protein, 124 aa, Sorghum bicolor
  Clone ID: SORBI-28MAY03-C37388_1.pep
LLEIITGQRAIDNTRAGGEQNLVAWARPLFKDRRKFPLMADPALEGQYPPRGLYQALAVAAMCVQEQPSMRPLIGDVVTALTYLASQTYDPEAHANSHLVAPGTPPRTRTRIRSHGAADQRGSG

SEQ ID NO: 39944 - protein, 127 aa, Sorghum bicolor
  Clone ID: SORBI-28MAY03-C37199_1.pep
HPLDPILFSIYVQIRPGFKAVARRELNDPENALIGAFAGAITGAITTPLDVMKTRLMVQGQGNQYTGIVNCAQTILREEGPKAFLKGIEPRVLWIGIGGSIFFGVLEKTKSMLAERRNRELRAVKDE

SEQ ID NO: 39945 - protein, 154 aa, Sorghum bicolor
  Clone ID: SORBI-28MAY03-C3735_1.pep
MEGQFQDGKEEVIQAWYMDDSEEDQRLPHHREPKEFIPLDKLSELGILSWRLNADDWENDEKLKKIREARGYSYMDICDVCPEKLPNYEATIKNFFEEHYRTDEEIRYWLVGRGYFDVRDENDQWIRVAVKKGGMIGLAAGMYHRFTLDTDNYI

SEQ ID NO: 39946 - protein, 103 aa, Sorghum bicolor
  Clone ID: LIB3476-040-P1-K1-F10.pep
MQDICDVCPEKLPNYEAKIKNFFEEHLRTDEEIRYCLEGSGYFDVRDENDQWIRVAVKKGGMIVLPAGMYHRFTLDTDNYIKAMRLFVGEPVWTPYNRPHDHL

SEQ ID NO: 39947 - protein, 77 aa, Sorghum bicolor
  Clone ID: SORBI-28MAY03-C37395_1.pep
TGADIYALCADAWFHAAKRSVKTFEIDPSRSNDASAEEVIVEIDDFITVLGDIAPSLSLEELQNYEQLRQKIEGPSR

SEQ ID NO: 39948 - protein, 270 aa, Sorghum bicolor
  Clone ID: SORBI-28MAY03-C43907_1.pep
ARGAGGGGGGDFLSRLFSVGAAHADDKSSGDWDAHGLPVNMTVPLTKLSRLQRYKLSELKFFDRAAAGGGAYTGPEDSFFEMVTLQPGGVYTKSQLLKELETLVSCGMFERVDLEVKPKPDNTIGLTVSFVESVWSAAKQFKCINVGLMSQSGQVDFDQDMTEREKMDYLRKQERDYQQRVRGAKPCILPENVRGEVLGMMKKQEKVSARMLQKIRDHVQKWYHNEGFVCAQVVNFGNLNTNEVVCEVVEGDITKVEYQFQDKLGNIVEG

SEQ ID NO: 39949 - protein, 198 aa, Sorghum bicolor
  Clone ID: SORBI-28MAY03-C44080_1.pep
ARARSPGPSPSSRPAPAARARRHLLASARPPAPCRLQPPRPASPSPRCLPAPPSQQVAHARPRALLAATPPQASPRPLLFGPRRRSGRAGPLLSSLVDARAATLFGVLLTRHPAAASNLTTSEPSPREVVCRVAGRKAKLYKKRFKTRETRTSRSLQGARRKFPLGPSVVGGRPGWDSSSPRSARVMPARLRSCYLRS

SEQ ID NO: 39950 - protein, 164 aa, Sorghum bicolor
  Clone ID: SORBI-28MAY03-C44084_1.pep
ISRFFHSSLTPCPLRCGWVPYDLAKPLLDTSQYSILSDYATMQGEVPQPQICGPSDDSSAKIDHHDSTSDEDDDEDFNDYESDMMVDEETIHSEKPDTTEGSSNINDIKNITLDLNGSRVKFKGLQQVFGPIERRHLTALEGQLSRYVKVVGKELSDRIVYCLS

SEQ ID NO: 39951 - protein, 182 aa, Sorghum bicolor
  unsure (1)..(182): unsure at all Xaa locations
  Clone ID: SORBI-28MAY03-C44103_1.pep
KVVIPRSPREAKGXLLLASIRDPNPVVFFEPKWLYRLAVEEVPEEDYMLPLSEAEVIRKGSDITLIGWGAQLAVLKEACEDAAKDGVSCELIDLKTLIPWDKETVEASVKKTGKLLVSHEAPITGGFGAEIAASITERCFQRLEAPVARVCGLDTPFPLVYEPFYMPTKNKVLDAIKSTVNY

SEQ ID NO: 39952 - protein, 200 aa, Sorghum bicolor
  Clone ID: SORBI-28MAY03-C44117_1.pep
CYCRFILVVLYRSQAKKLSTHQALTSKAPSLAPPRAPRRLEDLDARNDDGADRGVSSSSPPPPPPGVRADLGEPKLIWRAKATTAFAHFLIWPLSFPASTSFNEPGPMLSSSPENQRSYRFAFCFLLLLPPPPVAMSPSSSLTAAPSPFSCPSLPRRRAGSDLLPTDMDDVVAARWLSAISICVRKLIRPAGFVCDNNLP

SEQ ID NO: 39953 - protein, 164 aa, Sorghum bicolor
  unsure (1)..(164): unsure at all Xaa locations
  Clone ID: SORBI-28MAY03-C3775_1.pep
HEAQLGAMIVAWYLLNIYFNIYKAGAXALPLPLPYTITAFQLAFGSLLIFLMWATRLHPVPRLSAAQLGKIAPLAVGHMLGTVFTNMSLGKVAVSFTHTIKASEPFFTVVLSALFLGEVPSLPVLGSLVPIVGGVALALFTEVSFNWTGFWSAMASNLTNQSRN

SEQ ID NO: 39954 - protein, 152 aa, Sorghum bicolor
  Clone ID: SORBI-28MAY03-C37837_1.pep
LGYVYTWGRGYCGALGHGDENDKTSPELISSLKGQVAVQVCARKRKTFVLTDEGSVVAFGWMGFGSLGFPDRGSSDKVMRPRVLESLQDHYVSQISTGLYHTVAVTNKGIVFGFGDNERAQLGQEYIRGCLKPTEIMFQKSMEDIPIAAPSG

SEQ ID NO: 39955 - protein, 173 aa, Sorghum bicolor
  Clone ID: SORBI-28MAY03-C37775_1.pep
IDGPPVIRTSVINSTYKNFLEIVFQNNDTTVQTYHIDGYAFWVVGMDYGEWTENIRGTYNKWDGVSRCTTQVFPGAWTAVMLPLDSPGFWNVRTENLDTWYLGQETYIRVVDPNGGYNVTEMVAPDNMLYCGLLKDKQKAQKPHGSRSSASAAKLNYHVLAFLVSLVALALGL

SEQ ID NO: 39956 - protein, 213 aa, Sorghum bicolor
  Clone ID: SORBI-28MAY03-C379_1.pep
MNCETCQLKELELEPTEIRDVLRCILHTIFFHRTLSLVRPKDVDCDFLEITYVQCGLPELEKEVDEKIDQFTAWVEKHPNRRSQICLSFFDEKHRHPGWFVNKTERIYWEQWFINLHIMSPKRYSKSNSSKGLTNIGANALEETSTRRAALESSINEVLFQIINFANEKKDHIPAIPDRIFNHEIMIPSSDSVFGWNTDVIRRVLNSGHPYSL

SEQ ID NO: 39957 - protein, 166 aa, Sorghum bicolor
  Clone ID: SORBI-28MAY03-C37908_1.pep
YQTIPLNKIEDFGVHCKSYYALDITYFKSSLDSHLLDLLWNKYWVNTLSSSPLLGNRDYVAGQIFDLADKLEQAEGQLAHSRFGGMIMPSQRKKEQEESPLAKVTRDSSKITAEQVHGLMSQVIKDILFNSVHPSIKASTSAPDSSSAPDSSSAPDSSGPEPMVEA

SEQ ID NO: 39958 - protein, 115 aa, Sorghum bicolor
  Clone ID: SORBI-28MAY03-C37953_1.pep
LRKQNGDRAIWEYPFAVAGVNITFPLMRALGRLAVYPWPLLGPGFLFRRSENDRAFDILYCITFKLMDQQWLDMHATYMDFNTVMKSTRRQLERELLIEDIQRIEDMPSYRLLGR

SEQ ID NO: 39959 - protein, 101 aa, Sorghum bicolor
  Clone ID: SORBI-28MAY03-C37063_1.pep
MSQRQPRRPSGHQETTSGEQGAVRYGDVFPAVAGGLAEKPVAPQDAATMQSAENLVFGQTLRGGPAAAMQSAATANERMGAVGHDQATDATAVQGVTVSET

SEQ ID NO: 39960 - protein, 300 aa, Sorghum bicolor
  Clone ID: SORBI-28MAY03-C37077_1.pep
MKREYQDAGGSGGDMGSSKDKMMVAAAGAGEQEEELDEMLASLGYKVRSSDMADVAQKLEQLEMAMRVGGVGGAGATADDGFISHLATDTVHYNPSDLSSWLESMLSELNAPPPPLPPATTPPAPRLASTSSTVTSGAAAGAGYFDLPPAVDSSSSTYALKPIPSPVAVASADPSSTDSTREPKRMRTGGGSTSSSSSSSSSMDGGRTRSSVVEAAPPATQAPAAANGPAVPVVVMDTQEAGIRLVHALLACAEAVQQENFSAADALVKQIPMLASSQGGAMRKVAAYFGEALARRVYRF

SEQ ID NO: 39961 - protein, 198 aa, Sorghum bicolor
  unsure (1)..(198): unsure at all Xaa locations
  Clone ID: SORBI-28MAY03-C3700_1.pep
RVFSRQPVTTAPSDHLVHKLLSALIKDQRWIRAVLHIAGPACTISTVTNVAYKYQFKQYAWTHMILLTVFAQSAFTVANIFEGIFWFLLPASLIVINDVFAYLFGFFLGRTPLIKLSPKKTWEGFIGASVTTIISAFLLANVMGRSQWLTCPRKDLSTGWLYCDPGPMFKSEHYLLEEWVPTWFPWKELAIXPVQWHA

SEQ ID NO: 39962 - protein, 129 aa, Sorghum bicolor
  unsure (1)..(129): unsure at all Xaa locations
  Clone ID: LIB3478-046-P1-K1-D3.pep
SDHLLYKVVSGLIKYQMFICYFLYIAGFVWCILTLKKKAYKYQFKQYAWTHMILLTVFAQSAFTVANIFEGIFWFLLPASLIVINDVFAXFGFFLGRTPLIKLSPKKTWEGFIGALVTTIISAVLLTNA

SEQ ID NO: 39963 - protein, 119 aa, Sorghum bicolor
  Clone ID: SORBI-28MAY03-C37117_1.pep
LKGPEAPAVMQVPQIQKGGAEKGIVPTGYIGVPANIQQFVGSQAAFQPSIVYMVPSGVDPHAFGNVLMPVMYQQMFQVPPKPNETMQDTSANEKRKRPRGQKLTETSQQANGAPASASG

SEQ ID NO: 39964 - protein, 126 aa, Sorghum bicolor
  Clone ID: SORBI-28MAY03-C37184_1.pep
EEAKKLRKRKKAEAQRLLDMEKRQKQRLQEVRESQRKNEEAIQLKEQYRGVVRKELEDLERRHWDMTSILHALGISVEGGEVKAFKQALLKFHPDRVSRNDIYQQVKAEETFKFISRLKEKLPRLS

SEQ ID NO: 39965 - protein, 293 aa, Sorghum bicolor
  Clone ID: SORBI-28MAY03-C38125_1.pep
RRRWGPAGLGPPPRAAAPPPLPRPPFSPSPFLPAPSLSFPPPLAPRRSPPWFSGRGAVPPACRPPPPDSRRFGPSRGARLPPPPAAAALPAARAGSCKKVLRFLQSVEQSSGTVETSSGSMQVATGRYHTLLVHDSSVYSCGSSLCGVLGHGPDTTQCAAFSRVSFPSLSRVINISASHNHAAFVTESGEVFTCGDNSSLCCGHGEVGRTIFRPMQVEALKGIPCKQVATGLSFTVILTRDGQVYTCGSNTHGQLGHGDTIDRATPKLIELFEGPTKVVQIAAGASYTFAVTD

SEQ ID NO: 39966 - protein, 150 aa, Sorghum bicolor
  Clone ID: SORBI-28MAY03-C38240_1.pep
MDGSAGSFVAVRRLSGSDRAAAFHHSSSAEVVTGSSAWIGRGLSCVCAQRRDSDARLSFDLTPVQEECLQRLQNRIEVQYDSANREHQEALQALWCASFPGTELRGLISEQWKEMGWQGKDPSTDFRGGGFISLENLLYFSRNYPKSFQE

SEQ ID NO: 39967 - protein, 147 aa, Sorghum bicolor
  Clone ID: SORBI-28MAY03-C38279_1.pep
NVQRCFASCTLALLASSFARRLIPGLRTPFDFAGYMPLALNVNPKKYLQALFSACQNLADEASSLPSEQKEFKLYKQHVDDLHHLAGNYDSVIVCLGAKVRSLPELANKLPLRTCRGVIAEFKLPSDTIEEYGSQSPSILSDAWLAF

SEQ ID NO: 39968 - protein, 183 aa, Sorghum bicolor
  Clone ID: SORBI-28MAY03-C38295_1.pep
MESSKSPQSSKNSQITVPSDSNGPRFDNDGFASETASNQMVVFNSEAGDKEQDEPGENRLQKSVITRGISPSIGAFTVQCAKCFKWRLIPTKEKYEEIRERIIQEPFVCKRACEWKPGVTCNDPEDISQDGSRLWAIDKPNIAQPPRGWERQIRIRGEGGTKFADVYYTSPTGRKLRSLVEID

SEQ ID NO: 39969 - protein, 78 aa, Sorghum bicolor
  Clone ID: SORBI-28MAY03-C38392_1.pep
CPRGKAPWGVVQREFVRDCMGWGAAVKCSFHTGNEFILLLSGLVLPEGKGVIKCDTSEDLARLYGEEDYYNFVVSNRK

SEQ ID NO: 39970 - protein, 166 aa, Sorghum bicolor
  Clone ID: SORBI-28MAY03-C38338_1.pep
MGIAPASSSSVAVVVATVVVCLCGALARAQAQDMDKEWARPPYRGFFGAPGSLLPQSDVDLLEFPLNLEYLETEFFCWSALGYGLDAIDANLTGGGPPSIGGQSASLTPLIRDVASQFCYQEVGHLRAIKQTVRGFPRPLLDISAANFGKIIEQALNATLDPPFNP

SEQ ID NO: 39971 - protein, 151 aa, Sorghum bicolor
  unsure (1)..(151): unsure at all Xaa locations
  Clone ID: SORBI-28MAY03-C37416_1.pep
MADMGKPQQMEVRNHDAITGEGSSCSAAEIKPDSHCGEIVGSQVQLPEDILHRIHALMPMRDAAQAACVSLAFLRSWRCYPNLIISVDSLCINEYGSRYDELTTDFITRVEHIMQNHSGMGVKEFRLQSYPCSTIDPSYLDHWIQVAMTPX

SEQ ID NO: 39972 - protein, 192 aa, Sorghum bicolor
  Clone ID: SORBI-28MAY03-C37471_1.pep
MGGADGLGQPDGHANGAAVVEEKLDALRRQLGKADGAPRRIVGVGAGAWGSVFCALLQDAYGHLRDKAQVRIWRRPGRAVDRATAQHLFDVINAREDVLRRLIRRCAYLKYVEARLGDRTLYADEILRDGFCLNMVDTPLCPLKVVTNLQEAVWDADIVVNGLPSTDTREVFGEIGRYWKERITAPIIISLA

SEQ ID NO: 39973 - protein, 128 aa, Sorghum bicolor
  Clone ID: SORBI-28MAY03-C37483_1.pep
MAAGEESGSGVAGGREGGEAPAASAPNGDRSGNSPLATAPSSSSADDRGFHRSSTMPGVIKNDEITNETAGPSNLERSRTERRRQNNPADDPAKQLLDERIPIKKKLKMLNRIATVKDDGTVVVDVPS

SEQ ID NO: 39974 - protein, 107 aa, Sorghum bicolor
  Clone ID: SORBI-28MAY03-C37597_1.pep
SFFTWRSPFSAICDSAVPVHFLLLRLGSTCVPGTAFPGSTPRSILLWSIIWLQPYPQNMYGSYWYLACSSFVKWFKYSVAVAIGRFPPRPPRVWLHRPRRDCRRALS

SEQ ID NO: 39975 - protein, 66 aa, Sorghum bicolor
  Clone ID: SORBI-28MAY03-C37713_1.pep
GFLSRDPLYRYVLMVQFAVPPAMNIGTMAQLFDVGQEECSVIFLWTYLVAAVALTTWSTIFMSILS

SEQ ID NO: 39976 - protein, 135 aa, Sorghum bicolor
  Clone ID: SORBI-28MAY03-C38696_1.pep
KPASYIIEAMCAKSYEDTTERLKEIESKILAKRNDLRQFETEYRKALARFQEVTTRYTQEREAVDDMLRERDNIHCSFTTERTLVNPVGAGSSSSRYTVEQSIPESPENGSVDGKDKSGKKKWFNLNLNRSDKKA

SEQ ID NO: 39977 - protein, 371 aa, Sorghum bicolor
  Clone ID: SORBI-28MAY03-C388_1.pep
METSEEAGQEVFTAREEERISDAVACSRDEGKEEEEEVEVSFDELGLDEQLKRALRKKGIAKATPIQREAIPLILEGKDVVAKAKTGSGKTFAYLLPLLHELLKLSSEGRIRKPAPNAFILVPTRELCQQVYNEALSLLEFCTCKLRVVQVTASMSNKDITVALSGPPNILVSTPACVATCISKGIIRGPSVKESLSMMILDEADLLLSYRCEDDLKALIPHIPRSCQSILMSATSSSDVDKLTKLLLHNPFILTLSVVGQAKDDVIPKNVQQFWVSCDAKDKMLHILALLKFELIQKKVLIFVNSIDMAFRLRLFLEKFGIRSAFKTAASCQNSRLHIIEAFNAKLFDYLIQPMTLKQMTRSKPIRKTRK

SEQ ID NO: 39978 - protein, 187 aa, Sorghum bicolor
  Clone ID: SORBI-28MAY03-C3867_1.pep
MGIDLVAGGRNKKTKRTAPKSDDVYLKLLVKLYRFLVRRTKSNFNAVILKRLFMSKTNRPPLSLRRLVNFMEGKENQIAVIVGTVTDDKRVYEVPAMKVAALRFTETARARIVNAGGECLTFDQLALRAPLGQNTVLLRGPKNAREAVKHFGPAPGVPHSHTKPYVRSKGRKFEKARGRRNSRGFKV

SEQ ID NO: 39979 - protein, 142 aa, Sorghum bicolor
  Clone ID: LIB3481-029-P1-K1-G7.pep
MGIDLVAGGRNKKTKRTAPKSDDVYLKLLVKLYRFLVRRTKSNFNAVILKRLFMSKTNRPPLSLRRLVNFMEGKENQIAVIVGTVTDDKRVYEVPAMKVAALRFTETARARIGNACGECLTFDQLALRAPLGQNTVLLRGPK

SEQ ID NO: 39980 - protein, 108 aa, Sorghum bicolor
  Clone ID: SORBI-28MAY03-C38835_1.pep
NYGVCKCNSSSYNQPSVSSSYNKPTVFDMKQGPNVALQMGWPPLLYCCDWPLASFVIRCVTLCSQSNQESKGSFHPSSSLTALFHRSLNFSSSADDCLRIWVLKSNDL

SEQ ID NO: 39981 - protein, 208 aa, Sorghum bicolor
  Clone ID: SORBI-28MAY03-C38921_1.pep
MEGKSVVMSALGIGIGVGVGLGLASAPWAGASASSRAAGVTVERVEQDLRRLLVDGSNSKVTFDEFPYYLSEQTRVVLTSAAYVHLKQAEISKYTRNLAPASRAILLSGPAELYQQMLARALAHYFQAKLLLLDPTDFLIKIHSKYGTGGSTEKTFKRSISETTLERVSGLLGSLSIISQKEQPKGTIRRQSSMTDVKLRSSESMTNL

SEQ ID NO: 39982 - protein, 283 aa, Sorghum bicolor
  Clone ID: SORBI-28MAY03-C37957_1.pep
MVRLTADLIWKSPHFFNAIKERELDLRGNKIAVIENLGATEDQFDTIDLSDNEIVKLENFPYLNRLGTLLVNNNRITRINPNLGEFLPKLHTLVLTNNRLTNLAEIDPLASLPKLQFLSLLDNTVTKQPDYRLYVIHKLKHLRLLDFKKVKQQERVAAAKKFHSKEAEEEAKKVAVKTFTPGLPDAQDITMEPQGPKVVAPTPEQITAIKAAIVNAHTLEEAARLEQVLSTGQVPAEFAVPKPDANMAEASEGAEKMDTDGQNQEGEADGQKQDDESTPIQED

SEQ ID NO: 39983 - protein, 145 aa, Sorghum bicolor
  unsure (1)..(145): unsure at all Xaa locations
  Clone ID: SORBI-28MAY03-C38115_1.pep
MEVVEAARPDKLEPPPSPPVEGPGENGAATKLQKVYRSYRTRRKLADSAVVVEELWWQALDYARLEHSTVSFFDEPKPETAASRWNRVSLNASXVGQGLSRDGKALKLAFQHWIEAIDPRHRYGHNLHFYYDEWCKSQAGQPFFY

SEQ ID NO: 39984 - protein, 368 aa, Sorghum bicolor
  unsure (1)..(368): unsure at all Xaa locations
  Clone ID: SORBI-28MAY03-C38116_1.pep
VLEEMSSNPDIVYTDRSGRRNPEYISLGCDSLPVLKGRTPIQVYTDYMRSFRERFRDYLGNVIAEIQVGMGPCGELRYPSYPEANGTWRFPGIGEFQCYDKYMRASLEAAAVAAGHEEWGXRGGPHDAGEYARGPDDTGFFRRDGTWSTEYGHFFLEWYSGMLLEHGDRVLAAAEAVFGGTGATLSAKVAGIHWHYRTRSHAAELTAGYYNTRDRDGYMPIARMLAKRGAVLNFTCMEMKDEQQPQHASCSPELLVQQVKAAASKAGVELAGENALERYDEAAFSQVTSTARGAGLAAFTYLRMNKTLFDGDNWRQFVSFVRAMADGGARPALPRCDTGHSDLYVGFVDASKQRKAPDAESATAAAAV

SEQ ID NO: 39985 - protein, 156 aa, Sorghum bicolor
  Clone ID: SORBI-28MAY03-C38192_1.pep
MRRRRMGALHVVGEPRVVSFQQQPAAVVAKNGHGPVVEEIHGLIRVYKDGHVERLPAIPTVPCTWGGTGADAPGGVVARDVVVDPAPGVWARLYAPTTTTSAGGGTGGSRPPVVVYFHGGGFCVGSAAWSCYHEFLAQLSARAGCAVMSVDYRLAP

SEQ ID NO: 39986 - protein, 69 aa, Sorghum bicolor
  Clone ID: SORBI-28MAY03-C39048_1.pep
MFKLEDVAMGIWINEMKKDGLDVKYENDGRILVEGCEDGYVVAHYQEPRDMMCLWDKFQKTKRGTCCKE

SEQ ID NO: 39987 - protein, 123 aa, Sorghum bicolor
  Clone ID: SORBI-28MAY03-C3911_1.pep
DQRLAQEAEARRGRRRQHGHGAGAPAFPAEPAGPALVPCRAGRAGGDGAARGAARHLALRRSVRASQPATGHRGEAMRRAATDDAPAKAPTGQGAARHLRGARMRRGRARARIPVTAPADGMR

SEQ ID NO: 39988 - protein, 168 aa, Sorghum bicolor
  Clone ID: SORBI-28MAY03-C3913_1.pep
EAGKVEAIALVTSERKAREQIETSMRSEENLLHLKAANDAQRYKSEIRALEQHIAQLKVSLDSLKVAAPKWGTDNKTYALHLSEGRKNSNAQILSNIAVPQDLDFDDIQRDRECVMCLSEEMSVVFLPCAHQVVCVKCSDLHEKQGMKECPSCRTPIQRRVCARPAGF

SEQ ID NO: 39989 - protein, 94 aa, Sorghum bicolor
  Clone ID: SORBI-28MAY03-C39148_1.pep
MLASLKVPVVAPVSAAMALTALHLRLRYGERSDGLVTRRDAEVPGSVVVRPERRLDHAWMVYSTLKMGSAEADASEMCEALLAMLVEIGRKKFR

SEQ ID NO: 39990 - protein, 149 aa, Sorghum bicolor
  unsure (1)..(149): unsure at all Xaa locations
  Clone ID: SORBI-28MAY03-C39324_1.pep
RPPSVPPXMPQFMRAHGSISEQYQQNSSSSLFAGAHRSGGMRPAPTPLPENPTFSLFPPGSSGHSSMETDDVGGSRFYAWERDRFAPYPLMPVDCETSWWTSQQQSHSTSEPTSAPRRLFGQWLGVGRSSPEHRSPEGSSYRQMHSPRM

SEQ ID NO: 39991 - protein, 204 aa, Sorghum bicolor
  Clone ID: SORBI-28MAY03-C38485_1.pep
ARGSILPDCETVAFNTARVGTQTSFFNVESGSPSYSSRHKPRILSLGGPYLSSTWWASKEPVGIWSEDIFAAQGILEHLNVTKDISDYLSYTTRVNISDEDVLYWNSEGLLPSLTIDQIRDVVRIFVNGKLAGSQVGHWVSLNQPLQLVQGLNELTLLSEIVGLQNYGAFLEKDGAGFRGQVKLTGLSNGDIDLTNSLWTYQIG

SEQ ID NO: 39992 - protein, 171 aa, Sorghum bicolor
  Clone ID: SORBI-28MAY03-C38540_1.pep
VEHGLGHLPFTEKQVITPTGSVYMGVDFCKKLCGVSIVRSGESMENALRACCKGIKIGKILIHRVGDNGQQLVYHKLPMDIAERHVLLLDPVLGTGNSVAQAIDLLIRKGVPEGRIIFLNLISAPEGIQCICKRFPSLKIVTSEIDYGLNEEFRVIPGLGEYGDRYFGTDN

SEQ ID NO: 39993 - protein, 60 aa, Sorghum bicolor
  Clone ID: SORBI-28MAY03-C38594_1.pep
MQRLLGVGERLLAVGTNRRAATYSHPSHRSGYYTAARDNGLSTRRKIPAIFSRMFSHYKV

SEQ ID NO: 39994 - protein, 112 aa, Sorghum bicolor
  Clone ID: SORBI-28MAY03-C38616_1.pep
MSSSGKMEGPSAPAVRRDPYEVLSVPRDSSDQEIKSAYRKLALKYHPDKNASNPEASELFKEVAYSYSILSDPEKRRQYDTAGFEALENEGMDMEIDLSNLGTVNTMFAALF

SEQ ID NO: 39995 - protein, 180 aa, Sorghum bicolor
  Clone ID: SORBI-28MAY03-C38645_1.pep
MGNCASAIDAFVQRGNRASPSPSSAATPGMSASRRTSSSATTGKLSTISSTSTFMPSTVSGVSVDDDYPEGQILESPNLKIYTFAELKSATKNFRPETVLGEGGFGKVYKGWVDEKTLNPSKASTGIMVAVKKLNPESVQGMEQWQSEVNFLGRISHPNLVKLLGYSMDDNELLLVYEFM

SEQ ID NO: 39996 - protein, 201 aa, Sorghum bicolor
  unsure (1)..(201): unsure at all Xaa locations
  Clone ID: SORBI-28MAY03-C39615_1.pep
MSTAKVLDPAFQGAGQKVGTEIWRIEDFKPVALPKSDYGKFYCGDSYIVLQTTCTKGGAYLYDIHFWIGKDSSQDEAGTAAIKTVELDAILGGRAIQHRELQGYESDKFLSYFKPCIIPLEGGFASGFKKPEEEKFETRLYICRGKRAIRVKEVPFARSSLNHDDVFVLDTENKIYQXFNGANSNIQERAKALEVIQHLKE

SEQ ID NO: 39997 - protein, 166 aa, Sorghum bicolor
  Clone ID: SORBI-28MAY03-C39651_1.pep
MAAPQIPEKQWAQVFEKTAGPIEYKQIPVQKPGPDEVLVNVKFSGVCHTDLHAWQGDWPLDTKLPLVGGHEGAGVVVARGDLVKDVKIGEKVGIKWLNGSCLSCSYCQNADESLCAEALLSGYTVDGSFQQYAIAKAIHVARIPEECDLESISPILCAGITVYKGL

SEQ ID NO: 39998 - protein, 201 aa, Sorghum bicolor
  Clone ID: SORBI-28MAY03-C39712_1.pep
MGKGDVATRSKSQKSSAIQNEQSTPTHEATAYPDWSQFQAYYNAPGTAPVTPPAFFHSSVAPSPQGHPYMWGPQMMPPYGTPPPYAAMYAQGTPYQQAPMPPGSHPYSPYPMQSPNGTVQTPTSGAGGTETNKSNKNKRKTPLKRSKGSLGSLDVVAVKNNKSPAKPQASSSNEGSSQSESGSGSSSEGSSTNSKSSSRAK

SEQ ID NO: 39999 - protein, 204 aa, Sorghum bicolor
  Clone ID: SORBI-28MAY03-C39772_1.pep
RLSVSRWPRPPPPPPPPPPPPPAPWAGRGPAPPRPRRGPTPSGRGRRRRPGPCAGPAPAAAGFRAPAAAAAAVAAAAAPLPLAAAAALALPDGGGAAREIESAPEVKNLGPWAKGLLKGMPEMAAGPAAMAPVVKYPLVLAEDRTRRPDVLSHLKMYDGGWNVTNKHYWASVSFTGVSGFLLGALWFIFFGIAAAGRCYFGSAV

SEQ ID NO: 40000 - protein, 301 aa, Sorghum bicolor
  Clone ID: SORBI-28MAY03-C39786_1.pep
MASSASTLEIEARDVVKIVLQFCKENSLQQTFQTLQNECQVSLNTVDSIDTFIADINAGRWDAVLPQVAQLKLPRKKLEDLYEQIVLEMAELRELDTARAILRQTQVMGVMKQEQPERYLRLEHLLVRTYFDANEAYQESTKEKRRALIAQAVASEVSVVPPSRLMALIGQALKWQQHQGLLPPGTQFDLFRGTAAMKQDEEETYPTSLSHQIKFGKKTHPECARFSPDGQYLVSCSVDGIIEVWDYLSGKLKKDLQYQADESFMMHEEPVLCVDFSRDSEMLASGAQDGMIKVWRIRTGQ

SEQ ID NO: 40001 - protein, 305 aa, Sorghum bicolor
  Clone ID: SORBI-28MAY03-C38949_1.pep
MAAPARRSLLVLLAGLLVFASLATLATAIYEDQVGLADWHQKYIGKVKQAVYHSQKSGRRRVVVLTEENVISSLDLRSGDIFWRHVIDKNDPLDQLSLSHGKYVLTLSSGGTILRAWNLPDGQMIWETNLRTSAASNPQLHVMSNNKVAKDNLVLVSAGRWIYAVSSIDGAISWEKEFSIDGLEIKGILQSPENDVVYALGLAGSSKLALYHLSAKTGEILKDIQESLPGGLCGETVLGSDNVLVALDKARSSLLLIEFKAERISYNKVHVSDLVQDLSGSFKLQSLSNGIISLQTSSSISLLKL

SEQ ID NO: 40002 - protein, 155 aa, Sorghum bicolor
  unsure (1)..(155): unsure at all Xaa locations
  Clone ID: SORBI-28MAY03-C38958_1.pep
MGVWREGAGWCFCSGGGGDDGGRSERVKAAILHEXASGSRRAEADGHGRRKAATSGVPAAVTLARXPSAAAAEDADALLGHGHLAARLEPHRFFITSSILDLTIVGLDYTEGDSTQQGQQLHYLKTSCKPSLDHGSAVYLLGHTGKKELVIGEGN

SEQ ID NO: 40003 - protein, 216 aa, Sorghum bicolor
  Clone ID: SORBI-28MAY03-C3888_1.pep
MEKAGHEHVIGIPVNNRAFGIEEPDFPSTGAAKNAAAAGGRAAKFGGRTGDRVAQGLKEHVTLGPKLYETVKGKLSLGARILQAGGVEKVFRRWFSADKGEKLLRASQCYLSTTAGPIAGMLFVSTERIAFRSDRSLALTSPQGGGTVVRVPYKVAIPLARVKTAKPSENKDRPEQKYVQVVTDDGFEFWFMGFVRYQVSLQELEKAIAQSQSQSQ

SEQ ID NO: 40004 - protein, 95 aa, Sorghum bicolor
  Clone ID: LIB3481-031-P1-K1-B4.pep
MVFAVTLGPKLYETVKGKLSLGARILQAGGVEKVFRRWFSADKGEKLLRASQCYLSTTAGPIAGMLFVSTERIAFRSDRSLALTSPQGGGTVVRV

SEQ ID NO: 40005 - protein, 125 aa, Sorghum bicolor
  Clone ID: SORBI-28MAY03-C39025_1.pep
AAAGGCAACGIIRDGFSRSASDGGVLTMATSGRAHDAVPVPVPAAEGEEAERQQRRAMLVSRVIAGRVKRPKEEAEQASEEEAGPGEEEEYDSVAGSAGVYSNLEELLVFNPRAILPCFVVVYKA

SEQ ID NO: 40006 - protein, 166 aa, Sorghum bicolor
  Clone ID: SORBI-28MAY03-C39075_1.pep
MEAPSNGGLLYHEVQEGKLCAVHCVNTALQGPFFSEFDLAALAADLDQRERLVMLEGSRSPGVANPAAGDFFAEGEGSHNVSLGGDFSIQVLQKALEVWDLQVIPLDSPAAGSSLFDPEQEVAFICHLQDHWFCIRKVNGEWYNFNSLYPAPEHLSKFYLSAFIDT

SEQ ID NO: 40007 - protein, 190 aa, Sorghum bicolor
  Clone ID: SORBI-28MAY03-C40043_1.pep
GAKCSIDALLERTIKHMLFLQSVNKYAEKIKQADEPKIIDKESGVVLKDNPDAGRNGGATWAYEVAGQTMVCPIIIEDLSPPGQMLVEMLCEERGLFLEIADNIRGFGLTILKGQMELRDGKIWSRFLVEANREVTRMDIFLSLVKLLEQNSLVRSTDQMAKVMNNGVPSFANHQRSPMPVPVGIAERLQ

SEQ ID NO: 40008 - protein, 129 aa, Sorghum bicolor
  Clone ID: SORBI-28MAY03-C40046_1.pep
EVLVISSQKKGPAGGVLIPKGGWELDESMDEAARREAAEEAGVVGETGPALGRWCYRSRSYDATYEGFVLPLRVTRELDRWPEMAARRREWVSAAEAIARCPHLWMREALQRFADTVAAEATTHLASAL

SEQ ID NO: 40009 - protein, 129 aa, Sorghum bicolor
  Clone ID: SORBI-28MAY03-C40087_1.pep
ENEPEEEEIVAGPPLSPQCNAELHTDYDGAAVRWGLTHHKESAADCCQACLDQAKNAKPGELKCNIWVYCPSEFGCFSPDKYEHKHQECWLKQADHPKLNFKDKYSEPYRDAHPNAPVVVPWMSGVTSA

SEQ ID NO: 40010 - protein, 159 aa, Sorghum bicolor
  Clone ID: SORBI-28MAY03-C40088_1.pep
FRPLVGEALSKLNNVIRHPEARLPDNIMAYDNAVSALGKICQFHRDGIDAAQVIPAWLSCLPIKDDKIEAKVVHEQLCSMVERSGSEILGPQSQYLPKIVSIFAEVLCNGTELATDETRNRMVNILRRFQQTLPPDFLASTFSNLQPQQQLLLQSILST

SEQ ID NO: 40011 - protein, 164 aa, Sorghum bicolor
  Clone ID: SORBI-28MAY03-C4010_1.pep
RPKGRKEFMIIRQRIVKLQAHVRGHQVRKNYRKVVWSVGIVEKVILRWRRKRPGLRNFQPQKQLEGPSQIQPAKAEDEYDFLHDGRRQAEARLQRALARVHSMSQYPEAREQYHRLTTCVAEMKQSRMMQDEMLSEAAGGGVDDFMAGLEDLICIDDAAMSAIW

SEQ ID NO: 40012 - protein, 150 aa, Sorghum bicolor
  Clone ID: SORBI-28MAY03-C39355_1.pep
YSGGSKLEGDQFKLLCSISNSTNFKLSRVGTRVLGKEPRFQEFKNLRSLFLDRCDLSDDFKTLVFFLWGSPILEKLTLQCCEFPKCSSKKKRMPMCNSISSSELRGLDLLCENLKVEIIYNDGHGPHLIRLLQRVLVNLSKNNIKLTKVN

SEQ ID NO: 40013 - protein, 127 aa, Sorghum bicolor
  Clone ID: SORBI-28MAY03-C39476_1.pep
LEDLLLIDRSLIMRRANLIDRHREMRLDVDNMSYEELLALGERIGYVNTGLTEENIMSNMKQWKYALISLEDPPTGVEPCCICQEDYVEGEDLGRLDCGHDFHTGCIKQWLVIKNLCPICKKTALDT

SEQ ID NO: 40014 - protein, 201 aa, Sorghum bicolor
  Clone ID: SORBI-28MAY03-C3959_1.pep
MDTAASWRLLSPASSAPPPCPQQLLPKRRATFAASPQAQQSARSSAKFRLLCLLHDKSSAPTTSVQQSSQLQRLATVLQCGAVWAAVEAPAALATVTGEEDLDILGILPPIAAFAVFYLFVAPPIIMNWMRLRWYKREFVETYLQFMFTYLFFPGLMLWAPFVNFRKFPRDPTMKYPWSKPKEGTPLFKDRYPPIDTYKQP

SEQ ID NO: 40015 - protein, 192 aa, Sorghum bicolor
  Clone ID: SORBI-28MAY03-C3950_1.pep
MAAALLLSPRLVSLPPHPSLAPGFTFIKRPTSYPLGRRGARLRAVGDGPGAGLTSDQTTVYNGAYGPWTVDDSDVREVLLYRSGLVTAAASFVAAASAALLPEGNPASGAGAADLLYAVGASGLGLSLLLIHIYVTPIKRFLQALWAVGVLGSLGTYLVAARPLDEGLVQYVLDHPAALWFVGPTFAALTGL

SEQ ID NO: 40016 - protein, 167 aa, Sorghum bicolor
  Clone ID: SORBI-28MAY03-C39590_1.pep
MGDRQQQHAHGHGGGEHPAAADPPSSATLLRRVQTHAPNSTQVVGFLTLLVSGAVLLLLTGLTLTGAVVALVFLGPIALLTSPIWVPIAVALFVLTAAALSACGFVVAALAVGTWMYRYFTGRHPVGADRVDYARSRIADTASHVKDYAREYGGYLHNRSKDAAPGA

SEQ ID NO: 40017 - protein, 128 aa, Sorghum bicolor
  Clone ID: SORBI-28MAY03-C396_1.pep
MRGGGGGMMDDEERVGHAEIPTSFGPELRACLRCRLVKTYDQFRQNGCENCPFLEMEREHDNVVNCTTPNFTGIISLMDPSRSWAARWLRIGRFIPGCYTLAVSEELPEEYQGICQENNVQYVPPKRV

SEQ ID NO: 40018 - protein, 124 aa, Sorghum bicolor
  Clone ID: SORBI-28MAY03-C4034_2.pep
FLSLAITVPDGYHFSKEARSKFDVETEPPNEVEIEPASGFLNSEGQASLKFRRISSSFSMGRINCKVYYCKEDEVCLYQSVAFDVKFREEAEPSPAQIMLSYSVSPRDNSGSTQLIAARKNAKV

SEQ ID NO: 40019 - protein, 108 aa, Sorghum bicolor
  Clone ID: SORBI-28MAY03-C4034_1.pep
EASGKFDVETEPPNEVEIEPASGFLNSEGQASLKFRRISSSFSMGRINCKVYYCKEDEVCLYQSVAFDVKFREEAEPSPAQIMLSYSVSPRDNSGSTQLIAARKNAKV

SEQ ID NO: 40020 - protein, 192 aa, Sorghum bicolor
  Clone ID: SORBI-28MAY03-C40445_1.pep
MASELTYRGGSAAPGSASNGGEYSPKPSKPLSWLSRAARYAAAEHRPVFALAGMLFAAALFTFSSPSTSSPSQPAASVGFNHLAVTGHPSFRESVGGKVPLGLRRRALRVLVTGGAGFVGSHLVDRLVERGDSVIVVDNFFTGRKGNVAHHLQNPRFEVIRHDVVEPILLEVDQIYHLACPASPVHYKYNPI

SEQ ID NO: 40021 - protein, 392 aa, Sorghum bicolor
  unsure (1)..(392): unsure at all Xaa locations
  Clone ID: SORBI-28MAY03-C40519_1.pep
GIRHEGGLLRALGEAETGKRQTVWMSXGDEVVTLPQGFEVVARSVQGAVAAIEYREKRFYGLQYHPEGTHSAQGMETLRRFLFDVCGIKADWKMQDVLDEEIKTIQSTVGPDEHVICALSGGVDSTVAATLVHKAIGDRLHCVFVDNGLLRYKERERVMTTFESDLHLPVTCVDASEQFLSKLKGVEDPEQKRKIIGREFIAVFDDFAHKLEQKIGKRPEYLVQGTLYPDVIESCPPPGSGRTHSHTIKSHHNVGGLPKDMKLKLIEPLKLLFKDEVRKLGSILNVPDSFLKRHPFPGPGLAVRVLGDVTQGNALEVLRQVDEIFVQAIKDAGLYDKIWQAFAVFLPVQTVGVQGDQRTHSNAVVLRAITSEDGMTADWYYFDHAFLVDVVN

SEQ ID NO: 40022 - protein, 161 aa, Sorghum bicolor
  Clone ID: SORBI-28MAY03-C40538_1.pep
MDLVNGVLNWVGTPAMVACLLLFYPPYYLFKTCYSFLSWLFPEDLAGKVVLITGASSGIGEQLAYQYALKRASLALVARRESSLRHVADRALELGARDVIVLPGDVSAPDDCNRFVQTAISHYDRLDHLVCNAGIASVGAFQEIPDVTKYSSQLDVNFWGS

SEQ ID NO: 40023 - protein, 157 aa, Sorghum bicolor
  Clone ID: SORBI-28MAY03-C40654_1.pep
RPQPSIHGLFYLMKISVCGSAASTTKATPRIHEGADAGAAAARLRGCRCSCALRLLQEPEQHHGLHGLIGLGVVVRGWTTLMVLRREQPASRRRGGVRLHQRRRCTNSCHQLAHGQDQHADGSHLESESSSHGLYLASFGKTICCVVEQVYVRRSLV

SEQ ID NO: 40024 - protein, 142 aa, Sorghum bicolor
  Clone ID: SORBI-28MAY03-C40635_1.pep
FGSKALSVGVDVSFDTATSNFTKYNAALRLTSPDLIASLHLNNHGDTLVGSYYHLVKHHSGTAVGAELSHSISRNESTLIFGSQHSLDPHTTVKARFNNYGMASALVQHEWRPKSFITISGEVDTKAIEKSTKVGLSLVLKH

SEQ ID NO: 40025 - protein, 398 aa, Sorghum bicolor
  Clone ID: SORBI-28MAY03-C39792_1.pep
MAEEEAPPPPPKLLYIAVADGGGRRAFRYTRPVLQSTLHLMGCKPRHAFKISKRVFNVMKSEFLAASKSDGAIEQENYPALSLGVGTDTPKMLERSNSSIPFELYQNQTTIVVSREEFVSVVCDALSLYKYVGPNQKADLLLACRIKERKESVTILLCGTSGCGKSTLSSLLGSRLGITTVVSTDSIRHMMRGFADEKQNPLLYASTYHAGEYLDPIAVSQAKAKRKANKPTIVSHPNTSGGKDVTSDDKAQQGSSELPPRAELIGNKQMAVEGYKAQSEMVIDSLDRLITSWEEQKESVIVEGVHLSLNFVMGLMKKHPSIIPFMVYITNEEKHMERFAVRAKYMTLDPAKNRYIKYIRNIRAIQEYLCNRADKHLVPKINNTNVDQSVAAIHATVF

SEQ ID NO: 40026 - protein, 244 aa, Sorghum bicolor
  Clone ID: SORBI-28MAY03-C39820_1.pep
ARMPTVTCNACNTGFDDEEQQRLHYRSEWHRYNLKRKVAGVPGVTEALFLARQAALAEGSKPASTPMLYSCALCGSTRRSSKAHEQHLNSRSHLLKASQEPNASIAGITIVKPLPERVPRKAPSAVEEDEDDDEEEEWVEVDPNEMEVADESTSNMQEDEESSKSDDEMADLEELDISSCFMCDLKHDTIEDCMVHMHKKHGFFIPDSEYLKDPSGLLTYVGLKVKRDFICLYCNDRCQPFFSL

SEQ ID NO: 40027 - protein, 131 aa, Sorghum bicolor
  Clone ID: SORBI-28MAY03-C39872_1.pep
DLLYKLVKQCEAMLEQLLPVSEASVSSEDVKGDSNDEEKLAKPSSSLVNGGGIPELDEIEYMESMYMKSTVAALRSLKEIRSKSSTVSMFSLPPLQGNNAQDSYQIRAEQTKLDEEPERWSKVTVIEQAAK

SEQ ID NO: 40028 - protein, 81 aa, Sorghum bicolor
  unsure (1)..(81): unsure at all Xaa locations
  Clone ID: SORBI-28MAY03-C39985_1.pep
HSQNYKLRLEGAASNRMSQFAVVLEVXEVAPSLFMVDVRKVAGDTLEYHRFYKNLCSKLDSIIWRPTEVSAKSTLLRTTTC

SEQ ID NO: 40029 - protein, 83 aa, Sorghum bicolor
  Clone ID: SORBI-28MAY03-C40031_1.pep
GLCSPDRSPSIRESARRSRLRKQAEWEEVANRADLLKQENSSLKEELKQLQEKCDSLTSENTSLHEKLKVLEDEKSNGNWCKD

SEQ ID NO: 40030 - protein, 53 aa, Sorghum bicolor
  Clone ID: SORBI-28MAY03-C40886_1.pep
ARGADKPVESGDALGVAGAENRNRDDGTARPGGVAASMAAAARLNRDEAVWDQ

SEQ ID NO: 40031 - protein, 230 aa, Sorghum bicolor
  Clone ID: SORBI-28MAY03-C40897_1.pep
MAPPPASPADSAPDPRPIASAPVPITVPSLRDHTHHHLVDRRDTPRVRAWDWEPERNRRGGAMDGAAAAKLVSGEAGYVLEDVPHVSDYLPDLPTYPNPLQDNPAYSVVKQYFVNPDDTVCQKIVVHKDGPRGNHFRRAGPRQRVYFEPDEVHACIVTCGGLCPGLNTVIREIVCGLSDMYGVTKILGIQGGYRGFYARNTITLTPKSVNDIHKRGGTILGSSRGGHDTV

SEQ ID NO: 40032 - protein, 191 aa, Sorghum bicolor
  Clone ID: SORBI-28MAY03-C40987_1.pep
MASSGDEGRVVVDLRSAAESAAADEEAHATPLHEIESLCMRCGENGITRLLLTLIPHFREVVLMAFECPHCGERNNEIQFAGQLQPKGCCYSLKVPLGQSDILNRQVVKSDSATIKIPELDFEIPPEAQRGTLSTVEGIIMRAVDELQALQDERKKVDPQKAEAIDQFLLKLRSLGSGEAAFTFILDDPAG

SEQ ID NO: 40033 - protein, 330 aa, Sorghum bicolor
  Clone ID: SORBI-28MAY03-C40993_1.pep
MAGIRWPPEDPEIFPSRMVSGGAWIPVAPPGEMASDDDRSVAADSWSIKSDYGSTLDDDQRYADTAEVLLASSSASSAAAPSASVAVHPSSDFSFDKDVPDSSDVEPRLLGLQNFQDGAYAEDLANFHERSHADDWFGTEIMDIRVGWTKNLCSSRDLPSCSVLDIGTGSGRLLQQLAKQGFSDLTGIDYSEGAIELARNLAIRDGFEHINFLVDDVLESKLERRFELVMDEGTLDAIGLHPDGPVKRMMYWQSVASLVFPGGILVITSCSRTKDELVQEVENFNQRKLGAMGSEGLPASEAAVFSYLDHVQSYPSVDSSCITTVAFLHK

SEQ ID NO: 40034 - protein, 245 aa, Sorghum bicolor
  unsure (1)..(245): unsure at all Xaa locations
  Clone ID: SORBI-28MAY03-C41014_1.pep
MVGGLVLSQAQTHQVATPRTAAPAPAQALEKRPWDQAQPCGTAAAAAAAVSVRSLDEVRKAHARHIKLGVDRCPRHARPLLAACALSGWPGGMELAASIFESLVEPEAFDYNTLMRGHVGGGRGDREPAAALRLYVDMLEAGVGPDSYTFPFVLKACAQLASLQQGXLQAHIEKLGLQHDEHVQNSLISFYGKCGEPAMARLAFDRVEDEERTTASWSALLAAYTKAGLWGECLESFGAMVLDGW

SEQ ID NO: 40035 - protein, 151 aa, Sorghum bicolor
  Clone ID: SORBI-28MAY03-C4792_1.pep
RGWSRSSGTIQEGQPKESFAKKLSTEELIESVVAELEALDIDKKDPPDANPDPKNQMARDLIKQTREMEAQLKERREWAQGKAIQAARKLGADLTELRVLRMEHDENQRRKKEKQVMEDDTMKRLAHLENELKKKSGQLDRSNATVQRLEM

SEQ ID NO: 40036 - protein, 128 aa, Sorghum bicolor
  Clone ID: SORBI-28MAY03-C48004_1.pep
MMEASTHKRKRHSDVPLITSSSHEGSERSDPHGVTVDINKTFTDATNMILLQQDLASQAIEIQKRRLQIEAKELELAKQRLKWERFSKKKDREIEKMALENEHMMIENKRLELELRHKELQLDLKLKG

SEQ ID NO: 40037 - protein, 134 aa, Sorghum bicolor
  Clone ID: SORBI-28MAY03-C48048_1.pep
SAGEWPFVQVQQLARIAMRCAAEKRRRRADLVTDVWPVVETMMKNASLSACPSTSSSIQDESSVPHYFLCPILQKVMKNPHIAADGFTYEAEAIEEWLEAHDTSPMTNLPLRNCVTIPNSALRLVIQEHLQRGP

SEQ ID NO: 40038 - protein, 110 aa, Sorghum bicolor
  Clone ID: SORBI-28MAY03-C48096_1.pep
GTIEELLDPFLMSRQAPPDQMSKLVNIGLLCVQDSPADRPTMSSVSVMLSSNTVSLQVPSRPTFCVQELEGDSHLYTDAYKRALKLQSTDKTKATIMSPNEVSLTELEPR

SEQ ID NO: 40039 - protein, 270 aa, Sorghum bicolor
  Clone ID: SORBI-28MAY03-C41222_1.pep
LDLASSKELMRINGTTKSALANHLGESIAGATTIRAFQEEDRFFEKNLELVDKNAGSYFYNFAATEWLIQRLETMSAAVLSFSAFIMALLPPGTFSSGFIGMALSYGLSLNNSFVFSIQNQCQLSNQIISVERVNQYMDIPSEAAEIIEENRPSPNWPQVGRVDLRDLKIRYRQDAPLVLHGITCTFEGGDKIGIVGRTGSGKTTLIGALFRLVEPTGGKIIIDSVDITTIGLHDLRSRLGIIPQDPTLFQGTIRYNLDPLGQFSDQKIW

SEQ ID NO: 40040 - protein, 223 aa, Sorghum bicolor
  Clone ID: SORBI-28MAY03-C41188_1.pep
MVDFVRRLAAVLLKCCDLDIPSRPKGLEDPERLARETVFNVNEIEALYELFKKISSAVVDDGLINKEEFQLALFKTNRKDSMFADRVFDLFDTKHNGILEFEEFARALSVFHPSAPIDDKIDFAFKLYDLKQQGFIEKQEVKQMVVATLAESGMNLSDDIIEGIIDKTFEEADTKHDGKIDKEEWRSLVLRHPSLLKNMTLPYLRDITTTFPSFVFNSQVEDA

SEQ ID NO: 40041 - protein, 149 aa, Sorghum bicolor
  Clone ID: SORBI-28MAY03-C41320_1.pep
AFRTEAVDWGLAQSPGFSAVEVRGELHRFVSQDMSHPRTRDIYEMLHQMEWQLRFDGYRPDTSEVALDVGEEEKRHVVAAHSQKLAMAFGLLSTPEGAPVRVVTNLRMSKECHAYSALISEIFGREIVIRDRNRLHRFRRGACTCRDYW

SEQ ID NO: 40042 - protein, 83 aa, Sorghum bicolor
  Clone ID: SORBI-28MAY03-C41331_1.pep
LHTDSSQQASDGSWHSGLQLLVSCHLPFHFSAQTKEWKCCCLCPKLQCSTGHYLCFRMIQNSDPAIFFSPFFFIVFSTHELFL

SEQ ID NO: 40043 - protein, 210 aa, Sorghum bicolor
  Clone ID: SORBI-28MAY03-C41343_1.pep
GAGGAAGRCADPATRAWAVVETTGDRPSPRSVFCGAGIGRHVVVFGGEVDPSDRGRRGAPGLAAGARARRAGTRAGTRRGGVAATPRPAAGPPPPPPPRPRGWRPPPAGARVGRPGRRVLGGSAPSSARLDVCFFVAPVREAAAPRLRARPAGVLAAVGRVAGRSARLGCMYVGCGDSCEFVTHHLCGRLVFLLFFFSLVGLWVLCCVIG

SEQ ID NO: 40044 - protein, 103 aa, Sorghum bicolor
  unsure (1)..(103): unsure at all Xaa locations
  Clone ID: SORBI-28MAY03-C41474_1.pep
NIEDATQLSLKGYIDVESVLAGYLPXSPPTFASKSYLEMSKQWRATXLLFIGIQSSANXRRSSNVVARFXVALNRIKEVNEELKEADFFGDIVIVLFMDVKMP

SEQ ID NO: 40045 - protein, 108 aa, Sorghum bicolor
  Clone ID: SORBI-28MAY03-C41549_1.pep
QTFSPSRCLFTTICLVHLTHSRWGCAVHQLADQYTMGYQQTTQRTKSILKCHICKMHQQPTLSTTPHRQTDILISLSAPLCVSAIKMAYEVNKPHELASRLPSYSVSS

SEQ ID NO: 40046 - protein, 167 aa, Sorghum bicolor
  Clone ID: SORBI-28MAY03-C40710_1.pep
MHCTGYLYDFPFLGDDSTITVDDNRVDPLYKHIFPPEVAPHLSFIGLPWKVIPFPLFELQSKWVARVLSGRVKLPSKDKMMEDVKAFYLKLEALGWPKRYTHNFSNHQFEYDDWLAEQCGYPPIEEWRKQMYAVNAMNKAARPESYRDEWDDEHLVAEANEYFKKFL

SEQ ID NO: 40047 - protein, 109 aa, Sorghum bicolor
  Clone ID: SORBI-28MAY03-C40681_1.pep
LRDVFRWSRCKKAMPESAMRSIGIPLPADQLEVLQDNLEWEDVQWSQTSVWVAGKEHPLARGHVLPGSQKRLWVSGNQHPRARALFPFGQLARGAEVLCPLVYAGAVYV

SEQ ID NO: 40048 - protein, 214 aa, Sorghum bicolor
  Clone ID: SORBI-28MAY03-C40755_1.pep
PRGLNAVVPLAGAKLQRLVRSWGDCGGGAVLGCLQLRQDRGALPEPKRSPSVRLGRDGDVLVVPWACQVTGAGHPPNVTAPLATALYAGVAPFAVPQGPAPTVAVPCALEPSVRLLHSVGRCRGHPLALAPQAKYEKTKIYLWPGPMRSGMSAAGRTVETVLYLAGFSNVKTKIIGSRNPLNVIKALFIALNAIETPKDVQQKFGRTVVESYLL

SEQ ID NO: 40049 - protein, 90 aa, Sorghum bicolor
  Clone ID: SORBI-28MAY03-C40770_1.pep
TGPIQTSKACAAYSVHILFVKGNLKYPSRLIQNLIMFCSFALSACLLLNVHLNQTALCASCCLFFLRHGHWSGACSHVNCDLMKFILSQI

SEQ ID NO: 40050 - protein, 77 aa, Sorghum bicolor
  Clone ID: SORBI-28MAY03-C40794_1.pep
MPTAPPLHPTPTAAQRPPYGTPLLQPFPPPSPPPSLTPAHNNGPVISRDEVKDALQRLVLNDEFIDLIYRELQNAHM

SEQ ID NO: 40051 - protein, 148 aa, Sorghum bicolor
  Clone ID: SORBI-28MAY03-C4810_1.pep
ARGFYIIVFLGTHASGILRFLDMSPAYHFFLSRKMLLNLTRRLHTDYLTRVYKLIVLYSQQVQLVVGTQSTQPEPQPVSSTPELNRSPTGTTHTHRKLFGEDTLTEKETIVDQNLNAKGIITTTATVQWIHYCSQKKKGYSEALSKLT

SEQ ID NO: 40052 - protein, 159 aa, Sorghum bicolor
  Clone ID: SORBI-28MAY03-C41722_1.pep
EDPDDPKNFRKTIGRIMSIQYKIPEYVHVSQDCKELLSRIFVANSAKRITIREIRNHPWFLKNLPRELTEPAQAMYYKKDNSAPTYSVQSVEEIMKIVEKARTPPPSSTPVAGFGWAAEEDEQEDSKNPDGKHEEEEDGEDEYDKQVKQVHASGEFHIS

SEQ ID NO: 40053 - protein, 162 aa, Sorghum bicolor
  Clone ID: SORBI-28MAY03-C41818_1.pep
MAECQIQDWKHQHPSAPDSVSRHEASIPRTRQRNIFGLLAQRELSPRTKNQAKNLWTKPPRRDACPVELKFWGTDARHDLLSWAESEFLRWWIPKYCPLLPSSKATIAAAFSPDGRVLASTHGDHTVKIIDCQTGRCLNVLLGHQRTPWVVRFHPQRSDILA

SEQ ID NO: 40054 - protein, 393 aa, Sorghum bicolor
  Clone ID: SORBI-28MAY03-C41841_1.pep
MGGDKARADDRKPRPPTRPRSKARATPAFATRLAPACGRLPRRVSPAHRTHKNCKTPGPRTLPPPPPDPRSMSMAAPSSSLASSCHISRRATATATHEAQSHSPPLPQQLRLGCFQRGARAQSACRAASRRRTPGVCFVVSPSQPGLAAIDVPAAPNATTVRDRTSVSSLLEVVSDDLLKLNNNLKSLVGAENPVLVSAAEQIFGAGGKRLRPALVFLVSRATAELAGLSELSTEHQRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTRSAAIFSGVSTSICEQMYEYGRNLGLSFQVVDDILDFTQSGGAR

SEQ ID NO: 40055 - protein, 112 aa, Sorghum bicolor
  Clone ID: SORBI-28MAY03-C4189_1.pep
VSSAYHHMYDRKLEKVVKSETSGNFEFALLTGLRCAENPAKYFAKLLRKAMKGLGTDEKTLTRVVVTRTEIDMQYIKAEYFKKYKKPLAEAINSETSGNYRAFLLSLVGHGH

SEQ ID NO: 40056 - protein, 216 aa, Sorghum bicolor
  Clone ID: SORBI-28MAY03-C41894_1.pep
MNEAVQEAKLLRQVNALIVAHLRSQNLGQAAAAVAAATMTPISAAESVPANQLLRLVAKGLAAEGGGGAASAFDSAGFGGAVQPLGSSAVDFSMQDVKGSSKSFPKHEAKHVSDHKNAARCAKFSPDGKYFATGSADTSIKFFEVAKIKQTMVGDSKDGPARPVIRTFYDHTQAINDLDFHPESPILISAAKDNTIKFFDFSKTNARKAFRVIQDT

SEQ ID NO: 40057 - protein, 495 aa, Sorghum bicolor
  Clone ID: SORBI-28MAY03-C41926_1.pep
ARGNDYVGKGLSGGKIVVYPPRNSSFVPEDNIVIGNVALYGATKGEAYFNGMAAERFCVRNSGAQAVVEGIGDHGCEYMTGGAVVILGKTGRNFAAGMSGGIAYVYDVDGKFSARCNNELVDLYHVEEEGASITLKMMIEQHRRNTESVLARDILSDFDNLLPKFVKVYPRDYKRVLENMKAEKAVAKHAKEPKVANGISVTTKKVQPDQSASRPTRVANAKKYRGFITYERESISYRDPKERVKDWKEVAIESTPGPLLNTQSARCMDCGTPFCHQESSGAGCPLGNKLPEFNELVHQNRWREALDRLLETNNFPEFTGRVCPAPCEGSCVLGIIENPVSIKSIECAIIDKGFEEGWMVPRPPLQRTGRKVAIVGSGPAGLAAADQLNKMGHFVTVFERADRIGGLMMYGVPNMKTDKIGIVQRRVNLMAEEGVTFVVNASVGSDPLYSIERLRSENDAVILACGATKPRDLTIPGRELSGVHFCMEFLHANTK

SEQ ID NO: 40058 - protein, 129 aa, Sorghum bicolor
  Clone ID: SORBI-28MAY03-C4103_1.pep
RGVKQSSWSPRAPRFMAVVGTGSRVVVHLDVHPRRHLAEVSIFHRTLILLGRHLQSRVLRGQLAVRQRQASGKRRSRGSPGKKKKAGEHEEAEEKHSLLLRGELHHHCRRSAAAATSPPQSTVEQQPRA

SEQ ID NO: 40059 - protein, 180 aa, Sorghum bicolor
  Clone ID: SORBI-28MAY03-C41074_1.pep
LAAAVLVFGCAPPGREFVTGSYDRTVTICKCPGVLCRGVSRTSRMRSGLCGIDTCRGPFPGPPTDGARRRLRKSAASEQRGGPPPRGPCLRGPPGAVEAPYKLRPHAVRSVGLGRLPLPVSGAAIRRRAMWVPEVRRAVGCPPHSAPGSMPRLPFWLRRILNQVVVAGPGRGVCVVEAVL

SEQ ID NO: 40060 - protein, 126 aa, Sorghum bicolor
  Clone ID: SORBI-28MAY03-C41079_1.pep
SFDSTSGIVECAIVETADGRLGCLTIVDGTADLYCKNWQSNCVGRQEWLHDKQISLPKDSGITYHWEVEGTAGHYLALVGESSRNSEHFVLDIKTFLVENLCISSNGAIFGFPYARFPPPLELPSI

SEQ ID NO: 40061 - protein, 113 aa, Sorghum bicolor
  Clone ID: SORBI-28MAY03-C4110_1.pep
MGCAGSTPKVDENSKKLKKPKAWKHTQPITPAQLKQMRDEFWDTAPHYGGQKEIWDALRVAAESDLALAQTIVDSAGIIISNPDMTLCYDERGAKYELPKYVLSEPTNLIRDG

SEQ ID NO: 40062 - protein, 149 aa, Sorghum bicolor
  Clone ID: SORBI-28MAY03-C41101_1.pep
QIKGHAESGVSKWASKLDELETLFSQNFVLFIDRSSACSDELKALRKKVHDHLKEQKELANVNNELAIRLKEKEMVVSEMAKSAAEAEAKMLQLEKTVDEKEDELAARVQEKREAIKQLSDTIVYHKNYSDDLVRYIRSQSRPRLPFCL

SEQ ID NO: 40063 - protein, 147 aa, Sorghum bicolor
  Clone ID: SORBI-28MAY03-C42332_1.pep
MMAMQQQQQQHAGSASGSASGSASSSSSGLHLLASPSSFGDTTHTKVFVGGLAWETNSDRLRRFYERFGDILEAVVITDRHSGRSKGYGFVTFREADSARKACEDPTPGIDGRRANCNLASLGRAQHPVPPGNGKISLYFLPICSVL

SEQ ID NO: 40064 - protein, 136 aa, Sorghum bicolor
  Clone ID: SORBI-28MAY03-C42459_1.pep
MPALYAYGDGGCLVSAPAELSGLFCRGAVQQRKRTLVAASAVAVAAAAECVRAAKKQRQQLPLPLPSLDALPDECLFEILRRVPGGRGRGASACVSRRWLALLGSIRASELGQAAAAADTPSLPDLNEEFVMEEED

SEQ ID NO: 40065 - protein, 365 aa, Sorghum bicolor
  unsure (1)..(365): unsure at all Xaa locations
  Clone ID: SORBI-28MAY03-C42526_1.pep
TRPRRPAAPPARPPPAPAAPPRPAPARPHAVAPASSRPRRPRPGPRRGLAVSGSVPLASRPLSPPAGPRPVLRGGARPFRLGRRVEPGLWLVQSRHISDGEGYLERTFLSPASIRATAVIISWMKDAGLTTWVDQMGNIHGRFEPTNSTKEALLIGSHMDTVVDAGMYDGSLGIICAISALKVLKVTGKLQRLTRPVEVIAFSDEEGVRFQTTFLGSAAVAXGTTVQDVLKMNSFEATSTPVGQAKYNPESVGSYVEVHLEQGPVLEALRYPLGVVKGIAGQTRLKVIVDGSQGHAGTVPMKLRRDPMVAAAELVVTLERLCKEPNKLLTYDEECSCFTEESLAGLVCTVGELNTWPSASNVIPG

SEQ ID NO: 40066 - protein, 111 aa, Sorghum bicolor
  Clone ID: SORBI-28MAY03-C4240_1.pep
MAAKCALSAPSLSAHRPLCRNRLAPCLPSPRPARAVALRVSAAKLPPGVEVPRVQPKLSEPFLGFTQTAEIWNSRACMIGLIGTFIVELVLNKGILQMIGVEVGKGLDLPL

SEQ ID NO: 40067 - protein, 111 aa, Sorghum bicolor
  unsure (1)..(111): unsure at all Xaa locations
  Clone ID: LIB3478-001-P1-K1-B8.pep
MAAKCALSAPSLSAHRPLCRNRLAPCLPSPRPARAVALRVSAAKLPPGVEVPRVQPKLSEPFLGFTQTAEIWNSRACMIGLIGTFIVELVLNKGILQMIGVEVGKGLDLPX

SEQ ID NO: 40068 - protein, 210 aa, Sorghum bicolor
  Clone ID: SORBI-28MAY03-C42550_1.pep
MNRIPSVSLRGGADEDAAAASPPADPAALSRWVRAFSIIRFDLERGQLVEACYPPDALTAPGGGLDRLVAFSSFPDSMSHHLPRHRSSHEDSLFSFRVPDPSSPRRAFLYGFVFNRQRQDERLPRGGEQKSVLILSHAPYSSLFRLLLQILGPLCFDVGPSALAMVASHVAAWPAPAPGRPMELPIGSAALRVHLPPAADDPGPPPALLP

SEQ ID NO: 40069 - protein, 208 aa, Sorghum bicolor
  Clone ID: SORBI-28MAY03-C42645_1.pep
ARGSVTANKDHQYIYEILLASGLLHKEHSIAVLPGQLQPSNYPINPELFLILEQTKPDLVSAFQTVSGAKKSCKPCTGRLHRRLVFDLVNETIAQKMSVCRSGRQTVKFLQSRKLSGWQLFKDLCTEVDRLIKCSDEEENENMIFDEDTVNGTKDWMSFDTVLHGMVWEIERSIFKGLIDEVIGGETTEKMQFVQRKLQRQLSFSSIN

SEQ ID NO: 40070 - protein, 146 aa, Sorghum bicolor
  Clone ID: SORBI-28MAY03-C41558_1.pep
SVIAHELGHWKLNHTVYSFVAVQLLMSLQFGGYTLVRNSKDLFESFGFEDQPIIIGLIIFQHTIIPTRHLLSFCLNLVSRAFEFQADAFAKNLGYAPQLRAALVKLQEENLSAMNTDPWYSAYHYSHPPLVERLQALEDSDSKKED

SEQ ID NO: 40071 - protein, 55 aa, Sorghum bicolor
  Clone ID: SORBI-28MAY03-C41610_1.pep
LTSLTRAVRRGGENTSIEANGNSYDLSTKLLHLAWHPTENSIACAAANSLYMYYA

SEQ ID NO: 40072 - protein, 237 aa, Sorghum bicolor
  Clone ID: SORBI-28MAY03-C41652_1.pep
HEGRSSRRSPSPRHSVSPRRHSPRTTTSISRRRSPYSRRGSPSLSRYPSPSSRRRSPRRRKSPSSGPERFSPGRRPSPSPARRRPRSPSPGRRRPRSPSPGRRRPRSPSPRRRRLRSPSPGWRRPRSPSPGRRRPRSPSPGRRRPRSPSPGRRRPRSPSPGRRRPWSRSPIRRRSPSPKRRRRSPSSPKTRSANRRSSPQGRRSITPKTSRSPDRSRRSLSRDIEKETNGIPSIKDR

SEQ ID NO: 40073 - protein, 183 aa, Sorghum bicolor
  Clone ID: SORBI-28MAY03-C4166_1.pep
WATSGVKETEFALQGCEVSFVLQVIGMHFFNPPPIMKLIEIIRGADTSDEVFAAVKSFSERLGKSVICSQDYPGFIVNRILMPMINEAFWALYTGVATKEDIDTGMKLGTNHPMGPLQLADFIGLDVCLSVLRVLHSGLGDNKYSPCPLLVQYVDAGRLGKKRGVGVYSYGQKSSSVRPKSSM

SEQ ID NO: 40074 - protein, 305 aa, Sorghum bicolor
  Clone ID: SORBI-28MAY03-C42850_1.pep
HEDPDEENIEALCKLMSTIGEMIDHVKAKEHMDAYFARMENMSTSQKLSSRVRFMLRDSIDLRRNKWQQRRKVEGPKKIEEVHRDAAQERHAQSSRLGRGPAVSSVPRRGAPPMDYGPRGSSALASPSSHQGSIRGMPPQSRGSQDIRYEERHQFDNRTVLPQRAVKDEAITLGPQGGLARGMSIRGQPPVSNTELPSVIDHRRIVSGSNGYNSAADWTSSSGREDSSSRIPDRTSGRTPASSQSAGPSQRPASQEGRSGSKSYSEDELREKSVSAIREYYSAKDEKEVALCIVELNAPSFYPSV

SEQ ID NO: 40075 - protein, 535 aa, Sorghum bicolor
  Clone ID: SORBI-28MAY03-C42869_1.pep
ARGTHQNAMQNSHSDTTQGKRDGQGTTQKHAKPYLKNSQNEQHFPGSDPAHGSANVRIAGGTVGPARRHVGVINSTRQFTGRSGSQMHAPSGSSHANIQRGSFTSVGASGRYSPFMSRNIQQNQRPDTIFRGRPTGRSFVAQNVNRYHQGPTSNQKVHPIKEWKPKSTKKAPTTDADNNIADAASPSASNGENANAPDVNRLSEKLSQANLHEVEHVIIPEHLRVPEYEQTKLRFGSFTSGLESEQAPASTPQDTEQPEHLQESVQQVSEDDSLDAGHDDMDEQARSSQHLSTSTAEISLPPSEDSDRMSGQVENDDGLGLVQSDTPVGAADGDSTQITSTLTPFSAYGHEDPNMQPADEAQLYGLVEPNVHPQVLASSSQGYPSENPEADNAVQVFRMPEPNVHSQVLPSTSEALNPQIVSNSPVPISSQQQQQHISQQQAAAQMYPQMHVQHFPNFMPYRQLYSPVYPMPMPNYSPNVPYPSNGNNYLQMPSGGSHLTAGGVKYGVSQYKPVPSGNPSGYGNYTHPAGFTMGS

SEQ ID NO: 40076 - protein, 124 aa, Sorghum bicolor
  Clone ID: SORBI-28MAY03-C42874_1.pep
PNPSPPPPCLPPAPGRHGSNNNGVRAVPLLPVPISQLSSVGASPACPPWRPAPAPAPPPLATRMTTSSPAPTASAPAAARQRKPRKPRKPTRKVRAGTKIWPPTPTATATPTLAPAPAATATAT

SEQ ID NO: 40077 - protein, 79 aa, Sorghum bicolor
  Clone ID: SORBI-28MAY03-C42940_1.pep
TREDPGLEYELAALREAMASGFTYLLAHGDVRARKESLFMKKFVINYFYAFLRRNCRAGTATLKVPHSNIMRVGMTYMV

SEQ ID NO: 40078 - protein, 140 aa, Sorghum bicolor
  Clone ID: SORBI-28MAY03-C42903_1.pep
DFQKFDYENFTQSPMSDKAAPSVNLLPARGRITCRDYKKLVDNSEPHLLLDVRPAHHFQIASISPSLNIPLSMLEEKLPTLETSLKETGEASTLIVLCRRGNDSQRAVKLLHEKGFASATDIIGGLQAWGRDVDPDFPVY

SEQ ID NO: 40079 - protein, 155 aa, Sorghum bicolor
  Clone ID: SORBI-28MAY03-C43333_1.pep
HEGLLPPSFCFSVRLGEGRTSLPLASQIRGGLLRCCLACKRQRQGRPFSRDPLRCQRLLPWVPPPRLPPPSRSIPVPRGRDQIHHRATSSGRRHPLAADVPGVPFASDACTRAGALRALRHLPDGVNQRLDSKRTLSIKEKFVTEAEENLDVFNF

SEQ ID NO: 40080 - protein, 171 aa, Sorghum bicolor
  Clone ID: SORBI-28MAY03-C41962_1.pep
MEAIRKQASKLREQVARQQQAVMKQFGGGYGADGVFADEAEAQQHSKLEKLYISTRAAKHFQRDIVRGVEGYIVTGSKQVEIGNKLCEDGKKYGTENTCTSGSTLSKAALSFAKARSMMEKERGNLLKALGTQVAEPLRAMVMGAPLEDARHLAQRYDRMRQEAEAQAIEV

SEQ ID NO: 40081 - protein, 196 aa, Sorghum bicolor
  Clone ID: SORBI-28MAY03-C42200_1.pep
TRIADFGLARILVKSGEPQSVSAIGGTFGYMAPEYGYRPKVNEKVDVYSFGVVLLELTTGKVANDSSADLCLAEWAWRRYQKGAPFDDIVDEAIREPAYMQDILSVFTLGVICTGENPLTRPSMKEVMHQLIRCEQIAAEAEACQVSYEGGGGGGGGTPLLESRKKGSRRRSMSDSGRWNDDDDDEDSGNFVVHVV

SEQ ID NO: 40082 - protein, 107 aa, Sorghum bicolor
  Clone ID: SORBI-28MAY03-C4223_1.pep
SRYNFTSAVPEELSVWTYLYNRTVHYKFPSCRSPTGRSNPQLSTATAYGNSNTENLHVPYGLFSRTTIVLLTTNSQSRALFRSKIYKEPYYVPTGSPEMRLSSGTSI

SEQ ID NO: 40083 - protein, 196 aa, Sorghum bicolor
  Clone ID: SORBI-28MAY03-C42242_1.pep
SNKYVQSPRTCTVRRYRIIKHSIKSLFQRHRQWRLWIRDPQDRSHTGAEDLCSVFLVCNISNQMGVCNTCSVMLVGSRKVFVRHLFALPVTPRSLDMLFDTSTVKRKFRCARLIGPEGLCLRTSQAFVCCLPSLEKQQKLEIGRSHSRLAVKSAWAAIVNSSLVNLVSSPPPCGSTVLAMHVTYCSSRFNLQIKYR

SEQ ID NO: 40084 - protein, 187 aa, Sorghum bicolor
  unsure (1)..(187): unsure at all Xaa locations
  Clone ID: SORBI-28MAY03-C43151_1.pep
MEDTAVEEPEVSGAAEFAPALVAAHPQGNSVAVAIGPELRAFDLSAGLPVSLSDDCGGRSHSDAIRAICFSVSGALFASAGDDKLVKVWKTDSWRCIQTITSEKRVSAVAISNDDLYVTFADKFGVVWLVTLREDSAEQVSVDNKPVSILGHYCSIITSMQCSPLGRSVAAAGSAFXLRVSFPPKNP

SEQ ID NO: 40085 - protein, 241 aa, Sorghum bicolor
  Clone ID: SORBI-28MAY03-C43228_1.pep
MEVLRDMHLPPGFGFHPSDPELISHYLKRKILGQKIEYDLIPEVDIYKHEPWDLPAKCNLPIKDNKWHFFASRDRKYPTGSRSNRATLAGYWKSTGKDRAIKLNKRTLGTKKTLVFHEGRPPSGRRTEWIMHEYYIDENECKVSPDMKDAFVLCRVTKRSDWALDNDNEVGNRNSHLEQLDDAATSVVSTVKPEDAAASVICPEESNHAATPVGSAELCNDVAQAAITPDSRSPNGGIELE

SEQ ID NO: 40086 - protein, 219 aa, Sorghum bicolor
  Clone ID: SORBI-28MAY03-C43238_1.pep
MRAPAMLRWAAAALVLAALLAASPAAAFYLPGVAPNDFHKKDPLLVKVNKLTSTKTQLPYSYYSLPFCKPNTIVDSAENLGEVLRGDRIENSPYVFEMGEPKMCQIICRAKIDDKQAKELKEKIEDEYRVNMILDNLPLVVAIARQDRGAPVYQAGYHVGVKGQYAGNKDEKSFIHNHLTFLVKYHKDETADLSRIVGFEVKPFSINHQFEGPWNDKNT

SEQ ID NO: 40087 - protein, 254 aa, Sorghum bicolor
  Clone ID: SORBI-28MAY03-C43317_1.pep
MAFLKTLNPLIRKRATPISNPRPLLSLHTYLASSSPTTTAAANPFASDVHTHVPIRSGGPLFLSSAPWMLSQSATPLTAAAAALGAKLRRAQALAGGRALAVADAVRWEHRRISGGEAEVAASSGIVGCGGERFLNAPNLVSIGRMVSGPVIGWMIVNEWYLPAFATLAVSGASDWLDGFLARKMGINSVFGSYLDPLADKVLIGCVAVAMVEKDLLHPALVGLVVVRDLLLVGGAFYKRASSLGWKWNSWSEF

SEQ ID NO: 40088 - protein, 183 aa, Sorghum bicolor
  Clone ID: SORBI-28MAY03-C42647_1.pep
MTLDQIISVLNDLECTSTTNNPEEFTFDLNKLVETCRNDEIESLVKKKHGQEAYTIFRLLLKQGCPVETDEITDRTILDKQVVHETLYKLWKDEYIDSERVPSTSGTGTGSTQFFVWRVKNIYREHFMDHLYHAALNLRQMINYMAELLLEGSKDEIKLRNRKNILVLALTRHDESLMLFHDF

SEQ ID NO: 40089 - protein, 147 aa, Sorghum bicolor
  Clone ID: SORBI-28MAY03-C42655_1.pep
GYVSGANWDPEGRVALLSFSNSTTLGSIHFSSKPPSLDAHLLPVELPEIFSLIVSRGIEKLAWDASGERLALSFKDGNEMYRGLIAVYDVRRSPLISLSLVGFIRGPGEGAKPLAFAFHSKFKQGPLLSVCWSSGWCCTYPLILRSH

SEQ ID NO: 40090 - protein, 82 aa, Sorghum bicolor
  Clone ID: SORBI-28MAY03-C4268_1.pep
APISREEINKNFYLRTTTLINALGGAGKQPNTTNRDKYMMLAGSFSHINLDYYIYVLLLANLIKSKTLPICFYLLSDHVYTY

SEQ ID NO: 40091 - protein, 131 aa, Sorghum bicolor
  Clone ID: SORBI-28MAY03-C42791_1.pep
HEGPSPSSRQKKKKTTRGLLSTPRSRRLPMPASPNAAATTARLPRRSVLPPPLPSSPSPPMWRHGVRAPAAPPDRGASLRRDDVLRLRRSTACVTCRRSSPATAGHQQGFPSRALRWLAARVFSEAGSSKP

SEQ ID NO: 40092 - protein, 169 aa, Sorghum bicolor
  unsure (1)..(169): unsure at all Xaa locations
  Clone ID: SORBI-28MAY03-C42849_1.pep
MGKASKGSRKGKKAWRANIRTDDIDDFFEKQTRDAHAGAAAIPSLPSDSLFFVDKPAASASTSAAGASDTTTKDIPVKRKIEKKREKVLYHESLLKRNPFVQPIPSSVVSKKDKKKAKKKELQETQGEKSVPMEDDSVVKNFDIWAVDGRGDSKAKKRSTTSVIPAXEV

SEQ ID NO: 40093 - protein, 163 aa, Sorghum bicolor
  Clone ID: SORBI-28MAY03-C43768_1.pep
MPPKSKAAAAAAEPVAVEDLFTSIHRHIEAGAFEQAAKVADQVLKAAPGDEDAVRCKVVAYIKADEIDKAFAAIRAAERLPIDLSYYKAYCCYRQNKLQEALELLRGQEETSAVLQLESQIFYRLGRMNDCMSSYEKLQKFKIDSMDLKINIIAALVAAGRAS

SEQ ID NO: 40094 - protein, 256 aa, Sorghum bicolor
  Clone ID: SORBI-28MAY03-C43772_1.pep
MAPVAAPIRDLLTSFSPSADFLALSSGDGRIKVWDAVRGRLQTEFADIPAVEAGAVPVAESKRGHLALDYTCMKWVQLSSKKKRKAGSSLIVLGTRGGDVLALDVAAGNWKWHVGDCHPGGVTAVAYSKHGRSVYTAGADGMVCRIDASDGAVVGKFKSSSKAISALAVSSDGNVLATAAGQLRTFDTSSNKKIKKFSGHPVAVRSMVFSNDSQYVLSSGVGERYIAIWKLGSGKTQSSNCILSMEHPAIFVDCKC

SEQ ID NO: 40095 - protein, 210 aa, Sorghum bicolor
  unsure (1)..(210): unsure at all Xaa locations
  Clone ID: SORBI-28MAY03-C43820_1.pep
RFLRLPAASLSCTLRAAHAPRRSPRVPAPPRPRPRPPPRARAPPLPALPPAAAPSAPPAPSCARAPPPRAASPRRGVQSRGSDVPRGACLQRRGRIYQVIKAQHSHQGRGGATIQVELRDVDTGNKLTERFRTDEALEGLGVAAGSFPXPFPDGDSVPLMGPDALVLLDTAQERAGLPAPFLYGEMXLSLQCLAARPMAGTGPRRVARSV

SEQ ID NO: 40096 - protein, 191 aa, Sorghum bicolor
  Clone ID: SORBI-28MAY03-C43821_1.pep
MPDVQPLVSDFVLKLKRRKVEGSHAVARQTAELLRSVVSQHRMVSSANQAAALADAVRAVGEQLIAANPVELAVGNIVRRVLHIIKEEDISSTAVGIEGLSVTVDSDDEYDSEHDDRPALSAAVLAAHARNALRAPSLQTLLEDIPVSPAVSRTASSTGDSDGKSKSAGDKSSTRKLKHDVIAAIGDLIDE

SEQ ID NO: 40097 - protein, 179 aa, Sorghum bicolor
  Clone ID: SORBI-28MAY03-C43863_1.pep
ARGASYGGKIILNPHEGYVLQEGDEVIVIAEDDDTYAPAPLPKVKEAVYIDIVHPERKPQKILLCGWRRDIDDMIAVLDAFLAPGSELWMFNDVPEVDRERKLIDGGLDFSRLDNITLVHREGNAVIRRHLESLPLESFDSILILADESVEDSAIQADSRSLATLLLIRDIQAKRLPYK

SEQ ID NO: 40098 - protein, 232 aa, Sorghum bicolor
  Clone ID: SORBI-28MAY03-C4295_1.pep
IDLDQFEDYFITLRAWRLDGQCTEMCVKAHALKGQSCVHHRLVVGDGFVTMTKGESIRSFFEHAEEAGEEDEDDAMERDGNDFDGDGAHPQKHAKSPELAREFLLDAAAVIFKEQVEKAFREGTAQQNAHSVFVSLALKLLEQRVHVACKEIITLEKQNKLLEEEEKEKREEQERRMKRRTREREKKNRRKERLKEKDNNKGKRLVESKSPDDVSSSAPSNSSTSINDYSTN

SEQ ID NO: 40099 - protein, 147 aa, Sorghum bicolor
  Clone ID: SORBI-28MAY03-C42961_1.pep
TWYHFPSRQELLSTFGKYGYLIEAQTDISETTRSACVVFGKSIEAEEAYKNGCQYLLGQFGPPFAKLRLDFSPIKLTVPSPSLASKPPLRDIRKNLEDMISARRSALNKATSSNGQLNPVPDKLLGEMQGLLAKVDRMLTRPPANAP

SEQ ID NO: 40100 - protein, 195 aa, Sorghum bicolor
  Clone ID: SORBI-28MAY03-C43025_1.pep
ARGMAEVVLITWILTNPQSRTKWKWQLFESVRIGDLWHNPHYHELPLLPHFPVISTVEPHVIYFTVFDYKYDPEYEVMEVTERYVLGVDMHLRSVVSAFMASSSRMLTSHFTRYINQRTVCPMEKEVTDEGDPAAWASVWISTKPLGVSPVEPAHKAGRLGGRVSSDGVAQFISKTGPTMSSITPVIGLQCVLGH

SEQ ID NO: 40101 - protein, 162 aa, Sorghum bicolor
  Clone ID: SORBI-28MAY03-C43129_1.pep
EDIETAFKLVSDGVVSEATMGTETLHISGADAAEPKEAAGELHVIDAKSVDDMHAAFQKHFDAIVNSSFEENDDKYGHVETAESTKPDELTEAIHTESQHNLGDAREGLPVEGTGNMSTSEAESHDDIDAASNKVFHSSAKSTAQAVELEVSHEREEESEHQ

SEQ ID NO: 40102 - protein, 276 aa, Sorghum bicolor
  Clone ID: SORBI-28MAY03-C43150_1.pep
MSPPQPPHTVPRETVASAVASLTKWMKKRAAEARPNLLADERDDLVVLQLSLRRVPASRSTRPRLLPLPHPVVGHDGASVCVISDDRPKSRSPSASDLLHASKSLHGLPVSEVIPLSTLRTDYRPYESRRRLAASHDLFIADRAILPLLPRVLGKAFYSTKKAPIGVDFTRVGWPEQVRKVLGSAFLYLRSGTCSGIKVGRLDMEEAEIVDNVMATVEEAVEKVPKKWANVRALHLKAVDSVALPIYQAVPELGMKIEVPEIVGSAEVIDAAEAET

SEQ ID NO: 40103 - protein, 211 aa, Sorghum bicolor
  Clone ID: SORBI-28MAY03-C43_1.pep
MRTICDVCESAPAVLFCAADEAALCRSCDEKVHMCNKLASRHVRVGLADPNKLARCDICENSPAFFYCEIDGTSLCLSCDMTVHVGGKRTHGRYLLLRQRVEFPGDKPGHMDDVPMETVPMETKDPENQRDQKKAPKEQMANHHNGDHPACDGNCDDQGNIDSKMIDLNMRPVRTHGQGSNSQTQGVDLSVNNHDSPGVVPTSNSERDASK

SEQ ID NO: 40104 - protein, 205 aa, Sorghum bicolor
  Clone ID: SORBI-28MAY03-C44145_1.pep
MATAYYESSRPRGGPAEEADDFDEFDPTPYGGGYDLAVTFGRPLPPSEETCYPCSAPSTSYDAPHYSASEPSPYGHHAKPKPNYGFRPQQEQQPPYGGGGGYGSTPEPPAEEGGGYGSGYGSGYGRKQQAEESYGSGYGRKPPQAEESYGSGGYGSGYGGQTRPEESYGSAGYGSANPPAESYGSGYGREPQVDESYGSEYGSGY

SEQ ID NO: 40105 - protein, 73 aa, Sorghum bicolor
  Clone ID: SORBI-28MAY03-C44161_1.pep
HELPSYFKHRNFASFVRQLNTYGFRKVDTDRWEFAHESFLRGQAHLLPLVVRKKKKKKAAGGCREQLCEEGEE

SEQ ID NO: 40106 - protein, 103 aa, Sorghum bicolor
  Clone ID: SORBI-28MAY03-C44188_1.pep
LLLLLAARLVVRGDDGRGGVVGRGAGVRGVGAGHHGLGARPVLRHLPLELRHADPQPRLQPRHRAVSQVRRRERLDRPLPVPVLKGLCTATNGGGGGVVHPRA

SEQ ID NO: 40107 - protein, 195 aa, Sorghum bicolor
  Clone ID: SORBI-28MAY03-C44232_1.pep
HEAIERLRRLKGIGDSKPLSILCRSLRDIDTYTTGFPRGTNQGQANIFRAVKRAIPGPYTFILPATKQFPKQCIKHGSSTRYAKRRQVGVRIPDDPICQAILQNLDEPLICTSVKYLSEDEWILDPVIIADLYEPLGLDFIVDGGPRIADPSTVVDMMGTNPTIIRQGKGPMLDWMVAKDEEEEETQSMFAFKAA

SEQ ID NO: 40108 - protein, 87 aa, Sorghum bicolor
  Clone ID: SORBI-28MAY03-C44237_1.pep
ARGSAPPIISLHKRAEKAQYFLAEAMHNFNGTTEKELSLIVGDYVVVRQIAPNGWAEGECRGKAGWFPAAYVERRENIPPNKVFPQA

SEQ ID NO: 40109 - protein, 87 aa, Sorghum bicolor
  Clone ID: SORBI-28MAY03-C43438_1.pep
QICNVVACEGAERTERHETLSQWRGRLVGSGFEPVHLGSNAYKQASTLLALFNGGDGYRVEEKDGCLTLGWHTRPLIATSAWRLPAP

SEQ ID NO: 40110 - protein, 124 aa, Sorghum bicolor
  unsure (1)..(124): unsure at all Xaa locations
  Clone ID: SORBI-28MAY03-C4345_1.pep
HEAPACGGWCTAPTAAXTNHPWFSPDSKTLVFTSDYAAVSAEPISNPHHYQPYGEIFTVNIDGSGIRRLTHNSFEDGTPSWTPHYLKPEDVGETLQASGTCAFEDCHWLNIAAQPDGLMCGKHG

SEQ ID NO: 40111 - protein, 88 aa, Sorghum bicolor
  Clone ID: SORBI-28MAY03-C43562_1.pep
QEADQSNFTDAATSGDLEVIDNTQLLEWFAENYHQFGCSLEFVTNKSQEGSQFCRGFGGIGGILRYPADVSAYQDGDLSDGEYDEDFE

SEQ ID NO: 40112 - protein, 167 aa, Sorghum bicolor
  Clone ID: SORBI-28MAY03-C4357_1.pep
HRVASLMRFRRPRKERNFDKKIRYTVRKEVALRMQRNRGQFTSSKPKPDEIAASEMAAVDGSPNWALVEGRPPSAAECHHCGTNATATPMMRRGPDGPRTLCNACGLMWANKGLLRDLSKSPVPLQVMQSAPLLDGGNGNVMSAPGSELENAAAAMTNGHESSSSGV

SEQ ID NO: 40113 - protein, 269 aa, Sorghum bicolor
  Clone ID: SORBI-28MAY03-C43724_1.pep
MGEVHEADKNIEIWRVKKLIKALDAARGNGTSMISLIMPPRDQISRVTKMLGDEYGTASNIKSRVNRQSVLAAITSAQQRLKLYSRVPPNGLVLYTGTIVTDDGKEKKVTFDFEPFRPINASLYLCDNKFHTEALNELLASDDKFGFIIMDGNGTLYGTLSGNSREVLYKFSVDLPKKHGRGGQSAVRFARLRMERRHNYLRKVAELATQYFINPATNQPNIVGLILAGSADFKNELGKSEMFDPRLQAKVVKMIDVSYGGDSGFNQAI

SEQ ID NO: 40114 - protein, 180 aa, Sorghum bicolor
  Clone ID: SORBI-28MAY03-C4440_1.pep
SAHASAEIQRLAAHKEVIYQTLRGGYYQLRSGVLDFLNTLVGLDIPIAIATPHSRKSLEEGIKTVGLQGYFDAIIALEDFCLGKPDGEMFEVAAEQLGLEPDVCVVFGNSNLTTESAHNAGMRCVAVAGRHPAYELQAANHVVRWLDQLSIVDLQRLANGEVIGRRGRESDMDMEIVIEE

SEQ ID NO: 40115 - protein, 127 aa, Sorghum bicolor
  Clone ID: SORBI-28MAY03-C44409_1.pep
MRMRCTLAVWLYLVVMAAAAAAGDDKPEPRPVITPKPKPKPKPQPQPQPDQPKPTPDQPYKPKPQPEPGHPKPTPQPNPTPEPTKPKPMPQPEPKPKPQPQPKPEPQPGPGKPKPKPPAYSPGTPGP

SEQ ID NO: 40116 - protein, 72 aa, Sorghum bicolor
  unsure (1)..(72): unsure at all Xaa locations
  Clone ID: SORBI-28MAY03-C4454_1.pep
MGLVLCKSYPSEFISYFHYCRSSWFEDRPDYSYLKRLSXDLFIGEGYQFDCVFXWTILKYPQAATPGQSDKN

SEQ ID NO: 40117 - protein, 177 aa, Sorghum bicolor
  Clone ID: SORBI-28MAY03-C44561_1.pep
RSIDTHATKEVMRERDVQYACTSYSNCTLYTAVCNTSGSSGLLHGVRPPRRRGRRAPEGAQRRAAPADRTSTPPWRLQAMVAASWRKWFRYDRAGAREFLVVCVLVLLRSCDLLRGNGTEDAAVFKGIRPCHIYIIFRGRKIILPLELLVAAMRSSKDQLTYPSTLIQRTNCKQAAV

SEQ ID NO: 40118 - protein, 189 aa, Sorghum bicolor
  unsure (1)..(189): unsure at all Xaa locations
  Clone ID: SORBI-28MAY03-C4463_1.pep
GRRRKDFFGHSVEEDCVMANNSGSCRXQEXEAHTGEPSWMHEFTGVAKHASGPVTAAKTIYEDEEGYLIVVSMLFSDPHSVKVSWRNTLTHGIVKITCVSTARMPYIKRHDRMFKLTDPFPEHCPPGEFVREIPLATRIPEDAKIEAYYDETGTGLEIMVPKPRVGPEEHEVQVCMRPPHLGDNDLVLS

SEQ ID NO: 40119 - protein, 190 aa, Sorghum bicolor
  Clone ID: SORBI-28MAY03-C5220_1.pep
MNRRPVLGDIGNLVTVRPAEGKPQPQEQQVNRPITRSFGAQLVKNAQANAAIKNAAILPARHAPRQDRKAPAKLPPPEDIIALSSDSEQSRTQSESSASSVRSRRKAINTLSSVLSARSKAACGIADKPRQVIEDIDKLDVNDELAVVEYIEDIYTFYKIAQHERRPCDYIEAQVEINAKMRAILVDWIL

SEQ ID NO: 40120 - protein, 169 aa, Sorghum bicolor
  Clone ID: SORBI-28MAY03-C52162_1.pep
NIPAPNNTLPSIITKFKRQGLNVVDVVALSGGHTIGMSRCTSFRQRLYNQTGNGMADSTLHVSYAAQLRQGCPRSGGDNNLFPLDFVTPAKFDNFYYKNLLAGKGLLSSDEVLLTKSAETAALVKAYAADVNLFFQHFAQSMVNMGNISPLTGSQGEIRKNCRRLNNSH

SEQ ID NO: 40121 - protein, 151 aa, Sorghum bicolor
  Clone ID: SORBI-28MAY03-C52211_1.pep
IIWVKTNQLQRIIRTGRTGHWLNHSKEHCLVGIKGNPLVNRNIDTDVIVAEVRETSRKPDEMYAMLERISPRTRKLELFARMHNTQAGWLSLGNQLQGVRLVDEGLRARYKAAYPDVEVQPLSPPRTSAPMDVDQSSSQKAAAPDGGERPA

SEQ ID NO: 40122 - protein, 104 aa, Sorghum bicolor
  unsure (1)..(104): unsure at all Xaa locations
  Clone ID: SORBI-28MAY03-C5227_1.pep
HRTSPFYPYFQFGQSGNTTTNYTSGQGYNLQYPQMFQFSTVSSTAAAVTGFAQQYARPLSLAASPQAQATYQDKAVAKRNXNSQAXTQGGFMLIXSNWTTMTAK

SEQ ID NO: 40123 - protein, 200 aa, Sorghum bicolor
  Clone ID: SORBI-28MAY03-C52317_1.pep
MASGLSHGTSIESMARPVAVDHRISIHYYFRIADNLLRQANVYREEKNVLDLYIILLRYSSLLLETIPKHRDYHAFKAREKEFLKKGPHNSEKILGVVNELESLKPVVQQQIATCNSRGADEPNGVYGTYAASSGLEHQTPDPYMSKSLAGSPTRLLQKPLPGSKHQAATSQSIQPYRHAMKPPTNMLYSKEETLSRHSI

SEQ ID NO: 40124 - protein, 109 aa, Sorghum bicolor
  Clone ID: SORBI-28MAY03-C44780_1.pep
MNKVGIGEKKSCCLPSKINDSSGGAVLRYALHLRFLCPSKKSSKSMLRCKSDPSSAPYSNNTVPEEERRFYLYNDLRVVFPQRHSDADEGELRVEHDFPADPKYFDISN

SEQ ID NO: 40125 - protein, 62 aa, Sorghum bicolor
  Clone ID: SORBI-28MAY03-C44792_1.pep
SVHQGYNTKSFKSREDNEWWILPTILFLIKSLQAGLVNWHVANLEIQDYSLFSPDPDRFWAM

SEQ ID NO: 40126 - protein, 84 aa, Sorghum bicolor
  Clone ID: SORBI-28MAY03-C44822_1.pep
IKCAQWQPKWLLSIIPNYPLLNFMLTTAIYVAVSHRLFELTNTWKTVFVPNRDNKRLSYNFVAGAAISAALYFVSFVLIGIAGY

SEQ ID NO: 40127 - protein, 158 aa, Sorghum bicolor
  Clone ID: SORBI-28MAY03-C44824_1.pep
DAVHQLFFLLPSGRSGCAGSVRAGGELLPIGIATAAFDGIHSSKWEEPDGAKGCWLIYTMQAGKSCELESYDLMSANDAPERDPMDWVLEGSTDAGSTWNLLDARNSEMFESRFLRKTFTVDKRYKANAFRFRFLRVRESHSNPRFQIGSIDLYGKTV

SEQ ID NO: 40128 - protein, 179 aa, Sorghum bicolor
  Clone ID: SORBI-28MAY03-C44837_1.pep
MAKMVLQVHFHHHLLPLKLSVLCNGKRHPAKLHPDIAYFVRPLPMDLNTFLCKENQLRGMFEYARRCTFKDHLQKLEHEDSAEHSDKNLQVAQSVASKILSNANVHLVSMDMPVTFSVDDASGLCWRFSSEILSTSKPCLITILAEGHASGPLDLTVKVNSEDTVFALNLLNRVVVIID

SEQ ID NO: 40129 - protein, 74 aa, Sorghum bicolor
  unsure (1)..(74): unsure at all Xaa locations
  Clone ID: SORBI-28MAY03-C44873_1.pep
MSTTGEILRTELSSRTPPFGLRLWIVIGICIWVAILFILGFMCFWSIYRRKPSKSSFDSTNTIPVSQIPDVSXE

SEQ ID NO: 40130 - protein, 127 aa, Sorghum bicolor
  Clone ID: SORBI-28MAY03-C44259_1.pep
VVAAAANGFGPGDLDARLREAAEAAARAAHAPYSQCPSGFAVADGDGRIYAGGCLESAAYNPTLGPVQAAIIAMVAAGGGPAGDVVAAALVEKEQAAVAQEATARIFLDAVAPHASFHVYKYRPSDA

SEQ ID NO: 40131 - protein, 140 aa, Sorghum bicolor
  Clone ID: SORBI-28MAY03-C44295_1.pep
WTLRPRPLRPRLSFRTLREGLGLRPLTTWFPVVGSWMLAGPSCNALAACCGRVVAGSSVLLGRCWFLLAGFFRASSSAPLCVVRPAFVSRRGSLCATPSITNIRVRSLWLADSFIHQLEEPSLLKLSHILRGWACTLQCV

SEQ ID NO: 40132 - protein, 137 aa, Sorghum bicolor
  Clone ID: SORBI-28MAY03-C443_1.pep
MSILWEKSAGWRWLVRRTRDSKPFFFTFAALCGVVPGVIGYGVMQLTSSRNEQLEAHLRSTARPETTMMGQVNRERLAEFLGELQRKEDTNDRYIAALKGETLTRKRYERIQAVPANDQAGQETTAKASAEEKPKAK

SEQ ID NO: 40133 - protein, 194 aa, Sorghum bicolor
  Clone ID: SORBI-28MAY03-C44342_1.pep
DVLDTTGTMYSMAEYAGFVDEDGGGGFEGEYRAFLVDAGSTVLSAGLGSSTVTTYIESTAGIREGGRTGITAVTVAACFLASLFFGPLLMSVPPWAVGPSLVLVGAMMMRVARDIEWGDMKEGVPAFVTMALMPLSFSIAYGIIAGLGVYVALHWYDWARHGYGKLSNALDERRNQVAAAAGEIGTAPAAHDVV

SEQ ID NO: 40134 - protein, 225 aa, Sorghum bicolor
  Clone ID: SORBI-28MAY03-C44346_1.pep
LRGSPARRDQGASGRGANPRTQLTRRHLPASRANATPPIQQPTTNPPRASNNFLPQRRPAGGQYPPPAMAQLRARARTTNTSDVVLVCLLQQRPKCFSRRPAGLPPRSDNGPTRAPVLPNGPLQHRSARLTTPCGLHRAAPNNDGQRTLAPGPGPAAPHNNSSCGLCFFFSLRRAGTFFSDVRAGTAHHMPFGGPALTWARANSPSNQLFSPPKLEQQAPATASC

SEQ ID NO: 40135 - protein, 98 aa, Sorghum bicolor
  Clone ID: SORBI-28MAY03-C44396_1.pep
ATTASSSSCNVGGAEAEAEAEDDKRNVVLGCVNNMEPPEPESCVLVGPCATPADVSVESECDDHHHHHLDYDDGFPESYCAMPELWEPWPLVEWNAVA

SEQ ID NO: 40136 - protein, 180 aa, Sorghum bicolor
  unsure (1)..(180): unsure at all Xaa locations
  Clone ID: SORBI-28MAY03-C4523_1.pep
MVNYLSKQMFSLLHVLELLNLLQQHVYGIPELADEESRVEAQEEVPEDEEMQDPPPPQSANARMGWTTELXLWIPEADPKAFFHENLVLTLEHHYPDLQATLEYNCTEHKHPLRRSLWVAELVVKTLDATKGIRKVESKHISRISRDTMKESMADAAYQALIFYRGRCFXDVQYNATYHY

SEQ ID NO: 40137 - protein, 179 aa, Sorghum bicolor
  Clone ID: LIB3481-045-Q6-K1-B12.pep
MSEAGRRGAREKLREAACNAVAGGSAGVISATVLCPLDVIKTGGGVYGLPSNFSGAPPPGRVLISGFQQILKNEGLPGLYRGLSPTIVALFPTWATVSRTLVTKPKLLRTSKLRRALSKMPPRTRSAARMAAEEYRAMFNLGGQHVDGVPELEDEESRVEAQEEVPEDEEMQDPPPPQS

SEQ ID NO: 40138 - protein, 194 aa, Sorghum bicolor
  Clone ID: SORBI-28MAY03-C45465_1.pep
CLQSPYSFQAVISNCQPCTPAKSHSSSDKHTRSISGPFIAGAVAPGDSLLNLRLAVLVAGTVTLGESLLSLRLAVFVAEAIPLGTSLLNPRLAVFVAGAVPIGTSLLNPRLAVFVAGAALGASLLNPRLAVFLAGAVDASSFNPRLAASHASSDSDPESGGCMPVGMEGIVVFEPDGAAACKVGFGVGSTRCAR

SEQ ID NO: 40139 - protein, 126 aa, Sorghum bicolor
  Clone ID: SORBI-28MAY03-C45486_1.pep
KIEDSIAFVKAMPKPLAIYAFTQDAALRRRIVDETSSGCVTFNDAVVQYAIDGLPFGGVGQSGFGQYHGKYSFEMFSHKKAVMKRGYLLELTLRYPPWDESKVTMMRYLYRFNYFAFVLSFLGLRR

SEQ ID NO: 40140 - protein, 140 aa, Sorghum bicolor
  Clone ID: SORBI-28MAY03-C45333_1.pep
LSLFFNIMNMTLFYFNILLMTLLYLLIFKIILFLVYHSYVLGLVRLDLYTCLGSYSVYPSDPWVNDRYCVGVVLIPYLSAIVRNMPDRGVVRDSDSFIDSYIVPLSCIGLAEQYYYRGVIAMFLIFLANITMHGRSLVSQ

SEQ ID NO: 40141 - protein, 149 aa, Sorghum bicolor
  Clone ID: SORBI-28MAY03-C45506_1.pep
MDPDYMSTNKLTKKSDVYSFGIILFELITAINPQQGLMEYINLAAIGGEGRVDWDEILDKDLLVGNIPEEVRTLADVAYRCVNKSPRKRPLISEVTQAISRLRQRQLRKHDALTLPRSETRTVLRRIEYQHVELAALTSMRELTPIRAS

SEQ ID NO: 40142 - protein, 85 aa, Sorghum bicolor
  Clone ID: SORBI-28MAY03-C45520_1.pep
DGGRYRADYRYQPFLAGFRTFRTAGCEAAAPAAGCPPVPASPAGAGLSVQQRDAMRWAQQRSMVYYYCQDYTKDRSLYPECSLAT

SEQ ID NO: 40143 - protein, 149 aa, Sorghum bicolor
  unsure (1)..(149): unsure at all Xaa locations
  Clone ID: SORBI-28MAY03-C44644_1.pep
MRSSEPSSRFVQELVLYAASAALSCLVLFAGLRHLDPNRAASQKAQQQKKEIAKRLGRPLVSTTPYEDVIACDVINPDSIDVEFDSIGGLDQVKQALYELVILPLRRPELFAFGKLLXPQKGVLLYGPPGTGKTMLAKAIARESGAVFI

SEQ ID NO: 40144 - protein, 170 aa, Sorghum bicolor
  Clone ID: SORBI-28MAY03-C4465_1.pep
DVKSPETILDHDRIIWLGDLNYRIALSYCSAKALVEMHNWKQLLEKDQLRMQQRYGRVFQGWREGRIYFPPTYKYSFNSDRYAGEGRHPKEKRRTPAWCDRILWYGNGLNQLSYVRGESRFSDHRPVYSIFLAEVDIVHQRRRNMGYFSSRIEVEELLPHSQSYREIKFY

SEQ ID NO: 40145 - protein, 164 aa, Sorghum bicolor
  Clone ID: SORBI-28MAY03-C44676_1.pep
AAAGATFEEVFELYCQGHCGLGPQWEHVREYWEASKRTPGSVLFLRYEEMLQDPVGNLKKMAEFMGCPFSAAEEDAGVVRAILELCSLDKQRSLAVNKTGAYAYVNAREGLVTQVVDNKHFFRKGIMGDWRNHMSPEMAARLDGIVEEALKGSGFTFGYTNTNN

SEQ ID NO: 40146 - protein, 104 aa, Sorghum bicolor
  Clone ID: SORBI-28MAY03-C44679_1.pep
LEDIDSMQDEMMDLMDVSNEIQETLGRSYNVPDDIDEEELMGELDALEADMDFESESVPSYLQPDQESELNLPAAPTGHAAVPANQQQEDELGLPTVPQASIRT

SEQ ID NO: 40147 - protein, 271 aa, Sorghum bicolor
  Clone ID: SORBI-28MAY03-C4478_1.pep
SVLVYEYMENGTLRCHLYGTRWAPLSWRQRLEICIGAARGLHYLHTGAKNTIIHRDVKSTNILLGDHLLAKVSDFGLSKVGADTDQTHVSTTVKGTFGYLDPEYFRTQQLTDKSDVYSFGVVLLEVICARPAIVQTLPREKVNLVEWGMACHKRGELHQIIDPHLVGKIMPIALSKCGETVCKCLSDYGVDRPTMADVLWNLEFVLQLQESGEENSNIHMDNATSQQNLQEFTLQLQETGQDDNSNMTMTNDNSNTTMTNTSIQTMEDELP

SEQ ID NO: 40148 - protein, 168 aa, Sorghum bicolor
  unsure (1)..(168): unsure at all Xaa locations
  Clone ID: SORBI-28MAY03-C45807_1.pep
MMSERNLLARRQPLPPAIAVAVVVVAVLVHPRAVAVAQAQPSPGYFPSATVRSMAFSEDYDNLWGPQHQTLSQDKMALTLLMDRTSGSGFKSKRSYRNGYFGVSIKVQPGYTAGVNTAFYLSNNELYPGKHDEIDIELLGTVPGEPYTLQTXNVYVRGTGDGAHLVGR

SEQ ID NO: 40149 - protein, 132 aa, Sorghum bicolor
  Clone ID: SORBI-28MAY03-C46033_1.pep
VLHTVSPVDHDPKLVEAEVAPGLGETLASGTRGTPWRLSCHKFDGKVTTLAFANFSEEMVVLNSGPTDGEVTRRTVDYSKKPLSVDATFRGQFGQRLAAIGQYLEQKFGSAQDVEGCLVGQDIFIVQSRPQP

SEQ ID NO: 40150 - protein, 120 aa, Sorghum bicolor
  Clone ID: SORBI-28MAY03-C46044_1.pep
DGKSLSSETRLVIEQEVKNFLENAYNNAKTILTKHNKELHALANALLEHETLTGAQITNILAQVHNKQQQEHTIEAPQKTPAAPASPASPAASAAAAAAAAAAAAQQAAAKAKGVAGMGS

SEQ ID NO: 40151 - protein, 71 aa, Sorghum bicolor
  Clone ID: SORBI-28MAY03-C4605_1.pep
LATLQCLAATEAFARQKCWEAEAGPAAAQTGPDSAESQNCKHCLLDSLSSVLWGASSHPQGALVEDHVEIQ

SEQ ID NO: 40152 - protein, 267 aa, Sorghum bicolor
  Clone ID: SORBI-28MAY03-C4613_1.pep
MAAMTAYKYQAQAMMRDYLLADPLVPYTSVLIGVVLCKMAYDFTRILSSFYFKGYTSLTKIQRIEWNNRGMSSAHAIFITAVSLYLVMSTDLFSDRIKGPITFRNSIISTSALGVSVGYFITDLAMIFWLYPSLGGMEYVLHHTLSLVAIAYTMLSGEGQFYTYMVLISETTTPEINMRWFLDTAGLKKSNAYLVNGILMFVAWLVARIFLFMYVFYHIYLHYSQIMQMHAFGYYLTFVVPSVLFVMNTMWFMKILKGVMKTLAKWP

SEQ ID NO: 40153 - protein, 305 aa, Sorghum bicolor
  Clone ID: SORBI-28MAY03-C45037_1.pep
HEAELSAKAFAVMVLMLPPDSARKWRPHELELVEVVADQVAVALSHAAILEESMRARDLLMEQNIALDAARREAEMAICARNDFLAVMNHEMRTPMRAIISLSSLLLETKLTAEQRVMIETILKSSDLLETLSNDVLDISKLGDGSLELEVAPFNLHATFTDVVDLIKPVAALKRLSVMVHLAPELPTCAIGDRKRLMQIILNVAGNSVKFTKEGHISISASIARTDSLRDPYAPDFHPVLSNGSFYLAVQVKDTGCGISPQDMPHTFTRFAHPQNAINKLHNGNGLGLALSRRFVTLMQGNIWL

SEQ ID NO: 40154 - protein, 137 aa, Sorghum bicolor
  Clone ID: SORBI-28MAY03-C45105_1.pep
GAAPISSMMTVKRWSRGPSATQIGKPAVHMASVDLKGKAYDVLRQNSSSFLLEDVYRNPGPLQFEGPGADSKPISLCVEDQDYMGRIKKLQEYLEKVKSIVKPGCSQDVLKAALSAMSSVTETLNIMTSSSAGQTLL

SEQ ID NO: 40155 - protein, 89 aa, Sorghum bicolor
  Clone ID: SORBI-28MAY03-C45163_1.pep
KQMGKITKKICTSPQMVIGGAKPAAVSQNLVQHDLQHNRRCDIFRQEKHSLHNTLFAPIPTSSLEVPCKISGPDSRTVYDLGRKAKIRK

SEQ ID NO: 40156 - protein, 133 aa, Sorghum bicolor
  Clone ID: SORBI-28MAY03-C45297_1.pep
EEGSRRPSFAKEEPLLSSPAHSTDDKSNETNTTLGVTAAFTAQTSEVVTSVEDSTSGSQPATAGPVAIADASGATATNSLQGKGSRSLNRRRTRKGKGQSQSGTRTTPAAEKSRGASIVSRINSKVERIEAWR

SEQ ID NO: 40157 - protein, 110 aa, Sorghum bicolor
  Clone ID: SORBI-28MAY03-C46394_1.pep
MEIATGAISTLLPKLGDLLKEEYKLQKSVRGEIMFLEAELEAMQTVLLKISSAPMDEQPDAQVNLWVREVRELSYDLEDNIDRFLVRIDHAPEQLHGLRGFIDRSLKLLT

SEQ ID NO: 40158 - protein, 146 aa, Sorghum bicolor
  Clone ID: SORBI-28MAY03-C46290_1.pep
VAADERRHEAAYTRASAELFDVDPDGMVRALAYVMLGKVTMPGLLMSDGLGGGGDSLFARFSAVAQRAGVYTASDYGDMVEHFVRRWRVADLGAGLSGEGRRAQEYVCGLAPKIRRMEELAHRRAARGEPGLARFSWIFNRAVVVG

SEQ ID NO: 40159 - protein, 252 aa, Sorghum bicolor
  Clone ID: SORBI-28MAY03-C46420_1.pep
MKLPLLRPLWPGLGPAAGPADAAPEPAKPSLPATWLLLHALFCATSMAVGFRFSRLIVYLLFLPTPPINPAAHLVSLVSPPAVVLAGANATAMATITTTTTTTTTVTTTTTVAAEIGDHPQPQHHHHHHGPVFVGRHPIRVRAWPHPDPSELLKAHRILAAVQNAQRSTKRRGAGPARPVIAVTPTTTSALQVPSLTSLAHTLRLVDAQLVWIVVEPGHRTDAVAAVLSRSNLDFLHITGAGDSTASLRLHA

SEQ ID NO: 40160 - protein, 75 aa, Sorghum bicolor
  Clone ID: SORBI-28MAY03-C4648_1.pep
MTRGNQRDRDRERAAARKPNAKGSQDGLTPEQRRERDKKALEEKAAKKAQQAAAGGTGTSTDNNNNNKNKAGGKK

SEQ ID NO: 40161 - protein, 116 aa, Sorghum bicolor
  Clone ID: SORBI-28MAY03-C46607_1.pep
PTRHTSTSSGTHAAAARSSASSSANALSLSLASPPPAAAAAAARGRPPRGRPAGAAGAGGAAALHLPATAPLLQVDDEHARSACTLAGAAAMHAHPAKKSISTYVQFVVRVNLTSS

SEQ ID NO: 40162 - protein, 107 aa, Sorghum bicolor
  Clone ID: SORBI-28MAY03-C45524_1.pep
PYDHRADVFSFGIVLWELLTGKLPYEDMTPLQAAVAVVQKDLRPIIAADTHPMLANLLQRCWQKDPALRPTFAEIVDILNSIKEVVQSSVHHKRHPGRSHSGRRRGC

SEQ ID NO: 40163 - protein, 137 aa, Sorghum bicolor
  Clone ID: SORBI-28MAY03-C45532_1.pep
YAGPNARPSGGFRESLLHALKFNDFYHDTVHQFAPTYNEYVLYNHNEGDNAQTKYPSGSTAPSGQGVELAGITVVASNSPVTSSVSSNQAEQEETMTTPIKDKVDPPGGLYDLTELLDVDLSSYPAKVPAITDVRKQ

SEQ ID NO: 40164 - protein, 239 aa, Sorghum bicolor
  unsure (1)..(239): unsure at all Xaa locations
  Clone ID: SORBI-28MAY03-C4560_1.pep
FLLXIDTPQPGWGAAERIEETGRYLKXYAQTFNVPFEFRAIPSRFEAVQIEDLHIEKDELLRGDSMFKFKTLMDESVVAESPRNMVLNTIRKMNPHLFIHGIVNGSYNAPFFVSRFREALYHYSAIYDMLETNIPGDNEQRLLIESALFGREAINVISCEGLERMERPETYKQWQVRNQRAGFKQLPINQDIMKRAREKVRCYHKDFIIDEDNRWLLQGWKGRIILALSTWKPDHKSSS

SEQ ID NO: 40165 - protein, 194 aa, Sorghum bicolor
  Clone ID: SORBI-28MAY03-C4563_1.pep
MEKGKGLARHWAVELPDASSSSPAVPDPPGFTRSAPDADDAAGARQRKDSETAWKAQKAWEVAQAPFKNLMMMGFMMWMAGSTVHLFSIGITFSALWQPLNALRSVGKVFEPFKDPRVDTIAPKLLFIALNLAAMGLGVWKLNTLGLLPTNPSDWVSSLAPAREVEYAGGRGPLNLMTISTLELILLVVILHQY

SEQ ID NO: 40166 - protein, 258 aa, Sorghum bicolor
  Clone ID: SORBI-28MAY03-C45743_1.pep
MELRLASRGALSAAPPLSGCLSRHSLSPWLKIQNHIYPMPSLCYKVRTTAKCHASMATSYVETSEVTDLDWENLGFGLIETDFMYVAKCGPDGIFSKGEVLPFGPIALSPSAGVLNYGQGLFEGLKAYRKADGSILLFRPEENAIRMISGAERMCMPAPTVEQFVDAVKQTVLANKRWVPPTGKGSLYIRPLLIGSGAVLGLAPAPEYSFIIFVSPVGNYFKEGLSPINLIVEEKFHRASPGGTGGVKTIGNYASVLR

SEQ ID NO: 40167 - protein, 168 aa, Sorghum bicolor
  unsure (1)..(168): unsure at all Xaa locations
  Clone ID: SORBI-28MAY03-C4699_1.pep
PSISDVLCTATAEALAMGKFVICAEHPSNEFFMTFPNCLTYKTSEEFVARANRAMDREPQPLTPEQRXNLSWEAATERFMEYSDLDKVLNNEAAQPGQGRNRKNTRTSQPNLSDIMDGGLAFAHRCLTGNEVLRLATGAIPGTRDYDKQHCIDMGLLPPQVQHPVYGW

SEQ ID NO: 40168 - protein, 162 aa, Sorghum bicolor
  Clone ID: SORBI-28MAY03-C46914_1.pep
MAGRAVGVLLAVAVAALLAAAARAADDDDKKQPWKCFRSCARGCYHHHDNYAATVSTDFPSSGDAAEVSAVTGECKNGCHDDECFKDLPAISHTQCAMATCLSHPHNSRKKTACLKDCCEKCFGNSPPKPGPPKPGPPTPAPPEPPGPPAPGPGPKPTSPPN

SEQ ID NO: 40169 - protein, 110 aa, Sorghum bicolor
  Clone ID: SORBI-28MAY03-C47148_1.pep
APRPVQTSKAKTMLHLHHHSPLVSRHGAVCPPTRLACSCICNKANSRITAAQSTNNNANLLLLRGWSSTRRRITTVASGQSVPGYTPDDGDQCLETGNKISFTTVKDAVI

SEQ ID NO: 40170 - protein, 256 aa, Sorghum bicolor
  Clone ID: SORBI-28MAY03-C47155_1.pep
MNDETFGSSELSNEDRAEEERKRRASFELMRKEQHKAMQGKKNGPDILKENPSDDVISQLQTSTAKANAKTKNEKLDGSIVSSYQEDTTKPSSVLLAPAARPLVPPGFATAFADKKLQPQSSNITHEPKLGGQLEGDQSATEFTSGSKEKAISNNVAIMGPKHTLPAGGVTSSAELPPSILKGSEDWEADVMDKYSIGKEGKSKNIDPVRKDDSVSVLEQFFGNVLSKSGSNLPTYVENQPLKTDDDMIASSVPES

SEQ ID NO: 40171 - protein, 110 aa, Sorghum bicolor
  Clone ID: SORBI-28MAY03-C47217_1.pep
MEANPKNVFTIKVEDGKPGKDGQPAVGPVFRSVLAKDGFPVLEPDMQTSWDVFRVAVGKYPNNRMLGWRPFKDGVPGPYLWKSYKEIYDEVLQAGSALQHLGVQPGSAET

SEQ ID NO: 40172 - protein, 192 aa, Sorghum bicolor
  Clone ID: SORBI-28MAY03-C47298_1.pep
HEVGAGVDLEDGEGEEDAEAAAAEGSSRETRMLPRMPVRVLLAEGDDSTRHVISALLRKCGYRVAAASDGVKAWDILKEKSFNIDLVLTEVDLPLMSGFLLLSTIMEHDASKNIPVIMMSSHDSVSMVFKCMLKGAADFLVKPIRKNELRNLWQHVWRKQLANGGSDVHHIQQEENLAERIEQKTGVTKLII

SEQ ID NO: 40173 - protein, 124 aa, Sorghum bicolor
  Clone ID: SORBI-28MAY03-C46169_1.pep
MATAMRGGRLRRFGFRHVSSILFQPPPCPAPSLGLYLAVGRTGLGRLLCSAAGAGDHAGKQVPAWLALTQQVLRDAVERAPSAGSDPAPKITLGHVTGRFARSGGPGGLNANDVNTKVDIRLRL

SEQ ID NO: 40174 - protein, 231 aa, Sorghum bicolor
  Clone ID: SORBI-28MAY03-C4621_1.pep
PVDPPSGLVLLAANISLFLGFAGLFWAFAEARDIRFILLVMSAIFCGYVYQCPPFRLSYQGLGEPLCFAAFGPLATTAFYFSNSSTNISSGMALLPLTKTVIASSVLVGLTTTLILFCSHFHQIDGDLAVGKMSPLVRIGTKAGSRIVSIGILTLYILLAAFGLCRSLPPACIVLCALTLPMGKLVVDYVLKNHEDNTKIFMAKYYCVRLHALFGMALASGLFLARNGILS

SEQ ID NO: 40175 - protein, 92 aa, Sorghum bicolor
  Clone ID: SORBI-28MAY03-C46233_1.pep
AIGHPGARYQRCKSWLAPDDDQEDSDDFFTKEGKETAGYSIVSKTVSEILLQSETNEVKNGAACLLALDLSSLSGGAPGRTRGLKIRSVNSF

SEQ ID NO: 40176 - protein, 61 aa, Sorghum bicolor
  Clone ID: SORBI-28MAY03-C46253_1.pep
DQIFAWLHRSLKCPTLTNKSNHTLLCLKSCIASIKLSAILQEIGSSSYHPSMSVLYVFMLL

SEQ ID NO: 40177 - protein, 114 aa, Sorghum bicolor
  Clone ID: SORBI-28MAY03-C46263_1.pep
YGSCYFPFTNDLVCQETKKAYRCNPPVSSILWHPSRRRAAASQPMVDERSVVAMPYELFAYDMFIDPLIYWYYKPLLIYFSVTFVFTSLCHVLNKAFVYKFVPGESKLMHIATA

SEQ ID NO: 40178 - protein, 68 aa, Sorghum bicolor
  Clone ID: SORBI-28MAY03-C47607_1.pep
EKIYGYDTKTVNLANGSAEGAYALSRGLLTMMTVPFGVCVLFYSPLYLVFKHDRENAKLTSFKEQELV

SEQ ID NO: 40179 - protein, 217 aa, Sorghum bicolor
  Clone ID: SORBI-28MAY03-C4772_1.pep
ARGPFTVVLMDEIEKAHPDIFNILLQIFEDGHLTDSQGRKVSFKNTLIVMTSNVGSTTILKGRQSIGFLKEDTESSSYFAMKSLVMEELKAFFRPELLNRIDEMVVFRPLEKTQMLAILDIILKEVKGRLLALGIGLEVSEAMKHLICQEGYDKSYGARPLRRAVAHIIEDVISEAILFGEFKPGDTILMDIDAEGKPCMNHLDRQIVQVSDPTRTF

SEQ ID NO: 40180 - protein, 256 aa, Sorghum bicolor
  Clone ID: SORBI-28MAY03-C47738_1.pep
LVVRESVRVTDAGDVSAINGLYVALGSPKLPGWSASGGDPCGESWQGVTCTGSSITSIVFNAANLGGQLGSLGNFASITEINLSNNNIGGTIPEDLPVTLQNLFLSDNQLTGSIPMSLSKLHSLTAMSLNDNHLDGKLPDAFDSLTGLVNLDISSNNFSGSLPPSLGSLTSLTTLHMQDNKLSGTLNVLQDLPLKDLIVENNMFSGPVPPKLLNIPNFKNDGNPFNTSIAPSTSPSSTPTGSTPTQTPSSSSSPSG

SEQ ID NO: 40181 - protein, 453 aa, Sorghum bicolor
  Clone ID: SORBI-28MAY03-C47748_1.pep
HEGEYAYQFALVASSPDTILYCDVRLTKDEIGICLPDIRMDNCTNIPDFYAQGQKSYLVNGVPTSGWFSVDYNGTELGQVTLKQSINSRTPRFDSSFFALLAVEDVQSKFKPPGIWLNVQHDSFYSQFNLSMRNYIISVSKRVVANYISSPEVSFLTSTRGRISNKTKLVFRFLDESTLEPSMNQTYGSMMKNLTFVKTFASGILVPKSYIWPNSPDNYLQPYTSVVDDAHKAGLEIYAADFANDFLLSYNHSYDPLAEYLSFIDNDVFSVDGVLTDFPVTASEAIGCFTNLNKSNTDHGKPLIISHNGASGDYPGCTDLAYQKAVDDGADVIDCPVQVTKDGIPICLSSIDLMTDTTIARSQFISQTATIKDIQIAPGVFSFNLTWDDIVKNLKPKISTPWTNFKLDRNPRYRNAGKFVRLSDFLEFTKDKDLSGIMISVEHAAFLAGELGF

SEQ ID NO: 40182 - protein, 154 aa, Sorghum bicolor
  Clone ID: SORBI-28MAY03-C47892_1.pep
MAMRHRARSSPTSPLTPSSSTRTKKILGFSVSLILINLASIMERADENLLPAVYKEVSAAFNAGPTDLGYLTFAMNFLKSIASPLAGILALHYDRPTVLAIGTVFWALSTAAVGVSQHFGQVAFWRAVNGLGLAIVIPALQSFIADSYKDGTRG

SEQ ID NO: 40183 - protein, 185 aa, Sorghum bicolor
  Clone ID: SORBI-28MAY03-C9750_1.pep
MPPPPPPQGNGGKVTPNLAMDAEATRMLNLTVLQRLDPAVEDILITAAHVTLYDFNIDLNQWSRKDVEGSLFVVKRNSQPRFQFIVMNRRNTDNLVEDLLSDFEYELQPPYLLYRNAAQEVNGIWFYNQHDCEAVASLFGRILNAYAKVPPKPKVPTTKSEFEELEAVPTSAAIDGPLEPQLSSP

SEQ ID NO: 40184 - protein, 249 aa, Sorghum bicolor
  Clone ID: SORBI-28MAY03-C46776_1.pep
ARGHQSPPANCCGCASCGCRDAKSANGDMAVGGENKKKASEPAPPETPSMMEQLVPEITTHALSYLDYTSLCRLSMTNSAMRRAANDDGAWKALYHKDFTVEQGTINPPNGWKAYYAATKAIINLNAEFYNIIREGALPAMSRFWLNADYVKCIHATGEFCTGYNAVMESWGLLFNWGQDGGQGIAFQIRDVRVRVLGEVAWVNMKANVDVDPVLFHVTNVYELWNGRWYMVHHHSSLMADPAPHNMFG

SEQ ID NO: 40185 - protein, 252 aa, Sorghum bicolor
  Clone ID: SORBI-28MAY03-C46663_1.pep
HEGPGGFSPVPPGILYLRIFRCIKDCSILAEDILSLLMLSVKDIAETTVPRHRSDKLKKTKYGMRHGQVSLSAAMTQVKVAASLGATLVWLSGGTALVQSLIQEMLPSWFLAVQNLDQGGASGGMVYKLGGHALAYLAVYSGMFAWGIDPTPVSRRRERVMRSHLGFLASALDGKISLGCDLSLWRAYVSGFLGLVVECTPCWVQEVDLRVLKRLSSGLRHWGEDELAVALLRRAGPEAMGTAAEMILGREW

SEQ ID NO: 40186 - protein, 143 aa, Sorghum bicolor
  Clone ID: SORBI-28MAY03-C46851_1.pep
HEAKIFWKYPVSYIVYGSWGLKGGYKNDMLGLEFEPMVPGQPKITGEYIITEMMGLSLNHSKWLDLAMIFVLLFAYRLTFFIVLKLKEAAAPYIRVAYTRFTVKRLERRASFRKTLAMTSMSKRHNPPHPMAIQEGLNSPMPY

SEQ ID NO: 40187 - protein, 168 aa, Sorghum bicolor
  Clone ID: SORBI-28MAY03-C46864_1.pep
EEYSPHLSDCGLAALSPKPEREVSAEVVGSFGYSAPEFAMSGTYTAKSDVYSFGVVMLELLTGRKPLDSSRGRSEQSLVRWATPQLHDIDLLAKMVDPALDGLYPAKSLSRFADIIAICVQSEPEFRPPMSEVVQQLVRLMQRASIIRRQSDDLGYSYRVPDREADVL

SEQ ID NO: 40188 - protein, 141 aa, Sorghum bicolor
  Clone ID: SORBI-28MAY03-C46894_1.pep
TRASSAARAAPLSSAAAAFRRTSPLLSEDKPAKVEDVMPIATGLEREELEAELQGKKRFDMDPPVGPFGTKEAPAVIESYYNKRIVGCPGGEGEDEHDVVWFWLKKDEPHECPVCSQYFVLKVIGDGGDPDGHDDEDDGHH

SEQ ID NO: 40189 - protein, 378 aa, Sorghum bicolor
  unsure (1)..(378): unsure at all Xaa locations
  Clone ID: SORBI-28MAY03-C4821_1.pep
MAEVKPEEISHPPMEQLQGFEYCIDSNPPWGEAIILGFQHYILALGTAVMIPAVLVPMMGGDDGDRVRVVQTLLFVTXINTLLQSLFGTRLPTVIGGSYAFVIPIMAIIQEPSLSGIADGHQRFLETMKAIQGALIVSSSIQIILGYSQLWGIFSRFFSPVGMTPVVALLGFGLFERGFPVVGRCVEIGLPMLILFVVLSQYLKNIQIKEIPILERFSLFICIALVWAYAQILTSGGAYKNSSEVTQNNCRTDRANLISSAPWIKIPYPLQWGAPTFNAGQSFGMVSAVLVSLVESTAFYKAAARLASATPPPAHILSRGIGWQGIGILLDGLFGTGTGSTVSVENVGLLGSTRMGSRRVIQISACFMIFFSILGEIG

SEQ ID NO: 40190 - protein, 156 aa, Sorghum bicolor
  Clone ID: SORBI-28MAY03-C4822_1.pep
MGDKVNGAVRFCGLKLGQLKNLLGRTMYDQQSCAWMSGVNVIDLDKWRDHNVTENYLQLLRKFGNNDDEASLRASALPISLLSFQHLLYPLDERLTLSGLGYDYGIKEEVAQSSASLHYNGNMKPWLELGIPDYRKYWKRFLTRDERFMDECNVSP

SEQ ID NO: 40191 - protein, 162 aa, Sorghum bicolor
  Clone ID: SORBI-28MAY03-C48270_1.pep
DVEMHSPAQPAWLHEFAGVMKNACGPVTAAKSIYEDDQGYLIMVSLPFVDQQRVKVSWRNTLTHGIVKIVCVSTARMQHIRRHGRMFMLADPSPEHCPPGDFIREIPLATRIPEDAKLEACFDEAASVLEIMVPKRGNEPEEHEVRVSLRPPHFGANDLLLT

SEQ ID NO: 40192 - protein, 206 aa, Sorghum bicolor
  Clone ID: SORBI-28MAY03-C48306_1.pep
HEASQSSFKIIDAVLNRINTIMSKDFMDTRSFSQHMAFNIIGATLLGDAFFEWSDASAYEELLMLVAKDGCFWASYAIPPFWRPSYRRYRTLCAKLKILTESVVRKSRQNSSLNHFDQRSYLKSKGTDPNRRVLDNMMASHCLHGAIGGPLNSEEEICGNIMGLMLHGISASANLIGNILTKLVLSPELQDQLHVEIVSVCNESSK

SEQ ID NO: 40193 - protein, 104 aa, Sorghum bicolor
  Clone ID: SORBI-28MAY03-C48328_1.pep
NTEGRQEAQQRGAQGGDEFEGHRKPSHKLLIHYNHRSITQKDPVLCTPTRSTRLWVHGAKRRGRTNDGKNEERRKVQGPSGNRSTCRRATCLLVNVRCKNIFLS

SEQ ID NO: 40194 - protein, 112 aa, Sorghum bicolor
  Clone ID: SORBI-28MAY03-C47373_1.pep
MDGWAARLEAPVAVVTGASRGIGRAIAVALGKAGCKVIVNYAKSGMEAEEVCREIEESGGTAISFAADVSCEADVESMMRAASDPWRALVVRVSNPRIARHAPLMRCWWTSL

SEQ ID NO: 40195 - protein, 111 aa, Sorghum bicolor
  Clone ID: SORBI-28MAY03-C47453_1.pep
GKRFRDNEVRLDSIQDMDIDPPERSTKRTKSNTTPLKPVQTEDGGSVHMREDSVTVSTDVKDGNPDGYKKFTIAKLKEELTKHGFAAQLLELKNPNKKDILALYMKHVLCE

SEQ ID NO: 40196 - protein, 241 aa, Sorghum bicolor
  Clone ID: SORBI-28MAY03-C47495_1.pep
TRIPSNIDLFKELMLPFAIVAENFKKLQRWENPRSTFCFLLLVHTVIFRNMLSYVFPFTLMTVALSMLAVKGLKEQGRLGRSFGKVTIRDQPPSNTIQKILALKEAMASVENYLQNLNVSLLKIRTILLAGQPEVTTQVAIVLLASSAVLLVFPFKYVLAFVTFDLFTRELEFRREMVRAFMNFLKERWESIHAAPVVVLPYEGAESSPKTLPAKASGQSEPQNVQGGSGYVTSKNGISSS

SEQ ID NO: 40197 - protein, 219 aa, Sorghum bicolor
  unsure (1)..(219): unsure at all Xaa locations
  Clone ID: SORBI-28MAY03-C4738_1.pep
MAPAAAVGPSLARPSSSHPRRAGSVLLRPVSVQHVLLQGRRRRHRRLTGVVPVRAAPDAPPVVRAAVSAVTELLRALSPNKNLRDAAAQQQGEEPDSSPPRCGSVEDVLAVLQDDYRRAYFLTGDFTPGIYTADCLFEDPTIKFRGLSRYSQNLYLLVPFFDSPSLELESIEKGLRVETKFVKATWKLRTYLRLPWRPLIAIRGNTTYDLNEXFKVIRH

SEQ ID NO: 40198 - protein, 157 aa, Sorghum bicolor
  unsure (1)..(157): unsure at all Xaa locations
  Clone ID: LIB3481-048-Q6-K1-C1.pep
RPQRRHRAPTLSPNRNLRDAAAQQQGEEPDSSPPRCGSVEDVLAVLQDDYRRAYFLTGDFTPGIYTADCLFEDPTIKFRGLSRYSQNLYLLVPFFDSPSLELESIEKGLRVETKTYLRLPWRPLIAIRGNTTYDLNEDFKVIRHSESWDVFXVEAIA

SEQ ID NO: 40199 - protein, 238 aa, Sorghum bicolor
  Clone ID: SORBI-28MAY03-C47552_1.pep
ARGADGAPSLPQPEGVFAGGRRALQQRVAAVSRLPRAPDHSVATRIGISLLAAYSLRRRSVVVLRLTVRLRGLSEEVLHRMGRALGFAGEGVLRGGLALPGPRVGGVRGGGAPPGPPLAALVGRASAGLSAHAPLEGPAVADLRVASLPAGPAQGESREASEAARQSQEESHTATGPSTSSSIQQPSQHPANLAPGPSTRPHLLGSTDSEFSTVPLASSSSSSSYSSAPNPFSRPPLR

SEQ ID NO: 40200 - protein, 322 aa, Sorghum bicolor
  Clone ID: SORBI-28MAY03-C48558_1.pep
MLPRFFHRKTGSEASKRAFLPKSTDFGVLEGMLQDPCAAPMCLPMDFLKAITQDFSQEREVGRGGYGVVYKGILQNGKAIAVKKLSEMQLEDGPFQNEVIYLIGLKHKNIVKLVGYCAESRWEATQVSGKYVMAEIRKRLLCFEYLNKKSLDKHLSDESCGLKWNMRYQIIRGICSGLHYLHTECHIVHLDLKPENILLDDGMVPKIADFGMSRLFGQQQSRIITESRGGARGYMAPEHLTNGFISTKSDIFSLGIIIIELMMGSRDYPPSSEASFERFIKNVVENWRNNLEKAPKYIPLEIESRQVNTCIVIGLNCVHSDP

SEQ ID NO: 40201 - protein, 169 aa, Sorghum bicolor
  Clone ID: SORBI-28MAY03-C48544_1.pep
MASNTGASGWFRGKVKAVTSGDCLLIMGSSKAEIPPEKSITLSYLMAPRLARRGGVDEPFAWESKEFLRKLCIGKEVTFRVDYTAPNIGREFGTVYLGDKNVAYSVVSAGWARVKEQGPKGGEQNPYLAELLRLEEVAKQQGVGRWSKEPGAAEESIRDLPPSAIGEAS

SEQ ID NO: 40202 - protein, 130 aa, Sorghum bicolor
  Clone ID: SORBI-28MAY03-C4858_1.pep
MASSSTPAAVREMQKDLEVQANALSKIQKDIAKNHQVRKQYTIQVGENELVLKELELLSDGANVYKLIGPVLVKQDLAEAKANVKKRIEYITAELKRMDRALKDLEEKQNSKKESIFKLQQRMQAVQAKA

SEQ ID NO: 40203 - protein, 113 aa, Sorghum bicolor
  Clone ID: SORBI-28MAY03-C48899_1.pep
DGEQPAIAAIGSLKSVDPDRIILKKIVLTGYPQRVSKLKAIVRYMFHNPDDVKWFKPVELWTKHGRRGRIKETVGTHGAMKCIFNSSIQQHDTVCMSLYKRAYPKWPEQLYHV

SEQ ID NO: 40204 - protein, 149 aa, Sorghum bicolor
  Clone ID: SORBI-28MAY03-C48894_1.pep
MALSACDKKEEYDEEMTAAWEAICEAYCNDTNPTRDPGMLDAVKDAILRMTYYWYNFMPLSRGSAVVGYVVLLGLFLAANMDITASIPPDVQVDWEAILSPDPDTFVDAIKPWLYPSTKISRCLKDYTDVSIAFNTTGSVVAALTSVDP

SEQ ID NO: 40205 - protein, 221 aa, Sorghum bicolor
  Clone ID: SORBI-28MAY03-C48921_1.pep
MAGRNRSFVLWLHGLGDSGPANEPIRNLFSAPEFRLAKWSLPAAPRAPVSCNNGFVMPSWFDIHELPMSAGSPQDEAGVLKAVEKVHAMIDREVADGIHPENIFVCGFSQGGALTLASVLLYPKKLGGGAVFSGWVPFGSSVTEKISPEARKTPFLWSHGMADKVVLFEAGQAGPPFLQSAGVNCEFKAYPDLGHSLSKEELLYLESWIKSRLNASQEKDG

SEQ ID NO: 40206 - protein, 287 aa, Sorghum bicolor
  Clone ID: SORBI-28MAY03-C5740_1.pep
PTRPGFRGGSSGGGGAGAAHAGTLVPAMFVFGDSLTDNGNNNDLNSLAKANYPPYGIDFAGGPTGRFSNGYTMVDEIAQLLGLPLLPSHPDASSGDAALHGVNYASAAAGILDNTGQNFVGRIPFNQQIKNFEQTLDTLSKHLGGASKLAPSLARSIFYVGMGSNDYLNNYLMPNYNTRNEYNGDQYSTLLVQQYAKQLGTLYNLGARRFVIAGVGSMACIPNMRARSPVNMCSPDVDDLIIPFNSKVKAMVNTLNANRPGAKFIYVDNYAMISQVLRNPWSFGFSV

SEQ ID NO: 40207 - protein, 165 aa, Sorghum bicolor
  Clone ID: SORBI-28MAY03-C57406_1.pep
NTPAGRHHQTSSGRRRCPLARVYSPSPSHLQAAAGSSAFGRRSAVHERRSGTDTADLTPNTSGLPLPQPPSRSRPPSAGLVLVCAFVARLLRLRSASSTPPPPWGGSRECALAPPPSRSPRPLARSGLVVAPGLSLVIVSPGGGDAADRCASPGDRLRRGRRSEG

SEQ ID NO: 40208 - protein, 105 aa, Sorghum bicolor
  Clone ID: SORBI-28MAY03-C57497_1.pep
TRKHLHAMAQSSDEQLVVVSQVLVADINIGYEDIVNLQVLAFNGTPVKNLKHLATMVEECNEAFLKFDMDYDQLVVLETKTAKAATQDILTTHCIPSAVSEDLKS

SEQ ID NO: 40209 - protein, 331 aa, Sorghum bicolor
  Clone ID: SORBI-28MAY03-C57554_1.pep
MTSVGLLSSGYEASTSGTTDRLPDEMNGMSIRDEKEVEAVVVNGNGMEVGHTIVTTVGGRNSQSRQTISYMAERIVGQGSFGVVFQARCLETGERVAIKKVLQDVRYKNRELQTMQVLDHPNVVCLKHYFCSTTDKEELYLNLVLEYVPETVHRVIKHYNKMNQRMPLIYVKLYMYQICRALAYLHNCVGVCHRDIKPQNILLKLCDFGGAKVLVRGEPNISYICSRYYRAPELIFGATEYTTAIDVWSAGCVLAELLLGQPVFPGDSGVDQLVEIIKVLGTPTRDEIKRMNPNYTEFKFPQIKAHPWHKIFHKRMPSEAVDLVSRLLQYS

SEQ ID NO: 40210 - protein, 138 aa, Sorghum bicolor
  Clone ID: SORBI-28MAY03-C4903_1.pep
AILGFKKYGNMSYFQATIHKPHIMLTAYKPVDGLGRTCELLYQDSLCPHATRSFKLVEQVYPRLVLVSACHKRLGPVYASSGKENPKISNDPFSMESLNKAMAEAKRPRSIQDVLMEQMAKIGGLGSGGNGGNKNRYG

SEQ ID NO: 40211 - protein, 110 aa, Sorghum bicolor
  Clone ID: SORBI-28MAY03-C49046_1.pep
MVTSQVVMSNPDDDGYSWTKYGQKNILGAKHPISYYRCAHWIAQGCTATKRLHRKEDADTLGFDAIYYGQHTCDQIAHSTDNISSPLGCTTTGSTSKLGTDKIHPEQGGL

SEQ ID NO: 40212 - protein, 365 aa, Sorghum bicolor
  Clone ID: SORBI-28MAY03-C491_1.pep
MALRGNLLVLVLLFAAAATASGKSARLDLVPAAPGASLASRARDDRRRHAYMCARLFAPATQTKLFLDPEMPFYGVKVDAIHVAYSGTGQYFVKLRVGTPVQEFTLVADTGSDLTWVKCAGASPPGRVFRPKTSRSWAPIPCSSDTCKLDVPFTLANCSSPASPCTYDYRYKEGSAGARGIVGTESATIALPGGKVAQLKDVVLGCSSSHDGQSFRSADGVLSLGNAKISSRVRAAARFGGSFSYCLVDHLAPRNATGYLAFGPGQVPRTPATQTKLFLDPEMPFYGVKVDAIHVAGKALDIPAEVWDAKSGGVILDSGNTLTVLAGPAYKGLVAALSKAPGRVPKVSFPPFEHCYNWTARRPGA

SEQ ID NO: 40213 - protein, 363 aa, Sorghum bicolor
  Clone ID: SORBI-28MAY03-C4911_1.pep
VRPAVLITDAYNALNNQGYRKKQDQDFIDSLIKVLATGGSVLLPVDTAGRVLELLLLLDTYWDERRLQYPIYFLTNVSTSTVDYVKSFLEWMRDQIAKSFESNRANAFLLKKVMLIINKEELEKLGDAPKVVLASMASLEVGFSHDIFVEMANEARNLVLFTEKGQFGTLARMLQVDPPPKAVKVTMSKRIPLVGDELKAYEEEQERIKKEKALKASLVKEEELKASLGSNAKASDPMVIDASSSRKSANAGSHFGGNTDILIDGFVPPSTSVAPMIPFFENTAEWDDFGEVINPDDYMMKQEEMDNTLMLGPGDGLDGKIDDGSARLLLDSTPSKVISNEMTVQVKCSLVYMDFEGRSDGRS

SEQ ID NO: 40214 - protein, 123 aa, Sorghum bicolor
  Clone ID: SORBI-28MAY03-C49124_1.pep
QGYSARYGQIGGDSYPQARMVPLATDSETHQRMHGGTSADDYPSTRYSLGSSGARFSQPATTVPSFGLPGVSSQRGSGSVMDKYSYGPGPPTPPRRSGAPRCTAPPQAPCSCPGPSRAGWPHI

SEQ ID NO: 40215 - protein, 222 aa, Sorghum bicolor
  Clone ID: SORBI-28MAY03-C48341_1.pep
HEASVSPRTRRRQGASSSSYSVSSFMSDELDYSDSLSLHEDSSTEHSGSRSELLSSLSVDLKMPPTEHVQSPAPHRDLEDMDFDADLQDRLQKAFDEIVKLKKENLEESCQRQQVEKELLVVRKKAKKLQDHLLKELQHSKGFEEARAADQRLIQKLKKDIELLKIQRDEYLEKFHQASDQILLQPLGAAKEAHEQDKHEIETLREGISQLKIHRDEYLAKF

SEQ ID NO: 40216 - protein, 138 aa, Sorghum bicolor
  unsure (1)..(138): unsure at all Xaa locations
  Clone ID: SORBI-28MAY03-C48389_1.pep
MTNKLATSLLAAAVLLALAAPAVLAGDPDMLQDICVADYKSLKGPLRVNGFPCKRPENVTANDFFSNALATPGNTGNALGSAVTSANVETLPGLNTXRLSVXRIDFAAWGVNPPHVHPRATEVIFVLQGSLDVGFVTT

SEQ ID NO: 40217 - protein, 232 aa, Sorghum bicolor
  Clone ID: SORBI-28MAY03-C48390_1.pep
ARGWDFLANTTDNRGTRIARGFDNVSSSAAPAFDAASGRLVNATADYAANNSARRFGTGELPFDQTYPKIYSLAQCTPDMTAADCRTCLGTIIRTFTPTYFTGKHGGRVLGVRCNFRFETYQFFSGRPLLQLLAPPGPPPSPSPQPSVTGQGRRRDRTALILATALPLAAAILIALAVTCFCFRSRRTEARQDSAKPYSTNPDNIQSIDSLLLDLSTLRSATENFAESSKLG

SEQ ID NO: 40218 - protein, 149 aa, Sorghum bicolor
  Clone ID: SORBI-28MAY03-C48475_1.pep
MASKAGGDGKEAINEQVIANTYANMRTEMNQLYTKITELEMEVSEHSLVIGAIEPLDPSRRCYRMIGGVLVERTIREVLPAVKRNKEGLEEVIARMHEALERKKKEITEFELKYKIRIRKANNDAKDEGGKKEGTAQGVLVGLPDSNKI

SEQ ID NO: 40219 - protein, 90 aa, Sorghum bicolor
  Clone ID: SORBI-28MAY03-C48460_1.pep
MDIETDGRFGNKRVHHRLGPGSGGAPSSTNGKVCNYWRAGRCNRFPCPFLHSELPEAAPPKRPSGPGGNVWRNPHTGGRGGGGGGHSRGG

SEQ ID NO: 40220 - protein, 202 aa, Sorghum bicolor
  Clone ID: SORBI-28MAY03-C49441_1.pep
HEGARRSFSDTVMASLKPSLVFCSILTLLSLNCGPSHVFAKVYMVVMEDDPVISYKVNRKHVMRGDEAQKYKRVATTKHDSFLDSFLPVGSYKKLYSYTHLINGFALHAESEKTVRILSGAKGVRFIQEDIKMAKMTTHTPSYIGASAVWPLLGGAENSGDGVVIGMIDTGIDPKNPSFAISNTSSQAKPPPASFKGICRTG

SEQ ID NO: 40221 - protein, 192 aa, Sorghum bicolor
  Clone ID: SORBI-28MAY03-C49476_1.pep
MAAAVASLYRRVLPSPPAVDFASPEGKRLFAEALAAGTMEGFFPLVSVFQTQSEPAFCGLASLAVVLNALAIDPGRRWKGPWRWFDESMLDCCEPLDKVKDQGITFGKVACLAHCSGADVQSFRANRVTIDDLRRHLIRCVSSQDCHLIASYHRKAFKQTGTGHFSPIGGYHAGQDMALILDVARFKYPPHW

SEQ ID NO: 40222 - protein, 274 aa, Sorghum bicolor
  Clone ID: SORBI-28MAY03-C49671_1.pep
EASSLVATSKFEHKKRMEMIQPIPDIEEPSGQEGAELSKIPVDLKSGDWFLKIVPWIGGRIISMAHLPSDSQWLHSRIEINGYEEYSGTEYRSAGCTEEYKVIRRYLEQSGEEESICMEGDIGGGPGLQRQISILKENPKIVQIDSSIQARSVGAGSGGFSRWVWVRARPTFTLLHPTEVVVAFTAINGSKQEISPEAGEITFEGDLRPNGEWMLVDKCVGLSLVNRFNPKEVSKCFVHWGTGDVNMELWSEERPVSNETPLRICHQYEVRQTS

SEQ ID NO: 40223 - protein, 67 aa, Sorghum bicolor
  Clone ID: SORBI-28MAY03-C49590_1.pep
AQSKWMIADDQLRVDIRAAVEETVMPVYASLIAKLKSSPETGRDLYIKYTPEDVVAHIQHLFEGAAK

SEQ ID NO: 40224 - protein, 168 aa, Sorghum bicolor
  Clone ID: SORBI-28MAY03-C49666_1.pep
ARGERLGANFNRDQNGMHAQLLALSKLVELLDPPLHNYFRQNDCLNYFFCFRWVLIQFKREFSFDQIMLLWEVLWTHYLSEHFHLYLCVAILKKYRQRIIGEQMDFDTLLKFINELSGQINLDRAIQDAEALCTIAGENGASCIPPGTPPSMPIETDGGLYVQEDEVL

SEQ ID NO: 40225 - protein, 83 aa, Sorghum bicolor
  unsure (1)..(83): unsure at all Xaa locations
  Clone ID: SORBI-28MAY03-C4970_1.pep
SAPPSGQPPLLRPLEGPLGPLPSGARWEPFRQTCDGTPFVIPEMEPTLRKQIQECNWQVVNVTTPANYFHLLRRXHREFRKPL

SEQ ID NO: 40226 - protein, 60 aa, Sorghum bicolor
  Clone ID: SORBI-28MAY03-C48929_1.pep
VPKKRDSSLQHRIAYISYESEFLLGRLFSVVIFCLQHILAMSFCLQHRIAYRNNTNFMYV

SEQ ID NO: 40227 - protein, 63 aa, Sorghum bicolor
  Clone ID: SORBI-28MAY03-C48952_1.pep
MFYFSQVNQKMMLTLTASIMYWYLKRPTSHSLDSENGSSCETTSITTSDDSASESSIDDNTTR

SEQ ID NO: 40228 - protein, 136 aa, Sorghum bicolor
  Clone ID: SORBI-28MAY03-C48999_1.pep
VDGKDKPLMLKELKKVWNKDDPNLPWEEGEFSPSNTLLVDDSPYKALCNPPNTAIFPEPYSYLNQRDDYSLGPGGDLRVYLQRIAATDNVQNFVRDNPFGQKSITESDPNWNFYVKIVGKMEKRIVDEVEKKWKRK

SEQ ID NO: 40229 - protein, 98 aa, Sorghum bicolor
  Clone ID: SORBI-28MAY03-C49003_1.pep
LWNPISSGDGRTKTPLSPTVAGSDPHPFGMSHGLGGSSVQLMESSRQSLGAYHSYSVGSLGQMQFSSGVRGQTTLQSRRSQSREDLISSLADIHVPKV

SEQ ID NO: 40230 - protein, 95 aa, Sorghum bicolor
  Clone ID: SORBI-28MAY03-C49028_1.pep
SDEFEPLPIKISAKNMGNVSRFMNHSCSPNVFWQPVQYDHGDDGHPHIMFFALKHIPPMTELTYDYGVAGAESSGPGSRRTKNCMCGSQNCRGLF

SEQ ID NO: 40231 - protein, 165 aa, Sorghum bicolor
  Clone ID: SORBI-28MAY03-C50084_1.pep
TTSTRAGRTKTTVPVAPSFVCANRADKRKEFYTKLEEKHKALEAEKDEAEARKKEEQDVALKQLRKSLVIKAKPMPSFYQEGPPPKAELKKVPTTRAKSPKFTSSRRKSCSDTTQTPEGKNTNSTSTRSHRHSIGTSKDANRVQCSPKSGVATKTRSVKPELKAL

SEQ ID NO: 40232 - protein, 189 aa, Sorghum bicolor
  Clone ID: SORBI-28MAY03-C49997_1.pep
MGGMVASVAAALVVVLGVASVATAQLETCNGDLPPVLAANYSGLACQPVWNNFVLRYHQDKNNVLRIVLSTMYSTGWVGMGFSRDGLMIGSSAMVGWIGKKGLPHIRQFALRGKSSSWPAAAPAPLGSSAPGPTAGLPPPSIYLAFQLRFSYRLSHQHIIMAFGNSIPVKNKLTRHQDKTSFTFDFTTG

SEQ ID NO: 40233 - protein, 179 aa, Sorghum bicolor
  Clone ID: SORBI-28MAY03-C50137_1.pep
LQYTAASISVHDAADEEEALLSEHETSRENAEEEITEGELWYEFEKDLDRQTEVEARTREEEAAAAKEIMEEESAVLKGVEDRQSFTSDSLERQQFYPPGRIMHMVAMPPTDADPDDPVAADECSVGIYETPRDLYSKIRLSNTMINDHYMPMYKKMMEILIEKFAKDEDSYCTGSTVE

SEQ ID NO: 40234 - protein, 206 aa, Sorghum bicolor
  Clone ID: SORBI-28MAY03-C50155_1.pep
HEVQRDFPDTTSGRTSANQLVGSVSELTRVKKQGSSASLAGDDPDFAEEAVSKWSDSGMSKGSSHSLLKRSTNQHTTSQSVPADLSSAIRLKKAGLVSSDENKMESGVASVAQGMESSVPSNKEPGVYSMPSATNNPDASGQSFSEALKSSRKPPLQYDASESADGGPGGKGAKKKAKKGKQIDPSLLGFKVHSNRIMMGEIVRDD

SEQ ID NO: 40235 - protein, 316 aa, Sorghum bicolor
  Clone ID: SORBI-28MAY03-C50217_1.pep
ARGLAVKRGNQKSHQGLREFRTEIELLSGLRHRHLVSLIGYCDEHNEMILVYEYMEKGTLKSHLYGARGPPLSWKKRLEICIGAARGLHYLHTGFAKSIIHRDVKSANILLDENLLAKVSDFGLSKVGPEFDQTHVSTAVKGSFGYLDPEYFRRQKLTDKSDVYSFGVVLLEVICARPVIDPTLPRDMINLAEWAIKWQKRGELDQIVDQRIAGTVRPEALRKFGETVEKCLAEYGVERPTMGDVLWNLEFVLQLQEAGPDMSNIDSMNQISELPSNANRVSSLDISTTDQSRMPIEYSDMSTSNAFSQLINAEGR

SEQ ID NO: 40236 - protein, 103 aa, Sorghum bicolor
  Clone ID: SORBI-28MAY03-C49235_1.pep
KHHIYGDIPHQERGGRKGGRKGKRGRVNQRVDGSRERRAALPVCRSSRGGRQPWATTVSAHVAPPRRTHTTRVTLCEEPCHRARPRGVEEKGGGRGSSVLPSC

SEQ ID NO: 40237 - protein, 357 aa, Sorghum bicolor
  unsure (1)..(357): unsure at all Xaa locations
  Clone ID: SORBI-28MAY03-C49311_1.pep
TRGKLTRLYQRMETEPGLSKLVHNESGLKKAIEPLLQMAEKLIPRHAHKHTPLFLYATAGVRKLPSAEPEGLLDKAWDILNNSSFLCSRDKVKIINGMDEAYYGWIALNHHMNMFGTSSSKMTYGSLDLGGSSLQVTFENDKSVQDETSIRLSIGSVDHHLSAYSLTGYGLNDAFDKSVAHLVKRLGGAASNGKVQVKHPCLQTGYKENYTCSYCHPLKQDGSPSVGEKNTGKEKQGIAVELVGAPQWNECSALAKVTVNLSEWSSASPGLDCNIHPCALASNFPQPHGXQFFAMSGFFVVFKFFNLTADASLVDVLKRGQEFCEKPWKVAKSSVPPQPFVEQYCFRAPYIASLLRE

SEQ ID NO: 40238 - protein, 248 aa, Sorghum bicolor
  Clone ID: SORBI-28MAY03-C49371_1.pep
HEAWALLAAATSRASDSAKCPSAVSQRARGRVVFLPCGLAAGSSVTVVGTPRAAHREYVPQLARMRQGDGTVMVSQFVVELQGLRAVDGEDPPRILHLNPRLRGDWSQHPILEHNTCYRMQWGAAQRCDGTPPGDNDDKVDGFPKCEKWIRNDIVDTKESKTTSWLKRFIGRAKKPAITWPFPFVEERLFVLTIQAGVEGFHIYVGGRHVTSFPYRPGFTLEDATGLFVKGDVDVHSVYATALPMSHP

SEQ ID NO: 40239 - protein, 93 aa, Sorghum bicolor
  Clone ID: SORBI-28MAY03-C49388_1.pep
HEGLSSLALEISSIGCEEGHDQSGSKDNLHGHVSNHQVLSEAKVEGGEKELGDYPRPQAVVAASVLRHIGIDEMLKEIRAALRKCFDHKLPEP

SEQ ID NO: 40240 - protein, 169 aa, Sorghum bicolor
  Clone ID: SORBI-28MAY03-C49414_1.pep
MPKGAKKRAKLKKQQQQQGHPDDGGNTNNASNGNGNGSDDNNNASSGRDGEHHLRIPPKVSRVDASEDSMESSEEMVTPRAAASEPDEEERKATAAEVSVERAVEADVAGSGEVMVDAFPPETAGQEREGKVDEAEVEVHAAVAQEPEVKDVLVAEESVVQEPVADAPE

SEQ ID NO: 40241 - protein, 158 aa, Sorghum bicolor
  Clone ID: SORBI-28MAY03-C50589_1.pep
CQSYDGGFGMVPGSESHGGGTFCAVAALHLMDFIQVDLASNLRDSSSINICMLLEWCLQRQVTNGGFQGRRNKPNDTCYAFWVGGVLKILGAYHLIDRCALRGFLLTCQSPYGGFTKFPDDRIPDIYHSYYGLAALSLLEEDGLEPLRVDLGILSAAL

SEQ ID NO: 40242 - protein, 186 aa, Sorghum bicolor
  unsure (1)..(186): unsure at all Xaa locations
  Clone ID: SORBI-28MAY03-C50599_1.pep
HEGGVVPGQSKELXPRLFDESFSSTATSFSKYSVVDSSMDLSSCRFSELSGGALQEGSDDSEKERPLVLRNKAPRWHEQLQCWCLNFRGRVTVASVKNFQLISSVPQPAPVGVSSAPPLAVTPPTQTQPQASGPSSASSSHVHDPVILQFGKVGRDMFTMDYRYPLSAFQAFAICLTSFDTKLACE

SEQ ID NO: 40243 - protein, 220 aa, Sorghum bicolor
  Clone ID: SORBI-28MAY03-C50686_1.pep
ARGRTAENHHIKPETTLPSRTRDHSPLSPSPRFAPRRLFEYIDRRLKENNHMVIVVAEGAGQDLIAQSIPAADQQDASGNKLLLDVGLWLTHKIKDYCKSKKMEMTIKYIDPTYMIRAIPSNASDNVYCTLLAHSAIHGAMAGYSFTVGMVNGRHAYIPFHRVTSTRNKVRITDRMWARLLSSTNQPSFLSQKDIDAAREADKAANAKNQSAPALANGEK

SEQ ID NO: 40244 - protein, 120 aa, Sorghum bicolor
  Clone ID: SORBI-28MAY03-C50789_1.pep
TRVRGTLPWMAPELLNGSSNKVSEKVDVFSFGIVMWEILTGEEPYANMHYGAIIGGIVNNTLRPPVPGSCDPEWRRLMEQCWAPDPVQRPAFTEIAGRLRAMSAAANQVKAAMAAAAAGK

SEQ ID NO: 40245 - protein, 142 aa, Sorghum bicolor
  Clone ID: SORBI-28MAY03-C50818_1.pep
LNKLAAARTLGSSIGSKVLTDLVEGLEEAAVSVEIRLKIDQNHSDLKGGSFRDYGESVLRHLENAISKDPNLHIAPKNYEGVRVSGYGGWFLLRLSLHDPVLPLNIEAPRGDDAIKLGLAVLAAVNEFSALDVTALNKFVQQ

SEQ ID NO: 40246 - protein, 377 aa, Sorghum bicolor
  Clone ID: SORBI-28MAY03-C49700_1.pep
TRLVISAWNYPFLLAIDPVVGAIAAGNAVVLKPSEVAPATSSLLAELLPRYVDASCVRVVQGGIPETTALLELTWDKIFYTGNSKVGRIVMSYAAKHLTPVVLELGGKCPVVVDSNVNIHVAAKRIAAGKWGCNSGQACISPDYIVTTKSLAPKLLESLKKVLRKFYGEDPLRSPDLSRIVNSNHFNRLRTLMDDGTVAGKIAFGGQSDEQQLRIAPTLLLDVPLDSAIMKEEIFGPLLPIITVDKISESFAVINSVSKPLAAYLFTNDSRLKQQFERNISSGGMIFNDTAIHLTNPHLPFGGVGESGMGAYHGAFSFDAFTHRKAVLDRSSFLGEARARYPPYTPAKLGILRGVLKGNPLAMVLAAVGYTGGRRRA

SEQ ID NO: 40247 - protein, 146 aa, Sorghum bicolor
  Clone ID: SORBI-28MAY03-C49765_1.pep
LVIDPSSGKTIHELRGHLDYSFASAWNPDGRTFATGNQDKTCRVWDIRNLSKSVAVLGGNIGAIRSIRYTSDGKFMAMTEPADFIHIFDVESGYSRKQELDFFGEIAGISFSPDTEALFVGVHDRVFSCLLQFNRRRFYSYLDSPV

SEQ ID NO: 40248 - protein, 217 aa, Sorghum bicolor
  Clone ID: SORBI-28MAY03-C49861_1.pep
ARGDDDDDDFGGGDGYGDEPIPIAAPGTDYDVVIDALSPGSIANVHQIARRMVDAGFGRECAEAYAAARRSFVDESVARLGVRSRTAEEVHASPWEELEFDIARWIPAFNMVFRILIPSERRLCDRVFDGLAPFGDLAFIAAVRTQALQLISFGDAISSSSRAPERLFRVVDMYEAVRDILPDLDPVFSDPYSAALRAEVSAMCNTLGSSIKGIFRS

SEQ ID NO: 40249 - protein, 246 aa, Sorghum bicolor
  Clone ID: SORBI-28MAY03-C49809_1.pep
MGRHSCCYKQKLRKGLWSPEEDEKLMNHITKHGHGCWSSVPKLAGLQRCGKSCRLRWINYLSTRLKRGAFSQDEEELIIELHAVLGNRWSQIAAQLPGRTDNEIKNLWNSCIKKKLRQKGIDPNTHKPLTEADRSGAAPTVSTERTSGSSDVNPSSAGALGNLSHLLSETAQSSMLMPMYDQNRTETPNLARPKVPPKELFLEQLTAGHESPSTCRSSGQTLYFPFQQPLGYNSESGSGDGANMNS

SEQ ID NO: 40250 - protein, 285 aa, Sorghum bicolor
  Clone ID: SORBI-28MAY03-C49987_1.pep
MQSKHRIFAEDLLLAAEGEDHFDRVPDSLVLLIFNKLADARSLGRCSAVSRRFNAPVPLVDDACLRIDRVIPADAADGGDALGGLAGGPRPRAVLSHLLKAMLQAVLKPFAHCDAKSAAHKHALLQRARQQHHSPAQVLKNFSSIRNLRMELPVSDVGTDDGVVLKWKAVFGSTLQSCVILGGTKVERAASGSANASAAPPPAPHADAGDAAAAGGPDDSGSIPESFYTNGGLKLRVVWTISSLIAAATRHYLLREIVKEHPTLEQVALTDANGQGTLSMGRDQL

SEQ ID NO: 40251 - protein, 288 aa, Sorghum bicolor
  Clone ID: SORBI-28MAY03-C5107_1.pep
MLRLRACGGTAPASVPALVRARLARRASSAASAAATVASASSSSSALEELAAERRGLAKVILKKGKTQIFRDGSPMVYSGAVDRIIGRPPPKSGDVVLVADGTEKPIGWGLYNSAPGFCVRLMQLEEDAIRDPTCALNMERLLEARISSAVDLRRSLGLPSADTNAYRLINSEGDRLSGLIVDIFADVAVIASSAAWVEKYRQEIQFLVSKVNGISHIKWRPSADILKEEGLDISEHKEPASPCSTVKVMENGIVYLVSLEGQKTGFYADQRENRSFISLLSKDQRVL

SEQ ID NO: 40252 - protein, 91 aa, Sorghum bicolor
  Clone ID: SORBI-28MAY03-C5110_1.pep
ASALGRITQVRVEGGEEQGECWGQRSGGGRAPPHAIIRQLSSNSSKGTVTLMVEMQWRTSLSVSSRALADALGQDAVEDLLVAELANPTIS

SEQ ID NO: 40253 - protein, 99 aa, Sorghum bicolor
  Clone ID: SORBI-28MAY03-C51135_1.pep
LDLVLLQSGSFSAHAHHTHNERTGACANLTTNCWFAFSEARMGAHVELASATDGNGKPVTVDGRSGSSSPILSLFTPATSHPCLLEDCFSLRAGTYACD

SEQ ID NO: 40254 - protein, 112 aa, Sorghum bicolor
  Clone ID: SORBI-28MAY03-C51180_1.pep
LVQSSSAAVASPPSLPYTAPPSRLPPSPPPPALPPHPPRRPAAGPPAARLPPPPLPPRRAAAPPPPPAAARPPPSSPPSPLSSPPPASLRCAAAATSPLTAAAAASPRGLRW

SEQ ID NO: 40255 - protein, 167 aa, Sorghum bicolor
  Clone ID: SORBI-28MAY03-C5130_1.pep
HASDKMDVNKSGKLTFEEFKAGLRKLGNQMPDSDLQILMDAADIDKNGTLDYGEFVTVAVHVRKIGNDEHIEKAFTYFDRNKSGYIEIEELREALSDELDGNDEDIINGIIRDADTDKDGKISYDEFAAMMKAGTDWRKASRQYSRQRFSNLSLKLQKDGSLSAEPR

SEQ ID NO: 40256 - protein, 135 aa, Sorghum bicolor
  Clone ID: SORBI-28MAY03-C51494_1.pep
MMMGLLAFESHQGLWNSGYYSQLFGIGGVLITLTILMLSTGYFGGIGAPFSPFFWPYLGQVPKKRERKRPVRVYMDGCFDLMHYGHANALRQAKLLGDQLVVGVVSDEEIVANKGPPVLSMEERLTLVSGLKWVD

SEQ ID NO: 40257 - protein, 235 aa, Sorghum bicolor
  Clone ID: SORBI-28MAY03-C50373_1.pep
HEALLSGSGFVESSKQHVRQLWTSVKQPNILLPTLFIFLWQATPHSDSAMFFFITNKLGFTPEFLGRVKLVTSFASLLGVGLYNYFLKEVSLRKIFLATTIIGSALGMTQVLLVTGLNRQFGISDEWFSIGDSLIITVLGQASFMPVLVLAAKLCPPGMEATLFATLMSISNAGSVTGGLVGAGLTRIFGVTRDTFGNLPLLIVVCNLSSLLPLPLLGLLPEESGDTDNGETKNN

SEQ ID NO: 40258 - protein, 187 aa, Sorghum bicolor
  unsure (1)..(187): unsure at all Xaa locations
  Clone ID: SORBI-28MAY03-C504_1.pep
MGSDFKSIPLIDISPLVEKIDDPSMANDRDLLQVVRLLDDACKEAGFFYVNGHGMVASLIRELSACTHDYXRSLIRNSWILRLHPRLDKERKQAEFFSVTGRSLLLMLQPLAILLLPQVSPLPSLDQWKVLTSPQSAHRGLQCXGENITKGKPDMHEAIDCYTPIRPGKYGDLAKPMEGSNLWPEYP

SEQ ID NO: 40259 - protein, 167 aa, Sorghum bicolor
  Clone ID: SORBI-28MAY03-C50411_1.pep
WRTALICRELEDEFDALVKSYDQKEKLVTLIQQKENVGDLFNQLRLALQRRSNSRPAQTLAATCMDEQELTESMQKLLIVMQRLDEKIGPMLEADGEHFNKRWGWLSRAGLWDKSHLTRQIEKYADIYTSRVSNFLHYTPFMYFQSQEQTLAHDAHSYSGGKAINVH

SEQ ID NO: 40260 - protein, 129 aa, Sorghum bicolor
  Clone ID: SORBI-28MAY03-C50443_1.pep
GEDGSNRGAQKLARIRENSNFFRSELKKMGFEVLGDNDSPVMPIMLYNPAKIPAFSRECLRRKVAVVTVAFPATPLLLARARICISASHTREDLMKALDVISRVGDLVGIKYFPAEPPKIAEADHDKLE

SEQ ID NO: 40261 - protein, 73 aa, Sorghum bicolor
  Clone ID: SORBI-28MAY03-C50556_1.pep
DNAMPALEIIEMRYQTFEGLFGVNTLGNLKGVHLREEKLGEKDEKTINGFLLDDLKYSTEELQVAVDHTFITY

SEQ ID NO: 40262 - protein, 130 aa, Sorghum bicolor
  Clone ID: SORBI-28MAY03-C52016_1.pep
TDEEAAGSKAITKDQMDVDSGNVDGGFVGPIPPAPDTEGDNDEVSVQDNTSNTESSECASTNDGADKIDQAKLEGQDKADDSMAADAGPQEGKDELAPVGASISEENTTISLDQAVSKEDEGSAPERSIV

SEQ ID NO: 40263 - protein, 180 aa, Sorghum bicolor
  Clone ID: SORBI-28MAY03-C5181_1.pep
TRQRTLLRQKLYRRSSFRRNQIHHLIRHWNQLRLQQRTPRLAQHQHLVDQRYWRCHNLLARLPNGPQCTFLCQFDSNNCRQPHRVIFFTLPSPAVHRFGLHLIFRLTEPFPRAIKHLFISNPFFACADQHVPETQYVQHRLRRTLWLIQYPQMSCQLLALRTHRILLCKMNLRKVHSMIF

SEQ ID NO: 40264 - protein, 203 aa, Sorghum bicolor
  Clone ID: SORBI-28MAY03-C52071_1.pep
HGPIPPSRVADPRPGLATSETGRYQNLHVPVALMECFLSVAELNTANNLETCGILAGTLKKRTFYVTTLIIPKQKSTSDSCQATNEEEIFEVQDKGSLLSLGWIHTHPTQTCFLSSIDLHNHYAYQIMLPEAIAIVMAPTDTTRKHGIFHLTEPCGMGVIHDCDATGFHPHEEPLDGTPIYEHCSHVYMNPNVKFEMIDLREA

SEQ ID NO: 40265 - protein, 98 aa, Sorghum bicolor
  Clone ID: SORBI-28MAY03-C5216_1.pep
MGIVFTRLFSSVFGNREARILVLGLDNAGKTTILYRLQMGEVVSTIPTIGFNVETVQYNNIKFQVWDLGGQTSIRPYWRCYFPNTQAIIYVVDSSDTD

SEQ ID NO: 40266 - protein, 112 aa, Sorghum bicolor
  Clone ID: SORBI-28MAY03-C52160_1.pep
EAAVKKNKQKLLGKKVSIARSDPSKGKKSREAGQASQDNLPQSGGDDAKATGSSGPDNEVPKGDAKTTGKNTRFAPRAVVKTLGWTNKDEKKPDVTGELKSNEEFRNLLLKK

SEQ ID NO: 40267 - protein, 112 aa, Sorghum bicolor
  Clone ID: SORBI-28MAY03-C50876_1.pep
MEVEQAAEVSAPETADLKAPDKTLAHDDEKENIPNGNTNLQVKEAHNDEDDGTGSDGFELIDVKENFDSAKVEEEMAVPRSTTVDTSPVTEEGEAQEEKTTAHEEQSVAANT

SEQ ID NO: 40268 - protein, 228 aa, Sorghum bicolor
  Clone ID: SORBI-28MAY03-C50909_1.pep
HEEKALAPRPQSSPPPPPHPPPIPAARRPKPYASPSAPGIGSVITLSEMPSASKSKSKDRSAAKVAKEQPKVAAKPMGNGTLASSYNNLSGKFHVLEPSASLLGSQGIDKFRNTDEIDEHSRSSHGTGDFDCASNNGSCSGESEDPKEKPTSTASRVDSVPGCDIDKREKIRQKNEKKHQRQKERRAQELHERCKGYLMSRTLESLAQKLVAMGFSADQATMALIQNE

SEQ ID NO: 40269 - protein, 68 aa, Sorghum bicolor
  Clone ID: SORBI-28MAY03-C5062_2.pep
VDARCDQTGFAFWIASSSAWAGGSMEMFVCCYVTKHSLQAILRNHSRALEHDTMTLQLGHKISIYWLS

SEQ ID NO: 40270 - protein, 157 aa, Sorghum bicolor
  Clone ID: SORBI-28MAY03-C5062_1.pep
RSRATAHPSGAACEPKQRRRPELQRPPVPFPRPQATARFRGNGALPGRRRGLARPQDAGACTHQALRGASPLAAVHPGPELQLVSNLVKGRRRSRSNDDLVTPSAYFLDEDFLRAELGNRPLQIQDWICLLDSEQQCLGRWFHGSVRLLLCGIYWLS

SEQ ID NO: 40271 - protein, 76 aa, Sorghum bicolor
  Clone ID: SORBI-28MAY03-C50911_1.pep
MQGNVFTFNEKHTPKTVDRDKMDKTTELPGSESPAEERENSKQPSHSPLSPTEDEESKSSEQSFAKGWSTTLSFFF

SEQ ID NO: 40272 - protein, 185 aa, Sorghum bicolor
  Clone ID: SORBI-28MAY03-C51025_1.pep
MEYPAAAAGSGGHKYYYPPQHSQPQALRRPPRPAARWVKQWIPQDLASSGGKCSLFKWVREDRYRNSKENPRVLDVEAPKPEPTTEILFLCSYDNCGKTFVDVSALRKHAHVHNEKQYICNEPNCGKKFVDSSKLKRHYLTHTGQKDFVCPHPGCGKAFSLDFNLRSHLKTHALENYHICPFPAC

SEQ ID NO: 40273 - protein, 154 aa, Sorghum bicolor
  Clone ID: SORBI-28MAY03-C5232_1.pep
ARGFNSGLWLLKKLKGAQCIHQLTFSDDQDPQNTYFYKLCKLKTLENFKNIILLSSPQDGYVPYHSARIELCPAASADTSKKGEVFTEMLNNCLDQIRAPSSDTRTFMRCDVNFDQSNQGRSLNTMIGRAAHIEFLETDLYAKFIMWSFPDLFR

SEQ ID NO: 40274 - protein, 377 aa, Sorghum bicolor
  Clone ID: SORBI-28MAY03-C52342_1.pep
TRHRSPVSLFHSPAASSPASRSPSVSWLAGRERDRLFSSFVRNALGSCIDFAPVTSLPLGVRPAATGVDAAELAFELDESLSEAEPCCEPDARELLARVQARHCIFRDELVVKAFFEAHRAHRGQKRASGDPYLQHCVETAVHLANIGANATVVSAGLLHDTIDDSFMDYDHIFRMHEAGVADLVEGVSKLSHLSKLARDNNTASRTVEADRLHTMFLAMADARAVLIKLADRLHNMKTIEALPLVKQLRFAKETMEIFVPLANRLGIASWKDQLENICFKHLNPEEHKELSSKLVMSFDEALLTSTLDNLDKGLRDEGISYHSLSGRHKSLYSIYSKMIKKNLTMDDVHDIHGLRLVVDTEEDCYRALDIVHKLWP

SEQ ID NO: 40275 - protein, 173 aa, Sorghum bicolor
  Clone ID: SORBI-28MAY03-C5240_1.pep
RFQAILPLRGKILNIERRDEAAMYKNEEIQNLILALGLGVKGEDFKKEALRYHKIVILTDADVDGAHIRTLLLTFFFRYQRALFDEGCIYVGVPPLYKVERGKQAHYCYDDADLKEIVNTFPPNASYHIQRFKGLGEMMPVQLWETTMDPERRLLKQLKVEDAAEGHVVFSSL

SEQ ID NO: 40276 - protein, 197 aa, Sorghum bicolor
  Clone ID: SORBI-28MAY03-C52648_1.pep
MLLEELLRCQIQEWYPAFRRHSIPTAIIPLPAAFLRYLVGQPAYPDPDADADADEEPLPFLLPAITSGRQAFAPIHAHHPDPDSLLNSDVFFGSSDEDVFDPDADHPLRPEFPELEAAVDAAIAELGGAALPKLNWSAPKDATFMSADGTTRCSCFAEVAMLLRSSDCVAHDLSSARQSCQDFVRPEGARRNAQNVS

SEQ ID NO: 40277 - protein, 217 aa, Sorghum bicolor
  Clone ID: SORBI-28MAY03-C52675_1.pep
YWNRVHRTPPRGEAAAMAAEKPAPVRVLYCGVCGLPAEYCEFGPDFERCKPWLRAHAPGVYPDDLVAASSSGGGGDKDVDKVGERLQGVGISDGSTSAAGDASASKPDEVKRLPGGKLKKKEKQEVVIEKIVRNKRKCVTVVKGLELFGVKLSDASKKLGKKFATGASVVKGPTEKEQIDVQGDISYDIVEFITDTWPDVPESAIFFIEDGRKVPAA

SEQ ID NO: 40278 - protein, 155 aa, Sorghum bicolor
  Clone ID: SORBI-28MAY03-C51535_1.pep
MDHSSDEDSEISDSEIDDYEGKVYASLMSGGLKVKNNGENYSCLFCSSKKKNNYSKSSLVQHASGVSAAPNRKAKEKAAHRALFKYLKNDLAKSSEPQPLVIPVEPQPLQNRDEKFVWPWMGILVNVPTEWKDGRQIGESGNRLKEQLSHFCPLK

SEQ ID NO: 40279 - protein, 156 aa, Sorghum bicolor
  Clone ID: SORBI-28MAY03-C51573_1.pep
LSSALSCTLAKSAAAAATATSPRPGASPPAGLRPEIRLNSMFLSKPCPLALPPDSPHRAVDPQYKGIKRFLLTLLLFYSKQSKSIRGANVVYDRITSQVDAPAIYDVFQLEKTFKTTFSLLVLHMWLVLRRLKEEGKDGVKFGQYIYEMYNHDVEL

SEQ ID NO: 40280 - protein, 285 aa, Sorghum bicolor
  Clone ID: SORBI-28MAY03-C51712_1.pep
HEEVEQQKPKVPVLEEHLVGQLSKEEQDTLGAKFKEASEADKKVQELEKEILDSREKTEFYRTKMQELILYKSRCENRFNEVSESMSADKREVQSLSAKYDDRCKKVGELAAKLTMDEATFREIQEKKLEIYNAIVKLQKGDESDEKLQERANKIQSDLEELVKSLNEQCKRYGLRAKPTTLVELPFGWQPGIQETAYAWDEEWDKFGDEGFSIIKELTVEVEPPIAPKSQPTEDAKASTNGALAEKEDNKGDKSAAAAEQAVEPETTPSNIKPESAKSPPVSPV

SEQ ID NO: 40281 - protein, 93 aa, Sorghum bicolor
  Clone ID: SORBI-28MAY03-C51733_1.pep
MEQYEVVEQIGRGAYGSAYLVLHKAERKRYVMKKIRLSKQNDKFQRTAYQEMSLMASLSNPYIVEYKDGWVDEGTSVCIVTSYCEGGDMAQRI

SEQ ID NO: 40282 - protein, 117 aa, Sorghum bicolor
  Clone ID: SORBI-28MAY03-C52030_1.pep
AADRILLLDSYFTVVIFHGITIAQWRKAGYQYQEGHESFAQLLQAPQEEADAIIKERFPVPRLVVCDQYGSQARFLLAKLNPSVSYDNPPAPGGDVIFTDDVSFQVFMDHLQRLAVN

SEQ ID NO: 40283 - protein, 64 aa, Sorghum bicolor
  Clone ID: SORBI-28MAY03-C53056_1.pep
AQVVKETIDPMATIEFKPNTADDPHMRKPDITKAKQLLHWEPKVSLKEGLPLMVNDFRQRISDE

SEQ ID NO: 40284 - protein, 153 aa, Sorghum bicolor
  Clone ID: SORBI-28MAY03-C53348_1.pep
TRVRFTLCADAAAEGVGLASFDRCGAARVEGAREVSVSRCRAAEVERAGRVTLDRCRDARLRGGGALRAARCRRADVESFGGVRLARCRAARADWCGTVEVELCRAVDVTRCGAVTGERCRVVNAAGCGSVDVARAVINLVEEEQPLSASPVL

SEQ ID NO: 40285 - protein, 108 aa, Sorghum bicolor
  Clone ID: SORBI-28MAY03-C53104_1.pep
PQDYSLWNKLGATQANSIQSADAILAYQQALDLKPNYVRAWANMGISYANQGLYEDSIRYYVRAVAMNPKADNAWQYLRISLSNASRADMIAACDARNLDALQKEFPL

SEQ ID NO: 40286 - protein, 252 aa, Sorghum bicolor
  Clone ID: SORBI-28MAY03-C53391_1.pep
ARGGYCIAKNERLLVYKYMPKGSLYDNLHQQNSDKKALEWPLRLKIAIGSARGLAWLHHSCNPRILHRNISSKCILLDDDYEPKISDFGLARLMNPIDTHLSTFVNGEFGDLGYVAPEYTRTLVATPKGDVYSFGVVLLELVTREEPTHVSNAPENFKGSLVDWITYLSNNSILQDAIDKSLIGKGNDAELLQCMKVACSCVLSSPKERPTMFEVYQLLRAVGEKYHFSAADDELTMQPQNANPEDELIVAN

SEQ ID NO: 40287 - protein, 291 aa, Sorghum bicolor
  Clone ID: SORBI-28MAY03-C53744_1.pep
MKANMGTKPRPPSADVEKGEIGEIDTRAPFESVKAAVSLFGEVRFSSDKSAARKPKAPQAERVLAKETELHLAQKELNKYKEQLSNAETTRVQALSELEKAKKTVEELTTKLDVINKSKQLAIQATEDAKTRTKQLEGGSTNEGLGTDGPLKQELESAREQYAVALADLDAAKQELRKLKKDFETSLDMRLSAAQQEEESLHTTEANKEKANQLRSEIAEIQESLMHVKAATVQAHEEEAQILAEKDVARTTYKQALEETQKKLSSLRSDFDPAAYDSLKEKLEQTNSEIA

SEQ ID NO: 40288 - protein, 133 aa, Sorghum bicolor
  Clone ID: SORBI-28MAY03-C53805_1.pep
LLLVAQDQNNTTSKSMNTHQRKKEGIDYYCTVLLIHVLPAPHPTRTGGRTAGGGSAAPGAARGGTRERGQGETRPAQRGPDRGTARRGEAPRDGEERGAGGQLERGVGEAADGTRAGDRGGRPRTWEEDPAAG

SEQ ID NO: 40289 - protein, 125 aa, Sorghum bicolor
  Clone ID: SORBI-28MAY03-C61812_1.pep
GDKEGEIAEVGAETNIFEGNVTTRENEEISHPRDNPHSSPLQTQLAGATGITTGRTSSTLETQLASTTPATTANTRTTRSAVNKSKTAQNKGGNLAVSYTTTKALKDDAAKKRAFGKRKEQAGNV

SEQ ID NO: 40290 - protein, 82 aa, Sorghum bicolor
  Clone ID: SORBI-28MAY03-C61837_1.pep
GSAMRYGNSSSCGTYQYEQRTAKNPAIGATGVSPRGSYSRTIPTCKSETSEADRIDASQTRQPKPYIPNKLPTTVDGRNGHW

SEQ ID NO: 40291 - protein, 278 aa, Sorghum bicolor
  unsure (1)..(278): unsure at all Xaa locations
  Clone ID: SORBI-28MAY03-C61894_1.pep
MALITNLSDYEELARQKLPKMVYDFYAGGAEDQWTLKENKEAFSKILFRPRVLIDVSRIDMSTSILGYKISMPIMVAPTALHKLAHREGEVASAQATAAAGTIMTLSSWSSCSIEEVNSSAPGLRFFQLSVFKDRDIVQQLVRRAENAGYKAIAVTVVPPRLXSNHGGRQLDYLPATISCLEEVVREAKGRVPVFLDSGIRRGTDVFKALALGASGVFIGRPVLFALAVDGKAGVRNALQMLRDELEITMALSGCTSLKDITRDHVITESDMIRRSRM

SEQ ID NO: 40292 - protein, 158 aa, Sorghum bicolor
  Clone ID: SORBI-28MAY03-C6191_1.pep
MTGWTTAAALPQVVRPLPTSSPAMSAHQVQTVNGGDEIYNEDQRAIYKLLSERIKSENVPENKDGSDDDDDDDDEDEDEEGGDDDDDAEEDFSGEEDGGDDDDEDDDPEANGEGGSDDDDDDEDGDDDGDDDDEDDDEDDDEEDDEDEEDQPPSKKKK

SEQ ID NO: 40293 - protein, 129 aa, Sorghum bicolor
  Clone ID: SORBI-28MAY03-C54204_1.pep
ARGAYCRRGNLYSAYGWFRKMLEEGVEPNEITYNVLIHALCRTGRTQLAYRHFHEMLERGLVPNKYTYTLLIDGNCKEGNWEDAMRFYFEMHQNGIHPDYLTHKALFKGFDEGHMNHAIEYLENAVLGE

SEQ ID NO: 40294 - protein, 217 aa, Sorghum bicolor
  Clone ID: SORBI-28MAY03-C54256_1.pep
ARGYGKGQLSGFLADPDGVLDVVPADMVVNATLASMAKHGGAAGPGMHVYHVSSSTVNPLVFGDLSRFLFHHFTRCPYSDAAGQPILVPPMRLFDTMEQFASYVETDALLRSVRASSSSSPAVAQRARDLCARSVEQTVHLGSIYQPYTFYGGRFDNGNTEALFAAMSPAERARFHFDVRSVDWRDYITNVHIPGLRKHVMKGRGVAANQLLASTSV

SEQ ID NO: 40295 - protein, 174 aa, Sorghum bicolor
  Clone ID: SORBI-28MAY03-C54258_1.pep
MERAAPVRSSHTSTAGLLAWPHPDGAGSLPARRPNQPTEEFRKVVFGGQVTEEGAGGHNKTKMRATGSAPKSKETAGIGIFKAESAAAAVATASRDRQASQITFSQDGTIPPRKPTSVAGVARQRELSHTVESEGDSKMKRQVSSAKSKELSGHDIFADHEVPKPNRSRRSDYG

SEQ ID NO: 40296 - protein, 106 aa, Sorghum bicolor
  Clone ID: SORBI-28MAY03-C54316_1.pep
MATTMALRSGHICFMGVRVGAARCVGKLQRRSRRDGALQVDIDAEVEVAVAGQPKKRTFRKDSYRSVDLNVLLDMSTNDLSSSYPSVPAEGRRLLQQKMVLLVTEF

SEQ ID NO: 40297 - protein, 104 aa, Sorghum bicolor
  Clone ID: SORBI-28MAY03-C54456_1.pep
GSSATLSPVKNANVSSFSFGEADTDSAVKTAKKKGSSNKSTDLNGKTISGRDSVPAEKQALNRAKPKGMSGSSIFADGKASTTGDHAGRRTRQPPGGDSSILLG

SEQ ID NO: 40298 - protein, 289 aa, Sorghum bicolor
  Clone ID: SORBI-28MAY03-C5428_1.pep
IRDLWHCSKVSCFYLTADSEEPQETAKQHNRLGPASLALHYANIINHIDNIVSRSCAMPPNARDTLYHSLPPTIKSALRSKLQSFEIKEELTASRIKAEMEKILRWLVPFAKWANTGSELNCKLSGHMDMSRIETLYHADKEKTEALILELVVWLHHLISKSRNASGGVRSPIKSPVSSPTQKGAAIKLLPGKMNNSPPVLTQEDQDMLRDVKYRKFVPGISKSQEFDTKSSHSKQSRLSKSNSHSPASGNRKELLPVRRPSMLPVIDFEIDRTKALDLIDRLDILKIQ

SEQ ID NO: 40299 - protein, 106 aa, Sorghum bicolor
  Clone ID: LIB3476-006-Q6-K1-A4.pep
LTASRIKAEMEKILRWLVPFASNTNKAHHGFGWVGEWANTGSELNCKLSGHMDMSRIETLYHADKEKTEALILELVVWLHHLISKSRNASGGVRSPIKSPVSSPTQ

SEQ ID NO: 40300 - protein, 114 aa, Sorghum bicolor
  Clone ID: SORBI-28MAY03-C52775_1.pep
ENSNFFRSELQKMGYEVLGDNDSPVMPIMLYNPAKIPAFSRECLRQNVAVVTVAFPATPLLLARARICISASHSREDLIKGLEVISKVGDLVGIKYFPVEQEKTTAVEKLKKIQ

SEQ ID NO: 40301 - protein, 135 aa, Sorghum bicolor
  Clone ID: SORBI-28MAY03-C52804_1.pep
LGAGAAAPGFQGYTGFNHPSYAAAGYGGLQQQHLQQQQSNNLMASMQGYHHHPAATAAMMNNLRGLNSNMMMMHQPQQQPQMMYHSSPQISPYTGYYNPYNYYYHPHPGSAGYPASNGDVETMFSDENTKGCVVM

SEQ ID NO: 40302 - protein, 79 aa, Sorghum bicolor
  Clone ID: SORBI-28MAY03-C52835_1.pep
DGFGRTASALIGNRIKVYNRGAGVGSVLATAICGAPAAAVAPVSASARALHYALLGLRNSLDPEHKKESMYKYQGPPQS

SEQ ID NO: 40303 - protein, 183 aa, Sorghum bicolor
  Clone ID: SORBI-28MAY03-C52900_1.pep
TEEERNETTWVDDGFQYYLALRKWYPGLRPESEFRCFVRERKLVAVSQRDPSAYYPSLPAWSSEVQPKIEAFFDEVIEPQFASVNYTFDVYVRTDGRVKLIDFNPWGGYTLPLLFTWEELEEEGRGPELEFRVVMQQGAVRPGLMTAVPYDMLDWGEGSGWDVFLKKADEELDRQMNSVDGDS

SEQ ID NO: 40304 - protein, 120 aa, Sorghum bicolor
  Clone ID: SORBI-28MAY03-C52912_1.pep
ARGKEVQRDVIPLLCSIFLASQGTGETAEAISPDDEESLLQGEREAEMMIVEAYAALVLAFLSTESMKVRGAISSCLPDNNLKVLVPVLEKFVSFHLQLNMMTRETHSAVTEVIERCRQS

SEQ ID NO: 40305 - protein, 255 aa, Sorghum bicolor
  Clone ID: SORBI-28MAY03-C55193_1.pep
TRPTLAPTHLQDLPGFTRSVFKRDHALITPESHVFSPLPDWINTLGAYLISPAIGAHFTMYLANMQDGSKSSLPPKDVERLVFVLQGSISLTVGTGTTHSLLVDSYAYLPANTKHSMISDEPTTLVIFERRYSAVEDSHPDLIVGSTDKQPLLETPGEVFQLRKLLPTSLSYDFNIHIMDFQPGEYLNVKEVHYNQHGLLLLEGQGIYRLGESWYPVQAGDTIWMAPFVPQWYAALGKTRTRYLLYKDVNRNPLI

SEQ ID NO: 40306 - protein, 239 aa, Sorghum bicolor
  Clone ID: SORBI-28MAY03-C5498_1.pep
PTRPAQQTFIHRDLKPSNILLGDDMKAKVADFGLVRLAPADGKCVSIETRLAGTFGYLAPEYAVTGRVTTKADVFSFGVILMELITGRKALDETQPEDSMHLVTWFRRMQLNKETFRKAIDPVIDLDEETYASVCTVSELAGHCCAREAHQRPDMGHAVNVLSTLSEVWKPTDPDSDDSYGIDLNMTLPQALKRWQAFEDSSHFDGATSSFVASLDNTQTSIPTRPPGFAESFTSAEGR

SEQ ID NO: 40307 - protein, 166 aa, Sorghum bicolor
  Clone ID: SORBI-28MAY03-C55237_1.pep
MGMNQQRVPGNEHPVEQQNPSDAVWRGAGLDASWIPPWSSPVMDNPSSSSAVRSVGLTGVQMMMRQLASVTDNYGHADGTWNLWPEPMAGSSLVPSTSSMPGSASASGLRLRGSAGTGNNGSLSEVLTMVDRVREVLPHIPDELIIEDLMRTNNINATVNNLLLMQ

SEQ ID NO: 40308 - protein, 297 aa, Sorghum bicolor
  Clone ID: SORBI-28MAY03-C55240_1.pep
MSLTVKGKTAVVTGAGSGICYHFSKALLERGCNVVMADLALRPEASELLRAFPSQALYQPTDVTKWDQLDHAFEVAKKEFGGYDIVCPGAGVYDPPFSNFWHPAGTALSKDVHSASRFTSLDINLTHPIYATQQAIAHFTENKKPGSIVHISSIAAQGPVLSVPMYCAAKAGISHFVRSLGGLETPPESTDLASIRVTAVAPGVIKTPLWTEHPEKLAWIDGAKDEWVEPEDVALAMLSLVEKDEYVGGTVLEVGKGQTREVHVLNDVGPSGSGHTVSGLKKGVDEVWEILSHKRHS

SEQ ID NO: 40309 - protein, 77 aa, Sorghum bicolor
  Clone ID: SORBI-28MAY03-C55261_1.pep
LTDHRRHRSCSPYVINCFRCSFLVRYVTVQRERERERERESRSSRDGGRARVYVCYVISCRDDQWVLVNRRFFFFGM

SEQ ID NO: 40310 - protein, 86 aa, Sorghum bicolor
  Clone ID: SORBI-28MAY03-C55273_1.pep
RTERDLITLPFPLAARYYWEFVADKPLVNSSVSASIKWQCIFYTNWHLICFFIICQKPNYILGRPTFLHQRGQNLNQVLCCFWLSS

SEQ ID NO: 40311 - protein, 162 aa, Sorghum bicolor
  unsure (1)..(162): unsure at all Xaa locations
  Clone ID: SORBI-28MAY03-C53885_1.pep
MAEDPAAEQEMRQLEDRLREVGERLQAPPDDAEDLLNLLIEIEECLHKVEQSPPESTSNALRPATEALVKKDLLGHANSNVRLGVASCISEITRITAPDAPYDDDAMKDVFSLIVGAFEDLDDVESPFFXRRTSILDTVAKVRSCVVMLDLECDDLINDMFH

SEQ ID NO: 40312 - protein, 349 aa, Sorghum bicolor
  unsure (1)..(349): unsure at all Xaa locations
  Clone ID: SORBI-28MAY03-C5387_1.pep
MGAGRVCRGGPSSAHPAAGAGAGRPFPPLAASSSAFPSSAPSETASTSVTKTVNGSHHFKIAGYSLSKGIGVGKFIASESFNVGGFDWAIYFYPDGKSGEDGAAYVSLFIALASEGTDVRALFELTLVDQSGKGQDKVHTHFGRSLESGPYTLKYRGSMWGYKRFFKRTALETSDYLKDDCLLVNCTVGVVQSHTEGPKIYTIPVPRSNMALHIGQLLTSGKRTDIAFEVDGEMFPAHKVILSARSPVFRAQLFGPMKDKNMKCIKIEDMEAPVFKALLHFMYWDELPDIEELTGVNTTWVSTLMAQHLLAAADRYALERLKLLCELKLCEDVXINTVAHTVALAEQHH

SEQ ID NO: 40313 - protein, 148 aa, Sorghum bicolor
  Clone ID: SORBI-28MAY03-C53927_1.pep
SLSPPSHPAATSQARARAPPARAAAQRGWCSGTAGATRRRRSLAPPAPPGDPPAAAPAAARSRSPDPHLAARLRAPHVHLDPRSPAVAVHLHKVFSDALWRWVTFAFVSLLSPHYEFDSCSRESDSCSRVLVPLLACCSRVCLLCVNL

SEQ ID NO: 40314 - protein, 114 aa, Sorghum bicolor
  Clone ID: SORBI-28MAY03-C54115_1.pep
SSVKTLVNFLLHLQANMHQTMTTLYTTGNLMMNIPKGGTHCPPPLPWLVHSSSPHRGTDPSYVHWLKNLKPKTMKKHMKRAIVMHSQPELLLPSASLELSVKQVTQRPLQSKRL

SEQ ID NO: 40315 - protein, 175 aa, Sorghum bicolor
  Clone ID: SORBI-28MAY03-C6829_1.pep
MGLDYYKILGVDKGATDDDLKKAYRKLAMKWHPDKNPNNKKEAENKFKQISEAYEVLSDPQKRAVYDQYGEEGLKGQVPPPGAGGAGPGGATFFSTGGDGPNVFRFNPRNAEDIFAEFFGGSSPFGGMGGGGMGGSGMGGWDARHADRRDEVLLVHFRGRYIRLCVRRRPGRVRH

SEQ ID NO: 40316 - protein, 151 aa, Sorghum bicolor
  Clone ID: SORBI-28MAY03-C55404_1.pep
AMALADRVGRRPLLLVSTGGMTAALLVLGSLFAAFAGAKDDAAVAAVSVAAVVAFVVAFSVGLGPLAWVYSSEILPLRLRGQGAGLGTAMNRIMSGVVTMTFISLYQGITMAGAFYLYAAIAAASFVFVYACLPETRGRSLEDMEELFHTK

SEQ ID NO: 40317 - protein, 165 aa, Sorghum bicolor
  Clone ID: SORBI-28MAY03-C55563_1.pep
LQDPQKLCVYAEKKDASSPGPGGVGPFGLVVMASGDMREQTTVFFRVFRHGGTYKVLMCADLTRSSTKEGVHKPVYAGFVDVDVEKDRSISLRTLIDHSVIESFGGGGRTCITARVYPEHVVAGGSSHLYLFNNGAHPVTVSKLEAWELGTASVNVEEDYRVGTL

SEQ ID NO: 40318 - protein, 272 aa, Sorghum bicolor
  Clone ID: SORBI-28MAY03-C55576_1.pep
MGEPLLTSLSMENSNSHPCTLLSMDPAGSHPASAESSGGGGVATNGVGVGVGSGGDRELFIIPRRESAHPGPPDINLPLSARPLPPPPSWSLDTFDILDVTLGTHNYESEVALALPKSTGNSNGNGSATIGVGARKCAKRGDSIWGAWFFFNHYFKPALVEKPKGKMTRDASGSISGFDKSDLRLDVFLVQHDMENMYMWVFKERPDNALGKMQLRSFMNGHSKHGEPSFPFSADKGFARSHRMQRKHYRGLSNPQCLHGIEIVGSPNLSAV

SEQ ID NO: 40319 - protein, 347 aa, Sorghum bicolor
  unsure (1)..(347): unsure at all Xaa locations
  Clone ID: SORBI-28MAY03-C5561_1.pep
TRGVAAQLLDSVNKLETNMKTNLERAMKENDRVYLMRVPAAGSLGALPAASLVKPTSLAEVLDASKERLFSSLVPDGSMKALSKYTEMLDNIIRTQAEKLQQASEITRVRLKEMDLPDSILSLEGNITLPLDLKEDVEAVQISGGPAGLESELQQLRDLSRVNQELLVQTEELLQKEANEDAQFRTQFGSRWTRPQSSTLTKNIQDRLNLFASNLKRAADSDSLIERGVKENYPLMSILDKRPIESALPSISRPIMSLDGNEDAIVGALKQSLRQLEALGAQRAGLEDMLKEMKRKDDILPKLMTGXGSHDDLFKKELAKYDPICADNADNIVAQEQLLLQIQAQNE

SEQ ID NO: 40320 - protein, 154 aa, Sorghum bicolor
  Clone ID: SORBI-28MAY03-C55673_1.pep
MDPEAVRKSLEPTATAEKITGSTPARLHFYDPFVLSGVSIEAAEHGRLLCSFVVTPRLASPVGYLRSGVTATLADQLGSPVFFCSGLPSSGVSIEISVSFVDAAAVGEEIEVEGKLLRAGKSVGVVSVDFRKKKTGKLMAQARHTKYLVASSKL

SEQ ID NO: 40321 - protein, 283 aa, Sorghum bicolor
  unsure (1)..(283): unsure at all Xaa locations
  Clone ID: SORBI-28MAY03-C55718_1.pep
RRLATDSSSGNCAMTAKTTRNKGGIDCTRGLSREQRAINRRNKLDTSLVSSRGYKRSRDRNVNWILKRIAATEAFCKFEDNLSAIAVQRFGEPLPDREESNIAFEERSFGEIVKPGDKSSWACSGIPIPHGRTTQSLTRFVTSAHLVTQFNQNRNKDDKLRVAVRLPNNRATDGFLGLYDKDIAIVTCFGFLGVHRIDLNDKAKPFPVDNLKAAGRAFNSGSWMAMRGSLYQKRPLEHLEDLNTWVSDSQHISXAVLGGPLLGSDNKIVGMSLDIYDPGDANX

SEQ ID NO: 40322 - protein, 285 aa, Sorghum bicolor
  Clone ID: SORBI-28MAY03-C54533_1.pep
MARTNWEADKMLDVYIYDYLVKRNLQATAKAFIAEGKVATDPVAIDAPGGFLFEWWSIFWDIFHAATAKASSTSNASAAAAAAATAAFIDHTAKQQQPAGAGAPPPHPLHDINNNKSREHHMRLQLLHQHNPHLQTTRDAPPCASINALSSDVSAVLASKMMQDRIRNPNPIDSDASQHPRGANRIALLKSPPPSHTGPMPMQQQQQLHHPRNQQLDIKPDVAMPQRTMPADPSSLYAAGMMHPKPALLAAGLNQGVVGSVPLKGWPLTVPGIDQLRSNLGGQKQ

SEQ ID NO: 40323 - protein, 231 aa, Sorghum bicolor
  unsure (1)..(231): unsure at all Xaa locations
  Clone ID: SORBI-28MAY03-C5450_1.pep
MGSVASAAVPPPPQSAPPQVGAPPYGPGLAGILPPRPEGEEKKEEKVDYLNLPCPVPFEEIQREALMSLKPELFEGLRFDFTKGLNQKFSLSHSVFMGSLEVPAQAAETIKVPTAHYEFGANFLDPKLMLIGRVMTDGRLNARVKCDLTDNLTLKVNAQLTQEAHYSQGMFNFDYKGSDYRAQFQIGNNAFYGANYIQSVTPNLSMGTXMFWLGHQRKSGIGFASRYNTDK

SEQ ID NO: 40324 - protein, 179 aa, Sorghum bicolor
  Clone ID: SORBI-28MAY03-C5456_1.pep
MNPTRPAQASFRDRTNEFRAAVESARRQSSAPAAASSSSTGPLDGLMAATSARSEFNNRASKIGLGIHQTSQKLSRLAKLAKRTSVFDDPTVEIQELTAVIKKDITALNTAVVDLQAICNSQNESGSLSKDTTNHSTTIVDNLKNRLMSATKEFKEVLTMRTENLKVHENRRPMFSSSA

SEQ ID NO: 40325 - protein, 240 aa, Sorghum bicolor
  Clone ID: SORBI-28MAY03-C5474_1.pep
MEPRVANKFRLGRKLGSGSFGEIFLGTHVQTNEQVAIKLENMKTKHPQLLYEAKLYRILQGGTGIPNIKWFGVEGDYNVLVMDLLGPSLEELFSFCNRKLSLKTVLMLADQLINRIEYVHMKSFLHRDIKPDNFLMGLGKRMNQAYVIDFGLAKKYRDSTNQHIPYRENKNLTGTARYASVNTHLGIEQSRRDDMESLGYVLMYFLRGSLPWQGLKAGTKKQKYEKISERKIATSGEVLC

SEQ ID NO: 40326 - protein, 171 aa, Sorghum bicolor
  Clone ID: SORBI-28MAY03-C54960_1.pep
EDSCRAERHGQQYQHNFLGPSAESRVPPRPTQSFAHTPEYSVFSYPSQPAMPFPPAFFAPGGSPYLVDAKGAPVIPPLSGLSLGISHPSFSTRATPPSSNELSYFHPSMDFSYGVPSEGARREAGSYWPVSYQGQTMFVDERMRNVSQGGSSGLVLKRKEPESGWDMYSRR

SEQ ID NO: 40327 - protein, 159 aa, Sorghum bicolor
  Clone ID: SORBI-28MAY03-C5603_1.pep
LKRFLQESNCSLAVSLNATTDEVRNWIMPINRKYNLNLLLGTLREELNLRKKQIVLFEYVMLSGVNDSMDDAKRLIELVQGIPCKINLISFNPHGGSQFKPTPDDKIIEFRNVLIQGGLTVFVRLSRGDDQMAACGQLGEPGDYQLPLLRVPEKFQVAL

SEQ ID NO: 40328 - protein, 104 aa, Sorghum bicolor
  Clone ID: SORBI-28MAY03-C56143_1.pep
FKVPATTEPLWCFRQKFKPETSIWIQQIVDCDLVYVIAHSLLLVELGETQLKHRQNSLQSLVTFKQLRWWHQRWEAKFVCYCRLSGTGGWSPLKQLGCDIRSFF

SEQ ID NO: 40329 - protein, 128 aa, Sorghum bicolor
  Clone ID: SORBI-28MAY03-C56175_1.pep
GRRSKYHLHMVIAILSYILFGLLPPVIYGLSFRTSDNRENKMLVVAAVSLLCIALLAIGKAHVKRPRTYFTTLLYYLSIGFSGSGLSYATGVLIMKLLAHFGIIDQGGASAPAPPGLSFPEAVAWASY

SEQ ID NO: 40330 - protein, 125 aa, Sorghum bicolor
  Clone ID: SORBI-28MAY03-C56176_1.pep
KEPNDGGEHGSLAGWARHLYQSRGSITEATDMSIRYAGYSDEIEVVFRLGVLCTAEMASSRPTMDDVLQILLKCSEQTHEKSKTQRVPENEEDPLRLPQRGSRRKQLSNGTGIDIESKSHFDSIV

SEQ ID NO: 40331 - protein, 199 aa, Sorghum bicolor
  Clone ID: SORBI-28MAY03-C56207_1.pep
ARGTLQLPHPPRHPPPPPSPPPPPPPPPPPPAPRPRPPPPAPRPPPPPPPPSPPPAPRPPPPPPSSPPPAPRSPGPRPPPPRSGRGPRRPRTSRGGRRPGPRPAPSAPRPALRAPGARPPPAPRAPLPAAAFRPRRAGPVVRLGPAGPDVLMDSEGSSRGGLHIWKHGVCKHPSCSWYMVWGGIHQRKPLQLYSPDRQR

SEQ ID NO: 40332 - protein, 136 aa, Sorghum bicolor
  Clone ID: SORBI-28MAY03-C562_1.pep
MAERWCGGVCSLSMATSTGTATALLRPSRPAVPAKRRCLHGVDGRTTTSRRRGAAVVMRACFNPLGDERILREAIKEPVAFLGGVFAGLLRLDLNEDPLKEWISRTVEASGIAEENSSEESSEADQNDAPQQIEIE

SEQ ID NO: 40333 - protein, 123 aa, Sorghum bicolor
  Clone ID: SORBI-28MAY03-C55277_1.pep
SPSETGSTLSTASPASTKSNCFTPGKRPRDCNEEGDTKGNGKVWVPKTIRIDDVDEVARSSILSLIGINGDKAGKDGKGCKLARVFEQKEEARTATHSVINGLPFLQGNPAALSRSLTFQEGS

SEQ ID NO: 40334 - protein, 202 aa, Sorghum bicolor
  Clone ID: SORBI-28MAY03-C55305_1.pep
ARGLGTVDTNQLKNNMADISPNGRFIAAAAFTADVKVWEIVYSKDGSAKEVNKVMQLKGHKSAVTCLCFAPNSEEVITASKDGSIRVWNINVRYHLDEDPKTLRVMPIPLHDSKGSVCQYDHMNVSPDGKILAVTSGSTLQWLCVETGTVLDTAEKAHEGDITGIAWAPRKIPNGGVPVFILGTAGVDKKVKLWSAPEVGST

SEQ ID NO: 40335 - protein, 173 aa, Sorghum bicolor
  Clone ID: SORBI-28MAY03-C5531_1.pep
RSTTIVLCYLIKYRNMTPEAALDHVRSIRPRVLLAPSQWHAVRSFGSLTTGQLPVRSTNLGCFLEAIEARCMNTENDDYHVMEFDCEDSGLPLSQIMLSKPASPTGCTDAVLITEADLEGYDTYIGTRKDAVSLVVATRRPIMRRLSCLFGSLKLNSSSCEPASSRFTEVRAC

SEQ ID NO: 40336 - protein, 68 aa, Sorghum bicolor
  Clone ID: SORBI-28MAY03-C55312_1.pep
KLTIVRKHPSSAVNTSNSTGATESADDDLPSVMTCANYLKLPPYSTKEIMRKKLLYAILEGRGSFDLS

SEQ ID NO: 40337 - protein, 184 aa, Sorghum bicolor
  Clone ID: SORBI-28MAY03-C56360_1.pep
KAFMLLSKYYLEEAKWCNEKYMPNFKDQVELSSMSSAGPVLTLAALMAAGNEATKEAFEWASSVPDMVHACAEIGRFVNDISGFKKGRKNKNDVASSLECYMKEHGTTGEEAAAALTAMVEQAWRRINKAFMEIDRGLLPAVTLAVINQARLSVVVYYGGKDAYTFTSDLEDLITSVFLKPIPV

SEQ ID NO: 40338 - protein, 224 aa, Sorghum bicolor
  unsure (1)..(224): unsure at all Xaa locations
  Clone ID: SORBI-28MAY03-C5647_1.pep
MDGAQPPSGQLNNSFNTLMVSGDEQSQQPQDAGNETSFTNWKDLPMELLLRIISLVGDDRIVIVASGVCTGWRDTLGWGVANLSLSWCQDHMNDLVMSLAHKFTKLQVLSLRQIRAQLEDSGVEAVANNCHDLRELDLSRSFRLSDLSLYALAHGCPHLTRLNISGCSNFSDSALVFLSSQCKNLKCLNLCGCVRAASDRALQAIACNCGQLQSLNLGXCDSIT

SEQ ID NO: 40339 - protein, 327 aa, Sorghum bicolor
  Clone ID: SORBI-28MAY03-C56615_1.pep
HEADQEIELYEEIKFEPNVMCEIIDKKLTFRSSQLEDGARGCFQKSPGAEYDAQVRYPDVPSFLEYVHNRQVVHFRSLEKPKDDDFSLELSKLHTYDDVVERVARQLELDDPAKIRLTSHNCYSQQPKPQPVKYRVEHLLDMLIHYNQTSDILYYEVLDIPLPELQFLKTLARAFHHPTKDEVVIHSIRLPKNSTIADVINDLKTKVELSSPNAELRVLEVFYHKIYKIFPLQEKIENINDQYWTLRAEEIPEEEKNIGPNDRLIHVYHFMKDINQTQQIQNFGDPFFLLIHEGETLAEVKKRIQSKLQVSADEFSKWKFAFISMNR

SEQ ID NO: 40340 - protein, 181 aa, Sorghum bicolor
  unsure (1)..(181): unsure at all Xaa locations
  Clone ID: SORBI-28MAY03-C56625_1.pep
RRLARNELPPEAAAAGADADPEREAQGLAAASSAGAGRLGGAGRRRRAQMPXGLAVVASAAPSWMEEAGVDVLEEGGRWNPSVSDSYRPTGLPRPNATVLEAQARVCTGPAQTRPLGEEQAMRVLDTILRSAMGELKEEPVSSAQLGAFFAGMTIRANSPPGATPGCAGVRRALRAAWPRL

SEQ ID NO: 40341 - protein, 156 aa, Sorghum bicolor
  unsure (1)..(156): unsure at all Xaa locations
  Clone ID: SORBI-28MAY03-C56808_1.pep
MRRRTVHAGLVXKGEEGALSMTTKERSAHASKGLPVNHCSGFRTPNNIDSSETDGISRESFRVIVNAQELGFESTETPRTDRSILKNLELGLAALGGEKGAAYDRIVLNAAMADHLLGCSGAEDINTALDRAREAIDSGEALRRLMSYIKISHTVS

SEQ ID NO: 40342 - protein, 184 aa, Sorghum bicolor
  Clone ID: SORBI-28MAY03-C55844_1.pep
PAASSGGGAPRRLRAGPAPGRAGERLPRPVGAAPAAAAPAPSAPPVAPRRDGGGGGGPGRGEGGQADAQSRALFLLAYASAVSSPVRTSRLLCSRPSSFRLALALVLRPLIGVGGDCVQACGGVPPAPRSWSCACPATHQHCISRRSTALFRKLLRGSFPGAPGAVVPRRAGSAGPSSALRCIL

SEQ ID NO: 40343 - protein, 180 aa, Sorghum bicolor
  Clone ID: SORBI-28MAY03-C55846_1.pep
TRGTEALTCGIKGSDVHLISEAATDPEWNGDCTVYRHADSDLAVLPYGAALPVSLKVLEHDILTVSPIKDLAPGFRFAPIGLVDMFNSGGAVEGLTYHLLGGAKLLDGGNGSASGSEAVGLACMEVKGCGRFGAYSSVRPRKCMLGSAQLEFSYDSSSGLVVLQLEKMPKERVHKIVVEL

SEQ ID NO: 40344 - protein, 199 aa, Sorghum bicolor
  unsure (1)..(199): unsure at all Xaa locations
  Clone ID: SORBI-28MAY03-C55888_1.pep
MMVSITSHRQQLLLYLHLLVHLFLGIQQLSHSLATYTNQTTVPPPAAAAVPCRPDQSATLLRLRRSFSTTTDSACTLASWRAGTDCCLWEGVSCTAADGRVTTLDLAECWLQSAGLHPALFDLTSLRYLDLSFNSFNESELPAVGFERFTELTYLNLSYTDFIGKIPHGIRQLSKLVTLDFTNWIYLIESDNDYXLPLG

SEQ ID NO: 40345 - protein, 164 aa, Sorghum bicolor
  Clone ID: SORBI-28MAY03-C55918_1.pep
MEEGSDYYVVRKGDVVAVYKTLSDCQAQICSSVSGPAASAYKGHSWSRGKEEYLSSWGLSHATYVINAAELREDVLGPLVPCSFQDILGSSSNQQAPNHIGFHNVVASQTGAQYVDLNHEARSSSFRHISPANFNRTGAVDAQPISKQYMVGILHFDGASKGNP

SEQ ID NO: 40346 - protein, 276 aa, Sorghum bicolor
  Clone ID: SORBI-28MAY03-C56023_1.pep
DGSIAFENDFFKRQAFLTVSGQLQVETYACALSSVYTFGPTFRAENSHTSRHLAEFWMVEPEIAFANLQDDMNCAEKYVQYLCKWLLDHCQEDMEFMVKNYDKSAIERLELVSSTPFVRISYTKAVELLKNVTDKKFDNKVEWGIDLASEHERYLTEDIFKKPVIVYNYPKGIKAFYMRLNDDDKTVAAMDVLVPKVGELIGGSQREERLDVLKQRILDAGLPLEPYEWYLDLRRFGSVKHSGFGLGFERMILFATGMENIRDVIPFPRYPGRADL

SEQ ID NO: 40347 - protein, 299 aa, Sorghum bicolor
  Clone ID: SORBI-28MAY03-C57036_1.pep
MLPWAATASPPSTPAAVSFAPPLRAAAPRPPPPLCRPLPRMLCAGLNPPPRAASSDGDVFWEEPDDGSGSDYEDDGPEQRRALRLPASSPSSRLEAARQQEQDLRSAIELLLTPEEKAILDQHETPDVTKISSPKWHPLHSYALALQIPLMDKLLDSGVDINLLDRDGFTCLHKAVIGKKEAVISHLLRKGANPHVRDRDGATPLHYAVQAGALQTVKLLIKYKVDVNVADNDGWTPLHLAIQSRNRDIVKVLLVNGVDKTRRTKDGRTALDLSLCFGRDFKSYDLAKLVKLIPANRGV

SEQ ID NO: 40348 - protein, 225 aa, Sorghum bicolor
  unsure (1)..(225): unsure at all Xaa locations
  Clone ID: SORBI-28MAY03-C5710_1.pep
HLYRWRCLQPVGPGPRGAADPDPAHSSALLPFPSGGSGFASRGTVAPDEEEGGDAASSAESEEVAEATNDSFSYSLRECQKQRRLKSERSALVRPPASHELNSAGGIELLVLSPRCLIGGNPGGMSKSSTTSSRSRSGTGTFPSPGTPNYNRHCAGSMQYSKGWSSERVPLGTGSNRRYGGSGVVLPXYNGRKLPSKWEDAEKWILSPVSCDGMGRMSAPAPHHR

SEQ ID NO: 40349 - protein, 334 aa, Sorghum bicolor
  Clone ID: SORBI-28MAY03-C57176_1.pep
ARGKPPSPLPEPRPPLVRPMPSTSKRGSKWKFVLTGVLGGAAIVVLLGLSALVVCLLRRRGRRPRGRGVEQTAGGIRSGRRSSSVNPVTMSPMASPGASGSLKGLPIIVDEFTYEQLHHAAGGFGDDNLVKHGHSGDMYHGVLESGFQVVIKKIDLKSSKKCQGELSFLTKHSHGRIVPLLGHLAKDEEELLVYKYMAKGDLTTALHKKSVDVEQGLRSLDWITRLKIAIGVAEALCFLHDECSPPLVHRDIQASSVLLDDKFEVRLGSLGQICAQQSAGSQSFFSRILRSSRSLDKNISGPPASCSYDVYCFGKVLLELITGNFGASGSTDAD

SEQ ID NO: 40350 - protein, 325 aa, Sorghum bicolor
  unsure (1)..(325): unsure at all Xaa locations
  Clone ID: SORBI-28MAY03-C57210_1.pep
MKTRASKSYLCAGSSSFDDPDVVEVSPAAAAGWTPSHHKRKRSQVVPQEVIEIDDDDPDGVIIIADKAPVDKNKQTAVCPCPMNWPKYGKSGWFPDIPGPSTYASKHTDSWVDHKVFQDEAVYNYSDEYPYEGFEEDYAYDEDEFEDDGYDAPLIESEFKFGLSAKFDNLDVPPGLEASLSWTQKTAIEIANKTKPTKAVDDKIEEKYKAFKRFDTVDDHSDHYYSKPEKRRVQVVKKPSKDWVKRIQHEWKVLEKDLPDTIFVRAYEDRMDLLRAVIMGPAGTPYHDGLFFFDIYFPPQYPNVPPMVNYRAGGLRLNPXLYACG

SEQ ID NO: 40351 - protein, 196 aa, Sorghum bicolor
  Clone ID: SORBI-28MAY03-C5737_1.pep
LNILLDSDYTAKLSDFGLAKAGPEGDETDVSTRVMGTYGYAAPEYVMTGHLTARSDVYSFGVVLLELLTGRKSIDKSRPSREQSLVDWALPKLNDKRRLLQIIDPKLEGQYSVRAAHKACSLAFYCLSHNPKARPLMSDVVETLEPLQGGGSSDGAGQSSGLPDYRARRRLTGNNVHLRAIPNPKCSPAVPACRVR

SEQ ID NO: 40352 - protein, 129 aa, Sorghum bicolor
  unsure (1)..(129): unsure at all Xaa locations
  Clone ID: SORBI-28MAY03-C56261_1.pep
VQPVTKLDNVYIAXEVYKNEPFDRSADVFAFGLILYEMIEGTPAFHPKPQEEAAKMICLEGLRPPFKNKPKYYPSDVKELIQECWDTTPSVRPTFAEIIVRLNKIHASCAKQGRWRDTFKLPWKQTGDR

SEQ ID NO: 40353 - protein, 140 aa, Sorghum bicolor
  Clone ID: SORBI-28MAY03-C56292_1.pep
GDGNVLHDITEKPNHLQRVTIFSGTIINSIEYLYSDDNGQQHTAGPWGGCGGNGRKIHLDPEEFIVKVSGTFHPCAWDKSIPNVVSSLTLVTNTGKTHGPFGKQIGADFHVPMGSNSRIVGFFAHGGNYIEAIGAYVRTL

SEQ ID NO: 40354 - protein, 252 aa, Sorghum bicolor
  Clone ID: SORBI-28MAY03-C56310_1.pep
YGNNHRGSNEVLVRREYPLFTCTGASNIFMIDTSKNPSPSSDTQARALSCNKQSSIGPAGCEIHMPGRAGCESGSSTTACRAVPPQAKPATPLGPGCFFLVGRRGDRFLLHLMLRRATSPRPRSRWPSAPSCTTAPARRAAVAARRVALASPATTRRAAAPPLPAALARASSITCANVSSGVSVSVARTAGTRAAAARRSTSARPLCDCCEAWAVVVVMVGSWRQQRPALKPKKTVNAMKDAMAERMGEGLV

SEQ ID NO: 40355 - protein, 219 aa, Sorghum bicolor
  Clone ID: SORBI-28MAY03-C5636_1.pep
SIAVEAAKGLCYLHHDCSPPILHRDVKSNSVLLDADFEAHVADFGLAKFLRGNAGGSECMSAIAGSYGYIAPEYAYTLKVDEKSDVYSFGVVLLELIAGRKPVGEFGDGVDIVQWVRMVTGSSKEGVMKIADPRLSTVPLYELTHVFYVAMLCVAEQSVERPTMREVVQILADVPGSTSTSIDVPLVIEPKENGSPGEKKQEQQEGSHDSPPQQDLLSI

SEQ ID NO: 40356 - protein, 227 aa, Sorghum bicolor
  Clone ID: SORBI-28MAY03-C5632_1.pep
ADDIGDCINPGTVAGYSEVKGAVGASAATSAVRPAGSRSSSFHGVTRHRWSGKYEAHLWDSSCRVEGRRRKGKQVYLGSYDTEEKAARAYDVAAIKYWGGNTRLNFPIEQYGKELEDIRDLSREECVTYLRRRSSCFSRGASIYRGVTRRQKDGRWQARIGLVAGTRDIYLGTFKTEEEAAEAYDIAAIEIRGKNAVTNFDRSNYVDKGMHCIEGEGLRLLASKPEE

SEQ ID NO: 40357 - protein, 169 aa, Sorghum bicolor
  unsure (1)..(169): unsure at all Xaa locations
  Clone ID: SORBI-28MAY03-C57582_1.pep
VINSFLDFSKHPAPSLSRHRPPNYSPAAPAACLFPWAGGDVVPARSPALSLLHDRDYSSPLDLPPPAPLALRXRLQHNTHASTIPNYYHYTSRLIELARVLLALHDLRILLKHSSNKVSYVPLPTSFVGAAVGDGASNDNLSPIQCRRPALSVPVDIEAIKAKLGYQYN

SEQ ID NO: 40358 - protein, 246 aa, Sorghum bicolor
  Clone ID: SORBI-28MAY03-C57689_1.pep
MATAPERDEEDLLGVLLRLQRDGGLQFALTNEIVSTVIWDIFSAGSETSSTVLVWAMSELVRNPQVMHKAQSEVREAFKGQDKITEGDLIKLRYLQLVIKETLRLHAPVPLLLPREGRESCQVMGYDVPKGTKVFVNAWAIARDKKLWHDAEEFRPERFENSSVDFRGNDFEFTPFGSGRRICPGITLGLANLELALVSLLYHFDWTLPDGVKLEEFDMAEIFGITLRKKSMLWIMANPYNNLIPN

SEQ ID NO: 40359 - protein, 429 aa, Sorghum bicolor
  Clone ID: SORBI-28MAY03-C57724_1.pep
MATSAVVARLAGEASRPKVLASANGLSSSRSRVAVKRRWRGRGVRCCAAGSSGGGAGAGAVVPGEEFVGFFREAWPYIRGRRGSTFVVVMSSEVVSGPHFDRVLQDISLLHGLGIKFILVHEAHVQIDKLLSERGKKAKYVGQYRITDKDSRDAAMDAAGRIRLTIEAKLSPGPPMLNLRRHGVIGRWHGLVDNIASGNFLGAKRRGVVNGIDYGFTGEVTKIDVSRLGERLDSDSIVVVSNMGYSSSGEVLNCNTYEVATACALAMEADKLICIVDGQIFDEHGRVIHYMSIEEADLLIRKRAKQSDIAASYVKVVDEEGINSLHKGDNGSSLSAKAHINGYAASFQSGLGFNNGNSVYSGEQGFAIGGEERLSGSNAASFQNGLGFNNGDGFYSGEQGFAIGGEERLSRSNGYISELAAAAYVCHGG

SEQ ID NO: 40360 - protein, 245 aa, Sorghum bicolor
  Clone ID: SORBI-28MAY03-C5777_1.pep
ETREPPAAPPLSSSPPLYPNLCSSLAPASASASASSRRAMERRSVRFVPAEIARMEKLAADRNEQVFDNKFCQKLAEEFNRSAGRAGSKALQATQVQGWFLNKFPASATKPTCVPTACQEKTPASEVNVSVSEKRSAASEEKLVCPLLPKKSTSASEVNVSVSKKRSAASEEKLFPPDTSVSNNEDEVSPVFSLETRDMIPELDDLEFEAKSAKDSAWYDIAMFLAHRTNKAGEVKVRVRIQGLG

SEQ ID NO: 40361 - protein, 198 aa, Sorghum bicolor
  unsure (1)..(198): unsure at all Xaa locations
  Clone ID: SORBI-28MAY03-C57788_1.pep
HEVHHLRRLAVDIPSRQEGSPGLEAAAQYIKGELQGLAARAGPEYRIEVEETLVSGSFSMMFLRHRVTLGYRNHKNIIMRXDDDPSLLVNGHFDSPLGSPGAADCGSCVASMLELSRLIIDSGWVPPRPVIFLFNGAEELFLXGSHGFIKTHRWNRTISAFINIEASGSGGTDLVCQSGPGSWPSRIYAQTAKYPMAN

SEQ ID NO: 40362 - protein, 182 aa, Sorghum bicolor
  Clone ID: SORBI-28MAY03-C578_1.pep
MGKIRMPVPSLFRRRSKSPPPQQQPAAEGKGNGSPPRAATAEEEMARVFRKFDANGDGRISRSELAALFESLGHAASDDEVARMMAEADADGDGFISLDEFAALNATVAGDAAAVEEDLRHAFRVFDADGNGTISAAELARVLRGLGESASVAQCRRMIEGVDQNGDGLISFEEFKVMMAGG

SEQ ID NO: 40363 - protein, 182 aa, Sorghum bicolor
  Clone ID: SORBI-28MAY03-C6928_1.pep
MATPSAAASSSFLVPATTAVASTPSACPSTLPKKNAAGAGRRRHRTMQCRASSGGGRRGDGDDVDSRLLWLPRRQVLTGLSGVAAGFVGYPDDLASIALALEANPVESCRRGEKVTDKIVECSDPSRGFPCPPATRIPVVDFTPEPKVTRIRQPAHLLDAEYQAKYKEAVRKMRALDKSNPL

SEQ ID NO: 40364 - protein, 107 aa, Sorghum bicolor
  unsure (1)..(107): unsure at all Xaa locations
  Clone ID: SORBI-28MAY03-C5686_1.pep
MESGGASGGGGGGGGDDQLHGLKFGKKIYFEDAAAAGSSSGGGGGGSGNASATTAAPATQQPSPPQAASPRAASGGGGMEGQGRRRPLPGARPARXQVDGWHVNLTD

SEQ ID NO: 40365 - protein, 317 aa, Sorghum bicolor
  Clone ID: SORBI-28MAY03-C56915_1.pep
ARGKGTICERSQLLRIKYYGNFDKPLGRFLRDYLFDQGYQCRSCDKPPEAHVHCYTHRQGSLTISVRKLTEFVLSGERDGKIWMWHRCLKCPWSNGFPPATQRIVMSDAAWGLSLGKFLELSFSNHAAASRVASCGHSLHRDCLRFYGFGKMVACFRYAPISVHSGYLPPHKLDFGHQPLDWIQKEANEVIERAKHLFDEVLHSLHLISDKKVQGSSPNMEFSNYIADLEIMLRKEKSEFEGCLNKVLRRDMQKGQPDILEINRLQRQLLFHSYLWDKRLVFAARSDRYRHEKINSIDSVAEQNVLLKPQSECNGNS

SEQ ID NO: 40366 - protein, 319 aa, Sorghum bicolor
  Clone ID: SORBI-28MAY03-C56936_1.pep
ARGFRSVDYEKIANEEQNLSRAGKMKEKSDDKYDRDPREKLDRGERRRGEDAIERSTVRLSERRERSIERMQERVTDKAIEKGRARGNKDERNKVRYAEPSVDRTHSSDERFRGQSLPPPPPLPASFVPQSVGANRREEDADRRGGSSRHVQRSSPRRDEKERKQSEENTSSFQDDGKHRREEDIRDRKREDRDILSNKVDDRDREKGTSLKEDSDPSNASKRRKIKRDQTSLEAGEYAPFAPQPPSHGSGSSQLSDVRERERKGLISQHRTSHADDLPRTHGKDTASKSSRRESDQMHEREWEEEKRPRTETKRKHRK

SEQ ID NO: 40367 - protein, 195 aa, Sorghum bicolor
  Clone ID: SORBI-28MAY03-C5700_1.pep
ARVRPRVRLNAIRKACASLEAEYQPKVTLVVVHKRHHTRLFAHNHNDQNSIDRSGNILPGTVVDSKICHPTEFDFYLCSHAGIKGTSRPAHYHVLWDENNFSADELQTLTNNLCYTYARCTRSVSIVPPAYYAHLAAFRARFYMEPETSDSGSVASGPAGRGPQSASHSTRAPGGAAVRPLPALKDNVKRVMFYC

SEQ ID NO: 40368 - protein, 337 aa, Sorghum bicolor
  unsure (1)..(337): unsure at all Xaa locations
  Clone ID: SORBI-28MAY03-C570_1.pep
AFVYFSFPXGAGGPGHALASGRHAWATVDPHHPRGPGAGAAPAWYVRASLAQSAGLRTVVFLPCKGGVLELGSVVPVRETPETVRAIQTALAVAPPPAREECMRIFGKDLSPSGRTPRSGDNWAPQQLGVQATASKEAAAARPKAPEPPPRSIDFTKPPGKPEQQAGVGEERVPRKRGRKPANGREEPLNHVEAERQRREKLNQRFYALRAVVPKISKMDKASLLSDAIAYIQELEDRLRGGGGCSAARPESPAVEVKAMQDEVVLRVTTPLYAHPVSRVFHAIRDAQLSVAASDVSVXDDAVTHTLVLRSAGPEQLTAETVLAAMSRGMTSATPSP

SEQ ID NO: 40369 - protein, 186 aa, Sorghum bicolor
  unsure (1)..(186): unsure at all Xaa locations
  Clone ID: SORBI-28MAY03-C56975_1.pep
ARGPVGISLSVCAIAAPVGPTTAPPAAPPXPPPPPPPXPPALPTPAPRRVAAPPPPPPPPPPPAPAPPPPPPPPPPPPXPSPPPPPPPRPGRVPPPPPPRGAGXAGAPRPARRAGAPPAPPPPPRPAAPRAAPRLPPAPAPAHPADRGASRRGGPPHRFRWLFRRVFPAIGWLPYWVVHLTTFDGC

SEQ ID NO: 40370 - protein, 292 aa, Sorghum bicolor
  Clone ID: SORBI-28MAY03-C58018_1.pep
TRQKHVLSDYANNEGHELTICILNRLYREAEQDQDFLSSTTATSVYESFLLNIAENLRDMFPASDKSLGKLLCEIPYLPEGVLKLLEGLCSPGSNEKQDKDIQSGDRVTQGLSAVWNLIMLRPSNRDRCLEIALQSSTHHLEEVRMKAIRLVANKLFPMASISKKIEDFANEKLNSVLEVIPSGDSATTEMATPQAHKDVGLENLTAPVADAQTLMSLYFALCTKKHSLLRHVFAIYGNLPQAAKQAVHRQVPILIRTIGSSSDLLGIISDPPADCWDLLMQVLQTLTDAAV

SEQ ID NO: 40371 - protein, 307 aa, Sorghum bicolor
  Clone ID: SORBI-28MAY03-C58090_1.pep
ARGWFSPVNKISSSCTSSVYIGRFEFDTDFIAIKVFHLEEHGCLKSFLMECEVFRNTRHRNLMKAVTLCSTVDMENKEFKAIVFDFMANGSLDMWLHPKLHKNSPKRVLSLGQRIRIAMDVVSALDYMHNQLTPPLVHCDLKPANVLLDYDITARVGDFGSAKFLSSSLGSPEGFAGVEGTIGYIAPEYGMGYKISTACDVYSFGVLLLEMLTGKRPTDIMFTDGMSLHKLVSSAYPNGLHEVLDPYMFQEEDLVFATLTLQCYLVPLVEVALLCAMELPKDRPGIRDICAKILEISEAFLKPRCLY

SEQ ID NO: 40372 - protein, 263 aa, Sorghum bicolor
  Clone ID: SORBI-28MAY03-C58100_1.pep
MDNSSVASDGKSPVSEKLKLLSGSCYLPHPAKEATGGEDAHFISIDEHVIGVADGVGGWADLGVDAGLYAKELMRNSLSAIKDEPEGTIDPPGVLEKAYMSTKARGSSTACIITLKDQGIHAVNLGDSGFVVVRDGRTVLRSPSQQHDFNFTYQLESGGGSDLPSSAQVFHFPVAPGDVIVAGTDGLFDNLYNNEISGVIVEALRVGLEPQIAAQKIAALARQRATDKNRQSPFASAAQEAGYRYYGGKLDDITVVVSYVKSA

SEQ ID NO: 40373 - protein, 172 aa, Sorghum bicolor
  Clone ID: SORBI-28MAY03-C58119_1.pep
KERETTMLDHLVGLVKVRVVRGVNLAIRDLRSSDPYVVVRIGKQKLKTRVVKKSTNPEWNEELTLSIEDPAVPVRLEVFDKDTFVDDTMGNAEVDIRPLVEIVKMKLQDVADKTVVKKLVPNRQNCLAEESSIYISEGKVKQDLVLRLRNVECGEIELQLHWVDLPGSKLTT

SEQ ID NO: 40374 - protein, 384 aa, Sorghum bicolor
  Clone ID: SORBI-28MAY03-C58175_1.pep
HEALMGFKMGKRSSIGSKEAVPAEVEATSPAPAPATPESATEKERKNSWEKHGGERDIRQGIDLATTLERIEKNFVITDPRLPDNPIIFASDSFLELTEYTREEILGRNCRFLQGAETDMSTVDKIREAIREQKEITVQLINYTKSGKKFWNLFHLQPMRDQKGELQYFIGVQLDGSDHVEPLRNRLSENTPPQSAKLVKATAENVDEAVRELPDPNLRPEDLWDIYSKYVSPKPHRRYNSSWIAIEKITKSGEKIGLKHFKPIKPLGCGDTGSVHLVELQGSGELFAMKAMDKSVMLNRNKVHRVCIEREIYSLLDHPFLPTLYTSFQTPTHVCLITDFCPGGELFALLDMQPMKLFREESARFYAAEVVIGLEYLHFLGIIY

SEQ ID NO: 40375 - protein, 175 aa, Sorghum bicolor
  Clone ID: SORBI-28MAY03-C68171_1.pep
ARGSSSLSQVPSAQPSLSFPAQLSTSPPCVRPKSQPHHLSVVSHSLPPACASRAAEGVRLELRITDRRGLLAYVTRVFRENSLSVTHAEITTRGDKAMNVFHVTDVAGRPADPKTIDEVIQRIGTESLRVDEERWPRLCSTEGDAARGGGGAGIFSLGSLVKKNLASLGLIRSCS

SEQ ID NO: 40376 - protein, 206 aa, Sorghum bicolor
  Clone ID: SORBI-28MAY03-C68196_1.pep
CAPSLAPSPLSGCPGAPTRCPLSHSLCWSWASLVLPPSAPLPCPRAPVLLAQPPRPFYLSIYLSISVPAEFPGLVISAIIVDWFGRKATMWILLFGCCGFLGPLAVHQKEALTTALLFGARACGMGSSTVLCLYAPEVYPTSARSTGVGIATAIGKIGGIVCPLLAVGLLRSCHQMEAVLVFELVLGLAGVACILFPVETKGREMK

SEQ ID NO: 40377 - protein, 92 aa, Sorghum bicolor
  Clone ID: SORBI-28MAY03-C68207_1.pep
MASAAQKKMAVVCLMLLAVGLMVDATDKPTSCTDSVKNDSPPDSDCICSKNCACAGKCILMEPASVQSCFIDCVLKNDCICEDKKNGADQPQ

SEQ ID NO: 40378 - protein, 357 aa, Sorghum bicolor
  unsure (1)..(357): unsure at all Xaa locations
  Clone ID: SORBI-28MAY03-C5836_1.pep
ARGMVAVCLLELVPFAEIDAAALARRLQSETSSASEAERAALADLAAELGGSAPAAVALALRRIAEDSGGLQIEEAFIGGKQMTMVWAIDRSKLLKELPESASVIQMQPPPTPQVAPTDTDTNSAIIPRPPPLQQPDMWGHPMPPMFPRPRGMPMPRMPPGLMPLQRPFMAPGAVIPMGGGPGPSSAQLKLRTEEDDLKDLELLLNKKTYREKQNTKTGEELLDLIHRPTAKETAVAAKFKTKGGSQLKEYCTNLTKEDCRRQTGSFVACDKVHFRRIIAPHTDTNLGDCSFLDTCRHTKTCKYVHYELDQTPDVPXMMAGAVAPPRQIKPQRAEYCSEIELGESQWINCDIRNFRM

SEQ ID NO: 40379 - protein, 351 aa, Sorghum bicolor
  Clone ID: SORBI-28MAY03-C58371_1.pep
MWALNLKAGGPCLTPRHRQRAARFPLAAGIGSLAVGPTRRGRQPVRWPSLAVSASGWKGNNGREDGDEPRNKASSSGKGDAPTPSGDASNGTTQNQGEPKSSDTMYIPSNLSYWRDVRASFVIPKLEQTVDANSPQQTAQDGSVYHLPRKWAHSIPMPESGCVLVATEELDGNGTFERTVILLLRLGSRDAYDGPFGVILNRPLYTKMKHVNPSFGEQATPFGDCSLLFGGPVDMSIFLMRMTEGRPIKGFEEVVPGICFGFRTDLEKASALMKNGTVNPEDLKFYVGYSAWEHDQLLSEIDAGYWVVTSCSSGLITDALTMDPSCLWTEILQLMGGQYSELSQKPKQDGM

SEQ ID NO: 40380 - protein, 162 aa, Sorghum bicolor
  Clone ID: SORBI-28MAY03-C58383_1.pep
VSSPEFDPIPIPFYHPCYFQQVSQQPHAPQGSSHVSPHGDKARRPRLVPAPPPAWTADTTPLAGSEAGEKPAGRRRHQARLRRSRRPSAHTPRRRPVGAGKGACAGAAGTSAGSGQCGLLSGGARRGAAGTVMRDATRREERRLVPAGAGAGQQQASGGGDG

SEQ ID NO: 40381 - protein, 137 aa, Sorghum bicolor
  Clone ID: SORBI-28MAY03-C5845_1.pep
MPRANEMLRADSRMMVVFGALTSKPEQLTFEDSLRFVKKVKARDYMLYLSLFDILGRMELSQLDAYRELQLLFQNHPDLCEELEKFRPPVPIKQATNNIWPWVIVCAVPLVAVSLIPALGNPVLWFVQQTIGEKIAV

SEQ ID NO: 40382 - protein, 240 aa, Sorghum bicolor
  Clone ID: SORBI-28MAY03-C58454_1.pep
TRQEQDNQKGKQFQWPMARGPAGYDAPKQKAKEMNDTEGTPKSPKISEESPQSPKIKIIPLSWFENGHHHDQKLAAKNDSGDHNKRSAVKNQPVLTNNEDEDSMTLEGNPKTTSAVPKSINDEKKPLRESCKTIPVVPEKEINEKKASTCRTIPVMKGSDEKKIGMKEKKEAKETNSVEKVEENRKTKHSDSSIAKHSKLPPVCLRVDPLPRKKPGNGSSRSPSPPTRKDADSAKDMKNP

SEQ ID NO: 40383 - protein, 233 aa, Sorghum bicolor
  Clone ID: SORBI-28MAY03-C58468_1.pep
AGASFLSTAPLVARGVAACSSISTPTRRHPHIRVCCRADAEGSEAAAHEERLRFRRRDFIGTCVGSAIGLELIDGSTRFSGVATAADLIERRQRSEFQSKIKDTLYVAIKAKPELVPSLLTLALNDAMTYDKATKTGGANGSIRLETSRPENSGLSAALDLLTEAKKEIDSFSKGGPISFADLIQFAAQSALKRSFLDAAIAKCGGNEEKGRTLYSAYGSNGQWGLFDRTFGR

SEQ ID NO: 40384 - protein, 317 aa, Sorghum bicolor
  Clone ID: SORBI-28MAY03-C57812_1.pep
TRLMFVAAEPFEDDLIISVEDRVAQNKDEVIGETIIPLARLPTRADHKPVRPAWFDLRRPGIIDVNQLKEDKFYAKVNLRVCLEGGYHVLDESTQYCSDLRPTMKQLWKPPIGMLEVGILSANGLNPTKTRNDRGSCDAYCVAKYGSKWVRTRTIVDNLSPRFNEQYTWEVFDHGTVLTIGLFDNCHISGDNNHGSSGHMDKPIGKVRIRLSTLETSRVYTHSYPLLVLSPSGVKKMGELHLAIRFTTSSLINVLFTYSRPLLPKMHYAQPLSIVQQEILRHQAVQLVAQRLWRMEPPVRRQVVEFMSDARSHLWSM

SEQ ID NO: 40385 - protein, 350 aa, Sorghum bicolor
  Clone ID: SORBI-28MAY03-C57823_1.pep
MERTINSLMYKGSIPDAINQSRREKKLFVVYISGEDEASGSLEQSTLIDENVVEVIGRCCILLHLKQGNVDASQFSAIYPQKSVPSISVIGLNGVLLWNHEGYINSENLKESIEKAWAALHLQETAATLLTASLASRNVESVNTATTVLLAQGSSSTLENPSDLSSQSPDVFGASGVAHSTDLVSQVPSSTTLYEPLEINEREGSKSDSGDRTVEELGSTSTEFSCDLVDSSRKSNMVSSADPKGEYITASVKRKNKNDGSHTSVSLEDTPSTLTNRGVSSQSLVEQDKATTSAPPLIFVKSDDIQLSIRMPSGNRLEIKVTKQDVLRKVKNFVDENKGNELSSYDLSLV

SEQ ID NO: 40386 - protein, 100 aa, Sorghum bicolor
  unsure (1)..(100): unsure at all Xaa locations
  Clone ID: SORBI-28MAY03-C57961_1.pep
MCFVFCIPLLVKISLVNFHLVPRTDVHIINMSLHPIXSFQSARASSGLGIPSGYSGMVRRPDTASMVEAKYPALRFKQQLTAYVEKIYGIIRDNQYHWMI

SEQ ID NO: 40387 - protein, 194 aa, Sorghum bicolor
  Clone ID: SORBI-28MAY03-C57982_1.pep
MGQALRRLFDSFFSTREMRVVMLGLDAAGKTTILYRLHMGEVLSTVPTVGFNVEKVQYKNVVFTVWDVGGQEKLRSLWKMYLSNSDALIYVVDSLDRERIRDARQEFQTIIKDPLMANSIILVFANKQDLRGAMSTDEVSEGLGLHDLRNRIWHIQGTCALRGEGLYDGLDWLASTLKQLQESGHATSVAGPSI

SEQ ID NO: 40388 - protein, 228 aa, Sorghum bicolor
  Clone ID: SORBI-28MAY03-C58008_1.pep
MALTSMLPFAPSNTSLSYSSRASTAAAFAPRGAHFAAYGRSGGGGAQSLACAAPRRCGRAPRRRRGGGLVVWASADYYATLGVPRAASNKDIKAAYRKLARQYHPDVNKEPGATEKFKEISAAYEVLSDEKKRALYDQYGEAGVKSAVGGPGGAYTTNPFDLFETFFGASMGGFSGMDQSSFRTSRRNTAVQGEDIRYDVILGFTEAIFGTEKDIILSHLETCDTCGG

SEQ ID NO: 40389 - protein, 170 aa, Sorghum bicolor
  Clone ID: SORBI-28MAY03-C58881_1.pep
MAFVHGEQEGEDMVGAFALVYQHVFSYIKTMALKCAVELAIPDAIHGRGGAATLAEIAADTGVHESRLADLRCLMKLLTTSGLFRATAADGGEEVASSYALTAASSLVVGPRGLSNMVRFDCGPVSLTPFFDMPTWLRTAPGPEAPKSLFELTHGRTRWDPANADNDTMI

SEQ ID NO: 40390 - protein, 192 aa, Sorghum bicolor
  Clone ID: SORBI-28MAY03-C59000_1.pep
MEAAATAGAGDSSFEPSLWDDFFVSYTPPCSQMSEEWMRERADELKVEVHRMFEAVDEMRVADSMILVDALQRLGIDNHFQEEINTTMRHVYTGELEMPSSKELHMVALRFRLLRQHGFFLPTDVFDEFRDGTGNFNTCLTTDPKGLVSLYNAAHMAVPGEDVLDDAIAFTRTHLVAMKGSLVFPIADQISR

SEQ ID NO: 40391 - protein, 254 aa, Sorghum bicolor
  unsure (1)..(254): unsure at all Xaa locations
  Clone ID: SORBI-28MAY03-C59062_1.pep
MQPDPSGDAGXAKAKLPLPQPVTAPAPSSGRPASVLPYQTANVRDHYRIGKKLGQGQFGTTYQCVGKADGAARACKSIPKRKLLCREDYEDVYREIQIMHHLSEHPNVVRIRGAYEDALFVHIVMELCAGGELFDRIVAKGHYSERAAAKLIKTIVGVVEGCHSLGVMHRDLKPENFLFASTAEEAPLKATDFGLSMFYKPGDKFSDVVGSPYYVAPEVLQKCYGPEADVWSAGVILYILLCGVPPFWAETEAG

SEQ ID NO: 40392 - protein, 253 aa, Sorghum bicolor
  Clone ID: SORBI-28MAY03-C59177_1.pep
QEFRNMISCVSCQCISLTLILTFSYTKRKSSRNLHTEMQKDEETNHPSQETNRVTQEHQESSKSIRSAARSRSHHHRALLPAPPQSAEQLPTLLLLRVASLRARRRVGGGGFPGPCVGAHELHLVLEVLVQQRGAVGLVPVRRPLTGTTAAPALARRRRHEHQPPAASAEAGDGHGDEEQREAEEQQRQRDGQQAQRQARRPPRRRRAAGGGPHASSTSRRLARRRRLLVVVVVVGSRRRRGCCHGQERFASC

SEQ ID NO: 40393 - protein, 78 aa, Sorghum bicolor
  Clone ID: SORBI-28MAY03-C59213_1.pep
KFPADSSDLLHVGFEFHKATVTSVDMNWCCLPSRRAKKEENPYSNSIGGIYSEKNIRLFSYAELRSATDNFNRTNKVG

SEQ ID NO: 40394 - protein, 152 aa, Sorghum bicolor
  Clone ID: SORBI-28MAY03-C58181_1.pep
MLPTTASKGRGAARSAPPLLGPYLRRIVKWQQMDIEYTFWQMVHLCTSPKVVYQHTKYHKQTKNQWARDDPAFVVILILFLVFATSAYCAAYGESASHAALTITSVVFLHFLFAGIVLATLCWFLTNSYLREEPNSHVVEQRVEWLYAFDVH

SEQ ID NO: 40395 - protein, 127 aa, Sorghum bicolor
  Clone ID: SORBI-28MAY03-C5821_1.pep
MQQHIASSPLQPRSEMHPKMGSGVTRLPKINPRVFFDMTVAGKPVGRIEMELYAPDAPAAVENFVDLCNGGCVGDSGNKLHYKGSVFHSVIPGYMCQGGDITHGNGTGGETVFKKPFRDEINRELQR

SEQ ID NO: 40396 - protein, 237 aa, Sorghum bicolor
  Clone ID: SORBI-28MAY03-C58227_1.pep
HEAGMTRDDLFNTNASIVRDLAKACAESCPDANILVISNPVNSTVPIVSEVFKARGVYNPKRLFGVTTLDVVRASRFVSEIKGTDPKDENITVVGGHSGVTIVPLFSQSNHPDLSSNAELVNRVQFGGDEVVKAKDGAGSATLSMAFAGARMAESLLRASQGEKGIVEPTFVDSPLYKDQGIDFFSSKVELGPNGVEKILPIGKVDAVEEKLLEACFADLKKNIAKGVAFVAQNPPK

SEQ ID NO: 40397 - protein, 181 aa, Sorghum bicolor
  Clone ID: SORBI-28MAY03-C58246_1.pep
TDCRVHEENSLLLSIITIPSGPRGAAIFFWGLLPRPFRLAPRCGVSALLCLFGPPRLLTGSILAHEMMHAWLRLKGYRTLSPDVEEGICQVLAHLWIESEIMAGSGSGAASSSSGSSSSMSSKKAGRSQFEHKLGDFFKHQIETDTSMAYGEGFRAGNRAVLQYGLKRTLEHIRLTGTFPF

SEQ ID NO: 40398 - protein, 122 aa, Sorghum bicolor
  Clone ID: SORBI-28MAY03-C58274_1.pep
MKPPLERNPTKKRHSWWWDSHISPKNSKWLAENLEEMDKQVKEMLQLIEEDGDSFAKKAQMYYQRRPMLITHVENFYRMYRALAERYDNVTGELRKNIPTRLQSTTSSEYGSELQRSPSPSP

SEQ ID NO: 40399 - protein, 188 aa, Sorghum bicolor
  Clone ID: SORBI-28MAY03-C59565_1.pep
MEGNADASSTAPLAWHDFLERMRQPSAAEFVKSIKSFIVTFSNRAPDPEKDSAAVQEFLENMEGAFRAHTPWAGSSEEELESAGEGLEKYVMTKLFNRVFASVPEDVKSDEELFEKMSLLQQFIRPENLDIKPEYQNETSWLLAQKELQKINMYKAPRDKLACILNCCKVINNLLLNASIVSNENPPG

SEQ ID NO: 40400 - protein, 210 aa, Sorghum bicolor
  Clone ID: SORBI-28MAY03-C59569_1.pep
MKISWGKNSKVKKQSVVVSTIPGLPFGVGSDNDEVEREEKSDANTNCPGTKPVETAELLQSQGDKLAEEGKYHEALAKWEAALILTPDNAILHEQKAQVLLEVGDAWRALTAATRATELDPFWPEAWVTLGRAQLNFGEPDSAILTFDKALAIKPDYNDAKADRETAARLVKKRGQLHTSGLSANKRRFTVGEYPEKGAEGEEKGKETAV

SEQ ID NO: 40401 - protein, 201 aa, Sorghum bicolor
  Clone ID: SORBI-28MAY03-C59571_1.pep
HEVKKVNGGEIEGAVKRGYLKTDEEFLKRDESGGACCVTAVLQKGGLVVSNAGDCRAVLSRAGKAEALTSDHRASREDEKERIENLGGFVVNYRGTWRVQGSLAVSRGIGDGHLKQWVVADPDTRTVLVDQQCEFLILASDGLWDKIDNQEAVDLARPLCINNDKTSRMAACRMLTETSISRGSTDDISVVIVQLQNFSSS

SEQ ID NO: 40402 - protein, 208 aa, Sorghum bicolor
  Clone ID: SORBI-28MAY03-C5959_1.pep
MWATSPSPHPLHLRRPPPPPFLVRRHNKRLDRIAASQDPLTALTRVLWGRALPPAQLVLAVRHGWTAAWQLLMRQLAPSDPSTGAFTRTPARFPAVAGEPSSRLHLYVGLPCPWAHRTLVVRALLGLEARLPVSVAVPGDDGAWSFTPGSPDRLYGKRKLREVYTLRSGGFEGRASVPMLWDAERREVVCNESIEIVKFLCGLVGDRA

SEQ ID NO: 40403 - protein, 249 aa, Sorghum bicolor
  Clone ID: SORBI-28MAY03-C5967_1.pep
MGSDSKGLLEIEPLELRFPFETKKQISCSMQLTNRTDDYIGFKVKTTSPKKYCVRPNSGIVPPRSTSDVIVAMQAQKEAPPDMQCKDKFLVQSVIVAEGTLVKDITGHMFLKESGNVVDEVKLKVVYVPPPKPPSPVREGSEEGSSPRASLSDGSNLNYLEMQTTRESDEPLFSAVKTHKDQEDYTSETSALISKLTEERNSAVQQNNKLREELDLLRREVSKQNGGFSFVVVVAIALLGMLLGYIMKR

SEQ ID NO: 40404 - protein, 225 aa, Sorghum bicolor
  Clone ID: SORBI-28MAY03-C5974_1.pep
VHAFVAQIRDEDGTVLPNIRIADCGHKIGLNGVDNGRIWFQNIRVPRENLLNLVADVLPDGQYVSMIDDPDQRFAAFLSPLTLGRVNIAVDSVYISKVSLAIAVRYSLSRRAFSITPDGPETLLLDYPSHQRRLLPLLAKVCLMSSAANFMKNMYVKRTPEMSKAIHIYSSALKATLTWQNMMTLQECREACGGQGLKTENRVGVFKAEFDVQSTFEGDNNVLMQ

SEQ ID NO: 40405 - protein, 235 aa, Sorghum bicolor
  Clone ID: SORBI-28MAY03-C5861_1.pep
MDISGAYIAGYEAGNFSCLVKRSGSGHTLSSVTCYRSSYPWGGPPTVDVAVPEVSAWRVEDLDEAISSLFLFPTGNATKEDLSRGLAACDVMVATAATFPYVERRMSAGMWDGNGVSNDGSLRGLQESWPDLSAAVQESYQGAFAAPVALQRSNGEWMLVDNVRRAVPLVSFLENAGCKKKMTTTTEAAAADQRLPLLMRSVVQQPPPDEEDMQMQLGSSPAAAAGTTSCGQAEP

SEQ ID NO: 40406 - protein, 343 aa, Sorghum bicolor
  Clone ID: SORBI-28MAY03-C58615_1.pep
SRLRCAAAIAIATAVPAAAALPLPLALRRHRAFRRVPAAAVCLRFSSCRIPAPPRRAAAAMSSLAAAAQRTEHEAGAWFAVPGLSLRDHRFAVPLDHSSPDRGDTITVFAREVVAAGKEDVSLPYLLYLQGGPGFESPRPTEAGGWLKKACEDHRVVLLDQRGTGLSTPLTPSSLSQITSPAKQVEYLKHFRADNIVKDAEIIRLRLVPDAKPWTVLGQSYGGFCAVTYLSFAPEGLKSVLLTGGLPPLGEPCTADTVYRACFKQVQQQNEKYYKRYPQDIEVVHEVVRYLSESEGGGVLLPSGGRLTPKMLQCLGLSGLGSGSGFERLHYLLERVWDPALVA

SEQ ID NO: 40407 - protein, 366 aa, Sorghum bicolor
  Clone ID: SORBI-28MAY03-C58755_1.pep
ARGSNLFRLMKKVGADNNLLVKEHTHTFVNKGGVIGELDFRFPVGAPLHGIQAFLRTNQLKVYDKASTRVALALSPVVRALVDPDGALQQVRDLDDVSFSDWFMSKGGTRESITRMWDPVAYALGFIDCDNISARCMLTIFTLFATKTEASLLRMLKGSPDVYLSGPIKKYITDRGGRFHLRWGCREVLYEKSPDGLTYVKGLLLTKATSREIIKADAYVAACDVPGIKRLLPSEWREWEMFDNIYKLDGVPVVTVQLRYNGWVTELQDLEKSRQLQRAVGLDNLLYTADADFSCFSDLALSSPADYYIEGQGSLIQAVLTPGDPYMPLPNEEIISKVQKQVVELFPSSRGLEVTWSSVVKIGQSL

SEQ ID NO: 40408 - protein, 139 aa, Sorghum bicolor
  Clone ID: SORBI-28MAY03-C58858_1.pep
MGDSKEREPLPRLLDLIPDGKQCKGREAQGAGRSSRNTGFGSEEDKHLELKLGPPGLVEQGATAAASRGIQREIPALSLGCFPHKPSSKPAINTTATGTKRGFLDTIEAKTEGRDEQKQQAGAGCGKELALDQKITAAS

SEQ ID NO: 40409 - protein, 196 aa, Sorghum bicolor
  unsure (1)..(196): unsure at all Xaa locations
  Clone ID: SORBI-28MAY03-C58799_1.pep
ARGLPTRRRLRLDPPAKLYFPYEPGKQVRSAVRIKNISKSXVAFKFQTTAPKSCFMRPPGSVLAPGESIIATVFKFVEHPENNEKPLDKCKVKFKIVSLKVKGPVEYVPELFDEQKDQVAVEQILRVVFLDAERPSPQMDKLKRQLAEAEAALEARKKPPEDNSPRIVGEGLVIDEWKERRERYLARQQIEGVDSV

SEQ ID NO: 40410 - protein, 161 aa, Sorghum bicolor
  Clone ID: SORBI-28MAY03-C59914_1.pep
VPGPPRRLRSWPTTLSSPSSRTSSLSSPAAGDSDGLLAARAPKVAVLGRYGAAWMSPTGRRRCALPSTLPSLCRSAWLGRNPRCSLVLLTPPHQLQVPLDGVVIGKEQPQHLPFPLIFGFWFYLFDFFLCWLGFLDFSLLWPVMKIPDPIDQRYQLMFIFL

SEQ ID NO: 40411 - protein, 172 aa, Sorghum bicolor
  Clone ID: SORBI-28MAY03-C60000_1.pep
SQRRRRRRRGRGGRRRWWGRDGGGSATTRTRTAAPAPARSRRPPASRLLPPSPPRSAGERPRVAAARGLDWAQSCPFATIPCAARESRTRHTARQQASAPDRARHRRRRRTRGRTDGRPTRVRVWDLMRRKPWALGRGRVYVKASLRFASPSLSRLLRFRRHGILFSASRFA

SEQ ID NO: 40412 - protein, 239 aa, Sorghum bicolor
  unsure (1)..(239): unsure at all Xaa locations
  Clone ID: SORBI-28MAY03-C60005_1.pep
MDRDCEEVTEFLGQVPLLQCLPGSSIRRIAEAVQVRSYEPGDYVARDGEPVDGLYIILDGQAEVSAPANAEEANRPDYVLNKYDYFGYGTNSSVHQVNVVALSKLTCFILPNQHGHLLQPKTIWNPEETPEHSLLEQILHLEPLEVDIFRGFTLPEAPTFRHVFGGQFIGQALAAASRSLACPDIVLCLPASFLVAGLPHLPTFXRVLRARGGSSFAATFVDALPLRPVGASVSASCLS

SEQ ID NO: 40413 - protein, 293 aa, Sorghum bicolor
  Clone ID: SORBI-28MAY03-C60017_1.pep
MAGLGAGLGARPSAAFEAGRFQPLAAPLRPVRSGKFIVPKRCFTVSSRLTWVEDELMEIRKSQEQSSIKSKKRPPLRRGKVSPQLPVPGHIPRPSYVGSKGLPELCKGQLHDAQGITGMRAACKLAARVLDFAGTLVKPSITTNEIDAAVHNMIIEAGAYPSPLGYRGLPHPSRPSLHVCVSQRFPVSSPRLVRVLLHLAVVVFLNGYLRRSSSASAWGHLDDSIKHFLNAAEECLEKGISVCRDGVNYRKIGKKISKLAYFYGYYVVERFVGHGIGTTYHSEPLILHHANEN

SEQ ID NO: 40414 - protein, 390 aa, Sorghum bicolor
  unsure (1)..(390): unsure at all Xaa locations
  Clone ID: SORBI-28MAY03-C60024_1.pep
HEVRLQKHLPVRLQEHLLPIHRSASFIQLSLQRSPLSTAAATCSSRGHFAADDYLVSTCGLTREQAANAAKCISHWKSSSNADAVLSFLTGPALGLSKAEIALLVAARPRILSCSVDNTLRVRMDRFRSYGFSVAQISNFIRVAPCFFRTFNIDEKLGFWMPLLGSPDRFLRIVRRNFYMATSDLDKVVKTNIRLLQEHGLSIQEIGNLCVANPRLLTGNPDRTRAILVRADEMGVPRNTLLFRQALTAVAGLGPETMASKLKMMAKILGCSDAEVARMVQKNPXLVLRRSMERIQRTCEFLTNVVGVDTKYIQGRPTILMYSLEGRLVPRHYVMKVLRDKGLIRKDQSFYTMVTVSDNVFCSRYVHPHKDVLPSLADAYASACNGKIAI

SEQ ID NO: 40415 - protein, 142 aa, Sorghum bicolor
  Clone ID: SORBI-28MAY03-C60149_1.pep
MAHSLAASFSPAAAAARRQVTNVISSRSSVSFQSHRMTSVSIRSRPSSLRFKICCSAKKETVDKVCSIVKQQLALPDGTALTGESKFAELGADSLDTVEIVMGLEEAFNITVDETSAQDIATVQDAADLIEKLMQEAPPKVV

SEQ ID NO: 40416 - protein, 189 aa, Sorghum bicolor
  unsure (1)..(189): unsure at all Xaa locations
  Clone ID: SORBI-28MAY03-C5905_1.pep
MRSCSRLGGRKAGALRGSGRGRGGGPXGAAGPRPQPRPAERAGQGARGQRCSGVRRTAGAHSVQGGARARPSGRDTGRHARGAREHQSGQSGIDRKTGPAQARHQERESRQAERAQGKPKLHAPGLKRRDAAAPGLRRKCEATARGHGTAPRAGRRPRPRASAAARGAGRTPRRGGAGCPAREGRRRGR

SEQ ID NO: 40417 - protein, 75 aa, Sorghum bicolor
  Clone ID: LIB3478-053-Q6-K1-D5.pep
KLCKTRKVYHTKLLNPLKSSRVLQARGPNKQSYGRWLVPHMYNDPCSSIPTASDRTYGNADNYLSKKCLMELVLS

SEQ ID NO: 40418 - protein, 115 aa, Sorghum bicolor
  Clone ID: LIB3476-012-P1-K1-C11.pep
PHPLRRSRQNPRPSFITKRANAFLQSIQFQDHMLRGLLHADSPLVVYILSAPINFLHRHDSSQPITKEYGPLEERMKKLMAKIAEQLEKEFHALKWRLHDYNRRAVVAACCIKKP

SEQ ID NO: 40419 - protein, 249 aa, Sorghum bicolor
  unsure (1)..(249): unsure at all Xaa locations
  Clone ID: SORBI-28MAY03-C5926_1.pep
MVSGGCVGAEGEVDPEAVAPAAATEEAVVPVQAPAREVVVGYALTTKKAKSFLQPKLRGLARKKGILFVAIDQKRPLSDQGPFDIVLHKLTGKGWQQLLEEYREAHPEVTVLDPPGAIANLLDRQSMLQEVSELDLTDCHVXSAGKVRVPKQLFVNTDPSSIPAAVRRAGLSLPLVAKPLVAKSHELSLAYDPTSLTKLEPPLVLQEFVNHGGVMFKVYIVGDAIRVVPWFSLPNVDERDLLNNAWVIR

SEQ ID NO: 40420 - protein, 196 aa, Sorghum bicolor
  Clone ID: SORBI-28MAY03-C59306_1.pep
RGVRPHGAVSCVGGAAILFHPRLCLVLLPSSDCGCAVVDPHKPSGGRVRRTGGPLLRPVVHAVSADYLRWWPEVAPWVPPAALLAGPAPAPLFWLYAASAWMLGVARGGVAACYGVVPPCWSHTLTTTSLARSSWTGRRLVPFRVSFFRSPTVGGWSFRPVLGSMRRVPISVSSLLCALLPSSYYQCMADLSPITF

SEQ ID NO: 40421 - protein, 305 aa, Sorghum bicolor
  Clone ID: SORBI-28MAY03-C59495_1.pep
MPQRHSKNNNDLAFFTYEEKRKLGYGTQRERLGKDSIKPFDACCLCLKPLIDPLCCPKGHTFCKECILECLLAQKKDIKRKLAAHEAQKKQEKEEEEEKLILQKAKELDAFDQQNHGAVPQYHDRSGSQDKNGFHGANSVKVTSFEEEALRNMKAFWLPSATPEATVKVDAPSTDTVCPEGQEKLKLKSLFPISFTEETVDQKSKKTVEKSYMCPSCKSTLTNTMSLVAVSTCGHVFCKKCSDKFLVKDKACLECSKPFKERNLVPLEKGGTGFAAHDERLEARDFKHLGSGSGLGLVKPAPKAF

SEQ ID NO: 40422 - protein, 106 aa, Sorghum bicolor
  unsure (1)..(106): unsure at all Xaa locations
  Clone ID: SORBI-28MAY03-C59483_1.pep
MHGCGMQCRIELEQARLLVLEAADQLDRHGNKKARGILAMAKVAAPNMAXLKVLDMAMQVHGAAGVSSDTVLSHLWATARTLRIADGPDEVHLGTIAKLELQRARL

SEQ ID NO: 40423 - protein, 227 aa, Sorghum bicolor
  unsure (1)..(227): unsure at all Xaa locations
  Clone ID: SORBI-28MAY03-C60576_1.pep
MAGSEQRVVAVIMVGGPTKGTRFRPLSLNVPKPLFPIAGQPMVHHPISACRRIPNLAQIYLIGFYEEREFALYVSSISNELRIPVRYLREDKPHGSAGGLYSFRDYIMEDSPSHIVLLNCDVCSSFPLPDMLEAHKKYGGMGTLLVNKVSAESANQFGELVADPETNELLHYTEKPETFVSDLINCGVYIFTPNIFSAIEDVLKQRKDRAXLRRVSSFEALHSATKA

SEQ ID NO: 40424 - protein, 204 aa, Sorghum bicolor
  Clone ID: SORBI-28MAY03-C60662_1.pep
SWPTGCKRWSDFEEPFKISGMWQCSICTHENSTDNLSCELCGVLRDLSLYFNNISEAKDGAKCRHKYSGVSILAAPRWPPATSQAFASVCSGGFHGAGFPSGQLRATRGPRRQSSASRRPRPFCVGPCSLPSPSPRDMVVTGLKSSRNFRKVDTKVLVKDSVDVTGKKMIDNNILLTEKSTSMDPSASVQLDVIASHREAGRRG

SEQ ID NO: 40425 - protein, 254 aa, Sorghum bicolor
  Clone ID: SORBI-28MAY03-C60635_1.pep
SVTKEEEKCEISSWTMRTRDTGMAIDLLHIHRILSTLLEIKGIIIARYIKGKDNIQKITKLLLKAGEQKLLCTLEEPMDEHCIQDSKDSIRRTIMEHDKVFRQQVHELHRLYHVQRSLMAESDNHSYQPRTEETHEMVQGSRSNLKSSPSTSGTNQSARLGNAQHSTPQQVTEDLSLHECKPVNCLSLFSEENSTVKERFHRENHKSAEDESWNASVGSDLDLKLSIGPSSHSPKRPHWLFSGSRERNPSGQHR

SEQ ID NO: 40426 - protein, 311 aa, Sorghum bicolor
  unsure (1)..(311): unsure at all Xaa locations
  Clone ID: SORBI-28MAY03-C607_1.pep
MSSSSPSLLSSRLPSPAATLFTKKPASLRSVSSATARHGVRLVVAAASAAAAAPVSAAQVRPSAAEVARTVVELAASGTLSVVGPDGWPLGVGARFVTDAAGAPALCLAAAGVAAPDAPSSVRVEVGQSGARTPQCTMLGALTKPSDMSVLKKLSTRWQKKXGEEIDQDLLYLISVDRILHMEDFNEDGMWVVPSEYTSAEPDPLRNFAENIVEEFNSKNAEDVHRIYNIYVESDLQVADVKIIWVDRLGFDFHVHSGEGVFAVRIPFSREVTDEKGVKSSFNMMSHHAWEVEKSYASPEFEKVQFLKKVR

SEQ ID NO: 40427 - protein, 186 aa, Sorghum bicolor
  unsure (1)..(186): unsure at all Xaa locations
  Clone ID: SORBI-28MAY03-C60859_1.pep
MAAAEARGGEFPVGMKVLVVDDDPTCLLVLKRMLLDCRYDVTTCPQATRALTMLRENRRGFDVIISDVHMPDMDGFRLLELVGLEMDLPVIMMSADSRTDIVMKGIKHGACDYLIKPVRMEELKNIWQHVVRKKFNENKDHEHSGSLDDTDRNRPTNNDNEYASSANDGGDGSWKSXXKKREKEDD

SEQ ID NO: 40428 - protein, 180 aa, Sorghum bicolor
  Clone ID: SORBI-28MAY03-C60914_1.pep
MISNHFSIVYFLLKARGMRPGVVPYQSILSALQRIAKEEGIRGLYSGLLPSLVGVAHVAIQLPVYEKVKLYFARRDNTTVYNLSPTHVAICSSGSKVAASIITYPHEVVRSKLQEQGRDHHGATRYSGVADCIKQVYQKEGFPGFYRGCATNLLRTTPNAVITFTSYEMINRLMHQLLAP

SEQ ID NO: 40429 - protein, 271 aa, Sorghum bicolor
  Clone ID: SORBI-28MAY03-C59766_1.pep
HEAVVPPPADQPAVPSASLAGQSAAPSAPPSPRQEIALKQEQDSPDSLFSFAIDLSEEEGEEASSSQTVGITSAETRARLEELSVLLHQDTAHLVDDSDPTKTLFRTLRGQIPADVEEILFQAAHLESRQLQYQRASRRLADRAAQTQLSDEMRKEKLLTDEKHKNIGILKSSGDALKQKISDLSARRESLLAELKEVENALSQAQQEENQLPETIRLLEHERNVHGRKALQLKKKLKPIEGSADDDIKEIEAANQIRLRAISAIQSLLNT

SEQ ID NO: 40430 - protein, 408 aa, Sorghum bicolor
  Clone ID: SORBI-28MAY03-C59786_1.pep
MEDNGGGEVAWRFGAANPSLEAASALSIRALVHRLYGCVDRNDPRPLAPLGHGDPSPFACFRAAAAAEEAVAAAPAAGKYNSYPTAAGLTEACSAVAAYLSRYLPYELSTGDIVLTAGCNHAIEIMMAVLAMPGANVLLPRPGYPMYEARAALGGLEFRHYNLLPDKGWEVDIEGVEALADENTVAIVMVNPNNPCGSVYSYEHLTKIAETARKLGIMVICDEIYEHCTFGSKPFVPMGVFGEIAPVVTLGGISKRWMVPGWRLGWIAMTDPKGILRKKKGAIPQIIANTDDVFFTNAMNTMREAAEICYQRLKCMECITCPHKPEGSMFVMVELDISYFNGIDDDIDFCTKLAKEECVVICPGSGLGMKNWLRVTFAVDPPLLEDGMERLKSFCLRHAKPTRNHATS

SEQ ID NO: 40431 - protein, 194 aa, Sorghum bicolor
  Clone ID: SORBI-28MAY03-C5982_1.pep
MILRIRSRDGTDRITVPDSASATVADLQRLIESHLTVPVPLQRLSLDPALLLPNPSAAVPLLADPATPLASLRLANGAFVYLAYPPDARSARPPPPKALSVAGSFGKKMTMDDLIARQIRVTRQENALCAAASFDRDAANAFQLYVAESLAFAVKRAGFLYGRVDAETKEVFVDFIYEPPQQGSEDVVHLMRDP

SEQ ID NO: 40432 - protein, 147 aa, Sorghum bicolor
  Clone ID: SORBI-28MAY03-C59848_1.pep
TRPLSVILQRKREAAQGNNHEKSAEVAVMQTGSLVETEKKGCGNITSSADCKSGSGDEEYKEEDHIPVDAHRQSSSHGDKFEVEYAAEVDAEGNQEADNYGQREGESDDYETIEGHDYKSEDENAYEDDEDFDDDDDFARKVGVVFS

SEQ ID NO: 40433 - protein, 192 aa, Sorghum bicolor
  unsure (1)..(192): unsure at all Xaa locations
  Clone ID: SORBI-28MAY03-C6128_1.pep
GTGNGSSVSVENAGLLALTRVGSRRVVQISAGFMIFFSILGKFGAVFASIPAPIFAALYCXFFAYAGSAGFGFLQFCNLNSFRTKFILGFSVFMGLSIPQYFNEYTSVAGYGPVHTHSRWFNDIVNVIFSSKAFVAGFVAYLLDNTIHRHESSVRKDRGYHWWDKFRSYRTDTRSEEFYSLPFNLNKFFPSV

SEQ ID NO: 40434 - protein, 86 aa, Sorghum bicolor
  Clone ID: SORBI-28MAY03-C61304_1.pep
VGKKADLVVVNPFTWSMVPLHDRIANIVYSMRTENIESVMCNGQWIMKDHKIMNLNEEEEISSAVKRANDLLERAGINLPSRMNYV

SEQ ID NO: 40435 - protein, 153 aa, Sorghum bicolor
  Clone ID: SORBI-28MAY03-C61471_1.pep
LLTEEEKIMFRRIGRKMDGLVLLGRRGIFDGVIEEIHQHWKHKEVVKVITKQNQARQIMYTANLLEVETGGILIAVEKLTTSHAIILYRGKNYRRPAKSSFSNLLTKREALRRSLEVQRRGSMKYFVRERQKSISELKRRLRYVTRQIRYRTP

SEQ ID NO: 40436 - protein, 79 aa, Sorghum bicolor
  Clone ID: SORBI-28MAY03-C61641_1.pep
VACRAYLDGAQVGCLSGDGVQDVDEGDKSCSVRFKQSLKRLNEELLMEFTAKGADCDKFLTEKARSGASTSAADTTLRL

SEQ ID NO: 40437 - protein, 170 aa, Sorghum bicolor
  Clone ID: SORBI-28MAY03-C6166_1.pep
LQSLNLGWCDSITDKGVTSLASGCPELRAVDLCGCVLITDESVVALANGCPHLRSLGLYYCQNITDRAMYSLAANSRVRSQGRGWDAAVKSGGSSKDRERDGLASLNISQCTALTPPAVQAVCDSFPALHTCPERHSLIISGCLSLTSVHCACALHPHRAGRVILSNHAY

SEQ ID NO: 40438 - protein, 185 aa, Sorghum bicolor
  Clone ID: SORBI-28MAY03-C6175_1.pep
MSLPPDGGGGTGDDWFLDCGILDDLPAAACGAFPWDASPSSSNPSVEVGSYVNTNDVFKEPNDVFKEPGSNKRLRSGSNDVPTSKASREKMRRNKLNDRFLELGSTLEPGKPVKADKAAILSDATRMVIQLRSEAQQLKETNGSLEEKIKELKVIQLFFVNSHIIHCPFMVRACLCYSGIHNISQ

SEQ ID NO: 40439 - protein, 161 aa, Sorghum bicolor
  Clone ID: SORBI-28MAY03-C60357_1.pep
YYLNLMLINMPNICWRSFTSCSMYSPFNQLQGSFTQRVDLWSTSCSQAARHHARIGSVDFSVKKNVKSSQLQNVTCFVGLEQHLKCRLSARRHILNVKSDILSHQNVSSVSWSLGSMPQRIGCVVSGLGFAVSGLASAEGPVNNNIDSTEADKSSTNLSHG

SEQ ID NO: 40440 - protein, 243 aa, Sorghum bicolor
  Clone ID: SORBI-28MAY03-C60441_1.pep
MAERLAASLLPAASPSPSARRATVAAAAAASFPSPCSARAGLRLRSRPPPLSHSQKAAGRGRGVRVVRCMAASDAAQLKAAQEDIKELLKTTYCHPILVRLGWHDSGTYDKNIEEWPQRGGADGSLRFDAELSHGANAGLINALKLIQPIKDKYPGITYADLFQLASATAIEEAGGPKIPMKYGRVDVTAAEQCPPEGRLPDAGPRDPAEHLREVFYRMGLDDQEIVALSGAHTLGRSRPDRS

SEQ ID NO: 40441 - protein, 294 aa, Sorghum bicolor
  unsure (1)..(294): unsure at all Xaa locations
  Clone ID: SORBI-28MAY03-C60451_1.pep
TRIDFKDLTAINASSEEVSSWIETINNEHAQNNASGEARFVGSREATSSGKNSTASLLRCTKKDNFSFICECFFMTSRVLNLGLMKAISDYKHISQQLARFEDDLESNRAVRDQGGGSPQLEQDITRLEKIVEILSQDKFCYEAQILRDGAFLQRALSFYRLMILWSVNLVGGFKMPLPSQCPKEFACIPEHFLDDAMDLLVLTSRIPKALESFVLDDFLSFIIMFMGSTSYIKNPYLRAKMVEVLNCWMPXRSGLNSTASLFEGHQLCLDYLVRNLLKLYVDIEFTGSHTQFF

SEQ ID NO: 40442 - protein, 153 aa, Sorghum bicolor
  Clone ID: SORBI-28MAY03-C6037_1.pep
MAIKKGGAAASGLKQILRRCSSLGRRQQQQQQQHGGDEDYNEEDEETTGLPSDVPRGHFAVYVGERRRRFVVPIALLDRPEFRSLLRRAEEEFGFAGAGAGGILVLPCEEGASLPSPHGSAVAGARSSLPEVHQVPASDRRRAGPGGGDGVHI

SEQ ID NO: 40443 - protein, 156 aa, Sorghum bicolor
  unsure (1)..(156): unsure at all Xaa locations
  Clone ID: LIB3476-037-P1-K1-F12.pep
MGSFNGHVLPGTLFLAVGLWRVWSAVARFAADPPSFRVRAWCPLELPTRAPRLLELYVVAGGAFLDMCLELGGGVLAGRGGGVAPESSLIYLEHAGMLLMFFLFGALALLSQKCTRYLPLTDGELCLVAATAFTSEFLLFXYHSXTHMGLEGYYHH

SEQ ID NO: 40444 - protein, 358 aa, Sorghum bicolor
  Clone ID: SORBI-28MAY03-C6055_1.pep
ADHHSDTFDHNENTGETVFDKDSTNLHEDDKRNNERSEAEGGQINSADGNTEANNNNNEDETTGHAEEGKHDTESKSTDESKNEVNSTGDDMPRNNHSQEENTVEASGASHDEVVQSDESTSASGSGNGSDGEGEKKEAVDTQSGSESLPDVAKAEATDDRATGSLPDETGNIPSVHTDNSQNDASENQGDATSATSDSSEHGTGEAVHIETGLEDESATASSGTGSGDDKGNSSDSTPAEENTETASGDDEKGMETGTTTEAVHSKEENSENSSVSTEAENSQGDSSSGVNGSSEETSNKGDGATVTSNNGEQVDPKIESSTSTNDEHNESQGADGSSGANDSNGNDPEQTGKTESQ

SEQ ID NO: 40445 - protein, 401 aa, Sorghum bicolor
  Clone ID: SORBI-28MAY03-C6195_1.pep
MCAARGSSPPNQGGKAKQPTASSQIPSHCSSSSLRRLCYCCYTAMAARPVLPSPALLLLPLLLLVTASSGAAHGYGHGGDDDDGAGKLRVGFYKDSCPDAEAIVRRVVAKAVHEDPTANAPLLRLHFHDCFVRGCEGSVLINSTKGNKAEKDAKPNLTLDAFDVIDDIKDALEKRCPGTVSCADILAIPARAAPSPPTFAPTGGRWSKDGNLYQVETGRRDGRVSSAKEAVKNLPDSMDGIRKLIRRFASKNLSIKDLAVLSGAHAIGKSHCPSIAKRLRNYTAHRDSDPTLDGAYAAELRRTCRSRRDKTTELEMVPGSSTTFDTAYYGLVVKRTALFHSDEALLRNQETRALVYRYRDAAAGSEQAFLRDFGVSMVNMGRVGVLTGDQGEIRKRCAFVN

SEQ ID NO: 40446 - protein, 210 aa, Sorghum bicolor
  Clone ID: SORBI-28MAY03-C61966_1.pep
NRNQLHQCILYNSKEATWIISVFCRELLQWIESTSALHQWIPSLHAPGGPRLTAPDCRAAAQGHQSGGKTLDRDAKKVPRPPTGRRKAWHGKEGAGAIRVLGRERPRWSERTTALRHRSATHQAPACGGLTASRGKQQRTSAGSSERPARGTTPRTALMAGGDGTEATCAPSTEEVVSPRAATAQARRRAGWRMNPETRAYLGSRARRRG

SEQ ID NO: 40447 - protein, 134 aa, Sorghum bicolor
  Clone ID: SORBI-28MAY03-C62202_1.pep
ALQYMMKEHEGNEEERMRAAVGKFGLSGKAQVMPMRNLSDGQRSRVIFAWLAYRQPQLLLLDEPTNHLDIETIDSLAEALNEWDGGLVLVSHDFRLINQVAHEIWVCENQAVTRWEGDIMDFKEHLRSKAGLSD

SEQ ID NO: 40448 - protein, 167 aa, Sorghum bicolor
  Clone ID: SORBI-28MAY03-C62113_1.pep
ARGSCPDGETLTQQDGVILLFDAESPNPIASWSVKKASGGSISFVKGDVSLDANADSSRDHEAMLLVYVNGSHEYAIFDPRKSEVVVSKNTHKKIQAEESAPIGYASIYGDLQKLESKKEVSDVPFIPSDRPWETIFSGSSHVLPPLTKLCSAFLSSLLENRPVGNE

SEQ ID NO: 40449 - protein, 108 aa, Sorghum bicolor
  Clone ID: SORBI-28MAY03-C62216_1.pep
STFALQEGKLCGASDAESLIYLLYFSCGGVCPELDSVESALQWRETSWSRRVIQQKLGDISAVLKAFADYVDSLCGTPYPMDYEIWLKRLRRTINEDHGKEVDTSSSS

SEQ ID NO: 40450 - protein, 73 aa, Sorghum bicolor
  Clone ID: SORBI-28MAY03-C62221_1.pep
PLVGLLQDKINNWRAPAFTLTSILFAAAVFWFIGIFVPSVDRFNEESEDGLTVADRSNFRPLLDESDEPRTFD

SEQ ID NO: 40451 - protein, 205 aa, Sorghum bicolor
  Clone ID: SORBI-28MAY03-C60935_1.pep
MVDLRLQVVATVLGMVALAAAAGGSSSSGKQSEFQEVTVDAIHQGFKNGSLTSTALVRFYLDQIARLNPLLHAVIEVNPDALAQAARADAERSASRGRCAVGLHGIPVLLKDNIATRDRLNTTAGSLALLGSVVRRDAGVVARLRRAGAVILGKANPSEWSNFRPVESGWSARGGQTLNPYVLSATPCGSSAGPGVAAAANMAAV

SEQ ID NO: 40452 - protein, 267 aa, Sorghum bicolor
  unsure (1)..(267): unsure at all Xaa locations
  Clone ID: SORBI-28MAY03-C6098_1.pep
MADEEHLERREEASELAPFDPTKKKKKKKVVIQEPSDEVDKLAEKTETLAVTEPAELNFTGMKKKKKKQVDLDSSLADLGDGEDSQDDQAVEEQGEGIELGGGPTYPWEGTDRDYKYEELLDRVFNILRENNPDLAGDRRRTVMRPPQVLREGTKKTVFVNFMDLCKTMHRQPEHVMMFLLAEMGTSGSLDGQQRLVIKGRFXPKNFEAILRRYINEYVICNGCKSPDTILSKENRLFFLRCEQCGSSRSVAPIKAGFVAQVGRRKA

SEQ ID NO: 40453 - protein, 330 aa, Sorghum bicolor
  Clone ID: SORBI-28MAY03-C60986_1.pep
ARGGDGSSHGGGMQVVPYGAAARGAQHGGGMQMVPYGAAAGGSQHGGSFRASLKVVLLHGSLDIWVHDARHLPNKDMFSKSVAEFLGPRITSAVGSKMSSANMTSDPYVTVQVSYATVARTYVIPNCENPVWSQNFLVPVGHEAARVEFVVKDSDVFGAQIIGVVSIPAEKLLTGARIQGVYPVLEPNGKPCAPGAVLHLSIQYIPVAQLTMYHHGVVAGPDSIGVPHTYFPLRRGMRVTLYQDAHVPDGCLPDIWLDNGLRYQHGQCWRDIYDAICQARKLIYIVGWSVFHTIHLVRDGTQAPSLGDLLKMKSQEGVRVLLLVWDDPTS

SEQ ID NO: 40454 - protein, 194 aa, Sorghum bicolor
  Clone ID: SORBI-28MAY03-C60999_1.pep
MAAVATVSSCVPPTLPECDGYDAAVLVDMRCYIADLPSSTTARGTTSSGLPIQVTFHAARPPLLSHLCVHCPDLVLKSKPRVVATDADLVLLRVPIDPKVTSDIRYWDYFLYKPRSHRLDLLPNPHPRSFDDTATALLSREDGGWYAVAALSIRCPVHKRNSDVVVKWEFDLHLYRSDDVSKGWISKRMSVKEF

SEQ ID NO: 40455 - protein, 163 aa, Sorghum bicolor
  Clone ID: SORBI-28MAY03-C62668_1.pep
GLDKINPRYIPLLKETFTFPQSLGILGGKPGTSTYIAGVQDDRALYLDPHDVQMAVDIAPDNLEADTSSYHCSVVRDLALEQIDPSLAIGFYCRDKDDFDDFCSRASELAEKANGAPLFTVVQSIEPLKQMYKQDDGLGCSGSSMGNDDDLDGSGEAEEWQIL

SEQ ID NO: 40456 - protein, 225 aa, Sorghum bicolor
  Clone ID: SORBI-28MAY03-C62722_1.pep
EDRKLLLDWNKRLAIIEGTAEGLLYLHKHSRLRVIHRDLKPSNILLGWVLSPYLSDCALAIWSCSQIRHVNTSSSPSRAHGYMAPEYASEGLFSIKSDVFSFGVLILEIISGKRNSGIHDCGDFINILGYTWQLYEEGRWKELVDTSLLSMHHSDEMIMRCMNIGLLCVQENAVDRPTMLDVVVMLSSKTQILAKPNHPAYFNVRVGNEEASTTATTVSCSVSMR

SEQ ID NO: 40457 - protein, 165 aa, Sorghum bicolor
  Clone ID: SORBI-28MAY03-C631_1.pep
ASETDKASILDETIEYLKSLQMQVQIMWMTSGMAPMMFPGAHQFMPPMALGMNSGCIPAAQGLSQMPRLPYMNHPLPNHIPLNSSPAMNPLNAANQMMQNGHLREASNHFLHLDGRTAVVPQVPGPHVYGHQIAQAEEPNSILEVAASTVVPTSRAGQPPSFDGV

SEQ ID NO: 40458 - protein, 106 aa, Sorghum bicolor
  Clone ID: SORBI-28MAY03-C63600_1.pep
MPKTWSTRFTRAALCLWGLGLGPPAERLDVPANTSFHNAILGACARADDLMEMERVFRHMKHTQCDPDAVTYSILVEAYRKEGMTDKIYALHQENPALVPTDFVMV

SEQ ID NO: 40459 - protein, 273 aa, Sorghum bicolor
  Clone ID: SORBI-28MAY03-C6371_1.pep
NGKHKIEGSSVPLVVKWADTEKERQARKAQKAQLQLSNMPSASPMQQSSVFGALQMGYMPQYNGFGYQPPGTYGLMQYPLSPMQNQGPFQNMVQPLNQGNSIRGVNPELSPSSVQRSFAMQLGSPYPAIPGMQYPGSYSWGSMNNRPFGNSHNSISIKVPNSNANSAISSSPSSNAGGQVEGPPGANLFIYHIPQDYGDQELSSAFQSFGRVLSAKVFVDKATGVSKCFGFVSYDSPTSAQAAINRMNGYQLGGKKLKVQLKRENNNKHSKPY

SEQ ID NO: 40460 - protein, 121 aa, Sorghum bicolor
  Clone ID: SORBI-28MAY03-C63770_1.pep
IKSKTHPSPANLTSNPEQNNSTLKGHPDQQVNSTAVLGNQVQPLTNQTSLLELDSPPNGTLALVTDVQKSTSGAGDDGSSNTSSSTPVDKKTDGEDGPKEDVDVSTKIMNKAMSEDEVVPE

SEQ ID NO: 40461 - protein, 155 aa, Sorghum bicolor
  Clone ID: SORBI-28MAY03-C74715_1.pep
DDGVLVLGAQRGPPPHTTASCRRRLCLVAAGCLRRQQRRSPVVAAGALLVSGGGGGADLSGSIHACVCGGGAREATPIGVLLDRTLVFHVRVRLLVARARWGRRGAFFSLCLWLSVQGQVDVAQSSERGDKDGTHSITRLMMMDGWMDGWMGEVS

SEQ ID NO: 40462 - protein, 224 aa, Sorghum bicolor
  Clone ID: SORBI-28MAY03-C74766_1.pep
MCGRARCTLSPAQVARAFGFPSASPVPVRGRAAPAAPARLGRRFRPSYNVLPGAYLPVGAVRSRPGCGDRERGADGEGPVIQCMKWGLVPSFTNKTEKPDHFRMFNARSESLKEKVSFRRLIQKNRCLAAVEGFYEWKKYGSKKQPYYIHFQDHRPLVFAALYDMWTNSEGEINHTFTILTTRASTSLNWLHDRMPVILGSKDSVNAWLNDASVKLEEITAPYE

SEQ ID NO: 40463 - protein, 103 aa, Sorghum bicolor
  unsure (1)..(103): unsure at all Xaa locations
  Clone ID: SORBI-28MAY03-C74843_1.pep
ADGPPTPYSLSPSHAPRQQQDLSQETTELQEVRARSGADMKRDLTWWDLAWFGXGTVIGVGIFVLTGREAKEDIGLAVVISYVVSGASSMLSVSRCVRVAGGS

SEQ ID NO: 40464 - protein, 181 aa, Sorghum bicolor
  Clone ID: SORBI-28MAY03-C7487_1.pep
MEQPEENPEFPSCDAYFQAIQSKKKLPLSLQESLTAAFAQIPVSSFPEVPTGRVIEIPGDTSVLDAVRTLSEQNIRAAPVLNPEPGAPTDWQGRYLGVIDYSAIIRWVLENAELAGVALSAASATAAGVGMGAVGAVGVAALGATGPAAVAGLTAAAIGAAVAGGLTAEKGVANDGLTAAD

SEQ ID NO: 40465 - protein, 175 aa, Sorghum bicolor
  Clone ID: SORBI-28MAY03-C64301_1.pep
DAIVNGIERLIALGAVHIVVPGILPTGCLPLFLTLFTISVSSTSSDTDFDQHGCLKSLNRLTEYHNSMLQKQVQILQAKHRSTRMMYADYSSLVYKMVQQPQEFGFRNPLETCCGAGGKYNFDVAARCGMPGATTPCRDPSARLSWDGVHPTEAANKMIADAWLHGPYCNPPILS

SEQ ID NO: 40466 - protein, 95 aa, Sorghum bicolor
  Clone ID: SORBI-28MAY03-C64384_1.pep
WILMTYGFESCFMDNIGFLVPRLVLGVVIQLLCSYSTLPLYAIVTQMGSYYKMEIFNEHVQHGVLGWAEKAKKRSGFKEGSSSPTAESMHGEDAA

SEQ ID NO: 40467 - protein, 112 aa, Sorghum bicolor
  Clone ID: SORBI-28MAY03-C64471_1.pep
HKLQAHDGYILKCLLSPEFCDPNRYLATASSDHTVKIWNVDGFKLERTLVGHQRWVWDCVFSVDGAYLITASSDTTARLWTMSTGEAIRVYQGHHKATVCCALHDGAESAPS

SEQ ID NO: 40468 - protein, 155 aa, Sorghum bicolor
  Clone ID: SORBI-28MAY03-C645_1.pep
VRQHFDDCIPGRTFDNFQFVNFTDIMSTSKDMSKKEAAFALAALMEIPSQYKATQGLRPPEKHAQRIGSPRILPPPNKVLENDNAAASHPPQTASSKSTGIGKSTADEQVCPICLTNPKDMAFQCGHLTCKECGPTLSTCPLCRAPITMRVRLYS

SEQ ID NO: 40469 - protein, 39 aa, Sorghum bicolor
  Clone ID: SORBI-28MAY03-C6451_1.pep
VHFRLIGEEDQEFPTQLVNGFQSLTAELSHYIPAILSEL

SEQ ID NO: 40470 - protein, 64 aa, Sorghum bicolor
  Clone ID: SORBI-28MAY03-C64576_1.pep
HGLTANVRKMFLDMDSELFEECQHQYMEKQAKAKEMQEQRESAWRQLEAVVAAKAAGDDMVLVN

SEQ ID NO: 40471 - protein, 135 aa, Sorghum bicolor
  Clone ID: SORBI-28MAY03-C62328_1.pep
IKGLVAAGRNYENSICIRKACNFLLSIQLKTGGWAESYRSCETQVYVEGLSTHAVQTAWAMLALIYAGQMDRDPTPLHRAAKVLINMQLETGDYPQQEHVGNTNSSVYFNYPNYRILFPIWALGEYHRKVHAKSN

SEQ ID NO: 40472 - protein, 137 aa, Sorghum bicolor
  Clone ID: SORBI-28MAY03-C6237_1.pep
MADKEPVVERPEAAEEEDASAAAAAAGEEEDTGAQVAPIVRLEEVAVTTGEEDEDVLLDMKAKLYRFDKDGNQWKERGTGTVKLLKHKESSKVRLVMRQAKTLKICANHLVASTTKMQEHAGSDKSCVWHAADFADG

SEQ ID NO: 40473 - protein, 150 aa, Sorghum bicolor
  unsure (1)..(150): unsure at all Xaa locations
  Clone ID: SORBI-28MAY03-C62402_1.pep
KKDMFRFESKIATLESEIELLRCNSALAVPAVVTPGKHLYXDTVKSHSYITLMWAYATMQEQVVIPPVKNXCSSIILPQENHDALIKSLVEDRRFDDKKSAAACIAYKSLLHWHSFEAEKTNIFDRIIQTIRSSVEVAIHIAYHLTFSLK

SEQ ID NO: 40474 - protein, 118 aa, Sorghum bicolor
  Clone ID: SORBI-28MAY03-C62517_1.pep
LYRLEFKSSDAKKIAKSKLACNPLNEIQQQMVRLSADSPVDTKRMARSRTKANPVDVNTNIYSVPNTAVQANVPNAYQPGPQVDQMTYLNGNVVYGPHLPYGYSTEKSDFYWNSNDGT

SEQ ID NO: 40475 - protein, 164 aa, Sorghum bicolor
  Clone ID: SORBI-28MAY03-C62587_1.pep
SKTLAEQAAWKFSRDNGFEIVTINPAMVIGPLLQPTLNTSAEAILKLINGSSTYPNSSFGWVNVKDVALAHILAYEIPSANGRYCMGERVVHYSELVKIIRKMYPTIRLPDKCADDKPFVPTYQVSKEKIRSIGIELIPVETSVKETIESLKEKGFVSFDSSNL

SEQ ID NO: 40476 - protein, 251 aa, Sorghum bicolor
  Clone ID: SORBI-28MAY03-C6472_1.pep
MAAEAGPISKVLVVVAMQTEAMPLVNKFKLVEAPAHESTFPKGAPWVRYHGNYKDLHIDLVLPGKDAAFGVDSVGTVSVALVTSFSIQTLKPDLIINAGTAGGFKAKGASIGDVFLASDVAFHDRRIPIPVFDMYGIGARKTFAAPNILKELNLKVGKLSTGDSLDMSPHDEEVILSNDATVKDMEGAAVAYVADMFSTPAIFLKAVTDIVDGEKPTTEEFLQNLIAVTAALDLAVTKVVDFISGKRISDL

SEQ ID NO: 40477 - protein, 135 aa, Sorghum bicolor
  Clone ID: SORBI-28MAY03-C64782_1.pep
GDIIQRTVGGYYIVQGRADDTMNLGGIKTSSVEIERVCNRADECLLETAAVSIKPSGGGPEHLAILAVLKDRSAQYDVNLLKRKFQTAIQKNLNPLFKVSYVKVVPEFPRTASNKLLRRVLRDQLAQELSNRSKL

SEQ ID NO: 40478 - protein, 68 aa, Sorghum bicolor
  Clone ID: SORBI-28MAY03-C64858_1.pep
NYHHCFCPWYGTIDFIGQSLPSVNSWRPPAFIIVRKDQSACPLKELRVVTASFLQLTPKCLVFKLVHR

SEQ ID NO: 40479 - protein, 143 aa, Sorghum bicolor
  unsure (1)..(143): unsure at all Xaa locations
  Clone ID: SORBI-28MAY03-C64945_1.pep
RCAEAFKTSGQPTPGPLPRPPPPPGRPANSAPRPLTTRPXSPPPIPXRTPTLPPIPAEPASASFTAASLPPPPGRFSTPAPTPRLRCSHPRPYRSSSMPPGFLPPRKSGPQPPHRARCGAPYASTPPAVYFVIFGGPVARSTP

SEQ ID NO: 40480 - protein, 85 aa, Sorghum bicolor
  Clone ID: SORBI-28MAY03-C65075_1.pep
LCCSSYCMLTSSSFFVSFVFQLFSLSLCFLSIDCGWCYIFTRPVMGSVYIWPGWSLGWFDYTHGVAYGCRHSEVAMEIWALVIFA

SEQ ID NO: 40481 - protein, 147 aa, Sorghum bicolor
  Clone ID: SORBI-28MAY03-C6497_1.pep
SFGVVLLELVTGKKPVGEFGDGVDIVQWVKTMTDANKEQVIKIMDPRLSTVPVHEVMHVFYVALLCVEEQSVQRPTMREVVQMLSELPKPAARQGDEPPSVDDDGSAAPSDAPAGDGSVEAPHDEATNEQQPQPISQSSPTTDLISM

SEQ ID NO: 40482 - protein, 93 aa, Sorghum bicolor
  Clone ID: SORBI-28MAY03-C63795_1.pep
DGWGVTVTLGVPKTKPEVSAHYAFLLSGRTLKGSLFGGWRPKSDLPSLVDKYADKEIQVDGLVTHDIPFSEINKALELMLENKCLRCVIHMPQ

SEQ ID NO: 40483 - protein, 494 aa, Sorghum bicolor
  Clone ID: SORBI-28MAY03-C6396_1.pep
ARGLVPAHTILDFSSKHTFENVGSTKEKKARVQRIFAAGKSLLNFVQIDQLRIYFDPSSKKFVMAKNPPVSKANNPLNESPDALKTNGADMDHEAARTFDSVSSNMGTLQSNVQFGPDSDDDEEIVFKPIASEKFLKAPSDLLVNARAYPLPMSAAGWPTNASLVSVQSTASMSLTGWPPNGGSHSFLSTASLSAAGNYNINQSLPSSSVGWAVNGEQNVIPSIAPRFELMQPVEEPASSWTSSGAQHVVPQHIGLTFQDVVSEPRVSASMVQCFNSPDYSKFLSEQEMLLMNGLKTVNITRNGYLEQRLQAGLSGVQSIGYSSTEPAGTTKNSMHNHVNITGETVPSTLDSVVPSIAPSGGMPMKFTEAPLTASKKNPVSRPSKPVGPPPGFNHVTPKRQDDSILVEKLQSPQVDDYSWLDGYQPSIDDVNNLRAVYPGVGDTITSFATPFPFPGKQQISEIHAQGANEKTWQDFHLFEPPKQNMCQNYYQRN

SEQ ID NO: 40484 - protein, 128 aa, Sorghum bicolor
  Clone ID: SORBI-28MAY03-C64052_1.pep
GTFGYMPPEYARYGEVSPKVDVYAFGIVLYELLSAKEAIVRSTEFTDAQGLSNLFEETLSMPNPKEALQELIDPRLGGDYPIDSVVKVAYLAKSCTHEEPRMRPTMRSVVVALMALSSKDHELTRGQD

SEQ ID NO: 40485 - protein, 114 aa, Sorghum bicolor
  Clone ID: SORBI-28MAY03-C64281_1.pep
MGKDSSIQSAPAPVKSSKKNKWKPEEIKSLIQMRGEMNEKFQSVKGRMVLWEEISDTMLNQGISRTPAQCKSLWTSLVQKYEESKKDMESMKTWPYFSAMDRILSQQGEMATKG

SEQ ID NO: 40486 - protein, 107 aa, Sorghum bicolor
  unsure (1)..(107): unsure at all Xaa locations
  Clone ID: SORBI-28MAY03-C64176_1.pep
HASSSEHLDEGGILGXGTKKERVVSAEDAVCCICLTKYGDDDELRELPCTHFFHVQCVDKWLKINAVCPLCKTEIGGVVRSFFGLPFGRRRVDRIAGRGVACSRFNV

SEQ ID NO: 40487 - protein, 144 aa, Sorghum bicolor
  Clone ID: SORBI-28MAY03-C6552_1.pep
TRLLRHSPSSCKPVLPFPPKKNLTLSSCCRTAALPQLALPSQLPQCTPPSLHPLLSDPRATPYLRHSTASLRPYAPPPLDLLPSEGWQAHSRVNSRRHIEAASLSVRGRRPHLGRRRIIDLWLGCHALTERCRSVHRQLGSMVG

SEQ ID NO: 40488 - protein, 96 aa, Sorghum bicolor
  Clone ID: SORBI-28MAY03-C65665_1.pep
KKLECSKQAIALDTLAWDNIIGFPASGVRPRLRGIASWAQQHNAEESDANELEKLEKLLANALRNTKTKRMLAKQNNGGAGTSTGNQNSNGPSSHE

SEQ ID NO: 40489 - protein, 139 aa, Sorghum bicolor
  Clone ID: SORBI-28MAY03-C6573_1.pep
MTVEKVDAALADFDAHFDRLFASPDAASDGKVKLLLFLADREPDSSLTWCPDCNVAEPVIYERLEAALQGKDAVLLRAYVGDKPTWRDPAHPWRVDPRFGLKGVPTLIRWEDGAAAARLGDDEAHLKDKVDALLSVPSI

SEQ ID NO: 40490 - protein, 176 aa, Sorghum bicolor
  Clone ID: SORBI-28MAY03-C66040_1.pep
REGYQLDYVFDWTIMKYPQFRDKSKLQSSGKISGLAGPSAERTDRTAAEALFRRTGSGSGHNREHTKHRSLLESLMPSKTVDSDKTRPSSSSRNGSTSRRAVLSSSKPSSSGDPSDPNRMGRLVPSSSSRPPTAQRAHPSGGAEMRSSSLSKIGRSSHDDAIRNFELLSLGADRRK

SEQ ID NO: 40491 - protein, 153 aa, Sorghum bicolor
  Clone ID: SORBI-28MAY03-C6614_1.pep
KAYIQQVKKNAQALASALLRRKCRLVTGGTDNHLVLWDLRTLGLTGKIFEKVCEACHISINKTPIYGDNGSISPGGVRIGTPAMTTRGCLEEDFDVIADFLIRATHIASNVLKEHGKVQKEFLRGLQNNRDIIELRNQVEAFASQFAMPGFDV

SEQ ID NO: 40492 - protein, 200 aa, Sorghum bicolor
  Clone ID: SORBI-28MAY03-C6611_1.pep
GTLSATYRASKNYAERIRNIPKDMDLVGWHYLLLYFGSKEFKKCSFELRNEETGEEQSDLLLWRSTHTKHGNWSNSMSATVYENTAFKIGEIGLRPNTQPLSCVEENMIFQSCYKEVTAVKSSKLHGHGYLSKYRTRKELMKENLEVHARVETATRGKSIAFEAQVENLKEQIAHDAIERERVREEMRKMQEELEEGKNK

SEQ ID NO: 40493 - protein, 99 aa, Sorghum bicolor
  Clone ID: SORBI-28MAY03-C64577_1.pep
NYPFCTFVVTKETVFRCLTLTNNKPSISDNIWATDKCAKVAANQDDFFPPIELKNGDSACTSARFAHAATANETCYGSWRITAENSLYTSFFLNASIQL

SEQ ID NO: 40494 - protein, 101 aa, Sorghum bicolor
  Clone ID: SORBI-28MAY03-C64594_1.pep
SLDTFVFSPDLWNIRISKIVKLTAWRACSLFLLIVTALCVPAQLCWRVPHAVSPASAFVWQGRRRLEGIFEGSFWRVNYPACGMVLRCSPLAHCKFCFENM

SEQ ID NO: 40495 - protein, 278 aa, Sorghum bicolor
  Clone ID: SORBI-28MAY03-C64607_1.pep
MKGPVQITLARPDPPRQRWWRRDDDYVDDGDVGVLRIGRNLAAVDTTFSSSDEVTKRWLAEASTVARGRRLRAPLVAGLVALRGHDPSDRARGSTDFSPNDHDNPIRCIALCLGGSRAIVYSPEAYGCRVRKAKYDGDRLNFYSNNMTQLRAFLDDKRITVACFGAREATRKLAKEWGLHVALPEELTHLFALAFGKVAGVETEKKALKKPDKYWMGKAALARAKAKADRDDYDTDEEEEATNLGKTWRPPKVVSGLSLERMARVALGPEMRLARCPP

SEQ ID NO: 40496 - protein, 91 aa, Sorghum bicolor
  unsure (1)..(91): unsure at all Xaa locations
  Clone ID: SORBI-28MAY03-C64696_1.pep
LQLEASRNASEVKKXLLDGTPSTLVSIIGYKQYRRSARDMYYFLQSNVCIKQLAYAMLEQVLVTVFPELRQLIDDIHEKGRKEQASFTYQL

SEQ ID NO: 40497 - protein, 157 aa, Sorghum bicolor
  Clone ID: SORBI-28MAY03-C66691_1.pep
APTHDMLSKLKLMNLFILETLRLYSPVPLIRRRTRCPVELGGVVVPADALLTLPIATMHRDREVWGDDAGEFNPLRFDAGTTKAAPKNLSAMLAFSSGPRNCIGQNFAMVESRAVVAAVLQRFKLTLSPEYVHAPTDVITLRPKYGLPMIVTSVDDA

SEQ ID NO: 40498 - protein, 474 aa, Sorghum bicolor
  unsure (1)..(474): unsure at all Xaa locations
  Clone ID: SORBI-28MAY03-C6670_1.pep
PTRPDRFANESSGSRFSDFSASSTGDFRNDVLSPSSQETGYSSPSVHHSRNVSADNPQSQKYPNAASQIDFNGVRRSQRTASSGSFGSFDGSSVSNKSFESGNPPDAPRGQSAHCAVNNQTVASPEACSTQQYASPPNNHNLVPQKPADLGSQTAATRKPVQHSGAQIEAVVSAHAPVQPMTSTPLDLFDQSTVQQPVTSAAPIDLFAGFNEHLPASHNTDNVSSHSDVAKEPAHSVVQKGMVPSAEALATSHAVHQDLFSLSILQEPATSSSSQPIDLFADFDQHLSHFSTVQKIPSAAPLPANDGWAFLDMQHGSLTSVSNVQGQVPAASPSPPSDGIGKGIGQSTLPTSPPNVIGSQSSPAMMDNWSLNAEEVKIPVPKENSQSWNAFGESTQSTSNNLFTFNTMPQVEAHQFSMPSGPYVEARTPQDXARGEPERPTPGDMFSGFNVSHVEVVGPSFPSSLQPHLGGMVS

SEQ ID NO: 40499 - protein, 185 aa, Sorghum bicolor
  unsure (1)..(185): unsure at all Xaa locations
  Clone ID: SORBI-28MAY03-C6671_1.pep
LARDRLGCFNLSIEGHAECVKFVKKFNIPLLVTGGGGYTKENVARCWAVETGVLLDTELPNEIPNNEYIEYFAPDYTLKFVNLNMDNLNSKTYLSSIKVQVMVSLRSIQHAFRVQMQDSVLDFYNXDFDTFERDPDERVAKHTQVTVILSNDEYSMTKIDTIQHANLLPRNRCKWKLLLCSSAAL

SEQ ID NO: 40500 - protein, 118 aa, Sorghum bicolor
  Clone ID: SORBI-28MAY03-C67097_1.pep
SCCAAWILVTTHILYLNFYELDYGWNMKVCVVMAVVQLLSWAIWGGVSRHPARLKLWTVVFGGALAMLLELYDFPPYMGYADAHSLWHASTIPLTYLWWSFIKDDAEFRTSTLIKKAK

SEQ ID NO: 40501 - protein, 153 aa, Sorghum bicolor
  Clone ID: SORBI-28MAY03-C67114_1.pep
RPFLWVLREDTRSSEGAAPLGGERGMVVGWCDQVRVLSHPAVGCFVTHCGWNSTLESMACGVPVVCVPQWTDQGTNAWLVERIGTGVRAAVSDKDGVLEADELRRCLDFATSEMVRAKAAVWREKARAAASEGGSSERNLKAFVAKQIAGGNN

SEQ ID NO: 40502 - protein, 181 aa, Sorghum bicolor
  Clone ID: SORBI-28MAY03-C66718_1.pep
MEYGWLLSAALAAALASWAFDALVRLVWRPRALARSLRAQGVRGPPYRFFHGNLGDIRRLRAAGAGIRLDVADHDFTPIAQPQFRERIPLYGRVFLYWFGSTPNICVAGSALAVATCGAPLAAQQQERRATVLRGHLVELPAAVVSPPAAGGSCYEGGRRVLPPLELLLFAASSTLFNVHI

SEQ ID NO: 40503 - protein, 119 aa, Sorghum bicolor
  Clone ID: SORBI-28MAY03-C65105_1.pep
VKDKTSQDSNSYYILTMISLVSIVAFVITFSFGMGAIPWLMMSEILPVSIKSLGGSIATLANWLTSFAITMTTNLMLTWSVGGTFLSYMVVSAFTLVFVVLWVPETKGRTLEEIQFSFR

SEQ ID NO: 40504 - protein, 74 aa, Sorghum bicolor
  Clone ID: SORBI-28MAY03-C65264_1.pep
KVCQRFILRRQLILHGHKCLRQATKATGIAINVHETNMYIYCIKHFVHKLMCHCYLKHGTLLKNIRYQPYPCHL

SEQ ID NO: 40505 - protein, 132 aa, Sorghum bicolor
  Clone ID: SORBI-28MAY03-C65499_1.pep
SPTSPGYSPTSPSYSPTSPSYSPTSPSYNPSSAKYSPSHAYSPSSPRMTPYSQTSPSYSPTSPTYSPTSPSYSQPSPSYSPTSPFNTSGGPSPDYSPTSPNYSPSGSYSPTAPGYSPSSTGQGNDKDDESNR

SEQ ID NO: 40506 - protein, 98 aa, Sorghum bicolor
  Clone ID: SORBI-28MAY03-C65606_1.pep
LQNVQKPCISVSTGLTHLGGLERAPRISCKVAPTHSNCVIPVISIVRAASFLTPALGFLEPSAVAMAVFVDTRHEVMLSSDQLELNLMKILCQSIELQ

SEQ ID NO: 40507 - protein, 135 aa, Sorghum bicolor
  Clone ID: SORBI-28MAY03-C67341_1.pep
MAGFGWRVGSKLQRWGWSCLRSFSSAAVPSQLENVGFIGLGNMGSHMARNLITAGYKVTVHDINEKSMKKFSDDGIPTKQSPLEVSESSDVIITMLPSSTHVLDVYNGPNGLLFGGERLGPWLYIDFITVDPQTS

SEQ ID NO: 40508 - protein, 197 aa, Sorghum bicolor
  Clone ID: SORBI-28MAY03-C67354_1.pep
MGSASASVATATAHLVAATALLLMLARGGESVSFWLPPPTAGGGGGFLGGADRYLTREEHWMNQTLDHFNPTDHRQFKQRYYEFLDYYRAPNGPIFLYICGESSCSGIGNNYLAVMAKKFGAALVSPEHRYYGKSSPFNSLTTENLQFLSSKQALFDLAVFRQYYQETLNAKYNRSGADSSWFVFGGSYAGALSAWF

SEQ ID NO: 40509 - protein, 196 aa, Sorghum bicolor
  Clone ID: SORBI-28MAY03-C67394_1.pep
HEAALQVLRTIGAKFDGTGQPLNVLITAASGGVGLYAVQLAKLAGLHITATCGARNVELVKSLGADEVLDYRTPEGAILQSPSGKKYDGVVHCTVGISWSTFEPVLATNGRVIDITPNFTVFLKSALHKVTFAKKRLVPLLLSPNKADLEFLVGLLKDGNLKTLIDSRFPLSEVSKAWEKSIEGHATGKIIVEMVG

SEQ ID NO: 40510 - protein, 150 aa, Sorghum bicolor
  Clone ID: SORBI-28MAY03-C67430_1.pep
VMELPNGVENKPGGCIMLSRGGRSGIFLIYVKEFQLHIFHHRMGANDPGNWSLVDSVSLRQVCSNLDMASWQFMDGPSVGVKLCAVGDNAEFVLLEIFGTIVFLDIISRQAEKVYELTPEDKELVSVRPLMLIWPPVFPQLKDAYYEQKE

SEQ ID NO: 40511 - protein, 367 aa, Sorghum bicolor
  Clone ID: SORBI-28MAY03-C6744_1.pep
VEVTRSITKHNYLVLDVDDIPRVVQEAFFLASSGRPGPVLVDIPKDIQQQMAVPVWDTPMSLPGYIARLPKPPATELLEQVLRLVGESRRPVLYVGGGCAASGEELRRFVEMTGIPVTTTLMGLGNFPGDDPLSLRMLGMHGTVYANYAVDKADLLLAFGVRFDDRVTGKIEAFASRAKIVHIDIDPAEIGKNKQPHVSICADVKLALQGMNALLEGSTSKKSFDFGSWQAELDQQKREFPLGYKTFDDEIQPQYAIQVLDELTKGEAIIATGVGQHQMWAAQYYTYKRPRQWLSSAGLGAMGFGLPAAAGAAVANPGITVVDIDGDGSFLMNIQELAMIRIENLPVKVFVLNNQHLGMVVQWEDRF

SEQ ID NO: 40512 - protein, 101 aa, Sorghum bicolor
  Clone ID: SORBI-28MAY03-C67469_1.pep
MAAATAAAASTMSLLPISQLRQQQHGAGAVVVFRRRARDARRRRYVVPTARLFGPAIFEASKLKVLFLGVDEESNNKHGHPTTPSPTSPPLPLLPRTYTLT

SEQ ID NO: 40513 - protein, 141 aa, Sorghum bicolor
  Clone ID: SORBI-28MAY03-C66349_1.pep
GDGLQTRSFTFIDECVEGVLRLTKSDFREPVNIGSDEMVSMNEMAEIVLSFENKQLPIHHIPGPEGVRGRNSDNTLIKEKLGWAPTMRLKDGLRITYFWIKEQLEKEKAEGMDLSVYGSSKVVQTQAPVQLGSLRAADGKE

SEQ ID NO: 40514 - protein, 175 aa, Sorghum bicolor
  Clone ID: SORBI-28MAY03-C66451_1.pep
MGSPNQRHGGGGGSDEEGDAGSWRLRMDSGGFSVPDRFHRQPPPFYARIFVGGSHGKQRKIAKYYKKQENLLKDFSEMETMNELGGLDPNAAPSEEEQKQLAKSERFAINLSNVINLILFVTKVVASIQSLSMAVIASTLDSLLDLLSGFILWYTAYKMKKPNKYNYPIGKRRMQ

SEQ ID NO: 40515 - protein, 86 aa, Sorghum bicolor
  Clone ID: SORBI-28MAY03-C66455_1.pep
FFFFFFFFFFFGTYNHNILKLYIHQIVQWSTFFLPCKIKSKQRAKLTTNIRNRSNYYYYYYLTGLVIAMQQLLHMSGPSLHSKEDK

SEQ ID NO: 40516 - protein, 160 aa, Sorghum bicolor
  Clone ID: SORBI-28MAY03-C66490_1.pep
LAYVALDYEQELETAKSSSSVEKSYELPDGQVITIGAERFRCPEVLFQPSFIGMEAPGIHETTYNSIMKCDVDIRKDLYGNIVLSGGSTMFPGIADRMSKEITALAPSSMKIKVVAPPERKYSVWIGGSILASLSTFQQMWISRAEYEESGPAIVHRKCF

SEQ ID NO: 40517 - protein, 341 aa, Sorghum bicolor
  Clone ID: SORBI-28MAY03-C6650_1.pep
QVGKGRDVGLNQIALFEGKVAGGNGEQVLSRDVYRLGQLFDFFRMLTFFFTTVGYYVCTMMTVLTVYIFLYGRVYLALSGLDYSISRQARFLGNTALDAALNAQFLVQIGIFTAVPMIMGFILELGLMKAIFSFITMQLQFCSVFFTFSLGTRTHYFGRTILHGGAKYKATGRGFVVRHIKFAENYRLYSRSHFVKALEVALLLIVYISYGYTKGGSSSFILITISSWFLVMSWLFAPYIFNPSGFEWQKTVEDFDDWTNWLLYKGGVGVKGDSSWESWWDEEQEHIQTFRGRILETILSLRFLIFQYGIVYKLKITDHNTCLAVYGFSWIVLAVMGLLFK

SEQ ID NO: 40518 - protein, 256 aa, Sorghum bicolor
  Clone ID: SORBI-28MAY03-C6777_1.pep
PQIASVGSCCLVGVICAGTLYVANLGDSRAVLGRLVKATGEAVAMQLSSEHNACHEEVRQELQSSHPDDPHIVVLKHNVWRVKGLIQISRSIGDVYLKKPEYNREPLHSKFRLRETFQRPILSADPQITEHRIQPNDQFVIFASDGLWEHLSTQEAVDLVHSSPRNGIARRLVKAAMQEAAKKREMRYSDLKKIDRGVRRHFHDDTTVVVLFLDSNAMSKASWSKSPSVSIRGGGVTLPAKSLAPFSALAQLNSTY

SEQ ID NO: 40519 - protein, 153 aa, Sorghum bicolor
  Clone ID: SORBI-28MAY03-C67841_1.pep
QSSQTSWDVIKAAKHYKLFQRATHVYSEARRVYAFRDTVSSKLSEEDKLKKLGDLMNESHYSCSVLYECSCPELEELVKVCRDNGALGARLTGAGWGGCAVALVKEPIVPQFILNLKEMYYKSRIERGVIQQGDLGLYVFASKPSSGAAILTL

SEQ ID NO: 40520 - protein, 139 aa, Sorghum bicolor
  Clone ID: SORBI-28MAY03-C68007_1.pep
MALAPSRSGSEPVIPEVEMNAGADQAASTVRVTVVQASSVFYDTPATLDKVEKLIAEAAGYGSQLVLFPEVFVGGYPHGSTFGLVIGNRTAKGKEDFQKYHASAIDVPGPLVARFAALAGMFFHEYYHALFFGVETLPF

SEQ ID NO: 40521 - protein, 200 aa, Sorghum bicolor
  Clone ID: SORBI-28MAY03-C68017_1.pep
MLLMDSARRAGCSPSPVCLDLSVGLSPSSPGSSGPETTADTDDRLDRPAAGCRVASSLSDEQAKTLEAKLTQVSEENRRLTEMIAYLYASQVARQSSSSPDTTSRKRSRDSLEPPSNSSDGNGNAKAEPGDHAAVESALSDEGTCRRIKVTRVCTRIDPADATLTVKDGYQWRKYGQKVTRDNPSPRAYFRCAYAPSCPV

SEQ ID NO: 40522 - protein, 160 aa, Sorghum bicolor
  Clone ID: SORBI-28MAY03-C68170_1.pep
KPREVDPVLEQKWRLLEIERERQDALSTITATMGRAVVLGDYVLDLEDGVDLEDVDSDADVDDGRGTENTRRMLLFIMRQVAQHHQNQRLQNATGASDNAEDNYVVSSGANGTTPYPYPLEGEDENDMVVAGGRSTDVLRPERRRRRRRRNRGRLFLGAN

SEQ ID NO: 40523 - protein, 228 aa, Sorghum bicolor
  Clone ID: SORBI-28MAY03-C6811_1.pep
MGCRKKIKMEGFNEEDAWSLFQANVGGDTIHGHTQIPALARQVAAECKCLPLALVTVGRAMSNKRTPEEWSNALDTLKASLPSGTPGLDKSTHALVKFCYDNLESDMVRECFLTCALWPEDHNIFKEELVQSWIGLGLLPDLGDIEEAYRFGFSVIAILKDARLLEAGDNHRCNMYPSDTHVRLHDVVRDAALGSRPGKWLVRQAPGSGSPHAKRALGARANAVPDAQ

SEQ ID NO: 40524 - protein, 253 aa, Sorghum bicolor
  Clone ID: SORBI-28MAY03-C67135_1.pep
LDKQVRGMLMDIIKARVANKDTAGYGNDLLGLMLEACAPEHGETPVLSMDEIIDECKTFFFAGHDTTSHLLTWAAFLLSTHPEWQDRLREEVRRECGDEVPTRGDALNKLALVNMFLLETLRLYGPVSLIQRKAGSDLDLGGIRVPEGAILTIPIATIHRDKEVWGDDAGEFKPERFENGVTRAAKHPNALLSFSSGPRSCIGQNFAMIEAKAVVAMILQRFALELSPKYVHAPMDVITLRPRHGLPMLLKRL

SEQ ID NO: 40525 - protein, 184 aa, Sorghum bicolor
  Clone ID: SORBI-28MAY03-C67234_1.pep
MDLAWMVAAAVAAVLASWAFNALVHLVWRPYAITRSLRAQGVRGPDYRFFTGSLGEIKRLRGEGAAVTLDVDDHDFIPMVQPHLRKWIALYGRTFVYWTAARPNVCVADVNVVRQVLFDRTGLYPKNLMNPHVSRLLGKGLVLTDGDDWKRHRKVVHPAFNMDKLKMMTATMSNCALSMMSEWE

SEQ ID NO: 40526 - protein, 139 aa, Sorghum bicolor
  Clone ID: SORBI-28MAY03-C67257_1.pep
CGGAGNGSAAKICNNMAMAISMLGVSEAFALGQNLGIKATTLTDIFNCSSARCWSSDTYNPVPGVMEGVPSSRNYSGGFTSRLMAKDLGLAMASASGVGFKCPMGSEALEIYRKLCEDGCELKDFSCAFRHHYAGKDEE

SEQ ID NO: 40527 - protein, 164 aa, Sorghum bicolor
  Clone ID: SORBI-28MAY03-C67295_1.pep
MKLKCPPAVVAARAAISRTAFAKGLRPQPLPTKVLVIALLGMAVNVPLGIWREHTQKFSPQWFAAVHAAVPFIGMLRKSVLMPKAAMALTIAASILGQTIGSRAERIRLKRTAAAKLAREGHDAAADCIKAPMSVKSGNHSLRVESTVVAGAPAVLVPAVAAFN

SEQ ID NO: 40528 - protein, 159 aa, Sorghum bicolor
  Clone ID: SORBI-28MAY03-C68307_1.pep
EAQAVEVPAPGEQAHRHVGEARERGAGVLHLGAAAARGRAAPDRRAVHEVDAPLAAAGLAVGAGAGGSEIQLLDPRRAFRGGAGRLVLHADRRRRRHHGIAAKTPSVPNPLVPCPTAAPENHRHRESRPPGTNLRREEAAGRTGGPCSRRRGLQSRWGG

SEQ ID NO: 40529 - protein, 177 aa, Sorghum bicolor
  Clone ID: SORBI-28MAY03-C68360_1.pep
KVLVSKRTSSSSPPSKTKKSKTTTTTTTQNNKPHRAAASLATEHHNDDDDMLMMLVADHSCDEEQQHAAVRLASNTNFNSKSRRASSDDDCDDRHSASASLDTEEAASHVSQAAAEEAEPQQDDQLAEAEQQPPPMGLDLTLGLLTSSAPPPIGCRQGGGSSAAVDEPAGVIGFRFL

SEQ ID NO: 40530 - protein, 188 aa, Sorghum bicolor
  Clone ID: SORBI-28MAY03-C68482_1.pep
KKIVETRSIRHACTFTFWWDMLARRNCTNTRNVLAPGNTRKAREGYNKKLNATSKTNKAIRAKPGLLRLQAASSIRLAPWFVLSTLHCLSKRQRFDETNTQKHTIPDPQSLKIHGCSVIYIYTTTSCHHRTSDMLSMRVLATMASFSQSQRTVMMARMSVWTAVPPIIPAQIPSTRFAQRISGGEAML

SEQ ID NO: 40531 - protein, 197 aa, Sorghum bicolor
  unsure (1)..(197): unsure at all Xaa locations
  Clone ID: SORBI-28MAY03-C68680_1.pep
MRYYAELATKTALLLSLVVVGAAAAAAGSIPPSNDILRQVPAAVYVFGDSTLDVGNNNYLPGKNVPRADMPYYGIDMPGSGKPNGRFSNGDNTADSVAKSMGLESSPPPYLSLASSSDQLVQTALAAGVSYASAGAGILDSTAGRTKATTSXLSRQVKYFRATWSKMVASNGSEAVSALLSRSVILIGIGGNDISAF

SEQ ID NO: 40532 - protein, 127 aa, Sorghum bicolor
  Clone ID: SORBI-28MAY03-C6898_1.pep
MASHDHHHSHEHEHEHGHDHHHSHGDGGGHGSGGSWVGEDGRVWHSHDGLAPHSHEPIYSPGDFTKRAPPLASRNFADRAFTVGIGGPVGTGKTALMLALCRFLRDKYSLAAVRGMTLSSDSFTEAI

SEQ ID NO: 40533 - protein, 147 aa, Sorghum bicolor
  unsure (1)..(147): unsure at all Xaa locations
  Clone ID: SORBI-28MAY03-C6899_1.pep
MGKSKRNKGGRSGGGADDQLDGGSDADSVTSMSTALSDLQLAQATEHVSSQEFVLDNYIDALYEKRGSTREKALGALIDAFESFVLLGLVENKXLSITLGAGSSSHEIMDESHQQLLRVLQTWPDAPKMISALDCLAVVTFVGATDL

SEQ ID NO: 40534 - protein, 148 aa, Sorghum bicolor
  Clone ID: SORBI-28MAY03-C67625_1.pep
MAEICCEVAATGSDRKGECVGGDAGSRAARKRRMEIRRLRVVAEEASAKRRRLEADEEDAVRRPAPRYGVTSVCGRRRDMEDAVTTRLGFIDGHHFFGVFDGHGCSHVATSCGQRMHQIVAEEATAAAGSSASDDAARWRGVMEKSYS

SEQ ID NO: 40535 - protein, 204 aa, Sorghum bicolor
  Clone ID: SORBI-28MAY03-C67655_1.pep
MASMPPPSAAGADSDQILVEVNGFTRTLILNRPKQLNALSSTMIMGLLRCFTAYEKDDGVKLLIMKGKGRAFCAGGDVAGVVRSIHKDSWKYGADFFRNEFLLNYIIATYTKPQVSLLTGIVMGGGAGVSLHGRFRVATDNTVFAMPETALGLFPDIGASYFLSRLPGFYGECVALAGARLDGVEMLACGLATHFVHSNRLLLL

SEQ ID NO: 40536 - protein, 291 aa, Sorghum bicolor
  Clone ID: SORBI-28MAY03-C67668_1.pep
SSGNDNGVEFHLRLPVHLLFVQSSSPTCAMNGKQSLRHGRTAYHFQPAKNWMNDPNGPLYHKGMYHLFFQYNPHGPLFGTGKLSWGHSVSGDLVNWAFLGTALDPTSPFDAEGCWSGSTTTLADGRPAILYTGRDANDVQVQNVAFPKNPSDPLLREWHKPSCNPVVPQPADVTRNNFRDPTTAWLGRDGLWRFAVVAEVGGVGSTVVYRSADFVHWERNAAPLHASPDVPVWECPDLFPVAERGTEGLDTSVSVGPGVRHVLKLSKAADEDYYVVGRYDDETDTFAPVDD

SEQ ID NO: 40537 - protein, 185 aa, Sorghum bicolor
  Clone ID: SORBI-28MAY03-C67732_1.pep
LHEFGTRSRLQPPLAGSRPLLARAGPLGAFAAPLVDPPRALYLPPAAASPGRPLSSRSGTPPSPRPPRRPPARGPSPPGTPTTNLLKQTLVGTGALLVGAVSLFAFAAPVEDFLHALNQPPSAASSSKPSLRKEELLRLPVEVMQDDDLAAAAAEAADGRPVYCRDRYYRALAGGQYCKWDDLLN

SEQ ID NO: 40538 - protein, 200 aa, Sorghum bicolor
  Clone ID: SORBI-28MAY03-C67734_1.pep
FAGGIDTCAVTMIWIMAELMRNPWVMRKAQAEVRGLVGNKPRVDEEDVKNLRYLKMVVKENFRLHPPGTLLVPRETMKSCVIGGYDVLPGTRIFVNVWAMGRDPTIWDRPEEFNPERFDGSHVDFRGSNFELLPFGSGRRSCPAIAMGVANVELALATLLHCFDWQLPEGMKEEDIDMEETGQLVFRKMVPLCLVPIKRV

SEQ ID NO: 40539 - protein, 124 aa, Sorghum bicolor
  Clone ID: SORBI-28MAY03-C69650_1.pep
MEFGRRKPMSLLELCIRKAIDNLRYIESVDGIEMDLLKRILPHCTLEHLTKIEENTKMDLSSVTDPLWKRFYFREFGEEHTNKVIARLKSLKETRSDTKYTWWKLFEARQKKQKQAEDEMVEKF

SEQ ID NO: 40540 - protein, 147 aa, Sorghum bicolor
  Clone ID: SORBI-28MAY03-C69721_1.pep
LDTLSDLYETVTITQAVIFCNTRRKVDWLTDKLTARDFTVSAMHGDMDQAQRDLIMKEFRSGSSRVLIATDLLARGIDVQQVSLVINYDLPANRENYIHRIGRGGRFGRKGVAINFVTAEDVRMMREIEQFYSTQIEEMPMNVADLI

SEQ ID NO: 40541 - protein, 127 aa, Sorghum bicolor
  Clone ID: SORBI-28MAY03-C69701_1.pep
QRVHMRLVLASAMALCFKQKNYATAGHFARMLLENSPQEAQAKKARQVLQACQDKNDSHQLNYDFRNPFVVCGATYVPIYRGQKDVSCPYCGSRFVPSIEGQLCTICELAAVGADASGLLCSPTQSR

SEQ ID NO: 40542 - protein, 169 aa, Sorghum bicolor
  Clone ID: SORBI-28MAY03-C69792_1.pep
MPPPLRCLLLAFVVLLSGFPRLAHPFTALESDQIARFQDYLRIRTAHPSPDYAGAAAFLLPYAASLGLDTTTLHFTPCKTKPLLLLTWRGSDPSLPSVLLNSHIDSVPAEPEHWAHPPFAAHRDAATGRVYARGAQDDKCLPVQYLEAIRGLQAAGFAPARTVHISLVP

SEQ ID NO: 40543 - protein, 152 aa, Sorghum bicolor
  Clone ID: SORBI-28MAY03-C69762_1.pep
PRLLLRRRHRAVPHLRLPTPQGGAVMVCPSYAGFAAAHDEVGLILAPHAVVLEEIPGQRRNTCSSRQATKVRSFVGFAGAGESFLARRLGSHPSVTSLCTNFRSGIWADSSSAVPKIPIQIARFDSSLVRFGVLHVSVRGSIYLAVGPPLLI

SEQ ID NO: 40544 - protein, 271 aa, Sorghum bicolor
  Clone ID: SORBI-28MAY03-C8247_1.pep
KIPHFCGHQLATPHSQSPPQLVPCSVRLIQRLNPQTTMGFDKEASSSSSRLDAAPLLPQHGLHGGGGGGHLSSQPKTFANVFIAVVGSGVLGLPYTFSRTGWAAGTLLLLAVAALTFHCMMLLVATRRRIADEHPKIASFGDLGHAVYGAPGRHAVDAMLVLSQASFCVGYLIFISNTMAHLYPIGAESPASPLLTAKALFIWAMLPFQLGLNSIKTLTLLAPLSIFADVVDLGAMGVVLGQDASIWLANKPPVFAFAGPAELLYGLGVAV

SEQ ID NO: 40545 - protein, 430 aa, Sorghum bicolor
  Clone ID: SORBI-28MAY03-C82521_1.pep
MAINGEEAPPLLLDEAARPRRVALFVEPSPFAYISGYKNRFQNFIKHLREMGDEVIVVTNHEGVPQEFHGAKVIGSWSFPCPMYGKVPLSLALSPRIISEVAKFKPDIIHASSPGIMVFGALAIAKLLGVPLVMSYHTHVPVYIPRYTFSWLVEPMWQVIRFLHRAADLTLVPSVAISKDFETAQVISANRIRLWNKGVDSASFHPRFRNHEMRVRLSDGEPEKPLVIHVGRFGREKNLDFSKMVMDRLPGVRIAFIGDGPYRCELEKMFEGMPAVFTGMMQGEELSQAYASGDVFIMPSESETLGQEVLESMSSGVPVVAARAGGIPDIIPEDQEGKTSFLFTPGDLDDCLSKVQQLLTNREFRDNMGRTARSEMEKCDWQAASKTIRNEFYNAAIWYWRKKRAELVKPLQWLAQMFLPAPEVRSIKQC

SEQ ID NO: 40546 - protein, 213 aa, Sorghum bicolor
  Clone ID: SORBI-28MAY03-C8258_1.pep
FSPKMDHLVCFLPGTLALGATKGITKRKALESNLLTDEDKENLQLAEDLAKTCVEMYFVTSTGLAPEIAYFHIEGDTEGGPDGGNKSSKYINDIIIKPLDRHNLLRPETVESLFVLYRITEDPKYREWGWQIFQAFEKYTKVDSGGYTSLDDVTSLPPSTRDKMETFFLGETLKYLYLLFDENNTLPLDKYVFNTEAHPLPVMRSAERASHSV

SEQ ID NO: 40547 - protein, 164 aa, Sorghum bicolor
  Clone ID: SORBI-28MAY03-C82626_1.pep
PRLTYLTAVIKETFRLHPSTPLPLPRVAAEECEVDGFRIPAGTTLLVNVWAIARDPEAWPEPLQFRPDRFLPGGSHAGVDVKGSDFELIPFGAGRRICAGLSWGLRMVTLMTATLVHALDWDLADGMTADKLDMEEAYGLTLQRAVPLMVRPAPRLLPSAYAAE

SEQ ID NO: 40548 - protein, 175 aa, Sorghum bicolor
  Clone ID: SORBI-28MAY03-C70238_1.pep
NFRFFPLVHRVLQNLFDAAPAQHAGGRRPWRTSLPTSATPAPQPPRPPPRPTRHLRPSPPPSAPSPSPPREAAAAAPADATRALLLLQRSSTPPDASPVGPRYRPSPLAATARSTPSASSPSLAPPSSTGPAPNPLPSSSPPPQEKAPPDPLRRRSLPSPRGSFPISLPLRRGPR

SEQ ID NO: 40549 - protein, 159 aa, Sorghum bicolor
  Clone ID: SORBI-28MAY03-C70421_1.pep
IKGVKGPTTKCYRQANPGEPALERASTKERAMASIICSSKLSGTLLEPMLDPTEVDELPTPASTITSASAILVPASATSDHRPLELEYSEPSIVRCVLLLDGSSTLESEELLPTTLRSSVEDLSDLLRISNLGVWQADALEDSPCICCCSAKAATAKAN

SEQ ID NO: 40550 - protein, 148 aa, Sorghum bicolor
  Clone ID: SORBI-28MAY03-C70426_1.pep
KASFDSSSTFLSPFVPLWKAKPASKWHPPREAPPTKVRKGRRPGQATEVVAIPFHCRNGGLIQAWHGFGFTDSPLCDSIPLVEEYFLLYRARVVPMQQPPPPPPCKRELVLDDEAAERRAVRDALAALRRQGRLRRGWREALLLVGIA

SEQ ID NO: 40551 - protein, 112 aa, Sorghum bicolor
  Clone ID: SORBI-28MAY03-C7044_1.pep
MAPSKLAVVIALVASLLLLTNINTKAAPGPGGYPPAPPLGPPPHQIVDPAKDCGGACDVRCGAQSRKNRCARACLKCCSVCRCVPAGTAGNQQTCGKCYTDWITHGNRTKCP

SEQ ID NO: 40552 - protein, 164 aa, Sorghum bicolor
  Clone ID: SORBI-28MAY03-C70492_1.pep
MGNQVGGRRRRRPAVDERYTQPQGLYPHPDIDLRKLRRLILEAKLAPCHPGADDARADLDECPICFLFYPSLNRSKCCAKGICTECFLQMKSPTSCRPTQYPDQIHFNSNPVQSDALVECPYCKTLNYAVEYRGVKTKEEKGIEQLVSAHTNRVLFLSWLLWFI

SEQ ID NO: 40553 - protein, 187 aa, Sorghum bicolor
  Clone ID: SORBI-28MAY03-C70520_1.pep
MAIDHDSPFKELRLKNRRIMGGGGPDPEPEEEEEEAATAAYAEQWPRWLQPLLSARFFAHCKTHSDSHRSGECNMFCLDCSSAAAGAGTRALCSLCLAHGHRDHHTIQIRRSSYHDVIRVSDIQRFMDIAGVQTYVINSARVVFLNERPQQQKPGCGGGGKAASASANLCEVCARSLLDNFRFCSLG

SEQ ID NO: 40554 - protein, 195 aa, Sorghum bicolor
  Clone ID: SORBI-28MAY03-C69291_1.pep
WPAPAMAAPGSPGPLPRLDRRTMEWDEAGRIPPSGYRRFPARPQPASQRCAAPPPPPAAYRDVGRFGRGGLGRFPGWRARGWLAPRARDAVGCGGYWAWADGPPGSGDGASRGGVFVAGVAAGPGGSRGLVPGRGRAAVPSCSGWMCPRPARDRVPAICGALSPWSPCFRWRGLCVALAFWLRSVGCWVLSVVLD

SEQ ID NO: 40555 - protein, 173 aa, Sorghum bicolor
  Clone ID: SORBI-28MAY03-C69549_1.pep
MEPTGTIVFASVGVTNFGFDVFSVAVPTPASAEAEAGVSAQELDERRHTDGVSVNFNAQFADDAGDAVAFVSERTGAASLFLSRPPGSESDRPEPLPAAEGSLFHDRPTVRGGRVYFVSAHEKPDRTFQSWAAVYAARVGERKAEPERLTPRGVVDMSPAVSASGDLIAVASY

SEQ ID NO: 40556 - protein, 137 aa, Sorghum bicolor
  Clone ID: SORBI-28MAY03-C69589_1.pep
SGPSSLSNCSYKSPMLKKARMEATSQARLQSAIQKNTFARSSQPIRTTSFSGQPVRTTTIHRPNSTITTTKPIHRPNSTITDTKPIHRPNSTITTTKPIHRPNSTITTTKPMVKSRQIQNSKLMEKSRQIQNSRPKF

SEQ ID NO: 40557 - protein, 117 aa, Sorghum bicolor
  Clone ID: SORBI-28MAY03-C6964_1.pep
MGARTSGFVCGVTRLVGLSFECRLLGRSAGVGSDHASTRFTSPDSVAALSSRDNQALDRSTRGDKDGADGAGGRNKLWFSKDQATVIEVCFKMHSTLKPVSFLSLFLVIRLLIPFAR

SEQ ID NO: 40558 - protein, 133 aa, Sorghum bicolor
  Clone ID: SORBI-28MAY03-C69646_1.pep
QPVLGVAMAQLRAFDPTLGGGALLQCGHARRRQQRRLPGCCPSANYVGDEFLQDSHALLTREDDTWEDCVLIHKIRKLGSSTIKLRRRFSPTESPVLRPVCLPDLCTGIWGGDRMPEGFPSQVLPWSSSCMPT

SEQ ID NO: 40559 - protein, 180 aa, Sorghum bicolor
  Clone ID: SORBI-28MAY03-C70818_1.pep
MTTPTCTTNAAFFFLLLLLVCACCFATTLACDPNGDGAKFGYIGSMGPAHWGSLSPNFRQCARGTHQSPIDISTAEAVLNPGLQPLHRDYTVANATLVDNVFNIALRFDDDDDGAAGSVRIDGKVYWLKQMHWHSPSEHTINGRRFPVELHMVHASDDGNVTVVAMLYRFGSRPDPLLWQ

SEQ ID NO: 40560 - protein, 103 aa, Sorghum bicolor
  unsure (1)..(103): unsure at all Xaa locations
  Clone ID: SORBI-28MAY03-C71121_1.pep
SPLERALTGEAQAAARLASWPVVSATAQAGVVAACVVLFVPMGLAGWHLSRNKVLFFAGALFISLAVGNXIHLSPYMDSPRWESHGDRDRRGYRSTYQMHSQG

SEQ ID NO: 40561 - protein, 122 aa, Sorghum bicolor
  Clone ID: SORBI-28MAY03-C71152_1.pep
HHSGAASISVEGSLASHIGSSIPGPPPPSHAGPPHPSPASPTRRRRQPPSLARPCPRLLRFLRPRPRPPPVLVVAVSRLRCHFYVLFFGSWVIVYVLSSGLFVCVVFVRFGSFVIYINVVCV

SEQ ID NO: 40562 - protein, 232 aa, Sorghum bicolor
  Clone ID: SORBI-28MAY03-C7140_1.pep
MMEFKTGIFTVAILAIVLSSPAVAQKSPPAPSATILPPAPAPAPAPRHVDLADLLSVAGPFHTFLDYLQKTNVIETFQNQANDTKNGITIFVPKDSAFAALKKTTFANLTQDQLKSLLLYHAFPKYYSLAEFDKLSTLNPVTTFAGSQYTLNLTYNMGTIQVKSMWSNPKISSSVYSTRPVAVYEVNKVLLPMQIFQSDPPLAPAPAPAPDSRPLMLLPQGQNQQAQRRRRM

SEQ ID NO: 40563 - protein, 138 aa, Sorghum bicolor
  Clone ID: SORBI-28MAY03-C71421_1.pep
MRIRELRDGLEVEDDEREQEGSWGGGGDGEVVAVVRLRAKRALVGAGARVLFYPTLLYNVLRNMFDGEFRWWDRVDKYVLLGAVPFSSDVPRLKQLGVRGVVTLNEPYETLVPTSLYQAHGINHLEIPTRDYLFAPSL

SEQ ID NO: 40564 - protein, 164 aa, Sorghum bicolor
  Clone ID: SORBI-28MAY03-C69833_1.pep
GASATYSLILSLMQVTFEKVIKKETFSVVLNMQIYTALVATIASLVGLFASGEWKTLEGEMHAFSSGRLSYVMTLLWTAVSWQIASVGVVGLIFVVSSLFSNVISTLALPIIPVFAVIFFHDKMNGVKIIAMLMAIWGFVSYGYQLYISDKKARKTSVSVEENS

SEQ ID NO: 40565 - protein, 78 aa, Sorghum bicolor
  Clone ID: SORBI-28MAY03-C69859_1.pep
ENHELASIVLDYKRECGRDSVLQSHTSVQTDCNSESGETTLHCEHVLSLESGPTMVKARTMWRPKRTKAQETVVPSSF

SEQ ID NO: 40566 - protein, 153 aa, Sorghum bicolor
  Clone ID: SORBI-28MAY03-C6989_1.pep
MFGYQKGVDVEAGTSAATGGGARQLYPGMQESPELRWALIRKIYVILSLQLLLTAVVAAVVVKVRAIPHFFTTTNAGLGLYIFLIILPFIVLCPLYFYHEKHPVNLILLGLFTVAISFSVGLTCASAAGLVAPHPAVLATGLCDSGKPFVWVL

SEQ ID NO: 40567 - protein, 168 aa, Sorghum bicolor
  Clone ID: SORBI-28MAY03-C70140_1.pep
MEEDGSLAIQKVELNQVRHLVEDISCLFKGLDLRLMLCKKRILKNLDSEVENAVKSLVSAAIIDPNVKGGIRWPLGKESIGERFSIVGVWHTNYKAFRNETMRLKLRHADRFDHRSSTGEVSNEVTFKLTAISRKLEEDDPVENSVKEMLESAVQMIWDNALNYQIVP

SEQ ID NO: 40568 - protein, 209 aa, Sorghum bicolor
  Clone ID: SORBI-28MAY03-C70198_1.pep
MGIKGLTKLLADNAPKAMKEQKFESYFGRKIAIDASMSIYQFLIVVGRTGMETLTNEAGEVTSHLQGMFNRTIRLLEAGIKPVYVFDGKPPDMKKEELAKRFSKREDATNDLKEAVEAGDKDAVEKLSKRTVKVTAQHNDDCKRLLRLMGVPVVEAPSEAEAECAALCKNDKVFAVASEDMDSLTFGAPRFLRHLMDPSSKKIPVMEFD

SEQ ID NO: 40569 - protein, 141 aa, Sorghum bicolor
  Clone ID: SORBI-28MAY03-C71912_1.pep
ISVCSIDDPVNASFFESYESAHSMHDLTGSIAKKLGVQAPPVRIDSQAKYGALARGDGAIYLRFPHKGYREKIWDHAAGSIVVTEAGGIVTDAAGNDLDFSKGRFLDLDTGIIATNKNLMPSLLKAVQEAIKETNQASSLL

SEQ ID NO: 40570 - protein, 200 aa, Sorghum bicolor
  Clone ID: SORBI-28MAY03-C71856_1.pep
MALYLLFEVASGYALFHAYGIDEIGQSVDAVRASVLDLQRFGKAIKLTGFSPFSSAMDAINQCNAISEGIMTDELRNFLELNLPKVKEGKKAKYSLGVTEPKVGSHITEATGIPCQSNEFVQELLRGVRLHFDQFIDQLKKSDLEKAQLGLGHSYSRAKVKFNVNRVDNMVIQAIFLLDTLDKDINSISMRVREWYSWHF

SEQ ID NO: 40571 - protein, 218 aa, Sorghum bicolor
  Clone ID: SORBI-28MAY03-C72011_1.pep
MAAAAAGETPVGVGAPPSGPLYSFGPPRPELNQGLTYTAAFRCADADAVTTLIEFYSSKYKSSAPLPGWIKRIGNRQITVDGEVVTDPDMTLRDGSKLVYHRFPWQEPFAPYLLEVLYEDDDMVALNKPSGLQVLPKGLFQQRTVLAQLQLKDWKMASSCRSKRKDVQSHPVPVHRLGRGTSGLLLCAKTKVAKVRLASYFAEGAVLAAPAHQNHTLV

SEQ ID NO: 40572 - protein, 381 aa, Sorghum bicolor
  Clone ID: SORBI-28MAY03-C72030_1.pep
MAPIFAAASHASLLPLSHLDRPAAGRLVRGTLRPHTSGLRLRRPPGATGRGRGRGRGGIPDEWGERSPPGAPEPPAQPDPLIDDEDDSADGNSRPIVIDEWGEPGAPEPEPPSAADPPSPAADDEWEEEPEAPAPDPTPAPAAAEEDEQAVKREELKRCLVDTVYGSDLGFRASTEVRGEVVELVTQLEAANPTTAPVETSDLLDGNWILIYTAYSELLPILAAGATPLVKVKQISQEIDSKSMTIVNASTLTTPFASFSFSATASFEVQSPSRIEVQFKEGSFQPPVISSSVDLPQQIDIFGQKISLGPVQQALNPLQQAFASIAGSISGQPPLKVPIPGNNRARSWLLTTYLDKDLRISRGDGGLFILAKEGSPLLDLL

SEQ ID NO: 40573 - protein, 163 aa, Sorghum bicolor
  Clone ID: SORBI-28MAY03-C72087_1.pep
PVFDKLEAELAKAMLSLPASKGFEIGSGFAGTDFTGSEHNDEFYMDEAGNVRTRTNRSGGVQGGISNGEIIYFKVAFKPTATIGKKQNTVSREHEDVELLARGRHDPCVVPRAVPMVESMAALVLMDQLMAHIAQCEMFPLNLALQEPIGSASSASELEPNLS

SEQ ID NO: 40574 - protein, 217 aa, Sorghum bicolor
  Clone ID: SORBI-28MAY03-C72167_1.pep
CTQAVAATSLRGMVRREPCCHCIWSEVTGGSLAILHLEGYAADVDVPKSKVTSTGVTERSRQKTARAGAFVLTDGTTAAEPATGHPCPRVQKPRVSRSPPQGAPAPPASRGPCSRRAVARDGRRQGTLDAATRGHRRAARTHHGQAVPLGLGLQATTSGEMEREEGAAGAQGHHVEGRGEGGSSGGRAGRGRRCIARDRGRGRRRHRERRRARGIFF

SEQ ID NO: 40575 - protein, 320 aa, Sorghum bicolor
  Clone ID: SORBI-28MAY03-C7060_1.pep
TRVVVLSMALTPLLNEVGRRVAGIIDERSEEKEKPAEMVNYGATEPVVILGFGEMGQVLANFLSAPLSFGIEKDTEGWPYIAFDLNPAVVKSARKSGFRVLYGDGSRPSVLQSAGITFPKAIMVMYTGKEKTIESVNRLRQAFTAVPIYARAKDLSHLLDLKKAGATDVVLENAETSLQLGSILLKGLGVMSDDVSFLSKLVRDSMELQAQEALKDIGDQDVDIMKPLQVRVSDLVDSNGNSSRMVAQEQALSLSRRPDVKAIKPAVTNRIPDMKVENENPGYDFDRVESEDGVAYCLLESDDGSDEASSTSKEMIDQSA

SEQ ID NO: 40576 - protein, 161 aa, Sorghum bicolor
  Clone ID: SORBI-28MAY03-C70618_1.pep
MAPRQPLLPSFLYAASSPGGRDARPPVVVARAPSEPPFGKIEMFSPAYYAAGAIGGAAACGFTHAAVTPLDVIKCNIQIDPAKYKSTSSAFGVVMREQGLRGFFRGWAPTFVGYSAQGAFKYGLYEFFKKKYADMAGPEYAAQYKTVIYLAGSATAEVFAD

SEQ ID NO: 40577 - protein, 164 aa, Sorghum bicolor
  unsure (1)..(164): unsure at all Xaa locations
  Clone ID: SORBI-28MAY03-C707_1.pep
RRLRGSPAHPAAPSLPAGAPAPLRRAPLQPXPAAPPSRRTRRRRRSGAGRRSRACARGRTAPRRPPAPPXAVGAAGARVRVPPPRGAPVRRLXSRRAPPSPRRPAPRTSSPTSRARARPTPAPATVAGGTSPRRSSTPRQRASRSRRSSSSSLPCFLPRSAQLR

SEQ ID NO: 40578 - protein, 204 aa, Sorghum bicolor
  Clone ID: SORBI-28MAY03-C7072_1.pep
MASGEGVVDQLSGAAGGEAEAKMETEGEREGPVLYLDLTSYQLHDLSEVEIPPTLEEVDLTANRLSSVDPRIGQLPRLRKLSFRQNLLEDDAVAPLSSWETIAGLQELVLRDNKLTRIPDAGIFKGLLVFDVSFNEISSLTGMSKVSSKLKELYVSKNEVAKMEELEHLHALEILELGSNRLRVMENLETLTNLQELWLGRNRI

SEQ ID NO: 40579 - protein, 144 aa, Sorghum bicolor
  unsure (1)..(144): unsure at all Xaa locations
  Clone ID: SORBI-28MAY03-C70750_1.pep
MTRATHPPQPPPPPPAXPSRQPPPLPPPPPPAGGRPPGGARPGRPNGAGAPIEQAPRGELSLSRHQQCGPCSPYCRPPGSVPERQRVLRGAGRWSCNRGPQGVAPANGGPVSARHPPPADPPTAETWTSLPPRAMHYRHWPSHP

SEQ ID NO: 40580 - protein, 191 aa, Sorghum bicolor
  Clone ID: SORBI-28MAY03-C72380_1.pep
MSTRRQHRRGFPLVPLLLSLLAAAAYGRLISDGAPSAPLLSVIRLSGSPPAAAAGKAAEEKCEQSYGFLPCTTTVLGNLFLVLTYGFLMYKAATYLSTGSELLLEIMGPGLVGGLLLPILGALPDALLVLVSGLSGSKEEAQSQVLIGMGLLAGSTVFLLTLLWGTCVVVGKCDLGPNREAVDVTDTKGFS

SEQ ID NO: 40581 - protein, 221 aa, Sorghum bicolor
  Clone ID: SORBI-28MAY03-C7251_1.pep
MGRGASAAAYTAAALASAAAATVVALRLVHRHLLHYAEPTHQRFIVRIILMVPVYAVMSFLSLVLPHQAIYFNSIREIYDAWVIYNFFSLCLAWVGGPGTVVVSLNGQSLKPSWFLMTCCLPAIPLDGRFIRRCKQGCLQFVILKPILVVITFILYAKGKYEDGNFSVNQSYLYITIIYTISYSMALFALALFYAACRDLLQPYNPVPKFIIIKSVVFLTY

SEQ ID NO: 40582 - protein, 103 aa, Sorghum bicolor
  Clone ID: SORBI-28MAY03-C72524_1.pep
AQNYPPKIITCNQSKLLENQIMDKNKKEKSREHSEDKITYICHESQRAREGFGPSFPSQISTQTTRNFSVHEPLEREQSVGRKGKKNDRGGGWREVGEIGGEH

SEQ ID NO: 40583 - protein, 175 aa, Sorghum bicolor
  Clone ID: SORBI-28MAY03-C7257_1.pep
MVFLEAEMSWNVLISPSQLDRKGLLLRKAIIVRLLEDVTNRRASKEHGYYVAVSQLKAISEGKVRELTGDVLFPVSFTCITLKPMKGEVMVGHVDRILKHGVFLKSGPVESIFLAEKSMSDYKYIGGENAMFMNDHSKLEKDTAVRFKVLGFRWMEADRQFQLLATIAGDFLGPL

SEQ ID NO: 40584 - protein, 106 aa, Sorghum bicolor
  Clone ID: SORBI-28MAY03-C7258_1.pep
NPEFEDDPDLYVLKPTRPIGIEVWQVKAGSVFDNILICDDPEYARNVVEETWGANREAEKEAFEEAEKERKAREDREGQKAKDDGGRRRPRKKHYRDHWDDYHDEL

SEQ ID NO: 40585 - protein, 142 aa, Sorghum bicolor
  Clone ID: SORBI-28MAY03-C72587_1.pep
RICLRSDSLSMEAGGRGADKKNLNDQRDLFQRISDFIKSGECPEESLRISGKNGILRVTTWRESIQLNYMRRFLGRGFLKHSQDNDLLHEIFDIKIDRTENMSTTKKKMFRSEEEKGRALKLNKERRLAQERKQNILNEQYG

SEQ ID NO: 40586 - protein, 276 aa, Sorghum bicolor
  unsure (1)..(276): unsure at all Xaa locations
  Clone ID: SORBI-28MAY03-C71576_1.pep
MCSQAKHDMGGGEFRSSLLQQMVWSRRGGPAACSQLLRCLLPPPAVEPELPGPLGASSLVPPWSSPASMLRPLRLLPCSSGGLPLPLPPAMLNDSSATSDLHDGRESNMPESWSQLLLGGLVGDHERYNAATALLSKGLEEGPAAYNFYGHGHGGDEIQTSGTNSKSHQVSQTLLASSSPRSCITTSLGSNMLDFSNTTVPAPELKNHHSDNSSEGNSAASGSAPKKARVQTSSSAQSTLKVRKERLXDRITALHQIVSPFGKTDTASVLQGTIGY

SEQ ID NO: 40587 - protein, 152 aa, Sorghum bicolor
  Clone ID: SORBI-28MAY03-C71606_1.pep
ARGAVAAARAYDTAVFYLRGRSARLNFPDEIPSLSLSEGERGDGETDPAADGGGAGTLSAASIRKKAIEVGSRVDALQTGMMVPPPHHRERQRHHHHHHHHHHLPQLRVHAHAEEEHHQQEQKPSPQRPAWSGRVKNPDLNRAPSPESSDAE

SEQ ID NO: 40588 - protein, 121 aa, Sorghum bicolor
  Clone ID: SORBI-28MAY03-C71652_1.pep
LPPAILDLMPACPGLATAAAGLVADADPDQAARLFGVSIGLKRMRDEDDTGDEQADHGAGGEVKTEASDPQQQQHPSSSNEPSPDQHPWPIYRPTPVYHSMRPCNGPDQGAGSDQDGSNSR

SEQ ID NO: 40589 - protein, 161 aa, Sorghum bicolor
  unsure (1)..(161): unsure at all Xaa locations
  Clone ID: SORBI-28MAY03-C71741_1.pep
MVQERAAWGASDGGGNLVQDAVDYRGCPADKSSTGGWVAAALALGIELCERLSTMGIAVNLVTYLTGTMHLPSAAAANVVTDFMGTSFLLCFLGGFLADSFLGRYLTIAIFALVQAIGTGLLAVSTEVRQLXPPPCGSGAAGSCEQATGLQMGVLYVCLYL

SEQ ID NO: 40590 - protein, 98 aa, Sorghum bicolor
  Clone ID: SORBI-28MAY03-C71753_1.pep
SNNDHQKDYQRVHLDRKGSPATQQNRKGPRSRQQPTEAPTDPERNLVIKFPIYNLILFRGSGSLLADLCVCQRSHFRPLAHRKFSKISSFYNRDPLFI

SEQ ID NO: 40591 - protein, 186 aa, Sorghum bicolor
  Clone ID: SORBI-28MAY03-C73006_1.pep
MVAEAAPSSSSAIWSRRRDEITFDRLHKFWSALSPRARHELLRLDKQTLIEHARKNLYCSRCNGLLLESFTQIVMYGKSLLHEGSCEPRIQEVEAEEVQDPSVHPWGGLSTTKDGILTLLDCFINAKSLHVIQNVFDNARAREREREMLYPDACGGGGRGWISPVIPNYGRGHGTRDTCALHTARL

SEQ ID NO: 40592 - protein, 153 aa, Sorghum bicolor
  Clone ID: SORBI-28MAY03-C73031_1.pep
TCPRRVLSPRCLYGGPGPLCQSELLSFVDRVPRWFPWKELAIMPVQWHALALGLFASIIAPFGGFFASGFKRAFKIKDFGDSIPGHGGITDRMDCQMVMAVFAYIYHQSFIAPQNFSVEIILDQIIRNLAYDEQKYLYERLGEIFHERQLTQS

SEQ ID NO: 40593 - protein, 179 aa, Sorghum bicolor
  Clone ID: SORBI-28MAY03-C7313_1.pep
MSANGESGGDPAAARRRWDLTNKGPESTPMLKEAVEMSTDEESDGVVICHLNGNTDGCDETISGSRDDDSPEGQETNSIKDPDVQGDTQEDKCVNQDSLKLIDQEKSAPPKSPAKSATASSGSERPKRVVPQPFSLSTQRRSSGVNGGVTNPSANKDKSGDKSSISPASMTKKSTPVAP

SEQ ID NO: 40594 - protein, 169 aa, Sorghum bicolor
  Clone ID: SORBI-28MAY03-C73611_1.pep
MSEGPARSSTAESSSSAASSSGLDFEDTALALTLRLPGSDSDVRKRAASTSTPVAGRCSPRASASNEAPPAPKAQVVGWPPVSRNRRNAALPSRGKFVKVAVAGAPYQRKVDLEAYAGYDQLLAALQDKFTSHFTVRRRVGNDEMALVDVVSGAEYVPTYEDKDGDWML

SEQ ID NO: 40595 - protein, 245 aa, Sorghum bicolor
  Clone ID: SORBI-28MAY03-C73247_1.pep
PEEVRRHYELLVEDVDGIESGRVPLPTYAADGAAEEGGGGGGGGKKGGGGGGTHGDKGSAKSAEQERRKGIAWTEDEHRLFLLGLEKYGKGDWRSISRNFVISRTPTQVASHAQKYFIRLNSMNRERRRSSIHDITSVNNGDASTAQGPITGQTNGQAANPGKPSKQSPQPANTPPGVDAYGTTIGQPVGGPLVSAVGTPVTLPVSAPPHLAYGMHAPVPGAVVPGAPVNIAPMPYQKPPPSSHG

SEQ ID NO: 40596 - protein, 211 aa, Sorghum bicolor
  Clone ID: SORBI-28MAY03-C72190_1.pep
MAAPVSQPPVAARASTRFLPRGIGALPESAPASLRFSVGRRRRAARLEVKASGNVFGNYFQVATYGESHGGGVGCVISGCPPRIPLSEADMQIELDRRRPGQSRITTPRKETDTCKILSGTHDGMTTGTPIHVFVPNTDQRGGDYSEMAKAYRPSHADATYDFKYGVRAVQGGGRSSARETIGRVAAGALAKKILKLKSGVEILAFVSKVH

SEQ ID NO: 40597 - protein, 191 aa, Sorghum bicolor
  Clone ID: SORBI-28MAY03-C72264_1.pep
AMSNMGLFEAEMSSDSFQLLGMAEMGMIPAIFARRSKYGTPTFSILSFMSFQEIIEFLNFLYGLGMLAVFAAFVKLRFKNPDLTRPYRIPVGTTGAAVMCAPPVVLITTVMCLASARTVLINAAVVVAGVALYYVVEHAKRHAWVEFLAPVPPADSSHGSTTAPDAAADLEDVRAGLLSDESADEEGSKVE

SEQ ID NO: 40598 - protein, 291 aa, Sorghum bicolor
  Clone ID: SORBI-28MAY03-C7227_1.pep
PRALVAEVVLGRVSAGAATCVLSCLVTLVGRGFANSIPQTFSGWVGGSTFLPGISPPVGPSGRPGERKAPGVVAGIARANRLVPEAQGSARTLAHLSGSSAFSGHERSGPYFSKLCLKILELIDKDGDSDTSVKIAAISSLETLAKEYPSDNPVYSNCLATIIDQIGSDEAAVSSALIHTVGSLINVVGSKALPQLPLIMKNIMLISHQISCCPSGNYAHGSTRTAAELSNQDIAVLLSALTTIEVIVEKLGEFVNPYLKEILDLVVLHPECSTQMLPKLDAKAAHVRDLL

SEQ ID NO: 40599 - protein, 285 aa, Sorghum bicolor
  unsure (1)..(285): unsure at all Xaa locations
  Clone ID: SORBI-28MAY03-C72280_1.pep
MLRSPPLPVPLRPSAVRASPLPPPRPRAANPNTESTTTTTAAASADRAATMGAAAWWRRALGQRFNPTGVAAVAAVAASKPSLALPHVSVQDIRWLDWAELRRAGFRGVVFDKDNTLTTPYAPALWPPLAATFDQCRATFPPGALAIYSNSAGLTEYDPDGLDARAIEAAIEGVHVIRHDTKKPGGPANEIESYFGCSASDLVLVGDRYFTDVVYGNRNGFXTVLTDPLNIADESYIVKRVRKLEAYIINYWYKKGYKPMEHPLLPDARRMVKFDPYDDSVTTRI

SEQ ID NO: 40600 - protein, 382 aa, Sorghum bicolor
  Clone ID: SORBI-28MAY03-C7423_1.pep
MAAATAAARRVLCARAVLAACLGAAPRGADALRSLGVGGDKAADGDTAVDLDASNFTAFLQASPESFAVVEFFAHWCPACRNYKPHYEKVAKIFNGPDAAHPGTIVMARVDCASKVNVELCNKFSVDHYPYLVWGPPTKFNLAQWKPKQENSELELIDDARTADRLLKWINKKMGSSFNLDDKKYENESMLPKNASDPEQIVRAIYDVEEATAHALQIILEHKMIKPDTRDSLIRFLQILVAHHPSKRCRRGSAELLIDFDDHWHTNLSSLQDSSTLLKSAGEKICGNGVPRGYWIFCRGSKKETRGFSCGLWVLLHSLTVRIGDGESQTTFTSICDFIHNFFICEECRTHFYEMCSSVSVPFKSARDLALWLWTAHNKVNE

SEQ ID NO: 40601 - protein, 277 aa, Sorghum bicolor
  Clone ID: SORBI-28MAY03-C74273_1.pep
TRPDLTHLQYFYELDLSNNNFSGAFPDSVVPLGGLLFLDLRFNRYAGTVPAPVFALTVEALFLNNNGFGGRIPDTFGSTGAQYLVVANNQFTGPIPRSIYNTSATLSEVLFLNNRLSGCLPYEVGLVEGLAVFDAGGNEITGPIPLSFGCLRDVEELNLASNQLYGQVPDVLCLLARNGKLGNLSLSENFFHSVGHHCMELVRSRVLDVRRNCILGFPDQRPPLECAAFYADPTKHCPFIPHIPCDLPGYKPPHPHAAAEDAAPAHGHPHQGQGGGN

SEQ ID NO: 40602 - protein, 190 aa, Sorghum bicolor
  Clone ID: SORBI-28MAY03-C74375_1.pep
ATELAVTNGASSPMALTCAVPNHLRVSTPDATYALGLLGSDYRSVEPALSEFSIIPPDYGAVQQSAAGTAARHRWANRGLDMILSGGQDRGAADEPDGEEDDDYKHMTDVMCRVYSNAPKEFTIIDRGRRNSVRLHRKGFEELYVFSPGSQYQWYGKYAYVVVGPAMLEPVMLGPGDTWQGAQHLLNPNL

SEQ ID NO: 40603 - protein, 197 aa, Sorghum bicolor
  Clone ID: SORBI-28MAY03-C74376_1.pep
IKFGSASFFDFKRLVFDNITIVDAHRGLGMQIRDGGNVSDVMFSNIKMSTRYYHPLWWGRAEPIYITTCPRHPDSKEGTISDIRFINISSVSENGIFLAGSKHGLLRNLKFKNIDLTYKRWTNYTGGLYDYRPGCQKMVKHKTGGMMLEHISGLEIDNVRMRWARGSLKGWNVNPILFRPSTIDKLSFHDWQSVDVQ

SEQ ID NO: 40604 - protein, 145 aa, Sorghum bicolor
  Clone ID: SORBI-28MAY03-C74543_1.pep
QIAAEAIMTFMSIIHSIVVQQSQERQLKKKSDNMDSKFQTQLEKHSENAMQNSAQPPNKNHYSVSKNETKLDAFRKQVEEEKARYLTSVRVSRAMTLNNLQTSLPNVFHALVGFSGMCVQAFEGISRCSEVAVIHSGAASPAICS

SEQ ID NO: 40605 - protein, 114 aa, Sorghum bicolor
  unsure (1)..(114): unsure at all Xaa locations
  Clone ID: SORBI-28MAY03-C74605_1.pep
TTTTISRWLLRRMCWRTXVSXXVCVSISSSSSTTTTAATTIVPLPRRRLLTLVLTITTHVEGVTVVHMLLANVPKIKLGLPLHTHRGSKKLLDEASAELVELRPVCLGLGDAVL

SEQ ID NO: 40606 - protein, 221 aa, Sorghum bicolor
  Clone ID: SORBI-28MAY03-C72659_1.pep
LLEVHLLPPKLSRGPHHPSSSAGSAAMAIVALLQPWSLLGFLAALMALWWACRVLESTLIVPRRLGRALQSQGLRGNAYRFPFGDLKELARLAMAARAKPMPLSHDITPRVNRLYYNLIREHGKISVTWLGPTPRVIVNDPKLVREIMANKLGHFQKRKHTGIVRQFANGLVNHEGQKWAAHRKIINPAFHLEKLKKMLPAFAACSNELITRWVGYVESDG

SEQ ID NO: 40607 - protein, 145 aa, Sorghum bicolor
  Clone ID: SORBI-28MAY03-C72729_1.pep
REEDYPYNGRDSTCKFDKSKIVAQVNNFSVVSVNEDQIAANLVKHGPLAIGINAVFMQTYIGGVSCPYICGRHLDHGVLLVGYGSAGYAPIRFKEKPYWIIKNSWGENWGENGYYKICRGPHVQNKCGVDSMVSTVTAIHSSKKE

SEQ ID NO: 40608 - protein, 245 aa, Sorghum bicolor
  Clone ID: SORBI-28MAY03-C72767_1.pep
MEGGGAEQAPEAAAEVKNPRCFMDVTIGGEMEGRIVVELYASVAPRTAGSVRARGPGGGRVGAASAWPLRFAGSGFLRALHEFMVQGGDITAGDGTGGESIYGSKFEDENFVLKHERKGMLSMANSGPNTNGSQFFITTTRTPHLDGKHVVFGRVIKGMGVVRSIEHVTVGESDCPTLDVKIVDCGELPEGADDGVVNFFKDGDTYPDWPNDLEEKPAEVSWWMDAVESAKAYGNDNFKKQDYKA

SEQ ID NO: 40609 - protein, 422 aa, Sorghum bicolor
  Clone ID: SORBI-28MAY03-C72798_1.pep
DAPVTSKHPPVVFNEQNTVKVSTEQKTHIEPKTHTGGVIISSSIVPTEGTVVTVGSITVGGISLKPVNQEPVKSPDGTNSIESSRPRPQQARKSGKHQHVLRPIEKPHGNDGVLWAPVKPPLQNEQSDGAMPNAAVADLTQPSGKAINDGENVTRTKRAEMERYVPKPMSKELQQQNPSHDKEAIDKPSAAKSDAAAEPKKTSKGHGGKYNPSWRKRNPNESALVAPDSVEQADSSYESKEVQNCSDQNQPVELGKQDTQVKSNADAAAENSSAPAQTVTLLAGGAKEHSAANRQRRQHVKAQRNEASSYSNESKGREGKNDVVSATSVMDSSSSNHRNVPRSDVKGSGVVSHSRAWKPKANSHPQNSSDGKIAVEGPVESHGGGLEISMSKGSDTTTHQDTSTKPMKRSDGADEVSHSKQE

SEQ ID NO: 40610 - protein, 88 aa, Sorghum bicolor
  Clone ID: SORBI-28MAY03-C72806_1.pep
MGLRDIELTLPPGFRFYPSDEELVCHYLHGKVANERLAGAGAAMVEVDLHTHEPWELPDVAKLSTNEWYFFSFRDRKYATGLRTNRAT

SEQ ID NO: 40611 - protein, 194 aa, Sorghum bicolor
  Clone ID: SORBI-28MAY03-C75065_1.pep
MKSTGIGSCLVQPHIRKSCKGAMSTHLKGSSCRERQGEREGGARTKPRKNDERSSEATRMRPCQGGTSIGAPGGGRCGGAVAVDGPHRSGRTACTHLRRAGGLAGEGQTLDREGEEEGRGADAEVAAIRRPRHRSPRRTPASGASEGGRRKRKQRRGGDGSGGGGGGVAGTVGGVASDAVASGETKRAREASAF

SEQ ID NO: 40612 - protein, 179 aa, Sorghum bicolor
  unsure (1)..(179): unsure at all Xaa locations
  Clone ID: SORBI-28MAY03-C75143_1.pep
KGYLKAAELDPSNENVRQNIEVAKKKLAEQRVPPEXAGSSPGQEFFAGWSSDIGAPPPGHSISINLNDIFGQASVNAGGQGSSQTGNSNNHTPPASFPTGAAVPPPFAFSGSGNEGTQARQASNGHEGEHGEPGVHRDDGIHINVAGARPEQAAEALRAVMQMLGPHMTPHEGAPRGPG

SEQ ID NO: 40613 - protein, 86 aa, Sorghum bicolor
  Clone ID: SORBI-28MAY03-C75225_1.pep
RSFHNCRTLWFASKSINSMCLLDQGRHCSMDTIRICCRPLQDGVSSEGEDLSLDSTRMITKMKTSLLKWISVRNSEGAASTGLQVA

SEQ ID NO: 40614 - protein, 217 aa, Sorghum bicolor
  Clone ID: SORBI-28MAY03-C7528_1.pep
DFREAYAWLSHNTDVDDKVASWWDYGYQTTAMANRTVIVDNNTWNNTHIATVGTAMSSPEKAAWEIFNSLDVKYVLVVFGGLVGYPSDDINKFLWMVRIGGGVFPHIKEPDYLRDGQYRVDAQATPTMLNCLMYKLCYYRFVETDGKGFDRVRGYEIGKKHFKLTHFEEVFTTHHWMVRIYKLKPQKNRVRGKLKKLKASAKTSSTLAAGQKKNPWQ

SEQ ID NO: 40615 - protein, 114 aa, Sorghum bicolor
  Clone ID: SORBI-28MAY03-C75584_1.pep
MASSRVMPSSSPSHTASDLARLAQAASRPGGGGGGSGLGSMNVEELLRGIYGEMPTPAPPASEPERPMSPAPAPEIATRKTAEQVWKEITGGGATGEAVAPGAAQAAVPAGAGG

SEQ ID NO: 40616 - protein, 189 aa, Sorghum bicolor
  Clone ID: SORBI-28MAY03-C75478_1.pep
MAAASDSDAGAQQPRDDPSLLPFASFSLALSIRAPATPTLASVPSTIHLPTQISTLAVCLHPSAAQAPSRRPTRLNSATSSVIAPLPSSTPGLSRSFPSGAPAAAGRRRTLVWFRADLRLHDHEPFHAAAGASSSLLPVFVFDPRDFGKSPSGFDRTGPYRANFLLDSVADLRRSLRARGGDLVVRVGR

SEQ ID NO: 40617 - protein, 170 aa, Sorghum bicolor
  Clone ID: SORBI-28MAY03-C7367_1.pep
MATLSMVSVPVAPSSLSLSTRGRTSSVSLPAKKGGIGHGGLRIECIRIGGVEIPNHKRVEYSLQYIHGIGRSRSRQILLDLNFDNKITKDLSEEEVITLRKEVGKYMIEGDLKRFNRVAIERLKEIRCYKGIRHKLGLPVRGQRTKNNCRTLKGKRASVAKKKSPASQDE

SEQ ID NO: 40618 - protein, 145 aa, Sorghum bicolor
  Clone ID: SORBI-28MAY03-C73927_1.pep
RWQARIGRVAGTQALPPGAKGTRAEAAEAYEQAAQQQRGPAAATEADGSGEDVDFTMGTSSHSSSNTGSGVMWGTTTGAMGQQDSSSSKQGNGYASNIPYAAAAAAMVSGSAGYEGSTGNNGTWVTSSTSTSTAPQYYNYLFGME

SEQ ID NO: 40619 - protein, 194 aa, Sorghum bicolor
  Clone ID: SORBI-28MAY03-C74063_1.pep
MAAMPAPAAGLAILVLFAAALPALYADDLNSDAQALQALRSAVGRSALPSWNSTTPTCQWQGVTCESGRVVELRLPGAGLMGTLPSEVLGNLSALRTLSLRYNALTGPIPDDVSRLSELRAIYFQHNSFSGDVPASLFELKNLVRLDIAGNKFTGEISPDFNKLIRLGTLYLDGNSFTGAIPKLQLPALEQFNV

SEQ ID NO: 40620 - protein, 212 aa, Sorghum bicolor
  Clone ID: SORBI-28MAY03-C74202_1.pep
QLHQSPIPYYPTSGHGAPPLELLISRPKHLVPPIRAPQHSLSTKPQRPQRHRQKGLPMYRNPQPGYRDRPNLTPSTPPKRRLCSRNLDLPSPRLHRRCRGSTPRHGARRRRRVVETSRVGSRGRRRWQGPHPWLAAPSEATTTARKAGSRARAVESKAWVWGSSSSSRLGEMAARLMGKGKRKRGRINGEGKMQLGPEEVRRRAGSVVRSEA

SEQ ID NO: 40621 - protein, 175 aa, Sorghum bicolor
  Clone ID: SORBI-28MAY03-C74189_1.pep
MVCVGSKAIRPKGSTGNGLGDGALDDSSHKKRARKDKSEKPRKGGHSSSKGPSVGKPQHGKDRKQSSDDGKKGKRRGKDHHSGSSVMVNPRTRNLNNQDALPSSITSKPVQNVLRKRVDPETAKYFMEISNLFDNKEIDCEERSTICANALEESRGKELELATDAVISHTLQVLI

SEQ ID NO: 40622 - protein, 92 aa, Sorghum bicolor
  Clone ID: SORBI-28MAY03-C76525_1.pep
YAAVSCRSLLVTNDEMRDHLFQLLGTSFFPRWKEKHQVRLTFSGRGPTLHLPPPYSIVIQESEDGSWHVPTTTGDDIEKPRQWMCTTRKSSK

SEQ ID NO: 40623 - protein, 126 aa, Sorghum bicolor
  Clone ID: SORBI-28MAY03-C76643_1.pep
EGAGTGGAIAYFRSILEPVKVWVLTSLALVLPGYISFALAMFPIVAVKPARHWLVSVHWVVAPLFGSRDPLIRAPARVRYVTLNRTFSCNKAFEELGYKPIVTLQDGLRKAVKLYIQLSNKDLSKR

SEQ ID NO: 40624 - protein, 163 aa, Sorghum bicolor
  Clone ID: SORBI-28MAY03-C76679_1.pep
MGRGSAMAQALALVALLLACSDVAVVAAQETERIQGSAGDVLEDDPVGRLKVYVYELPPKYNKNILAKDSRCLSHMFATEIFMHRFLLTSAVRTLNPDEADWFYTPVYTTCDLTPWGHPLTTKSPRMMRSAIQYISKRWPYWNRTEGADHFFVTPHDFGACFY

SEQ ID NO: 40625 - protein, 137 aa, Sorghum bicolor
  Clone ID: SORBI-28MAY03-C76757_1.pep
LPPIQQPGQAHPQIRPGMHNVPPVAAGPGHHYAKPRGPGGPSRYPQGGNQGGGYNPNRGGQGGGYGSGPYPQQGRGPPYPGGGMGGAAGPRGSGASGYGASGPNYQQGGPYGASGPGRGPNYSQGGSRNQQQYGNWQ

SEQ ID NO: 40626 - protein, 244 aa, Sorghum bicolor
  Clone ID: SORBI-28MAY03-C76851_1.pep
MAVAAPGQLNLDEAPSWGSRSVDCFEKLEQIGEGTYGQVYMAKETGTNEIVALKKIRMDNEREGFPITAIREIKILKKLHHQNVIKLKEIVTSPGPERDEQGKPIDGNKYKGSIYMVFEYMDHDLTGLADRPGMRFTVPQIKCYMRQLLTGLHYCHVNQVLHRDIKGSNLLIDNEGNLKLADFGLARSFSSDHNGNLTNRVITLWYTPPELLLGSTKYGPAVDMWSVGCIFAELLNGKPILPGK

SEQ ID NO: 40627 - protein, 141 aa, Sorghum bicolor
  Clone ID: SORBI-28MAY03-C9431_1.pep
ASEKALVAGLGGLNLFGVIILGNLLKQMTVTPGGLISFAAQLYPLLQIYAGSFFAIPLFRWFLLRKTNNDIRKRNKAREQRAQELVSPDSSLRRKWLSARDMAERKVITPEEIVYTTEKDLLEQDYEVKEWERRFKELESE

SEQ ID NO: 40628 - protein, 195 aa, Sorghum bicolor
  Clone ID: SORBI-28MAY03-C9419_1.pep
MACSFSPSSSATRLQAVDAAAAAAVGVKNGRVPLNLKASVAPAQRSLGLGCCRATARQEGATQEPNVAVSSARAQLDLLEQLTSPTPDGIAGLENGVPTESRQRATIRQQLSALANGKVVDEFTLPLGRKLKEGLKSLNKLTVSQRRNIKRQALLTQVSGRDDSVFFATVGAFVLVPPFAILAIAVITGYVQLFP

SEQ ID NO: 40629 - protein, 199 aa, Sorghum bicolor
  Clone ID: SORBI-28MAY03-C94558_1.pep
MGRTMKPLACLAWALSLINVVMAADYVVGNPGGGWDGRTDYKSWSAAQTFAPGDSLTFKYNSYHNVLEVTKDAFEACTTTDPIFYDNSGSTTIALTMPGTRYFICGAPGHCLGGMKMVVQVADRPAPTTPSSPPALPPAPPMPSAPAPAPAAAPPRRAGHKKHKKRYCPPENLHAPAPAPAPTVQAAEPDFPLAMFAPD

SEQ ID NO: 40630 - protein, 323 aa, Sorghum bicolor
  unsure (1)..(323): unsure at all Xaa locations
  Clone ID: SORBI-28MAY03-C9514_1.pep
TRERRVRAVIDKFAERGLRALGVAYQEVPDGRKESPGGPWQFIGLLPLFDPPRHDSAETIRRALHLGVNVKMITGDQLAIGKETARRLGMGTNMYPSSALLGQNKDESIASLPIDELIEKADGXAGVFPEHKYEIVKRLQARKHICGMTGDGVNDAPALKKADIGIAVADSTDAARSASDIVLTEPGLSVIISAVLTSRAIFQRMKNYTIYAVSITIRIVLGFMLLALIWKFDFPPFMVLIIAILNDGTIMTISKDRVKPSPQPDSWKLAEIFATGVVLGGYLAMMTVIFFWAAYKTDFFPRLFHVESLEKTAQDDFQKLASA

SEQ ID NO: 40631 - protein, 134 aa, Sorghum bicolor
  Clone ID: SORBI-28MAY03-C9552_1.pep
KELIKNLYNKLQLEKQASKEKISFGRFEVHELAVFFRNPAGHYEAINRNCSNYYLSEESVALFTEHHPVHPAYIIGQIVHIERRIVHPGQMGGAPRRDSSGGRRSPASMLNPYNLPGGCEYFVVTVAMLPDAAR

SEQ ID NO: 40632 - protein, 165 aa, Sorghum bicolor
  Clone ID: SORBI-28MAY03-C77447_1.pep
MVGMYQHQLRDDPLGTLGGGHCGDQPRIAGGGASSSSSSSLSSSPSAVLAPLPAEAHGGGEPRQRFEALADGGSVLRGAGGGKGGVVGGDLGVLVRWMRELAADPVAPLPAPSEHRPRKRHVLALRRARYLRLEDVEDAEELPSFYKKRKLYWDKQKKKGCLNMP

SEQ ID NO: 40633 - protein, 95 aa, Sorghum bicolor
  unsure (1)..(95): unsure at all Xaa locations
  Clone ID: SORBI-28MAY03-C7745_1.pep
XKRQLMDPVDRAAMQRQKRMIKNRESAARSRERKQAYIAELESLVTQLEEENAELLREQEERHQKRLKELLERVTPVILRKKPSRDLRRTNSMQW

SEQ ID NO: 40634 - protein, 90 aa, Sorghum bicolor
  Clone ID: SORBI-28MAY03-C7741_1.pep
ARDATSGGFPNTPSTTPPQYAASGGFPSTPSTAPPQYAASGGFPNTPTGAPPGILPQQLHTSQQMPPQHENQSRGTPGTSQPPPSASYYR

SEQ ID NO: 40635 - protein, 122 aa, Sorghum bicolor
  unsure (1)..(122): unsure at all Xaa locations
  Clone ID: LIB3476-038-P1-K1-G11.pep
IENMQYAVTVDVLHTVFSSFGTVQKIAICEKNGGTQAXIQYPDVNTAAVAKEALEGHCIYDGGYCKLHLSYSRHTDLNVKAHGDKSRDYTIPAGVTQGVPQPPGVQATSFGWQGNLQAAGAY

SEQ ID NO: 40636 - protein, 94 aa, Sorghum bicolor
  Clone ID: SORBI-28MAY03-C775_1.pep
QIIERLEQGELKLRVRTLESERAFQRVAAVQKTIGYGVAAGSLVNLATMLYFNSIRGPATIAYSLCAFFGLQVLIGLVKVKKLDRQERLITGTA

SEQ ID NO: 40637 - protein, 194 aa, Sorghum bicolor
  Clone ID: SORBI-28MAY03-C77584_1.pep
MAPPPATVAAVRHHSPHLLLRRGGGGLLPPPPAPATLPFATRGVASAPARLRLPPPRFSLSPVPKSLSASSSSHVPVRSLFTGIVEEVGRVRRLGPPLAPSSGGGGGEAPGLDLEVETRDLLTRTQLGDSVAVDGTCLTVAAIDPAASTLTFGVAPETLRRTSLGGRAPGDGVNLERALTPSSRMGGHFVQGHV

SEQ ID NO: 40638 - protein, 317 aa, Sorghum bicolor
  Clone ID: SORBI-28MAY03-C75695_1.pep
SAGAVSGCGLTSRRRDLPFKRRAMAQLREYRMTMTSKDGLGDEGDYWWSLSLSRMHTFFRQVNILICLLLHRLMHMAMSRIHMFLSVDSGRPLSSRGSSEEQGVSKIYVLSEQPMPPLLLILWLDSGATHHAVGDARILCNLRDPPAGTAVRAADGVRLLVHKIGDILTQCIKIQDVYLVLGLQENLISVRQLAKDKKIVTIFYENYAELWREGKMVGGAIADNVTSLYQLRYLTMPTGDPEAGTSRYIREEAMDVATAREATNRSSFLQLLSLSNSTSTETKMIHACIHVLSNCYKSEDGLRVQNMFSAAAADSTY

SEQ ID NO: 40639 - protein, 62 aa, Sorghum bicolor
  Clone ID: SORBI-28MAY03-C7531_1.pep
LYSTVTPLPKKLILRKLILRGILFFILQASDLNIQHIIFVLFLGRSSRTEVFIHTLYLHILT

SEQ ID NO: 40640 - protein, 79 aa, Sorghum bicolor
  Clone ID: LIB5051-002-A1-XP1-A5.pep
VYTINDSLTKKIHILKITIQYCNTTPKKLILRKLILRGILFFILQASDLNIQHIIFVLFLGRCSRTEVFIHTLYLHILT

SEQ ID NO: 40641 - protein, 70 aa, Sorghum bicolor
  Clone ID: LIB3476-035-P1-K1-E9.pep
KIHILKITIQYCNTTPKKLILRKLILRGILFFILQASDLNIQHIIFVLCENVECFIKNIFRKICDLPMNL

SEQ ID NO: 40642 - protein, 62 aa, Sorghum bicolor
  Clone ID: SORBI-28MAY03-C76020_1.pep
ALPDNAMLIVCTGHGDTPLVQRLRKMLHHEEETIASRETIVQALGDLQAQAEVALCFCCVKH

SEQ ID NO: 40643 - protein, 73 aa, Sorghum bicolor
  Clone ID: SORBI-28MAY03-C76081_1.pep
TYFVISIRSLMYDLSLHLLIFFSAGVRCVLCSWLRLYPCLWCCSSYGNCRQNVGLHSTIQYISQDSEMCMVHC

SEQ ID NO: 40644 - protein, 212 aa, Sorghum bicolor
  Clone ID: SORBI-28MAY03-C76199_1.pep
MEKGSSGLSCRAAVCGVVVLLTVIAFSCSLAAEFHKVKEKDMKLDGSLCSLPKSSAFELGVAAIAFLFVAQLVGTTAAVTTVLAGKPKKSSAARGRAAFVALLVLSWLSFAVAVILLATAASMNHGQRYGRGWMDGDCYVARSGVFGGAAALVVVTALITLGLTFATESAAAAGAMATTPASSSSSSATCTRRTHLDAASADAEQPGGRSKQ

SEQ ID NO: 40645 - protein, 157 aa, Sorghum bicolor
  Clone ID: SORBI-28MAY03-C76492_1.pep
AAAYAAMATARAGKAARLRDRRVVDVEYKRIPCEYAKDRNLSIRVEEKSRPPSDLSIRFLYQGGQTDIVAVDVATVGSSNWRFMTRDHGPAWSTAQAPAGPLQLRLVVTGGYDGKWVWAESEVLPRRWEAGRVYDTGVQVSDVAQEGCYPCDTHQWQ

SEQ ID NO: 40646 - protein, 191 aa, Sorghum bicolor
  Clone ID: SORBI-28MAY03-C78371_1.pep
TIKESIARYNDVALAAKEKEIPVRGYVSCVVGCPVDGPVPPSNVAYVAKELYDMGCYEVSLGDTIGVGTPGTVAPMLEAAMSVVPVEKLAVHFHDTYGQSLSNILISLQMGVNVVDSSVAGLGGCPYAKGASGNVATEDVVYMLKGLGIKTGVDLGKVMAAGEFICKHLGRQSGSKAATALSKVTANASKL

SEQ ID NO: 40647 - protein, 216 aa, Sorghum bicolor
  Clone ID: SORBI-28MAY03-C78388_1.pep
MLAAPTKVGSRLASPHASSSASAAAAVATALASSPVLGSGSGVLSGAGFGETGSHHAADAPPPPPPCSSSGDSREYCQRKRLVNQRQSTLQGGKVTAALGDHVSGARCSSWSQHINRYFSSSSHQGRIWAGSKVLHDLPQYVKIVEVGPRDGLQNEKDIVPTPVKVELIRRLATSGLPVVEATSFVSPKWVPQLADAKDVMEAVRIIEGVRLPVLT

SEQ ID NO: 40648 - protein, 107 aa, Sorghum bicolor
  unsure (1)..(107): unsure at all Xaa locations
  Clone ID: SORBI-28MAY03-C78605_1.pep
IHWIRSKSKHETSKQRRRRAGRGVVAAPASAHRGALLHLRAQAPAAAARGGHLRRGVVPVLVLPRAAPALLLQEAAAGGARVHLRRPRASRRRGRGRRRQRRXRRCR

SEQ ID NO: 40649 - protein, 119 aa, Sorghum bicolor
  Clone ID: SORBI-28MAY03-C78645_1.pep
ERAISDMQGEARVSIPLVVFGHMHKSLAYGRGLRKMIASGANHTIYLNGAVVPRVKFSKTIPRYEQNQPEGPGSVAPARGAFTIADLSEGRVEKISEVWVLVSGARTEVEEEIVLYKHP

SEQ ID NO: 40650 - protein, 194 aa, Sorghum bicolor
  unsure (1)..(194): unsure at all Xaa locations
  Clone ID: SORBI-28MAY03-C78656_1.pep
QIHQPPLPREGIPTLVTWSQGGNEVFLEGSWDNWTSRRALKRSGKDHAILLVLPSGVYHYRLVGXGALCLFPHPPLAAVERRRAADLLVARDYVPESLDSVAEFEAPPSPEHSYDLQYPGDEEFAKEPPTLPPQLLMSVLGDTDNTDNQASKPQHVVLNLLXEGWGSQSLLALGVTHRFESKYVSFVLYKPLKR

SEQ ID NO: 40651 - protein, 164 aa, Sorghum bicolor
  Clone ID: SORBI-28MAY03-C76902_1.pep
FNPKTLSIEPTLLLNPPLDSDIMTEEIFGPLLPIITVKKIEDSIKFLKSKPKPLAIYAFTRNEKLKQRIIDETSSGSVTFNDAIVQYGLDSIPFGGVGHSGFGQYHGKYTFEMFSHKKAVLKRSLLVEFMFRYPPWDETKIGMLRRVYRFDYVSLFLAIVGLRR

SEQ ID NO: 40652 - protein, 243 aa, Sorghum bicolor
  Clone ID: SORBI-28MAY03-C76907_1.pep
MPALPPGDPAVPVSGLPIFPTHAVVLPGGATRVPEGVRPLTGVFHALGHFQLDGIPPAPAGGPPVQAAVVSDPGGVLVLGARVLAAAHPSLGPVTAGGGRPALVPSDTTVPVAELQILAADSQNQPGVAMHGLERDCPSTKHTLSLGRFSVDGGPPAPGRLPRMGVACVLGADGISDAGAGAFAPGKSNKITITNAMGSRSYQGVGQLLRAAGCRMPRAGGLPGGIVAGSGRDRAGPSAEQAV

SEQ ID NO: 40653 - protein, 148 aa, Sorghum bicolor
  Clone ID: SORBI-28MAY03-C76967_1.pep
VYEMLRMQPPVPLQFARARRDFVLQSHGGAAYQVTKGEVLCGYQPLAMRDPEVFDRPEEFVPERFLGDDGARLLQHLFWSNGPETEQPAPGNKQCAAKEVVVDTACMLLAELFRRYDDFVVEGTSFTKLVKRQPSPSLSPAAAAGAQQ

SEQ ID NO: 40654 - protein, 208 aa, Sorghum bicolor
  Clone ID: SORBI-28MAY03-C77118_1.pep
MEAQNGAGGGAPVVLNVYDLTPMNNYLYWFGLGIFHSGIEVHGMEYGFGAHEFPTSGVFEVEPKSCPGFIYRRSVWMGTTDMSRAEFRSFIENLAGKYNGNTYHLISKNCNHFTDDVCKNLTRKSIPGWVNRLARVGSFFNCLLPEGIQVSTVRHVPTHPAFSDDDMDSVSSSIIGDSDLEELDQHLLPSTTDAHSIDVPPKLAKDLL

SEQ ID NO: 40655 - protein, 178 aa, Sorghum bicolor
  Clone ID: SORBI-28MAY03-C77158_1.pep
MGRSPCCEKAHTNKGAWTKEEDDRLVAYIKAHGEGCWRSLPKAAGLRPRGAARRPRRTDYLRPDLWRAHFPRELLGRGIDPLTLRPIAGARAAAGPPGSSHPDIPNAAVAPLPPQLLPSGAVATAVVKVPRCPDLNLDLCISPPCQQKEDEELDLKPAVVVKREVLQAGHGGSLCFGC

SEQ ID NO: 40656 - protein, 192 aa, Sorghum bicolor
  unsure (1)..(192): unsure at all Xaa locations
  Clone ID: SORBI-28MAY03-C7932_1.pep
AIAYIYTLIFVTVPSMASVYNEYALKSQYDTSIYLQNLFLYGYGAIFNFLGILGTLLFQGPESFNILRGHSHKQXLICNFFSKYLSYSSXTCMNSYSFSVSTILTGLASAAFLGHTLTINFLLGISVVFISMHQFFSPLAKVKDDKPADLIELEDTQNHRSSESSFVNMTAGAADDASHRIGTDERQPLLPT

SEQ ID NO: 40657 - protein, 118 aa, Sorghum bicolor
  Clone ID: SORBI-28MAY03-C7941_1.pep
MDRDGRPGWLPSMGFAFLSFNCGMAVYRSWDDPYTVAFVLAAYAALVLLFRCLHLLERRRDHRLKLAVWALSTLLTLMFSYKVAAMMPPWAQLLVWALGILTIVAGFYAFFVARPEEP

SEQ ID NO: 40658 - protein, 142 aa, Sorghum bicolor
  Clone ID: SORBI-28MAY03-C79628_1.pep
MPMAAAKALREVARTRRGSWAAVVGRRCLSSGSGGPAAERKEGGGGGAKAVNLFTAVNQALHIALDTDPRAFVFGEDVGFGGVFRCTTGLADRFGKNRVFNTPLCEQGIAGFAIGLAAMGNRAIAEIQFADYIFPAFDQIVN

SEQ ID NO: 40659 - protein, 194 aa, Sorghum bicolor
  Clone ID: SORBI-28MAY03-C79633_1.pep
MGAGTNGLSNGASAAAGERADDGTTVFRGTAYSPLRTTVALALWLGAIHFNAFLVLASLFLFPRRVAALVLATQLFFMFVPLNDKSRLGRKIARFISKYVIGYFPVTLHVEDYGAFDSNRAYVFGYEPHSVLPIAVGILGDLVGFMPLPKMKILASSAVFYTPFLRQIWTWLGLAPASRKSFYSYLGAGYSCII

SEQ ID NO: 40660 - protein, 143 aa, Sorghum bicolor
  Clone ID: SORBI-28MAY03-C7960_1.pep
APSAVDPRLGPSVVRRPRERRPRSPTATAPSLSALRDTVVLDRYCPCVPLHTSLPPMPMPSEAKFRAWGSGAPRVPPPLPLGGGRALPPGPCHPLRGGRRGPPRPPRRRQGIPSVLHTHGASPSACRGLRLLAPGCARVLAHW

SEQ ID NO: 40661 - protein, 100 aa, Sorghum bicolor
  Clone ID: LIB3476-042-P1-K1-B2.pep
TNMQRHRKLEGTKGMTLTSSRGRCVQLGEVVRQFLSLDIQVPGGRDRRDGACCGQEQSSHGRRSRTGLARTVTNEDDSAAEGAQGRSCRGWRSRTTLSRT

SEQ ID NO: 40662 - protein, 202 aa, Sorghum bicolor
  Clone ID: SORBI-28MAY03-C7967_1.pep
RSYPGYADDPTVPKGSVTPTFAAAALLMGNARWDGVPFLMKAGKALHTRRAEIRVQFRRVPGNLYRRNIGTDLDKATNELVRTRGPDEAIYLKINNKVPGLGMRLDRSNLNLLYSERYRREIPDAYERLLLDAMEGERRLFIRSDELDAAWAIFTPVLRELEDRKVAPELYPYGSRGPVGAHYLAANYNVRWGDITSDDAAF

SEQ ID NO: 40663 - protein, 101 aa, Sorghum bicolor
  Clone ID: SORBI-28MAY03-C7758_2.pep
ILQNQLLGQSTKCSMHVIFPFQKEYIHYKQLKGWNHLVVYKSGIHGLGLYTSVFIPRGSMVVEYVGEIVGQRVADKREIEYQSGKRQQYKSACYFFRIDRE

SEQ ID NO: 40664 - protein, 235 aa, Sorghum bicolor
  Clone ID: SORBI-28MAY03-C7758_1.pep
MDHTIDFSSHVDPKKEYLRSNNWTCARTEGFKGRKGEGFFDSSRKKYEEYSGEFSVSQEQINAWLRINGSKPCGRGQKEYIHYKQLKGWNHLVVYKSGIHGLGLYTSVFIPRGSMVVEYVGEIVGQRVADKREIEYQSGKRQQYKSACYFFKIDREHIVDATRKGGIARFVNHSCQPNCVAKIISIRNEKKVMFFAERHINPGEEITYDYHFNREDEGQRIPCFCRSRYCRRYLN

SEQ ID NO: 40665 - protein, 331 aa, Sorghum bicolor
  Clone ID: SORBI-28MAY03-C7782_1.pep
GIYPEDYEIERDQLIYLWVAERIVTSKSPMQDVKDVAESCFNELVNRNMIQPESYYYRVHDMMLDLIIKRCREGNFVSVVHSAQVVVERQDRVHRLSVSLSDVPDDDSIFQLATNCCRSQVRSLVFLGASKWMPPLLELKSLRVLFLQFPKHLKTMDLTGVGQLSQLRYLKVNGIFYSDTSIVLPSEIGRMRHLERLEIPYTYICSTPSDIVDLPRLSHLILPEDTSLLDGIGKMKSLRTLRSFLLAESSPEDIKGLSELNKLEDLRVRCRGGRYNREHRPKRADGDTPTAIWMDALIFSLEKLSNLKSFCLSSEFTAVKADALLLLSPPF

SEQ ID NO: 40666 - protein, 136 aa, Sorghum bicolor
  Clone ID: SORBI-28MAY03-C7761_1.pep
QKKHHNIMFFKLLAGQHTSPTPRLPPAASDARGVGPDCALVQGGGGGPDSDLVQGCGGGHNVLVAAVATALVVAVATTLMAVVATALDSSRPRPRLDVQGGDRAMGGGGGTGGRGGRLRRSGGEAAVADLKINSPC

SEQ ID NO: 40667 - protein, 238 aa, Sorghum bicolor
  Clone ID: SORBI-28MAY03-C78222_1.pep
ARGNHTAFSNLAGIEKYYKSVGVDIKLDPNMKVPCSIVHGNQAWTGHVFSFLLQAYGRAVPVYVPVYLVPALGVHRQHLLKRAYSIIGKSFLGVARSSMFLSVYCASAWAWTCLLFRTFHRANTPLVILGTFPTGLALLIEKKSRRIEISLYCLARAIESFFTWMTDAGLCPPILQIKRADVVVFSIATSIIMHCYAQEREVFRSKYLNVLDWVFGVPPPPDSEDKNCYRPDEAKKCQ

SEQ ID NO: 40668 - protein, 248 aa, Sorghum bicolor
  Clone ID: SORBI-28MAY03-C7824_1.pep
MVLVAKQHRCTHSASCVCIKGHLSEDALYLVFKHMNWNPRLIAILSCVCKWFDEVAKQVLWKEFCNARAPKMMLDLHSGGSHIVDGNWKALGKLLIYCNGCTKGGLFNNIHVPGHFVFRTRFSRTAGRSFLPLPCKSDVLYVSDPCEHLDQGEEGDLGFFRGIFKSFATSRVKKMLIEKRARFHPTELCPYCKAKLWNMFQENMIPRSASARLGAYDDSVEYFVCLNGHVIGLGTLLPLSDSEEAADE

SEQ ID NO: 40669 - protein, 86 aa, Sorghum bicolor
  Clone ID: SORBI-28MAY03-C78260_1.pep
STTATAAPDSPKASASTTTTEGDESVHSAGSPPSSLPAFFPPPPPPQQQHPEMASLDFTEAPWDESAALHLNKYPSWEIDWDSILS

SEQ ID NO: 40670 - protein, 131 aa, Sorghum bicolor
  Clone ID: SORBI-28MAY03-C80239_1.pep
CDDGADALAAGFDDALGSLLSRLASDDDDHRLDGLTYSLGDLARRLLPISARPSAAGFADVDSACCGGGRLGAQSVCGQPNSTLCGDRRRHLFWDYGHPTQRGAELIVSAFYDGPEQFTTPVNFKQLVRRA

SEQ ID NO: 40671 - protein, 327 aa, Sorghum bicolor
  unsure (1)..(327): unsure at all Xaa locations
  Clone ID: SORBI-28MAY03-C80396_1.pep
MPPREWTQQDMRYVKDAGPMISPVSYPSRVAPLPEDRPLGGVAGPGLGRGLRRLAERTQLLAARASPCCSGLPLVLDLLPAPSLSPVLLRPXSSPVSPSAPSPLSRRVQXDKKRNFIETVEAHVILGVDPRRGDQMVRGALTLPHGTGKTVRVAVFAEGPAADEARAAGADVVGGDELIEEIRTGGGKLSFDKCIATPMFMPRLSKVARILGPRGLMPNPKLGSVTNDVSGAVKAAKSGRVDFKIDKTAIVHVGLGKVNFTEESLRENIGAFVHALLLAKPVGLKKTSKYVGYVKKFTLSSTMGPGFPVTIPSLSVAADHYNKVQVS

SEQ ID NO: 40672 - protein, 95 aa, Sorghum bicolor
  Clone ID: SORBI-28MAY03-C80406_1.pep
HGVLHGGGASSCASPGVSARKFQTDIEAGQVGINVPIPVPLPFFSFTGSKASFAGDLNFYGKAGVQFFTQIKTITQQWKESPAQRVSLSMPTSQK

SEQ ID NO: 40673 - protein, 135 aa, Sorghum bicolor
  Clone ID: SORBI-28MAY03-C8021_1.pep
MASLTGSALSFARPVKAISIKSSSFSGLRKDNVAFRLQPVPQRFAVCCPAKKETVDEVCKIVKKQLALAEGTDVCGSSKFQELGADSLDTVEIVMGLEEAFKITVEESSAQSIATVEDAANLIDELVAAEAAKAK

SEQ ID NO: 40674 - protein, 155 aa, Sorghum bicolor
  Clone ID: SORBI-28MAY03-C80510_1.pep
PARHLPWPRPLSSPRRAPSPPRAAPPAPPPPPPRAPPPPPLAPPAPRGARRPRGRPPAAPPAGRAAAPAPPVRPPWAGGRPGPGAAPEPPPSRAAPTRRPRAPPAPPPPTAPRGRCGGVSPGSCQRSALGSCFSPGFFWAWPRRWPTSVPLLSPV

SEQ ID NO: 40675 - protein, 241 aa, Sorghum bicolor
  Clone ID: SORBI-28MAY03-C78726_1.pep
MADGASSSGGAQNGGESVVTDYGRRRTTCGYCRSSGPARGSHGMWANSLKADDYQALLDRGWRRSGCFLYKPEMERTCCPSYTIRLKANDFICSKEQGRVLKKMQRFLDGDLDPHIGSPQCKASPTKRSLGEPLNSPTSKVSKVSAKEFRAGMGPNISKEDDVTCCLASKINEAADTCFQGGVFGSVQLPKAIVKTVKPQVKRKVGESVQEKKVGEAVQDLVYTCNISFQIVAAVRRALPK

SEQ ID NO: 40676 - protein, 146 aa, Sorghum bicolor
  Clone ID: SORBI-28MAY03-C79069_1.pep
MSSSLVSTPFAAAAQKQLLAAPVPLHSFLLSSRRQPGRRGGAGAIRCAVAGGNGLFTQTKPEVRRVVPTDPRGLPRVKVVYVVLEAQYQSSVTAAVQQLNADPRRAAAFEVVGYLVEELRDEDTYATFCADLADANVFIGSLIFVE

SEQ ID NO: 40677 - protein, 191 aa, Sorghum bicolor
  Clone ID: SORBI-28MAY03-C787_1.pep
MPSSSNRRKSPPSGCGSPSPIVARCPRPPSSRAPTRACSSSTVAATSARARPCADATSSTTPSPPPIASPRCPRPPTRAATSTGSGREPLSCAATNLALPPPPPTSSPSSPPRRSANSPTPMMVSSSCGAPTNNPHPGGPGRRFISPVRCAGRPTSTYSTATPPSPGPAAACAGWICSEVSSSAPTLGGRR

SEQ ID NO: 40678 - protein, 89 aa, Sorghum bicolor
  Clone ID: LIB3476-047-P1-K1-G1.pep
DLDISPLPSSLPNLPLSCAGTNLALTPMAATYSPSSPPRRSANSPTPMMVSSYCGAPTNNPHPGGPGRRLISPVRCAGRPTSTYSTATP

SEQ ID NO: 40679 - protein, 219 aa, Sorghum bicolor
  unsure (1)..(219): unsure at all Xaa locations
  Clone ID: SORBI-28MAY03-C7907_1.pep
MTSNAYRKTSVSPSATMLKALPVRFLASPEPGGLSRRLPRRSLRLISAALMTNPAYFEVGRFLGAHGFMNITSYSSSQFGEPSNVAGIQDLGLGYSPEEIDQLRIQDIGEGEVTIRLYEGRVVQGPLRGTQAVFKDLXVYPGSRAGASEADLMALNELRTHAFLQSDASDICANIQFLLGAFETATGEQWLAFRDDGRYSAADYAKVASARQLKEQSGG

SEQ ID NO: 40680 - protein, 183 aa, Sorghum bicolor
  Clone ID: SORBI-28MAY03-C79137_1.pep
GGFSFINSTHKHSINGFDRPIELSILPSLHRQRLTAAADNQLINCIVHPRLVSSILCALLCCTSNPFQGIYTLQGAAAYNYKCNPCSKPTGTSIYRQLHSFYSTSWLSGLQSESPHPPLPIQVGTPSLVHGIHHLSPSTVSRRASSSSTRAGNSVSSSTASRTPGSSIRSSSAMRRTPSLCLT

SEQ ID NO: 40681 - protein, 300 aa, Sorghum bicolor
  Clone ID: SORBI-28MAY03-C8153_1.pep
SSENIREKVNIDQNRGNVEKVFLNSYIRTDKSHGFRALVVMEDHSLLLIQQGEVVWSREDGLASIVDVTTSELPVEKDGVSVADVEHNLFEWLKGHMLKLKGTLMLANADEVAAIQALRLKSSEKNKMTRDHNGFRKLLVVLTKAGKVMALHTGDGRVIWSNLLSSLRASRFGGMPSALRIYQWQVPHHSVMRENPSVLVVGKSGAESSTPGVFSILDSYSGEELNSMKLDHSVVQIIPLTLKDSSEQRLHLIVDSNSNAHLYPKSPDALNVFLHEMSNLYFYSVDIQANVIKGYSLQKS

SEQ ID NO: 40682 - protein, 155 aa, Sorghum bicolor
  Clone ID: SORBI-28MAY03-C81698_1.pep
MAPASLLLTRVAAATVAVACVVALGAMAQQLSPTFYDASCPNLQSIVRSGMAAAVQQEPRMGASILRLFFHDCFVQGCDASVLLDDSATLTGEKNAAPNANSLRGFEVIDAIKSQVEAACPGTVSCADILALAARDGVNLLSGPTWAVQLGRRDT

SEQ ID NO: 40683 - protein, 192 aa, Sorghum bicolor
  Clone ID: SORBI-28MAY03-C8172_1.pep
MADNAKAEAARARPESSQEEEEDWKEAEGDVAEVDRAATNGAVPTDRPIRVYADGIYDLFHFGHAKSLEQAKKLFPNTYLLVGCCNDELTHKFKGRTVMTEDERYESLRHCKWVDEVIPDAPWVVTEEFLDKHNIDFVAHDSLPYADASGAGKDVYEHVKKLGKFKETQRTDGISTSDIIMRIVKDYNEYVM

SEQ ID NO: 40684 - protein, 225 aa, Sorghum bicolor
  Clone ID: SORBI-28MAY03-C81740_1.pep
NWTGSIDAVALVHSYDNERSGGHQKTKLSALNVPPMGLLYPRVLVPEEYPPPPRSWFQDYDDMLEDTWQTSDGLYPSGNGGFGMWDSYPVFSTRLKKFENIGLVEAIISSVLSTGRVDLQRKLFCSIQLVGGAASTAGLAQVLEQRVRTKISANQSIEKVEVLQSRTYPLFVPWKGGVILGVLDIGRDAWIHREDWIKNGVHIGSGRKYKDSYFLQAQVMCYYNI

SEQ ID NO: 40685 - protein, 176 aa, Sorghum bicolor
  Clone ID: SORBI-28MAY03-C82013_1.pep
SLGLDEAHFQRAFGGADCGATLRANYYPRCPQPDLTLGLSAHSDPGALTVLLADENVRGLQVRRGDDGEWVTVQPVRDAFIVNVGDQVQILSNSVYKSVEHRVVVNAEEERISLALFYNPKGDVPISPAPGLVTAGNLPALYPPMTFDEYRLYIRNKGARGKAQIEALKGQASPEK

SEQ ID NO: 40686 - protein, 276 aa, Sorghum bicolor
  unsure (1)..(276): unsure at all Xaa locations
  Clone ID: SORBI-28MAY03-C8200_1.pep
ARGRVFHIVLHMVGTLINRCNAGCISLYVSGHNEVEERHNHDWMLRRANFSGGYVCVKFEIRVRKSKDNLLSSSSSEIRHGSKPNNSEMGLSFNMCKXKIVQVMHGNISSLAVSKCIGETIMLVLQFQLQPVTPVSGASSDLYRSSAIPNFNGLRVLLADSDDTNRAVTHRLLEKLGCRVLSVASGVQCMSSFAAESSFQLVILDLAMQTMDGFEVARAIRKFSSNSWLPLIVALAARIDDNIRDRCQRSGINGLIQKPVTLAALGDELYRVLQNN

SEQ ID NO: 40687 - protein, 142 aa, Sorghum bicolor
  Clone ID: SORBI-28MAY03-C79702_1.pep
MELGSAVSAHRCSSYYTATYTHCSIGFSPRVRATSCWIRAAAEGDDGGADRRRRGASFAADGPRVVEVTAAPVATSGGGAGGAAGSAAGFGARDAELAMWDKLGAVVRLSYGIGIYGAMALTGRFICQMAGIDCTGGFHPSL

SEQ ID NO: 40688 - protein, 201 aa, Sorghum bicolor
  Clone ID: SORBI-28MAY03-C79839_1.pep
PKATPKRTRPPSMSSAAAPDPDQPPRPVRFGILGCASIARKLARAMLLAPGAAVAAVGSRSEEKARLFAADNGLDVAATLLHGSYEALLDDPDVDAVYLPLPTSLHVRWATAAAARGKHVLLEKPTALCAADLDAILAACDAAGVQFMDSTMWMHHPRTARMRDTVDDKDAIGDIATVSCVLTFRPDLALLQNDIRVKPDL

SEQ ID NO: 40689 - protein, 65 aa, Sorghum bicolor
  Clone ID: SORBI-28MAY03-C79916_1.pep
YLYGKLAEHTGHSVEKIHEDLSRVKRFDAEGALEYGIIDRIIRPSRIKKEGSTAQRRDMRNLGLG

SEQ ID NO: 40690 - protein, 347 aa, Sorghum bicolor
  Clone ID: SORBI-28MAY03-C79966_1.pep
MARRQLISGGLAVAVVAVLSSVLICSAHPVPGGHGGGFPPALLQPHFYDHACPQMQAIVGSIVAKAHAEDPRMAASLLRMHFHDCFVQGCDASVLLDADGSGRFVTEKRSNPNKDSLRGFEVIDEIKAALEHACPHTVSCADIVAVAARDSVVLTGGPGWEVPLGRRDSLTASLSGSNNLIPAPNDSLPTIIGKFANQGLDVVDLVALSGGHTIGDSRCVSFRQRLYGQNNNGQVDRTLNPAYAAELRGRCPRSGGDQNLFALDQATQFRFDNLYYHNILAMNGLLSSDEILLTQSRETMELVHRYAADQGLFFDHFAKSMVKMGNISPLTGTAGEIRHNCRRVNHF

SEQ ID NO: 40691 - protein, 108 aa, Sorghum bicolor
  Clone ID: SORBI-28MAY03-C82315_1.pep
IWPRVVQAQTDSETDHLGADKFRETIHNKPRNRGEAQQRIQTPEVPKTGEREPHGHGHGCLGNRNKAGLSASCVEPRFCCTLGPLYMYRVLLLLCSKVVYSSSTSSGW

SEQ ID NO: 40692 - protein, 123 aa, Sorghum bicolor
  Clone ID: SORBI-28MAY03-C82154_1.pep
RGEKIEPQKLEISEAKDDKKQDSKDDQSVQEEYIKAYYEALRKKQEEEEAKRRMQQEGKISVPDSQTERQVGKKYKRDDDDEGIEWEEHQPTGNATETYKLADLNAEAQESGDEEDDNEWEEG

SEQ ID NO: 40693 - protein, 170 aa, Sorghum bicolor
  Clone ID: SORBI-28MAY03-C82382_1.pep
MDSGTGSSADHIRDASLPGCARNGSKASRSLVAVAQTRRSTKCVRGSEAPRLDEAPGPQHRPWADLPPDIHGVVAGRLALLEDRARLRSVCRGWRAAARIHRRLPPCPPLLVLSDFSFFSFRSEGTLMGACRRVPLPGRETAGSGNVRCVGSFEGCLVGVKNNKSRYFGD

SEQ ID NO: 40694 - protein, 220 aa, Sorghum bicolor
  Clone ID: SORBI-28MAY03-C82388_1.pep
MAPKVQNRCPSPTAVLLLGACLAAAVAALGAADHDATASRPPPVPLPGHGGARRVLVANGLGLTPQMGWNSWNHFQCNINEAVVRRTADALVATGLAKAGYKYVNLDDCWADYQRNKEGYMVANPKTFPSGIKALADYVHSKGLKLGIYSSAGTRTCSNRMPGSLGHEDKDAKTFASWGVDYLKYDNCYRDGTPETVRFGRMSRALKNSGRPIFYSLCEW

SEQ ID NO: 40695 - protein, 171 aa, Sorghum bicolor
  unsure (1)..(171): unsure at all Xaa locations
  Clone ID: SORBI-28MAY03-C82418_1.pep
MAAAAAAADASSAEAPPSPPAASRVVWVNGPIVVGAGPAGLSVAACLRARGVPCVVLDRADCIASLWQRRTYDRLRLHLPRHFCELPGLPFPDNYPEYPTKRQFVDYLNAYAEQAGVQPRFNQAVTSARYDAAAGFWRVRADDVVLAEDAAAVAAGATTXEYIGRWLVVAT

SEQ ID NO: 40696 - protein, 57 aa, Sorghum bicolor
  Clone ID: SORBI-28MAY03-C8244_1.pep
DLDKSNAQTFQLERTADSRVVNMVQLDFSSNHGNLELTCIYRFRVHGREPGSLNTGA

SEQ ID NO: 40697 - protein, 136 aa, Sorghum bicolor
  Clone ID: SORBI-28MAY03-C80604_1.pep
MNSKRRRSHSPVEYKEGRDKDNDTSGRKDNSRDLDDTCDARRGHESGRHSDKHSYGTSRESKRHDDYRRYHDKYVDDYGRNHPRASRSDRESRADTYYDRSKHDSTSGRSRGDHRDVGRYGEKSVNRDQRSIIEGK

SEQ ID NO: 40698 - protein, 173 aa, Sorghum bicolor
  Clone ID: SORBI-28MAY03-C80717_1.pep
TRLLDNYVQRGPRLVDAQARSLLIHSKRSKRHMSLKQHKKCGSFDLDGTFHKYDFYKPMHEMWKDYIRELMKVTPKKKLSENLLSADLHGALLIVAECKAASYQGVNGIMIRDTAETFGIISEDNRFRVVPKAGSVFILQADCWKVTLIGDKLSPREKLKEDQRQHRAQSQIR

SEQ ID NO: 40699 - protein, 145 aa, Sorghum bicolor
  Clone ID: SORBI-28MAY03-C80826_1.pep
TRIPLPLFAAVYCVLWAYAAGAGFAFLQYCNLNSLRTKFILSISIFLGLSIPQYFRIYEMFFGFGPVHTHSVAFNVMVNVIFSSPATVAAILAYFLDVTHLYWEASVKKDRGWFWWEKFKNYKYDARSEEFYRLPYGLSRYFPSL

SEQ ID NO: 40700 - protein, 182 aa, Sorghum bicolor
  Clone ID: SORBI-28MAY03-C81174_1.pep
MAAPPRATAVLAWGSGEDGQLGMGGNEEKDWAHCVEALAPYAVTAVVAGSRNSLAICDDGRLFTWGWNQRGTLGHPPETKTESSPGPVNDLAGVKIVQAAIGGWHCLAVDDKGRAYAWGGNEYGQCGEEPQRTEDGTRALWRDIPTPRRCAPKLKVRQVAAGGTHSVVLTQEGHVWSWGQPW

SEQ ID NO: 40701 - protein, 273 aa, Sorghum bicolor
  Clone ID: SORBI-28MAY03-C81298_1.pep
MAAAETSGTAIGTSGRWALHGKTALVTGGTRGIGRAVVEELAALGAAVHTCSRKAEELGERIKEWEARGFRVTGSVCDLSERDQRERLLREVGNRFGGKLNILVNNVGTNIRKPTTEFTAEEYSFVMATNLESAYHLCQIAHPLLKLSGSGSIIFISSVCGMVGVFSGTIYAMTKGAINQLTKNIACEWAKDNIRANSVAPWYITTSLTERLLANKDFEEQVVSRTPLGRVGEPEEISALVAFLCMPGPTYITGQTIAVDGGMTVNGFYPTKP

SEQ ID NO: 40702 - protein, 172 aa, Sorghum bicolor
  Clone ID: SORBI-28MAY03-C8_1.pep
GYGRRKDVELLFPSTSPTQTVSVWTVDGILSHAQSKHSNPKVEKYGKITKLELKLGGDKAVGRKNYLAASKLYTQAIELDPDDATLYSNRSLCQLQIGEANKALLDANSCIKIRPEWLKGYYRKGVALMSLKEYKEACDAFLAGLKLDPTNVDMERMFMEAIEAMKKDHVTT

SEQ ID NO: 40703 - protein, 231 aa, Sorghum bicolor
  Clone ID: SORBI-28MAY03-C82723_1.pep
MDVPLPLLLGSLAVSVVVWCLLLRRGGDGKGKGKRPLPPGPRGWPVLGNLPQVGSHPHHTMCALAKEYGPLFRLRFGSAEVVVAASARVAAQFLRAHDANFSNRPPNSGAEHVAYNYQDLAFAPYGSRWRALRKLCALHLFSAKALDDLRGVREGEVALMVRQLARHQHQHAGVPLGQVANVCATNTLARATVGRRVFAVDGRLDLFTAGTDTTSSTVEWALAELIRHPDV

SEQ ID NO: 40704 - protein, 143 aa, Sorghum bicolor
  Clone ID: SORBI-28MAY03-C82820_1.pep
QPPLPDGYFGNVIFTATPLAEAGKVTSGLAEGAAVIQGALDRMDNDYCRSALDYLELQPDLSALVRGAHTFRCPNLGLTSWVRLPIHDADFGWGRPVFMGPGGIAYEGLAFVLPSANGDGSLSIAISLQAEHMEKFRKLICEV

SEQ ID NO: 40705 - protein, 152 aa, Sorghum bicolor
  Clone ID: SORBI-28MAY03-C82920_1.pep
MAMRMVATAAAVALVAVMCVLAPRAAAQTTPNCAAKLVPCSPYINTTGTPPDTCCSPLKDAVQNDLKCLCDLYATPEIFKAFNISIEAALGVSKRCGLDDTTTACKGLSPTQSPPGSPSGGSGSGSNAGHRTLSVGFPGLMSLFLALWSALA

SEQ ID NO: 40706 - protein, 91 aa, Sorghum bicolor
  Clone ID: SORBI-28MAY03-C830_1.pep
MLLSLINHYIISLLSIYVLTNTWTGNLVKVVIPRPDPSGAPVAGVGKVFLEYADVEGSTKAKTGMHGRKFDGNQVVAVFYPEDKFAAEQYD

SEQ ID NO: 40707 - protein, 118 aa, Sorghum bicolor
  unsure (1)..(118): unsure at all Xaa locations
  Clone ID: SORBI-28MAY03-C831_1.pep
MDPPPARRAASKRRDRRRRLRQRQAAATATDAGAVVLAVEPQSAAVTAPVTPAGAASTPAATARGRNRRRPRRRRHRSAGPAAAADEAPAASPVXMPFQFKKILPHKQVALWKQRQHI

SEQ ID NO: 40708 - protein, 173 aa, Sorghum bicolor
  Clone ID: SORBI-28MAY03-C83183_1.pep
MLFRAVQHALRQGNSRAGAPVVALLPGVGVAAGHFSTATTTADDSQRLAGKVALITGAASGIGAATAREFVRAGAKVVLADVQDDQGRALAAELGASYTRCDVTDEAQVSAAVDLSVARHGALDVAFWNAGVVGSLSRPALGALDLADFDRVMAINARGVGAGVKHAARVMAP

SEQ ID NO: 40709 - protein, 171 aa, Sorghum bicolor
  Clone ID: SORBI-28MAY03-C82098_1.pep
MASCMQEWPEPVVRVQALAESGLSVIPRCYVKPPCDRPVVVAPAAPTAVKETNSNKAAEASDISIPVVDLGELLLQAKDAGAGGLVGNVVTEAVASACREWGFFQVVNHGVRPELMRAARESWRGFFRRPLAEKQRYANSPRTYEGYGSRLGVQKGAVLDWGDYFFLHLAP

SEQ ID NO: 40710 - protein, 94 aa, Sorghum bicolor
  Clone ID: SORBI-28MAY03-C8211_1.pep
VLLQRRGWDASYCKRGGLQCTTVGEEPVNLFYMFKDLSAVNVKATSLNLLHDDPEMLGYLEQIGDVAQEGNVLISPMEIQAYKLDLQPPSTQEE

SEQ ID NO: 40711 - protein, 164 aa, Sorghum bicolor
  Clone ID: SORBI-28MAY03-C8204_1.pep
PAGFRSADLPIPLLPSSSIDPTTAPTPMASAASSAAGAGKSLFQGLRRFLKKPWEITGPCASPEYRSALPDALEYRVKCPATVRDDRDKAIVPTSDPETVYDIKYFTRDRRRNRPPVRRTLLRKPELERYMATKQFDPTKDFPVPYVNTTVEEDDNTIGGGYQK

SEQ ID NO: 40712 - protein, 111 aa, Sorghum bicolor
  unsure (1)..(111): unsure at all Xaa locations
  Clone ID: LIB3476-045-P1-K1-E11.pep
RRSRGVDLSRCRGARTRTAGSSWRWRISKKTIRGDKAIVPTXDPETVYDIKYFTRDRRRNSPPVRRTLXRKPELERYMATKQFDPTKDFPVPYVNTTVEEDDNTIGGGYQK

SEQ ID NO: 40713 - protein, 179 aa, Sorghum bicolor
  Clone ID: SORBI-28MAY03-C82308_1.pep
GRRDGTVSLASNTGTLPSPFAGFAGLLSSFANRGLNLTDLVALSGAHTIGVASCSRVAPRLYQGNATAVDPLLDSAYAKTLMSSCPNPSPAAATVGLDGGSPFKFDSGYYARVQQNQGTLASDAALAQNAAAAQMVADLTNPIKFYAAFSMSMKKMGRVEVLTGTNGQIRKQCRQVNTS

SEQ ID NO: 40714 - protein, 207 aa, Sorghum bicolor
  Clone ID: SORBI-28MAY03-C83813_1.pep
MDSDYVASLLMGSSAHALDFAALDTGFLDTLCGGAGLFGVPGVAAGTGCGSGGGGGSPEGSSVSDPAWARASDGGNARKRKAPPTGSAGGKETCLGKAAEAKVPDGKRCRVGASDSPVKPKVEEAAASDASVEVKGQKKGKGKSPKPAVEPPKDYVHVRARRGQATDSHSLAERVRREKISQRMKFLQDLVPGCNKVVGKALMLDEI

SEQ ID NO: 40715 - protein, 129 aa, Sorghum bicolor
  Clone ID: SORBI-28MAY03-C83853_1.pep
KMKPYIPDFKLAFEHFCIHAGGRAVIDELEKNLQLSPAHVEASRMTLHRFGNTSSSSIWYELAYMEAKGRVRRGHRIWQIAFGSGFKCNSAVWHALRNVKPSPDNPWEDCIDRYPVELVDGFPTHKPQQ

SEQ ID NO: 40716 - protein, 204 aa, Sorghum bicolor
  unsure (1)..(204): unsure at all Xaa locations
  Clone ID: SORBI-28MAY03-C8389_1.pep
HEAQFSKEKLDKLISEGPRVRDVIRFHYYVQYHLYIQLSEAATYARKKKVILKGDLPIGVDRNSVDTWVYPTLFRMNTATGAPPDYFDKNGQNWGFPTYNWEEMSKDNYGWWRGRLTQMAKYFTAYRIDHILGFFRIWELPDHAATGLVGKFRPSIPLSQEELLSEGLWDFXRMSQPYIRQEILEEKFGSFWTVIAANFLNEYH

SEQ ID NO: 40717 - protein, 125 aa, Sorghum bicolor
  Clone ID: SORBI-28MAY03-C8413_1.pep
MRNDTRLRIFSGTANPSLSQEIASYLGLELGKINIKRFADGEIYVQLQESVRGCDVFLVQPSCPPANENLMELLIMIDACRRASAKNITAVIPYFGYARADRKSQGRESIAAKLVANMITEAGAN

SEQ ID NO: 40718 - protein, 144 aa, Sorghum bicolor
  Clone ID: SORBI-28MAY03-C84265_1.pep
MDRLPESTRGSTMRKYASEAGGLRAARQGPHGRSLTARTAHNMSAAALRKKSDASLVRKVPFAPLRPVLANLQEVFLGTKLAVLFPAVPLAIAAQCANFGQVWVFALSLLGLIPLAERVSFLTEQIAIYTGPTVGGLLNATCGN

SEQ ID NO: 40719 - protein, 123 aa, Sorghum bicolor
  Clone ID: SORBI-28MAY03-C976_1.pep
DAWELWRGENGPELKHGFQKQFRNISAIMDCVGCEKCRLWGKLQVLGLGTALKILFSVDGDSHLNQPLQLQRNEVIAENNLLNKLSESVKFVHENQSSIAEVIVKLVPSSFQRVESVPTRTLE

SEQ ID NO: 40720 - protein, 331 aa, Sorghum bicolor
  Clone ID: SORBI-28MAY03-C115211_1.pep
MIPLTYMSDHKTKEEVFTQFLNGGNFASQGLSWFVGMTGCVFAFAGGDAAVHMAEEVANASRAIPRAIMLSVAINGSLGFGMLIAMLFCSGNIDDALSTPTGYPYIEIFHQATGSVPGALAMLSINLIIGGFSVIGMLAATSRQFWSFARDRGVPGWRWWSRVSSRHLPTYSVYLTMTVAWLLGLINIGSAVALNDITSMAVSGLYTSYLIVAVLLLYRRCRGDIAAYDENAETVINVPGAPLVWGPFRVPGIWGILVNIYACIYMVIVIFFSFWPPEMNPSLADMNFSVVGTVGVVVLAIAYYLLRARHVTRVPSGGWVVIRCGIAKGGL

SEQ ID NO: 40721 - protein, 181 aa, Sorghum bicolor
  Clone ID: SORBI-28MAY03-C11540_1.pep
MTSHVNRSLPFLIAPSEATPAGALPLTAMDRALASLPMTALFVFENPIDQPAETIARALSRALVPYYPMAGRLTITGDQLKIACTGEGVAFAGASASCTLQEAGLSGPRPVITVEDLTMNYAGQYSTEEPPLLLVQVTEFSCGGFAVGVTWNHVVTDGAGMAQFLQAVGEFARGFPSSPSV

SEQ ID NO: 40722 - protein, 149 aa, Sorghum bicolor
  Clone ID: SORBI-28MAY03-C11550_1.pep
HVEFLRSARQLGDFLLVGVYDDQSIRDRRGCRPIMHLHERTLSVLSCRYVDEVIIGAPWEVSKDMITTFNISLVVHGTVAEGNSAGEIDPYAVPKSMGIFQTIRSPKSITTLSVATRIVDNHEAYKKRNLKKKASEDRYYTQKKFVSGD

SEQ ID NO: 40723 - protein, 129 aa, Sorghum bicolor
  Clone ID: SORBI-28MAY03-C115602_1.pep
ARGPPAATGLTVYLSGGQGQVVGGTVAGPLLASGPVVIVAACFGNAAYERLPLDDDEPPQQQLLQQALPPPQGMAGASSSSPPPPLSLPGQHPLADQLPHSLMNGLPLPADAYAWANPGGSGAGRVAPY

SEQ ID NO: 40724 - protein, 186 aa, Sorghum bicolor
  Clone ID: SORBI-28MAY03-C11590_1.pep
GLGDAVEQGLVKAVGVSNYSEKRVRDAYERLKKRGIPLASNQVNYSLIYRNPEENGVKAACDELGVTLIAYSPIAQGALTGKYTPENPPKGPRGRIYTPEFLTKLQPLINRIKEIGESYGRTSTQVVLNWLVCQGNVVPIPGAKNAEQAREFAGALGWSLTADEVEELRSMARQVKPVIGFPVEKL

SEQ ID NO: 40725 - protein, 133 aa, Sorghum bicolor
  Clone ID: SORBI-28MAY03-C85607_1.pep
SAVEQGYHGVRPGWTRVSLAYYTSTQEAEFVLDAVAFVASFGHRFLPLYAFDWKTGDWHYDHRHGCARGLVPNHVVGNPGGRVKAENGYQSYMAFAHCLAESLATSTTCSGPTSTRAKRIPKSVDPQLVYFLV

SEQ ID NO: 40726 - protein, 249 aa, Sorghum bicolor
  Clone ID: SORBI-28MAY03-C85626_1.pep
ARGNILAAWAPSEMHPQFADDVSLTFFMESGTSMSTPHLSGIAAIIKSLHPSWSPAAIKSAIMTSSNTADHTGVPIKDEQYRRASFYGMGAGYVNPSRAVDPGLVYDLSAGEYVAYLCGLGLGDDGVKEITGRRIACAKLKAITEAELNYPSLVVKLLSHPITVRRTVTNVGKANSVYKAVVDMPKGVSVVVRPPMLRFTKVNEKQSFTVTVRWNGPPAVGGAEGNLKWVSSEHEVRSPIVIPPAKAAA

SEQ ID NO: 40727 - protein, 193 aa, Sorghum bicolor
  Clone ID: SORBI-28MAY03-C85714_1.pep
MPLLVSSSTNNVSTGAASPVPVPAAAAAAEHSDGLLFDGLVLGHGDDVNNKAKADNDDYDAPTERLEWLRSQIIGSEAEFASPFGTRRITYADHTASGRCLRFVEEFVARNVLPFYGNTHTTDSYVGLHTSKLAGDAARYVKRSLGAGPQDMLLFCGTGCTAAIKRLQEVTGMAVPPTLRAAVLAALPPTDRW

SEQ ID NO: 40728 - protein, 229 aa, Sorghum bicolor
  Clone ID: SORBI-28MAY03-C8514_1.pep
LLNGVLFTGGSEKQGVYFETIKKVFQYVLDKNDAGEPFPLFAQCLGFELISMIVSKDNNILETFDAQNQASTLQFPSYALEGSVFQRFDPALIKKVSTSCLVMQNHRYGISPRRYRENDALSSFFKILTTSPDENGKVYVSTVQAYNYPITSTQWHPEKAIFEWRKPMIPHSEDAVQVTQHFANHFISQARKSPNRPPADKVLDNLIYNYSPTFSGKKSKSFEEVYIFA

SEQ ID NO: 40729 - protein, 70 aa, Sorghum bicolor
  unsure (1)..(70): unsure at all Xaa locations
  Clone ID: LIB3476-050-P1-K1-E12.pep
PRVRNDALSSFFKILTTSPDENGKVYVSTVQAYNYPITSTQWHPEVXTIFEWRKPMIPHSVDAVQVTQHF

SEQ ID NO: 40730 - protein, 115 aa, Sorghum bicolor
  Clone ID: SORBI-28MAY03-C85956_1.pep
PSGAGQDPSMDPAYLAALTQQCPQVQGSDPAVPMDPVTPTTFDTNYYANLVAKRGLLASDQALLADPTTAAQVVGYTNSPATFQTDFVAAMLKMGNIEVLTGTAGTIRTNCRVAS

SEQ ID NO: 40731 - protein, 311 aa, Sorghum bicolor
  Clone ID: SORBI-28MAY03-C83253_1.pep
MAAAARLLTRISKRAVPSVALAGAARRRPEAASLLGASVLAAVEPCASIKVIPLLNQLAPYSTSAFQRFGFSTSAPQQDDKETNKHTDDGVNKSVGVSTEASSEANNVPGTEKAQEADSEDLDLSEEDLVKLLLEKDESLKSKDEEFKDMKDKVLRSYAEMENVLARTKRESENTKKYAIQSFSKSLLDVADNLSRASSVVKESFSKIDCSNNSDEAVPLLKTLLEGVEMTEKQLGEVFKKFGVQKFDPLNEKFDPNRHYAFFQIPDPSKPSGTVAAVVKVGYMLHDRVLRPAEVGVTEGGPTEEPEEKSS

SEQ ID NO: 40732 - protein, 148 aa, Sorghum bicolor
  Clone ID: SORBI-28MAY03-C8332_1.pep
SKGVAATNTSPTRPIAKLAKDTDDELNQINRKLEELRKMVVHRCRKMTTDEKRKLGAGICHLSPDDLNKALEIVAQDNPSFQTKAEEVDLDMDAQSETTLWRLKFFVREALERQANVASGKMDENAKRKREICNALAKTASKRIKKQP

SEQ ID NO: 40733 - protein, 106 aa, Sorghum bicolor
  Clone ID: SORBI-28MAY03-C83652_1.pep
ERPTQGLQASTPVRHHVRIDLCLRLRPPSGHKPHLHHRASIPQAITQAWLRPVSPSEQDFELSPATALVATHACSHAMGRGRPMSPHDQAPSTIVRPPWASVPPPY

SEQ ID NO: 40734 - protein, 122 aa, Sorghum bicolor
  Clone ID: SORBI-28MAY03-C83675_1.pep
AIAQGCALHAASRADYTIKCRTHEDYHRARSVATLQFNGHLALLVIAGAATYAAVLSRANRPPRGYSVLGKEVQMEGMPIMSQFTLDSDEEKEDEAITSTVAPVANGAESHDEIPLHEPDSK

SEQ ID NO: 40735 - protein, 184 aa, Sorghum bicolor
  Clone ID: SORBI-28MAY03-C83741_1.pep
ASEGIAYEWNYVVENQYGNDGMVAGKCPNRAESPAMDSKSQSLVLMNFFTTSPSQTGVCGNNSAPLVSMLKTCHDASGNRWPNYIAVDFYMRSDGGGAPLATDIANGHMVCGCDNIAYCKANSTFGTCVIPPPPPPSPPKAATPGSRGSTAGGDASAGMARSHHLPSQWSFFLGLPSLLLLLLS

SEQ ID NO: 40736 - protein, 224 aa, Sorghum bicolor
  Clone ID: SORBI-28MAY03-C8637_1.pep
MEHDGKNLTVTEVVRSVQLLKIDGYSATSTMVGSSEFIKPRSRWNIDGHEWEVHFYPDHCQFLEDEDVIPPFDDFIQWVALKLILVSEPQRDKLRVNLSCRLVCPSQRHLGPSEEKSVSHVFHRGSKCSPEVLLMTKYDVPSSGYLVNDSLTVECTITVLGGDEEQPLPVPPPSDMHKHFGELLQSQEGVDVMFHVSGESFAAHKVILAARSPVFKAKFFGGLE

SEQ ID NO: 40737 - protein, 253 aa, Sorghum bicolor
  unsure (1)..(253): unsure at all Xaa locations
  Clone ID: SORBI-28MAY03-C86480_1.pep
MDASYRRAGAGSGSAPRSVDDIYKDYRARRSAILRALTHDVEEFYALCDPEKENLCLYGYANEAWEVALPAEEVPTELPEPALGINFARDGMNRRDWLALVAVHSDSWLVSVAFYYAARLNRNDRKRLFSMMNDLPTVFEVVSGGVKQSKERDRSSTDNGGRNKLSAKQTSEPPLENNVREPDEGYDEDDGNHSETLCGTCGGIYSADEFWIGCDVCEKWYHGKCVKIXPHEAESIKQYKCPSCCNSKRPRPL

SEQ ID NO: 40738 - protein, 158 aa, Sorghum bicolor
  Clone ID: SORBI-28MAY03-C8651_1.pep
MNKERLMKMAGAVRTGGKGTVRRKKKAVHKTGTTDDKRLQSTLKRVGVNTIPAIEEVNIFKDDLVIQFLNPKVQASIAANTWVVSGSPQTKKLQDVLPGIINQLGPDNMEHLKRIAEEMQKHVAAAGAAAQVKEENDDDVPELVPGETFEEVAQEAKA

SEQ ID NO: 40739 - protein, 363 aa, Sorghum bicolor
  Clone ID: SORBI-28MAY03-C8657_1.pep
AANHLWQLVVARADLNGHLKALKDYFLLAKGDFFQCFLEESRQLMRLPPRQSTAEADLMIPFQLAALKTIGEEDKYFTRVSLRMLSYGMKSSTSQKDLQKPNASELSSQGKATSELALDGWDSIALEYSVDWPLQLFFTPDVLSKYRKVFQYLIRLKRTQMELEKSWAAVMHKDHADFSEYCKDRKNNSATQLRRQRSKPLWRVREHMAFLIRNLQFYIQVDVIESQWNVLQSHVQDSHDFTELVSFHQEYLSALISQSFLDIGSVSRILDSIMKLCLQFCWSIEQYETRPNIAEIDHITEEFNKKSNSLYTILRSSRLAGSQRAPFLRQFLMRLNFNSFFETTARGVMNSGRLRPSTAGAQL

SEQ ID NO: 40740 - protein, 129 aa, Sorghum bicolor
  Clone ID: SORBI-28MAY03-C8660_1.pep
NFKVKIYCLRLSRGGIHMETLPFEVVLEDVGQQRNMQQQGGKDAASRSVNRIKSLLSKRKSSVVSASNHSEGIQRKSSDSHVHYVRSPVLNRMLHSPRMSHSPVLSARSSSSSSSDDTRIVISPDLGPG

SEQ ID NO: 40741 - protein, 354 aa, Sorghum bicolor
  unsure (1)..(354): unsure at all Xaa locations
  Clone ID: SORBI-28MAY03-C86811_1.pep
TRVLHLAAQAGVRHAMRAPQAYVASNVAGLVALFEAAARHADPQPAVVWASSSSVYGLNTEAPFSHDHRTDRPASLYAATKKAGEAIAHSYNHIYGLSITGLRFFTVYGPWGRPDMAYFSFARSIVAGEPITLFRTADGADARRDFTYIDDVVRGCLGALDTAGKSTGSKSGKKSGPAPLRXFNLGNTSPVTVPNLVSILEKHLRVKAKKHVVEMPGNGDVPFTHANISLAREQLGYKPSTNLDVGLRQFVDWFLSYYGVTGGAGGSRLAAVPALSFSFPSPAAPAAAAPPPPPRRVPRPGPAVLHLGCSRLSWGPPGEQCPASWRGAWWKKANGEQYFLFSVFSSLHHLLFFV

SEQ ID NO: 40742 - protein, 131 aa, Sorghum bicolor
  Clone ID: SORBI-28MAY03-C84311_1.pep
VPHIAGEAFQLTEWYTVPKGTIVFPSVYESSFQGFPEAEAFDPERFFSESRREDVAYKRNFLAFGAGPHQCVGQRYALNHLVLFMALFVSVVEFRRERTPGCDDPVYMPTIVPKDGCTVYLKQRCAKFPSF

SEQ ID NO: 40743 - protein, 115 aa, Sorghum bicolor
  Clone ID: SORBI-28MAY03-C84487_1.pep
RTADPQGLWSKCRTNHAFCNSNQLQFLQGFRNQMLDAVKGFSASRRNGLFINSCFAHCQSERQDTWYANNSPRLGNKKIADAVGDWFFERGDAKYTDCPYPCDGTCHHLVFRGDH

SEQ ID NO: 40744 - protein, 215 aa, Sorghum bicolor
  unsure (1)..(215): unsure at all Xaa locations
  Clone ID: SORBI-28MAY03-C8470_1.pep
MADAGVARGPGSAGDALFRELWHACAGPLVTVPRQGELVYYFPQGHMEQLEASTDQQLDQHLPLFNLPPKILCKVVNVELRAETDSDEVYAQIMLQPEAEQNEPTSPDAEPPEPERCNVHSFCKTLTASDTSTHGGFSVLRRHAEECLPQLDMTQNPPWQELVAKDLHGNEWHFRHIFRGQPRRHLLTTGWSVXVSSKRLVAGDAFIFLRGENGE

SEQ ID NO: 40745 - protein, 164 aa, Sorghum bicolor
  Clone ID: SORBI-28MAY03-C84560_1.pep
ELLVPQPAPVAFSSFPQLTSNGYSHGRAPGGRAPEGAPRFLLAAYRELRPGDVHLVGRLGVGGLRRGHLRRRRPPARQALRLLGADNRRRKTVAGLRHLLPLPIARGPSGIQVGANRRVLDDVGADACGGRRRDRSRGRRLLLLLASPTQLVEAASPGSNLLAA

SEQ ID NO: 40746 - protein, 144 aa, Sorghum bicolor
  unsure (1)..(144): unsure at all Xaa locations
  Clone ID: SORBI-28MAY03-C84764_1.pep
MPRYDDRYNDRYDDRYDDRYGGNTRLYVGRVSSRTRTRDLEDLFGRYGRFWGLTXNLGVHGGRVPLVQLLAFLLTGDSYLYLLLDGVNVSGNHFRRVRYVDMKHEFAFVEFSDPRDADDARYHLDDREFDGSRLIVPPVSELYC

SEQ ID NO: 40747 - protein, 221 aa, Sorghum bicolor
  Clone ID: SORBI-28MAY03-C87422_1.pep
MRWPLAISTRRRPLLFVLLVALYTIPGTFSSRQVTLDTVEIFTTHEWFGKPTVAFRCNGENKTDLPDVKEAHTLYTFKGEESWQPLTELPEKKCKRCGLYEEDTFKTDVFDEWEMCSSDFKGGKYSRIKEGQFNATFLCPNCTASTGQGNSEPSEDLESKKTSVVVIIIVSVLASVLVIIALFGGYKYWQKKKRERDQARFLKLFEEGDDLEDELGLSNEI

SEQ ID NO: 40748 - protein, 244 aa, Sorghum bicolor
  unsure (1)..(244): unsure at all Xaa locations
  Clone ID: SORBI-28MAY03-C8747_1.pep
NVSSCGSLYAYMSSGRQGCQCAELHGRFEEITFQADGEQCDLQESAGSSDDGGGQTEHYVKSKESTHVNGLVQMGRRDLSNQXCFSSFQEQSCSSNRYENDNNHHTNGFDMKHEVKIAKXKARKMAQLKRAIHPSLDFDNAYGVNRMKPSLNKLQSFHIGKNHSFRVPTSPSKVSMDYHSDVNSQVWHSRHPDPGAQRARHCEVNAAGSSPDYVFTARRYYTGAQLPPNLPRTKSVPPLSAVDA

SEQ ID NO: 40749 - protein, 336 aa, Sorghum bicolor
  Clone ID: SORBI-28MAY03-C87579_1.pep
MTLKTFHFAGVASMNVTLGVPRIKEIINAARKISTPIITAQLAPGKDVLSARIVKGSMEKAVLGEVAVAIQIVLKSSQPNLIVKLDMQLIESLHMGISADSVQLSILNHPKIKLKSEHVRVIDRAKLRIYPAGTDKRKLQLELHNLKSILPKVIVKGIPTVERVVIDEVKVKNETERYQLLVEGTNLLAVMGTPGVDATKTKSNHIMETNQTLGIEAARRSIIDEIQYTMKSHGMNIDRRHMMLLADLMTYKGEILGITRYGIAKMKSSVLMLASFEKTSEHLFNASYSGREDQIEGVSECIIMAIPMQLGTGILKVRQRLDHVPEFKYQPDPILS

SEQ ID NO: 40750 - protein, 166 aa, Sorghum bicolor
  unsure (1)..(166): unsure at all Xaa locations
  Clone ID: SORBI-28MAY03-C87682_1.pep
LGPAAAPPPPPRAPPPAPPPPPPPRPGPAPPAXRPPPAAPPPRRPPPPPAPSPPPPRPFRRPRRGAPLRSPPASGGGPPVAAAPPPAAPPPPPPPLRRLPAVLGPPWVAGSRSRALPASSPPGCAAALPPFPGDPSARLSPGPRPLQHRCTRMRDRRAATPLYASP

SEQ ID NO: 40751 - protein, 111 aa, Sorghum bicolor
  Clone ID: SORBI-28MAY03-C8788_1.pep
SSQQNMDYPIIDEAKLDQFLFRVEAALHHETQGSTDGHKNHDSSRGDQKSDSEVTPLDTDLTSQNEFNNSNEEGLFDKFKFRKGVGRLCRHPVFQFSRSMKKSDEAEQACV

SEQ ID NO: 40752 - protein, 152 aa, Sorghum bicolor
  Clone ID: SORBI-28MAY03-C85968_1.pep
RFLPYAAVLGHLSGASGVGASASHHVADHLVALFGADASAKFRFHRHHGNSSGAAARTDDDDAGILLSGCQTDETSADVAAAGGGSACGAFSAALQAVLAAHPAPMSNREVVLRAREVLGEQGFQQHPCLYCSDANADAPFLGQHESMAKSN

SEQ ID NO: 40753 - protein, 129 aa, Sorghum bicolor
  Clone ID: SORBI-28MAY03-C8603_1.pep
ARRCPEVCAYPFAIPSYVPGRKAEAPPNGDVGVDGMVSVIAHELAELASNPLANAWYAGSDPSFPTEIADLCEGIYGTGGGGAYTGQLLTDARSGAAYNVNGVGGRRFLVQWVWNPVLSYCSGPNALDQ

SEQ ID NO: 40754 - protein, 221 aa, Sorghum bicolor
  Clone ID: SORBI-28MAY03-C86367_1.pep
MVGTMEETSRRIPGYFKNKGILITGATGFLGKILVEKILRVQPDVKRIYLPVRAPDAASAKKRLETEVIGKELFGLLRETHGKGFQSFIEEKVIPLAGDIIHENLGVEEPQLSQMTQELNVIVNGAATTNFYERYDVALDVNVMGVKHICQLAKQCPNLEVVLHVSTAYVVGEKQGVIQERAFKQGETLRETEAELDIDAELRLASDYQRQVAGDDAEQKN

SEQ ID NO: 40755 - protein, 190 aa, Sorghum bicolor
  unsure (1)..(190): unsure at all Xaa locations
  Clone ID: SORBI-28MAY03-C86368_1.pep
MAAAARQRGTVKWFNDTKGFGFISPEDGSEDLFVHQSSIKSEGFRSLAEGEEVEFSVSEGDDGRTKAVDVTGPDGSYVKGGSGGGGGGGGGYGSRGGGGSGGGGRSYGGSWGGGRRSGGGGGAGACYKCGEPGHMARDCPSADGGGGGYGGGGGGYRGGGGGCFKCGEPGHMARDCPSGGGGYXGGGGGG

SEQ ID NO: 40756 - protein, 184 aa, Sorghum bicolor
  Clone ID: SORBI-28MAY03-C86447_1.pep
LAAPRLPAGAPPPAPPPRRRSPPPLCFFLPIPCCFQANPTGRHAGPAAPRSGGPQGRGAAPPAPPPPAEPPANARPWPRGSGGASAAAAPPPPPPKVYRVEPREFRDLVQRLTPPPPPAPAPPRRRRRPPPRPAAAPAPPGRPRPAPPGRRAGALPLVPPPPPWFSFPMAGAVEAAQPQHGAFL

SEQ ID NO: 40757 - protein, 240 aa, Sorghum bicolor
  unsure (1)..(240): unsure at all Xaa locations
  Clone ID: SORBI-28MAY03-C8380_1.pep
DLLSNARWWLEEYKFDGFRFDGVTSMMYTHXHGLQVAXTGNYGEYFGFATDVDAVVYLMLVNDLIHGLYPEAVSIGEDVSGMPTFCIPVQDGGVGFDYRLHMAVPDKWIELLKQSDEYWKMGDIVHTLTNRRWLEKCVTYCESHDQALVGDKTIAFWLMDKDMYDFMALDRPSTPVIDRGIALHKMIRLITMGLGGEGYLNFMGNEFGHPEWIDFSRGPQSLPNGSVIPGNNYSFDKCRR

SEQ ID NO: 40758 - protein, 163 aa, Sorghum bicolor
  Clone ID: SORBI-28MAY03-C8880_1.pep
EPGRAEADFGRYDVKRVVRTIYVLFSRSEIPIAKEGQEIMDLADLSTPLPEWLTEDDLAVYASLYEKSGFRYPMEMPYRSLHKRMPIEDPRFQVPVFVVMGEKDYVFKFPGVESVLKDGIMEKFTPDLKITYIPEGSHFVQEQFPDKVNDLLVSFLKDHPVAA

SEQ ID NO: 40759 - protein, 162 aa, Sorghum bicolor
  Clone ID: SORBI-28MAY03-C89020_1.pep
KAIIRELSGQVSPSLPNYALPPSFYRPSISLLAPASLSAPAATDPDGVGDLMASGATICVGAIAAGAATVTPLVNMSWLVTGVAMRRTPMCCVLLPAIAAVVTFSWEVSDSFAAFLGFLARRRFSDGAGKASGMALSPPNKLFLWTEQKSVPHFALVPHPWN

SEQ ID NO: 40760 - protein, 342 aa, Sorghum bicolor
  Clone ID: SORBI-28MAY03-C8905_1.pep
MISATFSCIKQAMALGCFPRIKIIHTSKKVMGQIYIPVMNWFLMVMCIIIVATFRSTNDIANAYGIAEVGVMMVSTALVTLVMLLIWQTNLFLVLCFPIIFGAVEFVYLTAVLSKIQEGGWLPLAFSSLFLCIMYTWNYGSVLKYQSEMRGKISLDFILDLGATLGTVRVPGIGLVYNELVQGIPSIFGQLLVTLPAMHSTIVFVCIKYVPVPYVALEERFLFRRVGQKDYHMFRCVARYGYKDIRKEDHGFFEQPLADSLEKFLRREAQEIALEASTMEAERDDISVVSGVPQSPACDGDLQTPLLSDQNQVITTEWSPQMVAILCFPQFHVCRKRTWFRV

SEQ ID NO: 40761 - protein, 130 aa, Sorghum bicolor
  Clone ID: SORBI-28MAY03-C89070_1.pep
DPSMHLPHLTSAEAPLGAPAFTSGGTSAVAMNLLDMGCSSHNMVMKMTTSCGSASDMPLNSGGERFGAAADWSILDKLLASHQNLDQLFHCKFGGTTLAVPRHYQQQQMQQQQQQLMEMSASSLHRLPLH

SEQ ID NO: 40762 - protein, 305 aa, Sorghum bicolor
  Clone ID: SORBI-28MAY03-C89124_1.pep
MAKLQVTPAAAFTEYKELIFQGLYLHHMFWNRPKANQARIIENKAPLGIGATVVNNWEVYDGPGENAKLVARAQGSHIYAGKWANSFSLVFVDERFSGSTLEVMGIVVETGEWAVVGGTGQFAMANGVISKRLHKSTSDGNIIELTIRAFCPQLKGTMYPVIKVGPFGGSGGSAMDITEAPRRLESITVYAGVVLDSIAFSYIDNSGQKRSAGRWGGPGGGGPHTIQLGESEVITEVSGTFGTYYNATTITSIKFVTNLNKTYGPWGGGQGASFTIPVQPGSAIVGFFVRGATYLQAIGVYVRTL

SEQ ID NO: 40763 - protein, 156 aa, Sorghum bicolor
  Clone ID: SORBI-28MAY03-C86843_1.pep
MRGLRRWLPFCGGGARGCGEGGAGRGGGVADGLVWDVALKAHASGDYSIAVAQANESLEDQAQVLAAPAATLVGVFDGHGGPEAARFVNRRIFSHIQGFAAENGGLSAEVLQKAFGATEEEFIGLVQKSWPSQPRIVSVGSCCLVGAIEGGTLYVA

SEQ ID NO: 40764 - protein, 280 aa, Sorghum bicolor
  Clone ID: SORBI-28MAY03-C8688_1.pep
GDLEHTHLVKGLDYALLHKVRSEIEKKPDAEDGKDSKSRATKEDQAVSFRTATAKSVYQWIIKPQSIIKENELFLPGRMSFIYNMEEGITNDIPTTLHKSKADCPVPEEMVTVSVDGSVLDRIAKIMTYLRLGSSGKVLKKKKKERDIKGKNNLASGDYDESVKPSQINGSTLKHQSDMPPPPAPPPRNNNFNGKEKQPVPVSRADDDDIFVGDGVDYSVPNKEMSQSPVSDMDESPHNHQKQSNFTEPMYGPVPPSEPAQAWQQQNGYDAVQAQMAAAG

SEQ ID NO: 40765 - protein, 146 aa, Sorghum bicolor
  Clone ID: SORBI-28MAY03-C86933_1.pep
ACSPVFESMFMHDLREKESSTINISDMCLESCSALLGFIYGTIEQGQFWKHRLPLLAAANKYGIGDIKDCCEESLLEDITSANVLERLHVAWLYQLERLKKGCLTYLFVFGKIYDVRDEMHSFFHHADRELMLEMFQEVLSVWKPM

SEQ ID NO: 40766 - protein, 285 aa, Sorghum bicolor
  Clone ID: SORBI-28MAY03-C86978_1.pep
MKITVRGSEMVYPAAETPRRRLWNSGPDLVVPRFHTPSVYFFRRRDADGNDLTAADGSFFDGARMRRALAEALVPFYPMAGRLARDEDGRVEIDCNAAGVLFQGADAPDATIDYFGDFAPTMELKRLIPTVDFSDDTAFPLLVLHVAHFKCGGVAIGVGMQHHVADGFSGLHFINSWADLCRGVPIAVMPFIDRSLLRARDPPAPVYPHVEYQPAPAMLSSEPPQAALTAKPATPPAAVAIFKLSRAELGRLRSQVPAREREGAPRFSTYAVLAAHVWRCASLAR

SEQ ID NO: 40767 - protein, 185 aa, Sorghum bicolor
  Clone ID: SORBI-28MAY03-C8712_1.pep
RSQLTAMSSSSQVAHHGACGHGEVARGRDGRRPLVVVVPHAEREAAEAERGDEHPGEDAERPRGQRCQVRRRRGPPLQDERQHRLHGQRNHGEQDGGEAVADVVAGEEGRNGGGGAGRRREVRRDRHDHGAEVEEQRVPPHLVEQPLNFLFPLPFRLSGSNSLLRIHLPLLQLCSEPLGCAPKKR

SEQ ID NO: 40768 - protein, 305 aa, Sorghum bicolor
  Clone ID: SORBI-28MAY03-C91451_1.pep
ARDFVYIENQYFLGSSYAWRRQNDGVTVEDINALHLIPKELSLKIVSKIEAGERFAVYVVVPLWPEGVPESGSVQAILDWQRRTMEMMYRDVTLAIRAKGLQDDPRDYLTFFCLGNREAPSPGEYVPPDHPDPNTDYERAQQARRFMIYVHAKTMIVDDEYIIVGSANINQRSMDGGRDTEIAMGAYQPGYLATRNRPARGQVHGFRVSLWQEHLAQAAAAAAGGDLLRPSSLACVRRMNQVAKQHWDMFASDAFRGDLPGHLMAYPVSVLDDGSVVATTESFPDTNNAKVLGNKSDILPPILTT

SEQ ID NO: 40769 - protein, 356 aa, Sorghum bicolor
  Clone ID: SORBI-28MAY03-C9157_1.pep
MEHVVGARFKLGKKIGSGSFGELYLGVNIQNGEEVAIKLESVKSRHPQLIYESKIYMFLHGGTGIPNLKYFGVEGDYNVMVIDLLGPSLEDLFNYCNRKFSLKTVLMLADQMIARVEYMHTRGFLHRDIKPDNFLMGLGCKASQVYVIDYGLAKKYRDLHTHRHIPYREDKNLTGTARYASVNTHLGVEQSRRDDLESLGYVLMYFLRGSLPWQGLKAGTKKQKYDKISEKKMLTSIEALCKSYPSEFITYFHYCRSLRFEDKPDYSYLKKIFRDLFIREGYQPDYVFDWTVSRQAADNNRLRLSGKTGGLVGPSVDRAERAATRHDVAERFTGPADAFTRRTGSGSGHYGEHTKH

SEQ ID NO: 40770 - protein, 153 aa, Sorghum bicolor
  unsure (1)..(153): unsure at all Xaa locations
  Clone ID: SORBI-28MAY03-C917_1.pep
MKEGSSSGGGAFAGGSDPRQPSTAKPYAPPKLSPQDLPIDYAGFLAVVFGVVGVMLRYKVCSWIAIIFCAQSLANMKNFENDLKQLSMAFMXCCYGSGDELFWPPSSRQHKALICGRTPCASSFIGYLANLFGASIXLPSVLTFMYVQFEQTL

SEQ ID NO: 40771 - protein, 133 aa, Sorghum bicolor
  Clone ID: SORBI-28MAY03-C918_1.pep
MSKVFTLEDVAKHNTKEDCWLIIGGKVYDVTKFLEDHPGGDDVLLSSTGKDATDDFEDVGHSNTARAMMDEYLVGEIDASTIPSRTKYVPPKQPHYNQDKTPEFVIKILQFLVPLAILGLAVAVRMYTKSESA

SEQ ID NO: 40772 - protein, 168 aa, Sorghum bicolor
  Clone ID: SORBI-28MAY03-C9192_1.pep
ENLPMHAGFDEIQPEKDVQKPSTSVEDYSIKNHVGSESVQFDDEGKHLSDDDVEMRDDTPGYGSSHAQDDAHGFVAHDDGNESGEDFDEKSGHPSEPTDCKSCDTGASCKCWLKKHMTCLYNQAKETSAIWSVVVAAALVGIVILGRWHKDKLHLNQLKWRSGSAVRG

SEQ ID NO: 40773 - protein, 196 aa, Sorghum bicolor
  Clone ID: SORBI-28MAY03-C87924_1.pep
ESGRWDMMKSSPIPCDVDFRPSILVRNILYWPLKSKHILAFELVTHRLYHIECPPETHDIYRRNVHIMKTEDGGLGLAALAKFNLRLWAWETDAEGVTGWVLRRIIELDRFLPLDVSSLPSPENGSCGRPPVRMLGLVEDDDLVFLWTITGVFAVHLKSMKFKKVFEADVSKTVYPYKGFHIAGLVGCGGGNVAAE

SEQ ID NO: 40774 - protein, 180 aa, Sorghum bicolor
  Clone ID: SORBI-28MAY03-C88124_1.pep
GGGPLASGPFSGCLALPGLGYPLRRRGYPPLASTEPPLASTGGTMGAWRWTTYAWRTRTSVGCAPRAAAPGPKWDTAGPLWLWWAPLAPWQTLLATTPTLLETTPARLGPSVAPTRPSHAPTPACRWLLALSGLLLAPTPLYLALRSCPERLLVGRPPDRPLPWTLFDYGKRKSLSIQSL

SEQ ID NO: 40775 - protein, 192 aa, Sorghum bicolor
  Clone ID: SORBI-28MAY03-C8808_1.pep
VKAVKKEKKCPFATVKIEEISDDNDAGCVAIKKAFAKGNGKGKRKELSPQDAALLIQMTYKAHLGHRSQVLRCLRDLAVAKAKLKELRSLFYNISYRHRIAHDHEERQRFSEKIIVLLITVDALEGPDYMVRTAKKSMLEELEAMLEVVDPQPPGKQRSLSRRKFDLPEGGAISDEKMAAANKAVRIIEEGK

SEQ ID NO: 40776 - protein, 161 aa, Sorghum bicolor
  Clone ID: SORBI-28MAY03-C88477_1.pep
ARGRPEPSSPATPRLKYMKMDVKNMSDFGSGSFDAVIDKGTLDSLMCGQNPPLAPPLRLDVAPRLRLLLGGCGLSAFGDPRFRVRLLEVVDIGTASLLVVQRWEKCPDQPQRELTKPVPLDVAGSAPGALLAPIPDGPLVSLWGGRNARASAASMLGEAAN

SEQ ID NO: 40777 - protein, 174 aa, Sorghum bicolor
  Clone ID: SORBI-28MAY03-C8878_1.pep
HEEIATAPPRVGHGAGPSGLAPALQNDRQSGPEEARTSGWSSMDRRRAPLPITSVGTLSKQKAPVGNDATVSRDAVISGPNFLGRSSGSSRRPVISTSHDVVATDSSEPSRARTTDASPGAFRRASGPQRSSPVHSAEQKRSSSGRHPSNVKNYDSALKGIEGLNFDGDERVQY

SEQ ID NO: 40778 - protein, 293 aa, Sorghum bicolor
  Clone ID: SORBI-28MAY03-C88764_1.pep
MRKEVRQAVEEIRNQLEKAVTKSEPSEKPISSDAQPTQVITELRRSYTSKLEESEKRKQELLAQLAAEEQHGHELTKIVRELLPTPKMTANLQRQPRHRRRSNDRSRMSKRLTEEAEQYFEDFLSNVEDTDFSSFDGERSDSSSARKDLLLNATTETPVARPKVALPAEADGVVLPWLQWETTNDLQTSPCKTKAQGESTRCSTSNQTTSSRGSWSPGDHATSVASKDRLLTKFGEVGICRSICPDYVRTLSSFHIDDYLHLRQSEDLLLETWRQKHRIDSGGLALCSKSTIL

SEQ ID NO: 40779 - protein, 208 aa, Sorghum bicolor
  unsure (1)..(208): unsure at all Xaa locations
  Clone ID: SORBI-28MAY03-C9331_1.pep
TEFMSSGSVYDYLHKHKGVFKLPALVGVAMDVSKGMNYLHQNNIIHRDLKTANLLMDENGTVKVADFGVARVKAQSGVMTAETGTYRWMAPEVIEHKPYDHKADVFSFGILLWELLTGKIPYEYLTPLQAAVGVVQKGLRPTIPKHTHARLSELLQKCWQQDPAQRPDFSEILETLQRIAEEVGDEHEGKHKDRXLGGFFSAFRGRSH

SEQ ID NO: 40780 - protein, 81 aa, Sorghum bicolor
  Clone ID: SORBI-28MAY03-C92711_1.pep
SLLVVLCCCCVSSTAGFDVDYCVKEQRWLCVCDMNLLLVVWNCLSGKTRIRKLGSSAAVTKTNTPETIMVLYAVHPAYPAS

SEQ ID NO: 40781 - protein, 243 aa, Sorghum bicolor
  Clone ID: SORBI-28MAY03-C9357_1.pep
MDGGRAAAVGGDPSPIAAPTNPSALSSRPVDVSSFTHTPCYCEENVYMLCKELIRTGVADPAGTDLYVVFISNEEKKVPLWHQKAGHSDNGFICWDYHVICIQSRRSKGEVLDFVWDLDSDLPFPSPFIQYVSDAIQPLSFSNSRYARLFRVIHAPVFLRSFASDRSHMKDPEGNWIQLPPKYEPVVAEDGTTNNLNEYIMMSVEDVADVESMANDVYYNKHGVVLNETILPKFFAQLPGPDT

SEQ ID NO: 40782 - protein, 201 aa, Sorghum bicolor
  Clone ID: SORBI-28MAY03-C93711_1.pep
MAHVAGDIAVLVLFLSLSCQIITVVSGGASVLGRKAGSLATNEAAGNPAGKKGTAQYAVIFDGGSTGSRVHVFQFDKQLDLVKIGNEIQFFAQVKPGLSAYAGEPQEAAKSIAPLLEKAQSVVPTWLQHKTPLKLGATAGLRLIGDEKSEEILEAVRDLVRSKSKFQYNPNWITVLEGSQEGSYLWVALNYLLGRLQTLLW

SEQ ID NO: 40783 - protein, 225 aa, Sorghum bicolor
  Clone ID: SORBI-28MAY03-C9372_1.pep
GDVANAERRAQAAAQAAAHAAGAQVTAAQPGTAQATAVSAAATDPYAGAYASYPSAYQQGAQAAAYQQGAQAAAYQQGAQAGAYQQGAQAGAYQQGAQAGAYQQGAQVGAYQHGTQAGAYQQGNQAGAYTYAYDAATAYAYAGYSGYPGYAQSAVPNYSYAVPPQPSSGATTEAASMYGAAGSAGYPTAQVQPSSATANAAQPPPPPPPAAPYPSTYDQTRGAQR

SEQ ID NO: 40784 - protein, 139 aa, Sorghum bicolor
  Clone ID: SORBI-28MAY03-C8913_1.pep
EDADLEDFYDYSSSYVDAEGKQLVAVDESNNNIELGTGGSELVITNKSEKGTRVRTLGSREFIRYYRQKPRPSVATDRALALSLASSYKNMGLVTVQSKEQMVRLKVLRAMNKTGVETMRNKIGMKSNVIRNLPKNCPY

SEQ ID NO: 40785 - protein, 110 aa, Sorghum bicolor
  Clone ID: SORBI-28MAY03-C89972_1.pep
QRSVKDLSACFLTYHTISSSFQDHGLETMTNDCCHPVANGKQNGHMDKKSNTVSLPPFGLAAHKIQGSLWTNPITGDHRKMDVLFGAADSWLKQLGVQHHDFNFFITHPM

SEQ ID NO: 40786 - protein, 226 aa, Sorghum bicolor
  Clone ID: SORBI-28MAY03-C90146_1.pep
MSGGSVSAVFYADKYHPIQAGSIDGTDVAPHDNAVLRALICSQAGLYDPFGDPKASGDPYCTVFVGRLSRQTDDDTLRKAMSRYGRVKSMRLVRDIVTGASRGYAFVEYETDREMRRAYEDAHHSIIDGRYSHHRGHRKRRRSQELGELSPPEEDVSYEKERTSDEPGRSPDRYHHHRHHREDTYESRHSHHREDTYESRHSHHRDRRRHGDRHHSKRSESRDYRD

SEQ ID NO: 40787 - protein, 133 aa, Sorghum bicolor
  Clone ID: SORBI-28MAY03-C9050_1.pep
EHHEDAHDHEEFEFSEVFVHQLIHTIEFVLGAVSNTASYLRLWALSLAHSELSTVFYDKVLLTALGLNNIFALIIGGIVFVFATVGVLLVMETLSAFLHALRLHWVEFQNKFYEGDGYKFAPFSFALIREEED

SEQ ID NO: 40788 - protein, 324 aa, Sorghum bicolor
  Clone ID: SORBI-28MAY03-C91359_1.pep
ARGPNIGFTADDVILCSLPMFHIYSLNTIMMCGLRVGAAIVVMRRFDLARMMELVERHRITIAPLVPPIVVAVAKSDEAASHDLSSVRMVLSGAAPMGKDIEDAFMAKLPGAVLGQGYGMTEAGPVLSMCLAFAKEPFKVKSGACGTVVRNAELKIVDPDTGKSLARNLPGEICIRGQQIMKGYLNNPDATKNSIDADGWLHTGDVGFVDDDDEIFIVDRLKEIIKYKGLQVAPAEIEALLITHPSIADAAVVGKQVEPEIGEIPVAFVAKAKGSELSEDDVKQFVAKEVIYYKKVREVIFIDKIPKAPSGKICARSKEAASAT

SEQ ID NO: 40789 - protein, 345 aa, Sorghum bicolor
  Clone ID: SORBI-28MAY03-C95915_1.pep
MACLAPQFLWAPSAAAHVPSSSSSYSRCSALRVHCAVTSAVVVEDRTNRSAAQLKLAYAAPAIQRNLEATLASEALLNEEAVVAAAAAEAVALARAAAEAVQEVVQMVQKNNHQPVIRQKKGVDNYLANEILRTEMQSSSPDMYANNSLMEDLESFGIMASEDELEAYAQYAENIAVKSARQSERRARRTRAAIKASTTRCASQKAASSSKKKRSKGSSSSMNPLGSLWKMTGRRLLTAKEEVEFSEGIQDLLKLEAIQAELTEYNGGQPTFSQWATAAGVDEKTLRKHLNYGIYCKNRMVTSNVRLVISIAREFEGPGMDLYDLIQEGMQGLIRGAEKFDASKG

SEQ ID NO: 40790 - protein, 112 aa, Sorghum bicolor
  Clone ID: SORBI-28MAY03-C9592_1.pep
QYKLNSKLAMHRQQLHTMNLPDSMFQSSNTGNKLHTTLLQTVHFMPVKLKRNHGHVEHQAINILNSRLSNFALATIHSQWAQPNTHRTMSTNEFNLIQERSSMVEALGSARN

SEQ ID NO: 40791 - protein, 154 aa, Sorghum bicolor
  Clone ID: SORBI-28MAY03-C96099_1.pep
NAVFYLGITSTGQDIATEVLGSVAGRIRGAIDRMDDELVRSAIDYFEMAEMDSRPPRGTLSQTVLHIFSWLGRPQYDADFGWGKPELMSLAESQCGGFVNLMNDDDGAGNGGVRLHMCMEAVNIKEMEQLLYAKLALAAFATRKGTSCDDYLSR

SEQ ID NO: 40792 - protein, 317 aa, Sorghum bicolor
  Clone ID: SORBI-28MAY03-C96603_1.pep
MADASDNSMALVHARLAVSAVAPPRMLRQRQKWEVEYARYFGTPRRDPSAPPPPGLRHIIRGVHRHQGTWIPASCPASLCVSHPSLPSAVPVLTISIGDVVFEEHFVSILNFSWPQITCVMQCPIRGSRVVFVSFCDKSKQIQKFAVRFPQLCDAELFLSCVKECSCETMDMIPSGSDYVCEDSSTSEYIAYNGLHHRPDDASGFEEQSSDHTIDEPTMSYHEEQDQPVLEPLSASNTSNSYSAVPPSFTHVLTARSMAYVPEEPCPGAASLPAPLHVHALDAPQDGASPVPSAGHGLDAPAGADAGTLTFGPLAPL

SEQ ID NO: 40793 - protein, 321 aa, Sorghum bicolor
  Clone ID: SORBI-28MAY03-C967_1.pep
ARGLTSEEGVFRRFTQSFFLAPQESGGYFVLTDIFRFILERKPAEIVQGPTEENEISQNGRPASETCSALPEPIPADRNVISDHVTAESNVTERQVSDPSANGTAIENNVKTQPPVQVPKEDPKKALVAAPAPPTQTDVTKKSYASIVKVMKEGPLTPPVAKTTSSVPKQKPAPKPVSKAVEGPEKPSVKPTQAIETGDGIVAENNSSRNEQGYSIFVKNLPYHANIEMVEEEFKKFGTIKPGGVQVRHNKVDRYVYGYEEYESRQSMQAGIEASSVHMEDKVVGIEAKRANSRGGRFQSRMGAYHGDNFIGRRSGYVDNA

SEQ ID NO: 40794 - protein, 192 aa, Sorghum bicolor
  Clone ID: SORBI-28MAY03-C9198_1.pep
MAAPPGGAHAGAGAADPMQVDQPLPGAAAAAAAAAAHGPADAKHAGSMIEGSDPVTGHIISTTIGGKNGEPKRTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYI

SEQ ID NO: 40795 - protein, 215 aa, Sorghum bicolor
  Clone ID: SORBI-28MAY03-C92019_1.pep
SRSRSTILLLYYTIELGSPQHDDDNAGPRRRPEAGRCAVTGGRGCVARCRVAASLRSGEWRVRVTHLAPTLVFGPGETEAMLSDALCDGRATLASVDVCNLDHLTIALEGGDVVFHTAAADPSQNNLQLHYKVNVVGTRNVIEACKICKVKRLIHTSTSAVVFDGVHGLFDVNESLPYPDKFPDAYAQTKVEAEKLVIKANNINDLLTCCLRPGS

SEQ ID NO: 40796 - protein, 145 aa, Sorghum bicolor
  Clone ID: SORBI-28MAY03-C9205_1.pep
MATVPDSLVWQIVRKNNSFLIKQFGNGNAKVQFSKEPNNLYNVHSYKHSGLANKKTVTVQPASGKEAAVVLSTTKTKKQNKPASLHHKSVMRKEFRKMAKAVKNQVGDNYYRPDLTKPALARLSAVYRSLQVAKSGVKKKNRQAN

SEQ ID NO: 40797 - protein, 268 aa, Sorghum bicolor
  Clone ID: SORBI-28MAY03-C92443_1.pep
NGGGAGATAAMMLHGRVAIVTGGAGGIGSAVSKHLASLGARVVVAYIGDPAPALSLVSGINSSHPGESLSQQPRAIAVEADVSDAAQVKALFDAAAAAFGEELHILVTLAAVLDYSYPPLAETSEATFDATFGTNTRGTFLCCREAARRLVRDGRGRIVTFSSSGVGSLRPGYSAYAASKAAVEVMTKILARELRGTGITANVVAPGSTGTPMMYTGKTADDMQRYIAEAPLGRLGMPEDIAPLVSFLASDAGHWVNAQVLRCNGGTI

SEQ ID NO: 40798 - protein, 135 aa, Sorghum bicolor
  Clone ID: SORBI-28MAY03-C9271_1.pep
ILPFGAVFVVRSFLPASIWLHQFYYIFGFLFLVFIILIITCAEITIVLCYFQLCSEDYMWWWRSYLTSGSSAIYLFLYAGFYFFTKLQITKVVSGILYFGYMLLASCAFCVLTGAIGFCACFWFTRLIYSSVKID

SEQ ID NO: 40799 - protein, 185 aa, Sorghum bicolor
  Clone ID: SORBI-28MAY03-C9319_1.pep
PTRPPTRPVRTTVRMTRAMYAQLVQQNFQAPRGYPMPRREEGPEKWMEAELGMKIACGFEMMYQERRRQGEEGKGSTWEVYRKSLEAAGCFEGLLPGSMEYKRVMEDAMQYYKSSNLYSRTREILSEPVRRIDEILSTPYSADEFKGTDLPPSDDDSWLYGGDDELNAELRERHKELEEYEAAKK

SEQ ID NO: 40800 - protein, 110 aa, Sorghum bicolor
  Clone ID: SORBI-28MAY03-C98630_1.pep
HFDQYSPPDFYTRVGIAGVPADSVMKKTKAIEDNWMPVWEEEFSFPLTVPEIALLRVEVHEYDMSEKDDFGGQTVLPVSELRPGIRAVALFDRKGNKYNNVKLLMRFEFA

SEQ ID NO: 40801 - protein, 86 aa, Sorghum bicolor
  Clone ID: SORBI-28MAY03-C985_1.pep
LGAHGSATYRCGVQFMDLIITVSKVIVCKGADHGCKHYKTCFLFIYSTYNLLSVNHVRQPMRAMARALHWYNGLFVFGDSFADTGN

SEQ ID NO: 40802 - protein, 100 aa, Sorghum bicolor
  unsure (1)..(100): unsure at all Xaa locations
  Clone ID: LIB3476-013-P1-K1-H1.pep
LLPSGXXLHMDSDCTRMLGQKLASQIAVTWMPCFTACTKGLLASSNVDDKLFWLYKGCYCPIAPSMIYAFHILFGGFTAATNIDPQIFIWPISDIFIFGK

SEQ ID NO: 40803 - protein, 175 aa, Sorghum bicolor
  Clone ID: SORBI-28MAY03-C9877_1.pep
MASAPSTTAHTLAPSHRTPVSSAPRGARLPAAFRLSCAQPGPAGCRAASGRLVRPRARVRCGAAASPRGQPRVRAEVLESELPVLVDFVADWCGPCRLIAPVVDWASEEYNERLKIVKIDHDANPQLIEEYKVFGLPTLILFKNGQEVPGSRYEGAMTKDKFKQYLEPLLTTTVA

SEQ ID NO: 40804 - protein, 65 aa, Sorghum bicolor
  Clone ID: SORBI-28MAY03-C98790_1.pep
CAFPFSYQLRLKCGQVQSLRNRNLIAWLVLGRSLLINHETGLLVFNKHLGDGGLVSSTRSKLWLG

SEQ ID NO: 40805 - protein, 128 aa, Sorghum bicolor
  unsure (1)..(128): unsure at all Xaa locations
  Clone ID: SORBI-28MAY03-C988_1.pep
MSSAVETISCSKVDVPAGPEPEEKAKKAAVPAEHGGDAAAPINGKCGEAAPRCHEEEEEDEEDAPKVIDLGPMVSIKEQLEKDKDDESLRRWKEQLLGSVDFNSVGETLEPDVKIMSPAILSPXRPDI

SEQ ID NO: 40806 - protein, 159 aa, Sorghum bicolor
  Clone ID: SORBI-28MAY03-C13789_1.pep
MYPAKPCAPAGMAVAPVVGFPVAGALRQQWSSGLFDCLDDCHICCLTYWCPCITFGRIAEMVDRGATSCGTSGALYAVIACLTASQCTWVYSCTYRAMMRAQFGLPRGACADCLVHLCCEPCALCQQYRELTARGLDPVHGWDFNAAMYPPPTQGMRRR

SEQ ID NO: 40807 - protein, 155 aa, Sorghum bicolor
  unsure (1)..(155): unsure at all Xaa locations
  Clone ID: SORBI-28MAY03-C13777_2.pep
QISDLKSKELSGHDIFAPPEDPRPRNSENGSTSQTPGKNAYVLTSELTSSXYKLSYNSSSVAHCWWLFSQQVSNIKFGEADEDSVVKTAKKIPTKKFTDLAGNIFKGDETPGAAEKHLSTAKLKEMTGSDIFADGKAPSRDYLGGIRKPSGGESS

SEQ ID NO: 40808 - protein, 131 aa, Sorghum bicolor
  Clone ID: SORBI-28MAY03-C13777_1.pep
KRQISDLKSKELSGHDIFAPPEDPRPRNSENGSTSQTPGKNAYVSNIKFGQADEDSVVKTAKKIPTKKFTDLAGNIFKGDETPGAAEKHLSTAKLKEMTGSDIFADGKAPSRDYLGGIRKPPGGESSIALV

SEQ ID NO: 40809 - protein, 104 aa, Sorghum bicolor
  Clone ID: SORBI-28MAY03-C1379_1.pep
MAKAQAMAALMLTVLVVLAASAEMAHGVCNLSSAGIRACQPAAAIRNPTEQPSAECCAALAGADLACLCRYKNAAGVWVRFYRIDINRAMGLPGKCGLAMPANC

SEQ ID NO: 40810 - protein, 204 aa, Sorghum bicolor
  unsure (1)..(204): unsure at all Xaa locations
  Clone ID: SORBI-28MAY03-C13888_1.pep
MAAPAEAHAHDAAAAAAAGLRLDYDVIVVGAGIMGSCAAHAAASRGARTLPLAPRGPRLLLRAPLGLPRPLRAAHGDARFPPVARLPPRLGPVAGPAPRLRAPAPAPPRSRGPPPTPPLPMGPRSSASLAAALANIGAEEVHXDDLGGRXGGAFPFTVPDPSDEWVTALSDHGGVLSATKAVAXMFQSLAVAKGAAVRDNTEVV

SEQ ID NO: 40811 - protein, 213 aa, Sorghum bicolor
  Clone ID: SORBI-28MAY03-C99156_1.pep
ARGKYCGVSQCHQCSLRRNYFISRGGQCSTFTVPRGLWPTFSGRVTKPSEGMFHVPQRPYTSLGTLRDQIIYPLSREEAKIKVLSLHRSGNNSSASVLLDDHLKTILENVRLLYLLEREGWDSTPNWEDVLSLGEQQRLGMARLFFHHPKFGILDECTNATSVDVEEHLYRLATSMGITVITSSQRPALIPFHALELKLIDGEGNWELCAIQQ

SEQ ID NO: 40812 - protein, 184 aa, Sorghum bicolor
  Clone ID: SORBI-28MAY03-C9928_1.pep
MPPGGGGNRDAAPAMHVLMLPWLAFGHIVPFAQLARRLLASSSSVRVTFVTAAGNVPRVEAMLSSASSSAGGRVSIVPLRLPHVPGLPEGAASTAELSLDGAELLKVALDGARPQVAALLAELRPDAVLLDFATPWAAHDAAALGVKSLHFSAFSAVARAYLAVPARRPEGASPPPSARDLMPR

SEQ ID NO: 40813 - protein, 137 aa, Sorghum bicolor
  Clone ID: SORBI-28MAY03-C99338_1.pep
ARGPIRRCIRVWPLLDAPGRSAPGWRCPVVPPMRPCLGPLGVYALGGWPAFRASRSARHPVTKTVSVEFGRKDNIACILLHPGTVDTDLSRPFQRNVPKDKLFTREFSVQKLLSIIDNVKKSDNGKFFAWDGQEIPW

SEQ ID NO: 40814 - protein, 107 aa, Sorghum bicolor
  Clone ID: SORBI-28MAY03-C99386_1.pep
GWCVTTAAGIASYPLDTIRRRMMMTSGEAVKYKSTMDAARQIVAKEGVKSLFKGAGANILRGVAGAGVLSIYDQLQVLLFGKAFKGAPGLTPPDQTCVWRSSDPGGD

SEQ ID NO: 40815 - protein, 74 aa, Sorghum bicolor
  Clone ID: SORBI-28MAY03-C100298_1.pep
LHPHLAPHPKAGERRRPPLVLQAADLVDGRHDLSPERSASLFTPFFPLWIYAKFSRLSSSSSVRTKRVNNPCPC

SEQ ID NO: 40816 - protein, 166 aa, Sorghum bicolor
  Clone ID: SORBI-28MAY03-C99791_1.pep
ARGFFTSILATPGGTNTTSGSVVTGANVEKVPGLNTLGVSLSRIDYAPGGVNPPHTHPRATELVFVLYGKLDVGFVTTANKLVARTIARGDVFAFPRGLVHFQRNPGTEPAAVISAFNSQLPGTQSIAMTLFGASPDLPDDVLAKAFQIPDEQVAKIKDKFAPKKG

SEQ ID NO: 40817 - protein, 212 aa, Sorghum bicolor
  Clone ID: SORBI-28MAY03-C97580_1.pep
MDKQGAGGDVEVPAGLGLTAAEYEQLRSTVDAHHRYAVGEGQCSSLLAQRIQAPPAAVWAIVRRFDCPQVYKHFIRSCALRPDPEAGDALRPGRLREVSVISGLPASTSTERLDLLDDAARVFGFSITGGEHRLRNYRSVTTVSELADPGICTVVLESYVVDVPDGNTEDDTRLFADTVIRLNLQKLKSVAEANAAAAASFVSVVPPPEPEE

SEQ ID NO: 40818 - protein, 126 aa, Sorghum bicolor
  Clone ID: SORBI-28MAY03-C97833_1.pep
MGKQKIVLKLPLDDERKRRKAFKAAVGMNGVTSATMEGDKIIIVGDGVDPISLTTMLRRSLGYAELLSVSSGDDKKKGDGYGYGSSGGMMYGGGGGGMGGSGAFGGGKEGLGGSESGGGKSSSGHA

SEQ ID NO: 40819 - protein, 176 aa, Sorghum bicolor
  Clone ID: SORBI-28MAY03-C9820_1.pep
MNKRPRDDHSSFASAPKRQYGAGGGYGAQQGYSEERNSARRVADHYSARSNQTLEERENSPIIHLKKLNNWIKSVLIQLYARPGDCVLDLACGKGGDLIKWDKAKVGYYVGVDIAEGSIKDCMTRYNGDTDQQRRQKVSFPARLICTDCYEARLDEYLYEDAPFDICSCQFALHYS

SEQ ID NO: 40820 - protein, 359 aa, Sorghum bicolor
  unsure (1)..(359): unsure at all Xaa locations
  Clone ID: SORBI-28MAY03-C9852_1.pep
TRPAPRSPAPRRPSPPPRLRRPAARRFPALCCRRPLCSRSSGPSGRATRTTNNHSRRLGTPWCVILFGSNLTILEKRYICLSAMSIEERKISMISKSTMLNPNAEEFVPSSLRSVNDSSKRSDATMVVSGPSKESSTDKPESILRSNSDEEAHQYWQQQLPDDITPDSLPLGQDESTGPDSLSLTGLSINDGIGTSIFSPNQALSMQHHASPFIRDKLSPRVRINLSGPTYMDERSQATILSPTAGSMSPNAAPWVKTMRNGVHYNTSRRDTSHYNGDSSIGASLHNLSDVYGSRRSLSSTMDIMSQLESKVDGRLGQNLRSLSFGNSSPPSPASYAQNGLXNYSNESFGCQTAIIDLF

SEQ ID NO: 40821 - protein, 102 aa, Sorghum bicolor
  Clone ID: SORBI-28MAY03-C98598_1.pep
MGDSSSSASYIRMVHHMIEKCICFNLNKEECMDALEKHANVNPVVTATVWKELEKENKEFFETYNKEREERNIIEAETMERIQKMLSEAAASKSSDDDDDDG

SEQ ID NO: 40822 - protein, 206 aa, Sorghum bicolor
  Clone ID: SORBI-28MAY03-C10136_1.pep
HEAQVHLHELGFSDLSKIYVFRGTKEISKDQILDQLGLAGAGRPRFPKMPQQPGGPQVNGMHSLSTAGVNRFLLPVSECECALSTLLDELQPDQWPVEAGNRAIRCTGVALSVAAGLLGACMPGTGARIIALLGGPCTEGPGMIVSKELSEPVRSHKDLDKDAAPHFQKAIKFYDGLAKQLVSQGHVLDVFASALDQVGLAEMKVA

SEQ ID NO: 40823 - protein, 121 aa, Sorghum bicolor
  Clone ID: SORBI-28MAY03-C10197_1.pep
MKETNKVTAEAMEEEEEEEEEEERYVKVGTRFYRVTMRPNGGGGAGDAVARRRRRLHYLESCYLCKQSIACDRDVFMYKGDAAFCSEDCRDDQMDMDEALHAAARRHRLLQRSPASASAVV

SEQ ID NO: 40824 - protein, 144 aa, Sorghum bicolor
  Clone ID: SORBI-28MAY03-C102018_1.pep
SLHTISIFIQLSHLFITMNRQQHYTQPYQTAPTHRYPSTSSAFSASANPNEDWTKITDLAERRRIQNRIAQRNYRKKLKKRLEDLEKRAASNSASPEQKPVELERPSAQKKNSTSSESRDPHSFSTFDSQTSQASSMQFMPFDD

SEQ ID NO: 40825 - protein, 116 aa, Sorghum bicolor
  Clone ID: SORBI-28MAY03-C103427_1.pep
MEPTPRPSRSSSTSSRNKSNLSLDLSDLPPLIQPTPPSNTLLFTNLNNLDIFLPENLQEIRSLIEKVSPIHSFAPLKSFRRIIVSFFDIDSSLAIRQIWDGKAIMGERIRLYFGQT

SEQ ID NO: 40826 - protein, 77 aa, Sorghum bicolor
  unsure (1)..(77): unsure at all Xaa locations
  Clone ID: SORBI-28MAY03-C102671_1.pep
PTTCSSTRSTDCWSSTSTNCWSSTCQSSSRSTDCSSTRSTACQPSTSTGSTNCSFXSTTCQSSTSTRSTNCWSSTST

SEQ ID NO: 40827 - protein, 211 aa, Sorghum bicolor
  Clone ID: SORBI-28MAY03-C10179_1.pep
MELCVSTTTASVRATTAAPISFAPPRRGGASASTALPVHHRRIPTRGWRCAASAAVPDPVPSEEPASASYTVVVTDKPDTPADDKVEEVSAAPSGSAEAPVAELVSSEASPSPDGGGLDEILSKLNIEVTPTLILTGSAAFVALWILSSVVAAIDSVPLLPKLLELVGTGYSIWFIARYLLFKVHLFLMELFKESRDDLFAKFEDLIQRIV

SEQ ID NO: 40828 - protein, 77 aa, Sorghum bicolor
  Clone ID: LIB3478-011-P1-K1-C2.pep
FIFQIQTLSWMIYSLSCCCLLIYRAYIFQLNIEVTPTLILTGSAAFVALWILSSVVAAIGSVPLDRSYVCLHKSELV

SEQ ID NO: 40829 - protein, 110 aa, Sorghum bicolor
  Clone ID: SORBI-28MAY03-C98846_1.pep
VTQEMAVAKDETFGPLAPVFEFETEEDAIRLANDTEFGLAGYFFSKDISRVMRVAHKLQVGMVGANTGKISAAEAPFGGVKESGYGKEGSLYGMAEYQNIKSITIGNLNN

SEQ ID NO: 40830 - protein, 72 aa, Sorghum bicolor
  Clone ID: SORBI-28MAY03-C98876_1.pep
ARGHDKKLFFKVVFTLYFLAALGRVVSGAAVAYAALCIFCLYMFAQSTDLFDQLPSWVPVGRDSLGGTQDTA

SEQ ID NO: 40831 - protein, 168 aa, Sorghum bicolor
  Clone ID: SORBI-28MAY03-C9913_1.pep
MALALASLPMASLSFHSGRISAAAIGGVARTRRAAPVGVSASPFLRSSFVSSSSTSSASASPASLAAAVSASLAFTSSSSFAGSSLGIEFSYNRMTTRRSRGMQIRAGKAALCMTKRSRSRKSLARTHGFRRRMRTTSGRKVLKRRRAKGRKVLCTRTNSPTGKKRLF

SEQ ID NO: 40832 - protein, 64 aa, Sorghum bicolor
  Clone ID: SORBI-28MAY03-C99131_1.pep
GGLRFAHLGGAPCRRLLSMSSSVDCSKKRCSWRRPNLHRRCYYLCRHIYTCMIIIMGHEHSRLP

SEQ ID NO: 40833 - protein, 249 aa, Sorghum bicolor
  Clone ID: SORBI-28MAY03-C99198_1.pep
TRPNSRPAALRPSATEGQSLARRRRQRLPLPPRPSRAPPLRPPRAGPRSAAPSAPPPPASRQSRRSPPPSAHRPATLALQAEMDIKRLEADKLDCRLYVGNLDFRISESEIIKMFSPFGKITAEDFLWHTRGPKRGEPRGYAFVQYTTKEEAQLAKEKMNGKLVCGRPMVVHLASEKSSLDSSSSHRAVKDKKLTGGSGGKSQYTDRAAKIAAIKNKLKSLEEGGCSTKKPRLNPDNLTGIREQSHKKF

SEQ ID NO: 40834 - protein, 145 aa, Sorghum bicolor
  Clone ID: SORBI-28MAY03-C107175_1.pep
TGEHFEAMPNDAIVCNIGHFDIEIDVAWLKANASSVQNIKPQVDRFLMPNGRHIILLAEGRLVNLGCATGHSSFVMSCSFTNQVLAQIMLYKAADKAWGEKYVEFAKTDKLDVGVYVLPKILDEEVARLHLDHCQAELSTLSKVQ

SEQ ID NO: 40835 - protein, 78 aa, Sorghum bicolor
  unsure (1)..(78): unsure at all Xaa locations
  Clone ID: SORBI-28MAY03-C107383_1.pep
MQRNGVLECSVCHSKVAVPSPRSVSRAYDKHRSKISSKYRALNVLLVSGDCILVGLQPILVFMXKVDGKFQFSPISVN

SEQ ID NO: 40836 - protein, 164 aa, Sorghum bicolor
  Clone ID: SORBI-28MAY03-C10745_1.pep
MDGDGGGAAAVHHHTRSPEDVFRDFRARRAGIVKALTTDVEKFYQQCDPEKENLCLYGLPNETWEVTLPAEEVPPELPEPALGINFARDGMIEKDWLSLVAVHSDAWLLSVAFYFGARFGFDKEARRRLFTMINNLPTVYEVVTGVAKKQSKAPNGSSKSSKSN

SEQ ID NO: 40837 - protein, 169 aa, Sorghum bicolor
  Clone ID: SORBI-28MAY03-C107528_1.pep
MAPSWAAGSAGRSPAAAAAAPAGAAAGAAAGPAVAAEVVPSAGGGSYAVLQCGEDSEYVRQKYSGYFTVFRALLEEDGESWRVYRAVRGELPTDAEAAAFDGFVISGSCADAHADDPWILDLRRPVRRLRAAGCRALRVGCRPPLLRRPLRARARRPACGSAIGVARQA

SEQ ID NO: 40838 - protein, 295 aa, Sorghum bicolor
  unsure (1)..(295): unsure at all Xaa locations
  Clone ID: SORBI-28MAY03-C10762_1.pep
MAAMMGSISAYGSYQTNRPSALKQAPHMQFQQCCSSGVGFLSKHSQSMRSKTQLAKRRATNNGIHPKTTRPRAPIVCSTGMAIIFVATEVHPWCKTGGLGDVVGGLPPALAAMGHRVMTIAPRYDQYKDAWDTSVLVEVNIGDTVETVRFFHCYKRGVDRVFVDHPMFLEKVWGKTGAKLYGPTTGTDYRDNQLRFCLLCLAALEAPRVLNLNSEHFSGPYGEDVVFVANAWHTAVLPCYLKSMYKPNGIYANAKVAFCIHNIAYQRKLAILYSRTGNTXDSLLPSFDPIDGYVK

SEQ ID NO: 40839 - protein, 288 aa, Sorghum bicolor
  Clone ID: SORBI-28MAY03-C10056_1.pep
MFCEGHIPCVVVDKDTRFRILESRSKMAKISPAATMVGPEVASPRVATFSSRGPSAEFPFILKPDIAAPGVSILAAKRDSYELMSGTSMACPHVSAIVALLKSVHPDWSPAMIKSAIVTTASVTDRFGLPIQANSQQRKPADPFDFGGGHIQPDRAMDPGLVYDLKPDDYTNDDIAIEQLNLPSIAVPDLKNSTTFTRTVTNVGPAKATYRAVVEAPAGVKMSVEPPVIAFQKGGPRNATFKVTFMAKQRVQGGYAFGSLTWLDDGKHSVRIPVAVRTVVRDFVADVS

SEQ ID NO: 40840 - protein, 235 aa, Sorghum bicolor
  Clone ID: SORBI-28MAY03-C10103_1.pep
MLVSNCLFRMGGAAILLSNRRSDRRRSKYELVHTVRTHKGADDQCFGCVTQEEDESGEMGVSLSKDLMAVAGDALKTNITTLGPLVLPLSEQLLFMGTLIAKKVLKMKIKPYIPDFKLAFEHFCIHAGGRAVLDELEKNLELTDWHMEPSRMTLYRFGNTSSSSLWYELAYTEAKGRIRKRDRIWQIAFGSGFKCNSAVWKALRTVNPAKEKSPWMDEIDNFPVDVPKISKVGGA

SEQ ID NO: 40841 - protein, 555 aa, Sorghum bicolor
  unsure (1)..(555): unsure at all Xaa locations
  Clone ID: SORBI-28MAY03-C10104_1.pep
TRVFMWDAKKRKDEMPIFTRVHGVKRATSVCVGETHMLVLSSIXHPEYPPKPKSQGRKSMLEWNSGTEELDEDILFNDVQPNSGLSGSSGEMSKGVPSLKSLCEKVAVEYLLEPKNAIQLLEVADSLEAKELKKHCEDLAIRNLDYIFTVGAPSIMNASPEILVNLEKLLDEKSSEPWSQRRLPTMTATYPAVIDSDVEEDEREFPKPRKCGKSASRPSAMSSHDNFLQKDCTAEQAVTKQIRALRKKLQQIEILEAKQLAGHQLDNQQLAKLESRAALEGELSELRVPSEAYSTSSACPAEGRANRKPEVSKKQKRKNKQATQTPSVKSEPGQQIPIKDLQEVLSVNVSAEKEAYAADPIKHIEAAAFSNTKDIASPLEKKASQPTSSKKKKKKGGLSLFLSGALDDTPKPSLPAPVVPVTPKPEGPAWGGAKITKGPASLRDIQSEQSKTNEPTSPKAKDRYENSPDSAGRVRLSSFIPDSHSSPIAVTPARAVPXXEGDKSTPPWSSSATSPNVSRPSLKDIQMQQEKRHHGISHSPKTHTSXFALPHHGGS

SEQ ID NO: 40842 - protein, 225 aa, Sorghum bicolor
  Clone ID: SORBI-28MAY03-C10134_1.pep
RSHRKHMLAREVEAATWTHRRQMYAAGGAPNGVKRPDSNAWTVPTIGFPPPPPPPPPPPPSPHPMQHFGRPLHVWGHPTPTVESPRVPMWPRHLVPRTPPPPWAPPPPSDPAFWHHAYMRGPAHMPGQVTPCVAVPMPAARFPAPPVRGALPCPPPMYRPLVPPTLDTQFQLQTQPSSESIDAAIGDVLTKPWLPLPLGLKPPSVDSVMGELQRQGVANVPPACG

SEQ ID NO: 40843 - protein, 236 aa, Sorghum bicolor
  unsure (1)..(236): unsure at all Xaa locations
  Clone ID: SORBI-28MAY03-C101317_1.pep
QVANGELLSSSKVIPATVWSMQGLEFQQDLKVIPLSSYDMILGLDWLEQHSPMXIHWAHKWLQLPYKSGMVQLTGILPEVPGESLHLLVDHMSSQQEDTKGPSEVQSLVEEFNDLFQPPSQLPPSHACDHAIPLIPGASPIYSRPYHFAPAVKDEIEKQVNEMLHSGLIQKSSSPFASSVILVKKKXSHGIFCVDYRQLNAITQKSKYPVPLIDDLLDELGQASWFSKLDLRSGFC

SEQ ID NO: 40844 - protein, 171 aa, Sorghum bicolor
  Clone ID: SORBI-28MAY03-C10902_1.pep
MDPLEMQHDSKKSNKPKYSKFTQQELPACKPLLTPAIVISTFLLVGILFVPIGLASLSASQEIVELVHRYDTSCVPSADKVGFIQDTKTDKSCTRTLTVPKHMKSPIQIYYQIGDFYQNHRRYVKSRSDKQLLYKDAAHLTKDCEPEVYGADGAPIVPCGLIAWSLFNDTY

SEQ ID NO: 40845 - protein, 259 aa, Sorghum bicolor
  Clone ID: SORBI-28MAY03-C10916_1.pep
GVPRSPPRRDPSSPSDQTRCSAAMATRYWIVSLPVQSPGATATSLWPRLQDAISRHSFDTPLYRFNVPDLRVGTLDSLLALSDDLVKSNVFVEGVSHKIRRQIEDLERAGGVDSGALTVDGVPVDTYLTRFVWDEGKYPTMSPLKEIVGSIQTQVAKIEDDMKVRAAEYNNVRSQLSAINRKQSGSLAVRDLSNLVKPQDMVSARQLGSLLPVVPYCPQAHWLSSYESLDTFVVPMSSKQLYEDNEYALYTVTLFAKVA

SEQ ID NO: 40846 - protein, 217 aa, Sorghum bicolor
  Clone ID: SORBI-28MAY03-C10929_1.pep
HEGANHGALIDSHAALVRLNNARISGYAAHVGSKTNFSFINSNILHLCARRPGCFCHPYGHGVPILLYICQAGHFLDVAACNATSSSHHGSPISVTDARLDVLCARIVKYYSLRRFVVETGRAPEEWDRAHDAAMFHYSSGMQAIMVAVGVCDKVSVFGFGKSSDAKHHYHSNQKAELDLHDYEAEYAFYHDLSEHPQVVPFLKDSGLTVPPVVFYH

SEQ ID NO: 40847 - protein, 298 aa, Sorghum bicolor
  Clone ID: SORBI-28MAY03-C109393_1.pep
PRRPGLRRVRVRGVPAVLPPAVPAASAVRGLLHPAGPAARAPAGCVSTLDALGGGAPAASGPLGPARQAYSRGPRPLRARAAPPPPPSPSSRTRCGGRGGGLRRRDGRAPRSVGPGPAARLTGMTNEQLVEFAWGLANSGRPFLWIIRRDLVKGDTAVLPPEFLAATADRGLMASWCPQQAVLDHPAVAAFLTHSGWNSTLEAMCGGVPVISWPFFADQQTNCRYQCNEWGVGMEIDSNVRRDAVASLITELMDGERGKEMRRKALEWRDIAVEVAKPGGTSHRNFDDLVRNVLLPKN

SEQ ID NO: 40848 - protein, 113 aa, Sorghum bicolor
  Clone ID: SORBI-28MAY03-C10945_1.pep
MAGKKRKAEAARLEETDRALYGAFRGAANSLSQLYTLAMGAQKASFHAGERHAMEKLYEWILRQHENGLRLTVADVASHIQVSLQLFLHMFLSNLKMETWVKTWIYWHFIHHV

SEQ ID NO: 40849 - protein, 158 aa, Sorghum bicolor
  Clone ID: SORBI-28MAY03-C10379_1.pep
GIPSPTGFVMNMQPSEAEVGFDLRLGPTEDIEQIKRRVKEEWAPAHKNLTYQLMQKGPVTDVAGRPIFTATNESNPWWSIFEKAITSAGGKLSKPEILSSTTDSRFVRQLGIPALGFSPMTNTPILLHDHNEFLEDKVFLRGIKVYEHVIRALSSFQG

SEQ ID NO: 40850 - protein, 105 aa, Sorghum bicolor
  Clone ID: SORBI-28MAY03-C104768_1.pep
MAEEKSALQSAREWVVEHKLRAVGTLWLSGIVGSIAYNWSRPGMKTSVKLIHARLHAQALTLAALAGSGLVEYYDHQQGSGSKVHQYAKQFLSSDADSSSSPQKE

SEQ ID NO: 40851 - protein, 118 aa, Sorghum bicolor
  Clone ID: SORBI-28MAY03-C107098_1.pep
TRYQNGPLSFDIDSYMGGLPRLVYRPETWTKVSNIIFLDSPVGAGFSYSVKEQGYNSSDTKAVNHILIFLKKWFEEHPEFLSNPLYIGGDSYAGMIVPTVTSEIGLKIALQNNSKEPL

SEQ ID NO: 40852 - protein, 266 aa, Sorghum bicolor
  Clone ID: SORBI-28MAY03-C105350_1.pep
ARGPSLSSLSLTPEERPEREWRRWADGRPGAHAPAKPGASHGRAKRSRSGRARSSRGHVWSSRDGRGRGSCGQARGLAWPSLGPARRHARQPAMASSCHGAASPAAGLMRPRAGARCGQGSRWPGQGAASVGGVGRPERPSGSPTATARGGQVASSRPGAWQWRPARLGQGHARPGPEARTAELGQEARLAAGVEAAAALFPAASARCVLVSMSSGRRRFGLYAYRWVWHFRAIVWLLRATFWAIASGHAQEPPRCLQAYPLVTSS

SEQ ID NO: 40853 - protein, 202 aa, Sorghum bicolor
  Clone ID: SORBI-28MAY03-C110979_1.pep
MWPAGAEHPMGMGHGPAAPSPRPSTTATHSASAWQSPVPYLFGGLAAMLGLIALSLLALACSYWKLSGSILAAGEPDDDDLERRAAGAGAGDGKAAAAGKADAGERWREHVVVIMAGDERPTFLATPASGRGAPDDARGVAVVSVACGGGGSGSGPGSEDGEEERCVECGARSWPARVADDEPSRSELSGGSGSGSSVISER

SEQ ID NO: 40854 - protein, 197 aa, Sorghum bicolor
  Clone ID: SORBI-28MAY03-C11156_1.pep
MVEQAAKPLARPVRVWVLDATPGKVRAGGDGEDHPAELIEFLRRMPEQVSSKQEVVDALVKGQFSVDVARWVATNLRRTSPLGQRSSSSFSWTFDLNGISEMYKSYEDTNLWRIVENVPRGVHINFLKAERSLHRWALEDLQRIHTAEELAADEGGGVEMHVLEDAGHWVHADNPDGLFRILSSTFRIETTIRGMQD

SEQ ID NO: 40855 - protein, 87 aa, Sorghum bicolor
  Clone ID: SORBI-28MAY03-C11175_1.pep
HEAPPPPPARPPPPPPPPPPPPPGPSPPRPAPAAARSAAARPSHALPGAASPHSGRPSATGSGGRMRRIHGGRQQRRRRRRKRPVAG

SEQ ID NO: 40856 - protein, 206 aa, Sorghum bicolor
  Clone ID: SORBI-28MAY03-C112712_1.pep
PPMLGKHRAVTRQALALLQDNYPEFVAKKVFINVPWWYLAANKVMSPFLTQRTKSKIVFCSPGKSAETLFRYIAPEQVPVQFGGLYKEDDTEFSTSDAVTELTVKPSSKETIEIPATENSTVVWELRVLGWEVSYGAEFTPDAEGGYTVIVQKTRKVPAHEEPIMKGSFKVTEPGKVVLAVNNPASTKKKLLYRFKVKSTAESAAA

SEQ ID NO: 40857 - protein, 102 aa, Sorghum bicolor
  Clone ID: SORBI-28MAY03-C113735_1.pep
MAPSRTALSSLALLLALLLSCAAVSSAARRLEEAAPKEGEPHLTVPELPVPEHELPPLPKVELPPFPEVHLPPFPKVELPPKPEIPAIPEFHFPEPEEEAKP

SEQ ID NO: 40858 - protein, 216 aa, Sorghum bicolor
  unsure (1)..(216): unsure at all Xaa locations
  Clone ID: SORBI-28MAY03-C11396_1.pep
RTRGFNFEKSVVEISLDSIKRVKDQVASEXTNQKCSTFDVVTAIIFKCRALAVDFAPDAEVRLGFAASTRHLLSNALPSVEGYYGNCVYPGGLTKTSQEVKEASLVEIVTAIREAKEALSSRFLDWLSGGAKENHYNVSLDYGTLVVTDWSHVGFNEVDYGFGEPSYVFTLNDDVNIVPSVVYLKPPKPKQGIRLVLQCVEGQHSAVFSEELQKHA

SEQ ID NO: 40859 - protein, 148 aa, Sorghum bicolor
  Clone ID: SORBI-28MAY03-C10770_1.pep
IGRLHRIQWLVGESGGGGGGGSGPSRVRGYIGAQRRGSGCSQLWPCLAAGLRTSRSAWWPHSATGLGTSCSAVATPGRGATVACGEGGGRGVGQQRRPHPPVVCMLLLPFSAARILQVFFCRFDKMFIPEVHLLLPCRCLFTVTFAEI

SEQ ID NO: 40860 - protein, 188 aa, Sorghum bicolor
  Clone ID: SORBI-28MAY03-C10775_1.pep
MKKASSLSELGFDAGDASSGFFRPVSDSSSSSAADGVVVTPSAHRRRLTKVSVIGAGNVGMAIAQTILTRDLADEIALVDALPDKLRGEMLDLQHAAAFLPRTRLVSDTDMSVTRGSDLAIVTAGARQIPGETRLNLLQRNVALFRKIVPALAEQSPDALLLVVSNPVDVLTYVAWKLSGFPGRRVIG

SEQ ID NO: 40861 - protein, 179 aa, Sorghum bicolor
  unsure (1)..(179): unsure at all Xaa locations
  Clone ID: SORBI-28MAY03-C10782_1.pep
KKTSLHKRRLIRGLXPWLPRGYDPCTEXYSTKYYNLPEVQKALYANVTGIPYPWVTCSDPVYDFWKDSPRSMLPIYRELIAAGLRIWVFSGDADSVVPLTATRYSIDALFLPTVTNWYPWYDDEEVGGWCQVYKGLTLVTIRGAGHEVPLHRPRQGLKLFEHFLRDEPMPKPVDSIQSF

SEQ ID NO: 40862 - protein, 104 aa, Sorghum bicolor
  Clone ID: SORBI-28MAY03-C108024_1.pep
MASNSKALLVLALLLAATFLVASANEQAREQAKEEKKAEVQDWHGGGGYPGRGGGWHGGGGGYPGGHCRWGCCDRGHYGGCRCCSHPDQIPEPMYRPELVEVHN

SEQ ID NO: 40863 - protein, 124 aa, Sorghum bicolor
  Clone ID: SORBI-28MAY03-C10838_1.pep
MAGRLTAAGSRILGGGGARAAASALRHRAGMGLPVGRHIVPDKPVPVNDELVWDNGTPFPEPGIDRLAPHIGKYEALAWLCGGLGFFAVLGVAAAVNDKASKIPYTPKVYPYDNLRAELGDRPF

SEQ ID NO: 40864 - protein, 400 aa, Sorghum bicolor
  Clone ID: SORBI-28MAY03-C11471_1.pep
ARGEEYKINNVSTDVILCISSIPDVKISSLSDDEFDEEECQDLRLLAKNESFKRPTVGELEEKARSLRRDIMSHWISKELQRLERLIDRARHEGWHKEKFEYLDKKQLLRNPSEQQRLLEEVPRVIPEMEDSQDTEFQVTGQDKPIQKSIVALQGTNGTGSPFLKSCTEKKFKGTAADTDRASAGLLAANPGATAAFAFSPVLPKYLHRQAATEANNAGDISPIQKLDAEGAKASTDGDKTVTDIPHGSIEATKANTAGEAPGAFLEKQCAKAADVITIEDDDDDNNNHPCYKGQQTAVVAFQEKTAVVVDLEADDAGGNHPVQHETNSRGHRHAKVNGEVPQRIWYYLDPQGEEQGPFIMQHLRMWWESGFFTKDFRVWRAGQTSNEAILLTDALQMMG

SEQ ID NO: 40865 - protein, 304 aa, Sorghum bicolor
  Clone ID: SORBI-28MAY03-C11479_1.pep
MSACSPVPTLRPDERSDLLSLLAAAARPLADVVADFLARFPRERRLRVGGALSFLLEDKKMLHPTGRLIAFAILHQSYSPQTANPYIPILLNAACDETSEKSERAFVQLLLTSSSGNNNNEVLNQSAVDYINGSVSASQDFLPREQLEKQYCSTSVHSRPQISSFRAAMVRSAIPDPDVPQSCANSSESSISPPGSKQKSASDDRDTTIAVLRQDKSGGRLGPQWIRPTPPRLPVLDGELQWLNPDNNHELLWDYSMCADTSRGAAIRDLIARALKGSLAPAQQEVHCYILIFLQDDDDYYQIA

SEQ ID NO: 40866 - protein, 188 aa, Sorghum bicolor
  Clone ID: SORBI-28MAY03-C114933_1.pep
SDRQKLLGQKGCVVWITGLSGSGKSTLACALSHELHYRGHITYVLDGDNLRHGLNRDLSFKAEDRAENIRRVGEVAKLFADAGIICIASLISPYRRDRDACRALLPDSNFIEVFMDLPLKICEARDPKGLYKLARTGKIKGFTGIDDPYEPPVNGEIVITMKDGECPSPKAMAKQVLSYLEENGYLQA

SEQ ID NO: 40867 - protein, 181 aa, Sorghum bicolor
  unsure (1)..(181): unsure at all Xaa locations
  Clone ID: SORBI-28MAY03-C11507_1.pep
MASTTLSSAFTLLSRPSTSPSPTASLPRSSLAVPHCRRGRRAVAAACTATESPKILELGDAIAGLTLEEARSLVDHLQERLGVTAAAFAPAAVVAAPAGAGAAEEEAPVEKTEFDVVIEEGPSSARLATIAVVRALIDLALQEAKDHSVGLHLKFKDAVXRDEAELPKKQLEEVGAKISIV

SEQ ID NO: 40868 - protein, 103 aa, Sorghum bicolor
  Clone ID: SORBI-28MAY03-C11521_1.pep
TKAVCVEHIELRNELLTLLNLQKQLQSKEAEVSANRENSFTEAPSTPKRSNRDIDRPFNPDAIGFTGERAGKRDHKRKTTGRFIDAPPSPPQSKRPRKLKGSD

SEQ ID NO: 40869 - protein, 210 aa, Sorghum bicolor
  Clone ID: SORBI-28MAY03-C1100_1.pep
MAVTAEAAAEIGLERRAYARVGLLGNPSDVYGGRALSFTIADFSATVRLRPSPELLIQPHPHHDLVAFPSLPQLVSRLQSEGYYGGVRLLMAICKVFYNHCIQNNISLKAENFTLSYDTNIPRQAGLSGSSAIVCAALSCLLDFYDVRHLIKVEMRPNLILNAEKELGIVAGLQDRVAQVYGGLVYMDFSQEHMGKLGHGIYMPLDVNLL

SEQ ID NO: 40870 - protein, 194 aa, Sorghum bicolor
  Clone ID: SORBI-28MAY03-C109750_1.pep
MPQQNGGGWAVEAQQQATTTKQPARRGRPGEVVVLLLLLLRVGALCAAAASAALAASSATATLRRAPFRFLLAADAIVAVYSAFEAAAAAWEVARGVTLLPEAMQLWFDFGHDQGFGYMALAAAAAAARDAAWCGGGGREGWMTTGSAACVRADVAVGLGFAGFAFLALAALVTGFRVACFLATGSRFPPPASY

SEQ ID NO: 40871 - protein, 144 aa, Sorghum bicolor
  Clone ID: SORBI-28MAY03-C11019_1.pep
VQRYTSARFGTRSTGDILTDQESTLLTDYIYHTLAAKASGELCLKYIFSFGAFARKPLLQCASDWKVPTTFIYGQEDWMNYQGAQQARKDMKVPCEIIRVPQSGHFVFIDNPSGFHSAVFYACRNLLSQNGEEGFTFPGGLISA

SEQ ID NO: 40872 - protein, 200 aa, Sorghum bicolor
  Clone ID: SORBI-28MAY03-C11076_1.pep
PTGARPPALSPNRAHPAAPPPPSRAPVPPLSAAVRRRPARPSPRRPTRRAPGDPSQASSVEGLRCRPNSPRPWGSPRRLLSDWVWSGRRSGPASTSTPGGPFTPTPTTRKGRLRGPGVLGLTSLALWVCLDRVCPASITPYLRGATRLPSVPHHERRPLIRPAGRRCYRKARARQAEAGTEGRSNSPPRQPQPPQFQAST

SEQ ID NO: 40873 - protein, 366 aa, Sorghum bicolor
  unsure (1)..(366): unsure at all Xaa locations
  Clone ID: SORBI-28MAY03-C11075_1.pep
MAAASDSTDPPPSVTHDDHEDDDDEEFDDDLDDEADDGGEPPASSSEAARLEAVLRRLTADEVRIRVHQVAIRGCDRTRLGAFDTVSITLDAAPPXSPVAPSAPSLTSRRPGLAPPVTVASSPDAAPPGIPGSAVVVLVDVAEARGRAAGDFGVFAHTQTRSCSLEGSVKLINLFGFCETWDASGALELDKTAELSAGVQMPRIGAIPTPLLARISFLSDDWLKSSLKEHLMGVSVGLLSTMNHNLAYNMTWRKLTDPTRMSSNSVQEELGHSLLSSIKYAYKVDQRDSSIRPTRGYAFLSSSLVGGLAPGSKYSRFLRQEFDVRVALPLGVLNGALNAGVAXGVIHPLERGSTXSVSPLLERFTW

SEQ ID NO: 40874 - protein, 210 aa, Sorghum bicolor
  Clone ID: SORBI-28MAY03-C11633_1.pep
KAWAALHLQFGQVSRPQSSASYDVGGNSGVGVYFGYLRTVLSYANPLSYLRGNTNSSNPELQSNEGHGSGPWSEPRPLVGNRGHEVTDANSANMLRRRSRPFGANIHTLGNEDQAPADAANVLRRRSSPVGAGVHTLGVVARRPPDDSTAFSDGLSSGLRGHVPQQAGAGRGRGVCTALSDRLSGRLLIRGPLLPSRRLWSRVAGGDSYR

SEQ ID NO: 40875 - protein, 221 aa, Sorghum bicolor
  unsure (1)..(221): unsure at all Xaa locations
  Clone ID: SORBI-28MAY03-C11645_1.pep
MYRSLKQKLQSNMRRALCHKIPCCGRTTAGPRILSTPWIPAIWPGSVATGINFPSQKDPSYYHRKSANFSTKVTPSSPPSTAMEPGADEVAFESSAHFRIYKSGRIERLNRPPVLPAGLDDATGVTSKDVVLDADTGLSVRLYLPKLQQERPSKKLPVLVYFHGGAFLIESAGSATYHAYVNPLAAAAGALVVSVSYRLAPEHPLPAAYDDSWAALQWAAX

SEQ ID NO: 40876 - protein, 172 aa, Sorghum bicolor
  Clone ID: SORBI-28MAY03-C1167_1.pep
MAAEAKTPSLAEEYSLPPQEVAVEKAAEEKPSSGTETEAAPSTNDEAPPSVEDKNETSEVQDTAEKSEAEETNTAAEETPAAEEASETTEEEEAEKPEIKIETAPADFRFPTTNQTRHCFTRYVEYHRCVAAKGEDAPECDKFAKYYRSLCPGEWVDRWNEQRENGTFPGPL

SEQ ID NO: 40877 - protein, 156 aa, Sorghum bicolor
  Clone ID: SORBI-28MAY03-C117086_1.pep
MAIASRVTKRALSTFAAAKLPEEAVAAAAAGEAIAATTAAAVPLASSERTAIARAALLQFEDTGRLFAGEPTSALLRTLAALQALSVGPLVDAATAALRSPAVAGSALGRAAARATAYRHFCAGETADEAAAVVRRLWRGGMGGILDYGIEDAEDG

SEQ ID NO: 40878 - protein, 192 aa, Sorghum bicolor
  Clone ID: SORBI-28MAY03-C117176_1.pep
MAHHALSLPLATILAVAVALLLARRAAGYPWYVCGSSSNFVANSTYQAHLDLVTATLPKNASSSPDLFATAVVGTIPEQLWAMGLCRGDVNASTCFNCLTQGFQEVPDDCPYDRDASIYYDFCTVRYSDVHTLRNDDDTGPMINTYVETNDGNVTAADAARFKRLLADLIDATVEYAANSSRRFATGVGRLQ

SEQ ID NO: 40879 - protein, 432 aa, Sorghum bicolor
  Clone ID: SORBI-28MAY03-C11405_1.pep
HEASRGFGGGSFFGRTAQAPAPQASKVSRPVVPATDQGNAIKRDVQHAATQATGKSATAGETRNAWTNFNRPVSPNVQPHPTGLKKSWHQLFSRSASVSPCPDVTTSVHDMIRKPEPNGAQINNAHTFLSQYPPLDYKPSSSQSMQFPGFPPLNVAPPSNPLPHFPAGHMPFYDDAESTLLEEPEQFEDPCYDPDAIALLGPVSESLDDFPPDFDCGFLSSDIIKESHGRPSPIESPLSRSRTAEEKPIKPPHSSIAPGGSILPETSSEQGTWQMWSTPLVQESLGLQGPQSQWLRQNTNQFNHSANLFSSGGGAISSLGTGLNDSDPWMQKAPFQQLPPDTPSLFLSHEMPGKLHNDLVFGSPNKSAREHPFGPPGYLWPKEELALNGAQEGGGGHILSPSGAHVGGGVGLFSSTSPDVQSLWSFNEKETA

SEQ ID NO: 40880 - protein, 176 aa, Sorghum bicolor
  Clone ID: SORBI-28MAY03-C114286_1.pep
MAEEAAAPAVAAGTEAAPPPGKMTMVVGVDESEHSFYALQWALQHFFPPPPQPQQYRLVVVTAKPSAASAVGLAGPGAADVLPYVEADLKKTALRVIDKAKALCAQVSDAVFEAVEGDARSVLCEAVERHHAEMLVVGSHGYGAIKRAVLGSVSDYCAHHAHCTVMIVKKPKHHKH

SEQ ID NO: 40881 - protein, 268 aa, Sorghum bicolor
  Clone ID: SORBI-28MAY03-C114476_1.pep
MDAPAAAEGSGNGGKHIVLVHGACLGGWSWFKVATPLRAAGYRVDTPDLAASGVDPRPLREVPTFRDYTQPLLDLLASLPEGHRVVLVGHSLGGVNVALAAETFPDKVAAVVFLCAFMPDCTARPSHVMEKFVEGKWLDWMDTEMKPQDAEGKLPMSMMFGPRIIREKFFQLCEPEDITLAASLMRVSSMFVEDLVLQQPYTKERYGSVRKVYIVCREDHAIVEKFQRWMVENNPVDEVKEIVADHVVMLSRPDELVRCLTDIANKYA

SEQ ID NO: 40882 - protein, 226 aa, Sorghum bicolor
  Clone ID: SORBI-28MAY03-C114528_1.pep
HEGKAVLVVGSGNSGMEIAYDLAAAGAITSIVVRSELHLVTKEIWNVAMALSAYLPVWVIDKLVLLMCAVVFGDTSRHGLRRPAVGPFTMKLTTPAYPVVDVGTYAKIRTGEIRVLPAAVKSVRGNVVEFGDGKRHPFDAIVFATGYRSTVTHWLKSEDGLIGDDGMAARSYPEHWKGDNGLYCAGMVRRGIYGSCEDAELIAGDISKLLLLRPQQEQEQEQGNGF

SEQ ID NO: 40883 - protein, 352 aa, Sorghum bicolor
  Clone ID: SORBI-28MAY03-C11839_1.pep
MAALGTATTPAAAPGAPRCYNRHPRPRHHIAARRNRVASARRLDLCASASPSPAVTAPDIPDEAVEEPLVEPAAETKLRKLACPICYYPLAGSSDQSDDASSLECSTCKKSYPNKQDYWDLTVSVGSIEYSESMPAATELFRTPLVSFLYERGWRQNFIWGGFPGLEREFEMAKTYLKPTFGGTIVDASCGSGLFSRLFVKSGLYSLVVALDFSENMLKQCNEYIKQENISDERLALVRADISRLPFVSGSIDAVHAGAAIHCWPSPACAVADISRVLRPGGVFVASTFVADVIPPVIPVLRIGRPYISQITGNNTFLSEVEFEDLCKACGLVDFKFVRSGFYIMFSATKAS

SEQ ID NO: 40884 - protein, 135 aa, Sorghum bicolor
  Clone ID: SORBI-28MAY03-C11926_1.pep
MAWCLSAPAAAPPVAAVPGALGVSALARAPVPAGRRRRWDALVVCAAPDEEKITKRSPLDFPIEWERPKPGRRPDIFPKFSPMKTPLPHPLPADDPLDDDEEEEEEEQPQPQEEPQEDDPDKEEPEEDDPDKPTE

SEQ ID NO: 40885 - protein, 114 aa, Sorghum bicolor
  Clone ID: SORBI-28MAY03-C119541_1.pep
MVARPVSHLLRSRCLLRKPQNTQAFSTRSSVRAADHGNHYDPPTGWLFGVKPGQKYEKEGWEGIWYYGFIGSLLVAGVAYVFKPDTSIQTWALEEARRRLEAEGILEDPEKVKK

SEQ ID NO: 40886 - protein, 91 aa, Sorghum bicolor
  Clone ID: SORBI-28MAY03-C11822_1.pep
GRRQSSAKAESERKLVKGRKPYLHESRHQHALKRARGAGGRFLNSKSDDKEENSDSSHKEKQNGVAPNNGQPSTPPSPNGASSANQAGSRE

SEQ ID NO: 40887 - protein, 118 aa, Sorghum bicolor
  Clone ID: SORBI-28MAY03-C119629_1.pep
MQTRSGKCRVFAKFGSSHGALPAPFLSQQELISTGGSTTTWIAMAAAAGGPSKQELKTKNRPSKQEQKQCPKMSCCAPCERKRREREREGERNDAVFVLLNPYSAAVYCRHVLIQLPR

SEQ ID NO: 40888 - protein, 159 aa, Sorghum bicolor
  Clone ID: SORBI-28MAY03-C1197_1.pep
MKIQCLMTQRTVTSAIIQPNFPQVVLPLNMSAEGNGENAPEEQARPTYQRTLSGGLQSPRATEVPQKAILERMKSKSESKSYQLGHRLSLKWSTGAGPRIGCVKDYPMELRMQALEMVDLSPRASTPSASRRLPPLSPTKVTSPTSPLAPIQASVPQPS

SEQ ID NO: 40889 - protein, 69 aa, Sorghum bicolor
  Clone ID: SORBI-28MAY03-C14174_1.pep
MPKQIHEIKDFLLTARRKDARSVKIKRSKDVVKFKVRCSKYLYTLCVFDAEKANKLKQSLPPGLSVQEV

SEQ ID NO: 40890 - protein, 213 aa, Sorghum bicolor
  Clone ID: SORBI-28MAY03-C17150_1.pep
LATHRTMASSSSSNHSFLLLLLFPLLLVLLLSTTVVAADSTATAEKYQKWCQVASDSPSCVKVIESIPGIQEVDYNNAGKVADLCLHFAANKTKEAKGAADTLLAAEKGKPASGCLKACATNIKSMAEVLVNLPAGQDDMNAYQTYKEVRAKFKNEKPPACEKDCWNKTSSSSSSAADIVDKFHDIWNVAKVGNMQINYIFPWPDSDDDDNIL

SEQ ID NO: 40891 - protein, 197 aa, Sorghum bicolor
  Clone ID: LIB5047-001-R1-XP1-B5.pep
LATMASSSSSNHSFLLLLFPLLLLLSMVVVNSGSAPTTTPATMAEKCQDWCRVASDSPSCIKVIGSIPGIQEVDINNAGKIAELCLHFAANKTTEAKGAADTLLVAAKGKPSSCLEACATNIKSMADVLVNLPSGQDDMNPYFTFIKAVRAKFKHERPPACEKNCWNKTSSSSSADETSIVDKFHDIWTVVKVAICR

SEQ ID NO: 40892 - protein, 247 aa, Sorghum bicolor
  Clone ID: SORBI-28MAY03-C17369_1.pep
MTDYHRIHPVSVGSPPPSAPPEHAKKPSHDQLLPVTAPPPYAPAPLPPPRRQRRHSRCCRCVCYTFLALVLLVVALGVTAGILYLVFRPKIPTFNVDRLTVTRFDVNTTTATVTDAFDVDVTATNPNRRIGIYYDGGDVTASFNGTVLCRGAFPALYQGHRTTVHPNISLAGETRLDSDVAAQLLQQRQAGFVPLTVRARVPIRIKFGAIRLWKMTGKANCNLVVDNIQAGTQLNIRSNTCSFKLKI

SEQ ID NO: 40893 - protein, 204 aa, Sorghum bicolor
  Clone ID: SORBI-28MAY03-C17457_1.pep
MLLSPRPPPAAAHLRAAAPTRTPLLLTRRPAGPPPASASASAEFPGSVPDSAQMPPRRRRRRSVAGIDQDELLDPDALADPDSSFYEINGVRLHHKVCSHEDEDEVEDSSSDQPSSSTTASDAVRNSQIGLPILLLHGFGASVFSWSRVMRPLACIVRAKVLAFDRPAFGLTSRASWSADDTKPLNPYSMAFSVMATLAFIDYL

SEQ ID NO: 40894 - protein, 187 aa, Sorghum bicolor
  Clone ID: SORBI-28MAY03-C17475_1.pep
MSEVVAMAGQAYMRQLQAHPLRTKAITSGVLAGCSDAVARKISGVPKLQLRRLLLIALYGFAYAGPFGHFLHKLMDKFFKGKKGKETTAKKVLVEQLTASPWNNMMFMMYFGLVVEGRPFGQVKNKVKKDYASVQLTAWRFWPIVSWINYEYMPLQLRVLFHSFVASCWAVFLNLKAARSIANTKKA

SEQ ID NO: 40895 - protein, 300 aa, Sorghum bicolor
  Clone ID: SORBI-28MAY03-C121243_1.pep
RLLRGRLRLRRSPGSGSVQWFIDDDDDKPQKRADKAAAAAAPHGRVVREGVEARGNGDRYEGEFHGGRCSGSGVYSFFGKGKYEGDWVDGKYDGHGVESWARGSRYRGQYRQGLRHGHGVYRFYSGDCYAGEWAGGQSHGIGAQTCSDGSTYAGEFKGGVKHGLGCYHFRNGDRYAGEYFADKIHGFGVYSFANGHSYEGSWHEGKKQGFGMYAFRNGDERAGEWDSGILKNSLPLSDPAVQRALQAARRAADCAFHLPRVEEQVNKAVMAANRAATAARVAAIKAVQNRIDGKLCFINV

SEQ ID NO: 40896 - protein, 174 aa, Sorghum bicolor
  Clone ID: SORBI-28MAY03-C12129_1.pep
MATAISSLVTPPALHRRCLSPASVSVSAPIRISFRAAAASQAWRRGLALRVSASSAVLEAPEVVAARKLYVGNVPRTVTNDELRDMFAAHGTVERAEVMYDKYTNRSRRFGFVTMSTVEEANAAVEALNGTEVGGRKIKVNVTESFLPNIDRSAPESEPVFVDSQYKVYVGNLA

SEQ ID NO: 40897 - protein, 206 aa, Sorghum bicolor
  Clone ID: SORBI-28MAY03-C1214_1.pep
HEEFIGCSPSLSGAIRVNPWNIESTAEAMNESIAFSDTEKQLRHEKHYRYVSSHDVAYWSKSYIHDFERSCRDHFRRRCWGIGLGFGFRVVALDRNFKKLNVDSIVADYKKSKSRIILLDYDGTLVPQTTMNKTPSETVVNMMNTLCADKKNVIFIVSGRGRDSLEKWFYPCPELGIAAEHGYFMRWTRDEQWQIQHQTSDFGWMH

SEQ ID NO: 40898 - protein, 313 aa, Sorghum bicolor
  unsure (1)..(313): unsure at all Xaa locations
  Clone ID: SORBI-28MAY03-C1212_1.pep
YMTNMTHAMGAALTYRHELGMNYNFIRPDLIVGSCLQSPLDVDKLRKIGVKTVFCLQQDSDLEYFGVDIGAIQDYSLRFKDIMHCRADITDFDAFDLRLRLPAVVSKLHKLVNCNGGVPYIHCTAGLGRARXAAVALAYMFWILGYSLNEGHQLLQSKRACFPKLEAIKLATADIXLSKNTITLKWEDDGSSSVEISGLDIGWGQRIPLTYDEERGAXFVRKGTFCSHXLPEGRYEYKYISIVDEGLCNEHEMLTKPNADGHVNNYVQVSRDGTSDEEKELRERLTGPDPVLTDEERLMIREYLEQYADAGER

SEQ ID NO: 40899 - protein, 302 aa, Sorghum bicolor
  Clone ID: SORBI-28MAY03-C12219_1.pep
MELEGGDTMELDGAAAGRAHASGGGGGGSSAGDRDDRLSALPDSLLHTIMSFLKARQAVQSCVLGTRWRHLWRSVPCLDVDLDEFRAVPKPSNNPDPDVDNSDVEFDEEDDDSDDGNNEETKNNEWDNFEDFADSLMHHCNIAQLDSLRLHVSKSRAPSFADKQAGGWLRRAMKYCTPGPCRQLEGLRSTDSWRLKRLYLCNVALDCRFAIHVSSACQSLEDLELDDCTCAIHVISSNSLKSLVLKNCRWNVLAGIASPTLKRLAIAGGTNSSDVVLVIWAPTIARLCLDVPLRFAKRIAVN

SEQ ID NO: 40900 - protein, 227 aa, Sorghum bicolor
  Clone ID: SORBI-28MAY03-C11767_1.pep
TPLVHTSSSPSLPLSSFTARATPATEPEPATNQARWARRRAATTRPSPRRSCSRCRCTAAATGAPTRSAPPSRTSRSAATASCRSTSRLSTPRATWRWWPRPTRRGSAAACARPPARTSASASPSPPRRTVARTRTRTPCRRCSPAFSSSSSRCTPTRCLPSAPGTRSSTAGTGRRRTRGGCCNSSRRRTWRPTPPPRTLLLPGPRTRTAADGSGSDRPAVEQSRSR

SEQ ID NO: 40901 - protein, 369 aa, Sorghum bicolor
  Clone ID: SORBI-28MAY03-C11732_1.pep
HEAALMEMYQSMGDALAHQYGGSAAHNTVFPERQGKWKATTQSREFLKSFKRYYSNAYTDGEKQDAINLFLGYFQPQEGKPALWELDTDCSRHVTTAGDDLMSDSYHLSSAPGHNVFVGFGAALNPGTTLSPVPACKEDFSRMKLTSFDKLIQRTCSSIRNVRLHCDADLKLSGGVGTSGMAPDAAEIQLKSPNWLFGQRKHTETMPTAKVALVENVNEGNRDEPNVSLCGELNWLSSSGSCEEDIFRRYLAFTTADVENGWYGGTLIYDRDENSGAYKHYSELCQGAVMDPFEHDPEKERHYAEALIVDLDVSNDARVEAEMQAALDDYQIIGSDLSIIPSCGALAEDPSQLTRWIIGDEKLLVGAAQ

SEQ ID NO: 40902 - protein, 207 aa, Sorghum bicolor
  Clone ID: SORBI-28MAY03-C117980_1.pep
HEAHTFTLPSLLPLCCNLQGTSARERGSGAQKLRRPCARPPAAPETTPATGAPDDGVQVLLPEGRGRRRRPAPAVEGRGGGARAAAPRRAPPVQGGRGRRGARQDRGQQARAQADGRGARRRRWRRGDRGSGGGGGHQRAAPAAARGDGGGRLVVRGGSGRRAGRRAEAAVAAAAQHAEGRRGRAPDAGQRGVGARPAEHPRGGFLN

SEQ ID NO: 40903 - protein, 208 aa, Sorghum bicolor
  Clone ID: SORBI-28MAY03-C11796_1.pep
MAETTNTMAAPRPLLRRMLSFREPLLVIPYLLTFLGAAASALARSHSSLLHSLARALFPPANAKHAAAPHAPSSAATAAAAATCPDDSDGEDEDAALSKAEVEAIMATIGLAAAGRGEGLAPAIDLDDVRGLFDADEPSFAEVRAVFAVFDADRDGFIGAEDLQGALARLGVRQDAAACRAMVVAAGGGRDARMNLFQFVRFLENGLC

SEQ ID NO: 40904 - protein, 89 aa, Sorghum bicolor
  Clone ID: LIB3478-034-P1-K1-A5.pep
KPARCPAREVCQGPASSARLDTHCPILRNVSSGTSGRQEVLGRNKGVQIIVLSLTHLQRHRVCRLSHIGRLSLIITLSCEGIAPGVALR

SEQ ID NO: 40905 - protein, 186 aa, Sorghum bicolor
  Clone ID: SORBI-28MAY03-C118050_1.pep
TRHKGPEHLARNPFGQIPAFQDGDVVLFESRAIAKYILRKYKSAEADDPRPGGDLKEAAMVDVWTEVEAHQYHPALSPVVYECLIYPATRGVPTNHKAVDESLEKLGKVLDVYEARPSSRARPAGACGRVAGRTRSPRPCRRSATPPASPRPSAPPPPACGRWPGAWPSMKKLGATMAAAAGIKQA

SEQ ID NO: 40906 - protein, 335 aa, Sorghum bicolor
  Clone ID: SORBI-28MAY03-C12521_1.pep
MGDASSSSWPSTGAAAAYDYERDPRWAEYRASSAVPPHLFSHPYVRAHLQQKFYRRFVDPDFSVQGMSSTTSTQPSASSGGASTSADENARPPDSGTNSSGPARSILSLQLDQRSLHFHASAWVLIVALIGIFPLAPHALQYKGYRLSLLGTTCTTGYALFALYRLPRAGNLQAVQAWCHHVTSSKDFIPFMYCLMFATSKLHLKLVLVPVICWALEHVARFLRRHFTSSSLYRTYLEQPCTWVETNTTAVHFLRSNSEILLGFLLILSLFSRQRNVMQTFMYWQLLKLMYHSPFTAAYHRAIWLKIGRTINPYIQHYTPFLHDPINAGMRWWFR

SEQ ID NO: 40907 - protein, 160 aa, Sorghum bicolor
  Clone ID: SORBI-28MAY03-C12543_1.pep
VAFAAIFTVPGGNTNDGVAVAVHATAFKVFFIFNAIALFTSLAVVVVQITLVRGETKAERRVIEIINKLMWLASVCTTVAFISSSYIVVGRRLKWAALLVTLIGGVIMAGVLGTMTYYVVKSKRTRKIRRKVKSTRRSGSNSWQHNSEFSDSEIDRIYAI

SEQ ID NO: 40908 - protein, 78 aa, Sorghum bicolor
  Clone ID: SORBI-28MAY03-C12562_1.pep
MQLLGVIESLKGITSNQVASQCVLQSYTSGNAQLVNRTDAQTLSQFTAHFISDTDEDRGCNFAAYVPLEEDAPLQVKQ

SEQ ID NO: 40909 - protein, 262 aa, Sorghum bicolor
  Clone ID: SORBI-28MAY03-C12603_1.pep
MMSAVASSFPSRGHAAPFGGSRALPPPPSTRRSTSLRRPRVSALGGGLEGEAGKILDPRATPFQILGLDATTAFYSAAQLKAAFRARVKEFHPDVCKDPENADLIMRRVIEAYQMLSGNQEMMVERNNVDPFDEPECEARDIFVNELLCIGTGCPYSCVKRAPHVFSFSDDIGTARAISQGNGEDDLVQLAVGQCPRKCIYYVTPCQRTILEDVLASVLMPPYDIAEAAVLDSLLSKAKFENNRYRKPKRGAKSSSDYVDWM

SEQ ID NO: 40910 - protein, 117 aa, Sorghum bicolor
  Clone ID: SORBI-28MAY03-C12595_1.pep
SQKKRVAEEKKSARKMGLGVRLLPPSAADATAAASVKFASRFEKNRKDKRAAIKAASIFPESSSSASNGKLDLVLKRRNIKAGAATTLMAGRVKPSSWQSASSTSSRTRMPVLAARK

SEQ ID NO: 40911 - protein, 288 aa, Sorghum bicolor
  Clone ID: SORBI-28MAY03-C11988_1.pep
HEDLVECSPTLQKIQYNTLKCEDEHVDDGKRTVSKLCGAPICWHASLEQVPSGSPTVIIAHEFYDALPIHQFQKASRGWCEKMVDLAEDSSFRFVLSPHPTPSLIYLAKRSGWASSEELERIEHIEVCPKAMELTEQIADRISSDGGGALIIDYGKNGIVSDSLQAIRKHKFVDILDDPGSADLSAYVDFASIKHSAEEASDDISVHGPMTQSQFLGSLGINFRVEALLQNCTEEQAESLRTGYWRLVGDGEAPFWEGPEDQTPIGMGTRYLAMAIVNKKQGTPIPFE

SEQ ID NO: 40912 - protein, 120 aa, Sorghum bicolor
  Clone ID: SORBI-28MAY03-C12049_1.pep
DATFGTVLASRAIKAAHCLTSIQFSPTSEHILLAYGRQHSSLLRTIFISGETRVPMYTVLEVYRVSDMELVRVLPSAGEEVNAACFHPSPGSGLVYGTKQGKVRFLQHHGAVSTRWGECS

SEQ ID NO: 40913 - protein, 193 aa, Sorghum bicolor
  Clone ID: SORBI-28MAY03-C1205_1.pep
TRVNAYYSAALVGLSYGDAHLVSVGATLTALEMLAAQTWWHVREGQGEGSIYEDDFSGDNRVVGVLWANKRDSGLWFAPPEWKECRLGIQLLPVLPISEALFPDVAFVKDLVAWTLPALERDGVGEGWKGFVYALEGIYDKEAALTKTRALNGHDDGNSLTNLLWWLHSRGSVVVGDGDAGFTRCCWYRQYCH

SEQ ID NO: 40914 - protein, 233 aa, Sorghum bicolor
  Clone ID: SORBI-28MAY03-C12071_1.pep
ADLKIPTNSSNSGGRTELPPRACCVVVEYLAGGTLKQYLIKSRRRKLAYKVVVQIALDLARGLSYLHSRKIVHRDVKTENMLLDTQRNLKIADFGVARVEAQNPKDMTGATGTLGYMAPEVLEGKPYNRKCDVYSFGICLWEIYCCDMPYPDLSFADVSSAVVHQNLRPDIPRCCPSPMANIMRKCWDANPDKRPDMDEVVRFLEALDTSKGGGMIPEGQAGGCLCFFRARGP

SEQ ID NO: 40915 - protein, 238 aa, Sorghum bicolor
  unsure (1)..(238): unsure at all Xaa locations
  Clone ID: SORBI-28MAY03-C12106_1.pep
TCGRSRGADGTVPGGAGEGRRGASGQXGAHADPPAFYELAAACSNPKLLEELRKVHDFFLRSPFRSDLRVNNKLLEMYAKCAAMPHARRTFDNMPDRDMDSWHIMIDGYSVNGLGDEALRLFELMKECMAPTSQTYLLVLNACANSEAIEEALLYFDAMSRDHGIEPGVEHYVGIIEVLGKSGHLNEALEFIEKLPFEPNAMVWESLLNLAQMNGDIDLEDRAEELVVSLDPFKANPK

SEQ ID NO: 40916 - protein, 100 aa, Sorghum bicolor
  Clone ID: SORBI-28MAY03-C128172_1.pep
EVTHRRVAPGDLFIILATDGVWDVLSNEEVVSIVCATPRKQHASKAVAEAAAQRWRTRYPASRVDDCSAVCLFLRDQHDWASSVAAAKAKAAAARPPHAR

SEQ ID NO: 40917 - protein, 282 aa, Sorghum bicolor
  Clone ID: SORBI-28MAY03-C12853_1.pep
TRREPVSGHTVLPPPPPPSSPPPASSANGSKTNSSQPSVVLPPPPPPPGLPPKSTDMEAASTSKDTPGLKEDTAVRVLPPPPPPSFPTRPPRPPMQSDMLAPGAMRFPPPPPPPDSRPPLMAPGVTRPPPPPPGFPPSQMPMPPYGVLPGPPPMLRPPFMPGPPMQLDEFAAFVPRPQLPQQPSYVKSAAPTVVKRPLAQHTPELTAMVPASVRVKRESALPKPKPKVQQQQQSSTASISKPSVTLIRSDAQPSSAAPKPPSMDDSYMAFLEDMKELGALDG

SEQ ID NO: 40918 - protein, 168 aa, Sorghum bicolor
  Clone ID: SORBI-28MAY03-C1287_1.pep
MGRTSVATAVAAALLVLAACAALPEKAAANKISINWKPNVNYTDWLKQHSPFYKDDWLVFYYTAGQADVVQVDEVGYNKCDATNAIYNYSKGRSFAFQLNETKTYYFICSYGYCFGGMRLAIKAEKLPPPSPPPSASDQSSAIAAFARSHAVVVYAAVAVLAALLRMV

SEQ ID NO: 40919 - protein, 265 aa, Sorghum bicolor
  Clone ID: SORBI-28MAY03-C12896_1.pep
YVKDTQGKWFKADDSQVKPVSLDNVMSKCAYMLLYARCSPRAPSSVRQAMGDPAHPKKAKQKVVSGGTTWRGGSLNRHQAGQQHRDQTADDLTHAFDEYRDVPYSPSDSPSPSESSSLFSNSDAGSHSTVSTDSSESTRNSTSTEEYEYMFGAADQMYSGGSMGGAPVESDYPTYSRLRSSLNTSSSGREAYSADSSAEHRLQGGWVEGDESPSLLYTDRSNQQWSSKLTDQYRQLDRSGHDPGETRGGVLSRRPSRDRTAQTFY

SEQ ID NO: 40920 - protein, 196 aa, Sorghum bicolor
  Clone ID: SORBI-28MAY03-C12223_1.pep
MAELLSWLAWLIASLLAVSFLDHLAHPRRRGLPPGPRPLPLIGNLHLLGDQPHRSLAGLAKLYGPLMSLRLGTVTTVVASSPEVARELLQKHDAVFATRFVPDAIGDHAKSSVVWLPNDSPRWRTLRKIMGKELFAPHRLDAFQHLRREKVQLLVDHVGRLARAGVAVDVGRVAFATMLNLLSSTMFSCDLTDLDD

SEQ ID NO: 40921 - protein, 165 aa, Sorghum bicolor
  Clone ID: SORBI-28MAY03-C12267_1.pep
CISFGAGTHAFTLDWSTGEFILTHPSIQIPPRGQIYSVNDARYFDWPEGLRKYIDTIRQGKGQHPKKYSARYVCSLVADFHQTLIYGGVAMNPRDHLRLVYEANPLSFLAEQAGGRGSDGKNRILNIQPVKLHQRLPLFLGSIDDMLELESYGDVQQKVNPGYEV

SEQ ID NO: 40922 - protein, 203 aa, Sorghum bicolor
  Clone ID: SORBI-28MAY03-C12319_1.pep
MRPLIRTARCWLLRARVRAMATLPMAPPAAAISSFTTRSLYSPSSRSHRLLLARFFSAAPAPAGARALRAAASAVEVGGVKIAREDVVKENDPTNNVPDTIFSKIGLQLHRRDNHPLGILKNTVYDYFDKNFTGQFDKFDDLCPLVSVKQNFDDVLVPSDHVSRSYNDTYYVDGQTVLRCHTSAHQAELLRDGHTHFLVTGDV

SEQ ID NO: 40923 - protein, 112 aa, Sorghum bicolor
  Clone ID: SORBI-28MAY03-C123190_1.pep
MEGRRSNEVSSAEAVLVGALSSGVNAPTWFVLRITFLLLALCFTAMLALAFSSKNFVIVAHVLLLVTIGTVLFVLLNRFLAEVGLVPVEQQMKEMGIHKTEATDKDKRGKRN

SEQ ID NO: 40924 - protein, 284 aa, Sorghum bicolor
  unsure (1)..(284): unsure at all Xaa locations
  Clone ID: SORBI-28MAY03-C12465_1.pep
RLFEQPFIKNDKVTISEWLKQTIATTGENMKVKRFARYNLGEGLEKKXQDFAAEVAAQTAAKPPPSAPPKDDKPAETTESAEKKPAVAVSASLVKQLRDETGAGMMDCKKALAESDGDLQKAQEFLRKKGLSSADKKSSRLAAEGLIGSYIHDNRIGCMIEVNSETDFVARNEKFKELVNDLAMQVVACPQVDYVSVDDIPESIISKEKEIEMQRDDLQSKPENIREKIVEGRISKRLGVMALLEQPYIKDDSKTVKDLVKEMIASLGENIKVRRFVRYTLGEN

SEQ ID NO: 40925 - protein, 247 aa, Sorghum bicolor
  Clone ID: SORBI-28MAY03-C12493_1.pep
ARGSADLLRREEEFYSSLFDSAKGDGAKSRSQLIEKKIEVLEDMATKVSNRRSRKWLNDRLLIELVPRLHVEEIKGLFAPPPWGEEVPLSAFCRTSVGEWDAFRSIDMDAEARLMQNMKRSSQKTRNHVDEGELIALNAWHRIDRQTREAIKRNFLPDLLEIYEERVRAFIEDTSDKDVLMLNIQDPFQRLLLHGVCEFYNVSSTTTSSVRDGRPWKTTPIKKRQGTGVPSAITLVNFLRMKKNGSQ

SEQ ID NO: 40926 - protein, 183 aa, Sorghum bicolor
  Clone ID: SORBI-28MAY03-C13147_1.pep
MFEQVVSDFCWHAREVVSSAMGLWGWPWGRRGPSGFGSASTAEEVTAGVDASNLTAIVTGATNGIGKETARVLALRGAKVIIPARTLESGLKVKESLAEQVPSSKLHVMEMDLSSLSSVRDFARSFDSSHQHLNLLINNAGIMACPYQLSKDGIELQFATNHVGHFLLTSLLLDKMKSTARET

SEQ ID NO: 40927 - protein, 124 aa, Sorghum bicolor
  Clone ID: SORBI-28MAY03-C13185_1.pep
VVQDKISEVALSLITAYDSGELTQALAEGRDGWQKWVKGFGKSIKRKGKGLFMPLRVLLTGKLHGPDMGGSIALIHKAGICGAVTSQSNFVTLDERFRILKEVDWESLAKEQETPAESAVPAAS

SEQ ID NO: 40928 - protein, 98 aa, Sorghum bicolor
  Clone ID: SORBI-28MAY03-C13063_2.pep
NSGQYAIELGVCSRERGKFYLSGTPFFALHGAICGIFATDWTMLMLLIPSWLGSLRWDLSTRIEVLAAWEWEHDSRSCSHVPHSRNVDVPETPMFPLG

SEQ ID NO: 40929 - protein, 184 aa, Sorghum bicolor
  Clone ID: SORBI-28MAY03-C13063_1.pep
AGRAGNDLLCELSGNLCYVHSPSSREVSIWLAQDGQNIITWSLRCRVNLPVPRLLRVYACASADQGTIFLSVDALHLLKCNLHDGSLETVGSSYTAECDESLKPAVGMTFEDIELAREFYKAYAAHVGFPVRVSQHKAKNELLINKCFYCSWEGFHKAKDETQSEPVRSGRRKCGPWISVTYYN

SEQ ID NO: 40930 - protein, 80 aa, Sorghum bicolor
  Clone ID: SORBI-28MAY03-C13187_1.pep
AINYMSHQYFTLTHQLYQKRSHYATDTKTIKVRHKKLWKTSLTMPRHCRCPHRHRPPRIDTKDVPAGIASHQTCRRTVDA

SEQ ID NO: 40931 - protein, 106 aa, Sorghum bicolor
  Clone ID: SORBI-28MAY03-C13235_1.pep
HEAPPEVVVVPKRKPAASSSSSSSSPAPKRKERRKEWEEMSVGEKAAELYVGEKGLLFWLNKFAYASIFIMVGAWILFRFVGPSIGLYQLDAPPLPPTAVFGGGSP

SEQ ID NO: 40932 - protein, 265 aa, Sorghum bicolor
  Clone ID: SORBI-28MAY03-C13277_1.pep
QHQRRAIDFWQKHWDKPIPLKLKRLARDHERFLWALSIVQSRSVNLKLRMGAFIQDANVLAPYADMLNHSPNANCFLHWRFKDRMLEIMIKAGHAIKKGDEMTIDYMSGVNSKFMERYGFSSPTNPWELINFSSPATIHMDSFLSVFNIAGLHDELYHNSTLPSVETDFVDGAVVAAARALPTWSDGDVPAIPSVERKSAQALQEECRQMLDSFSTTIEQDQQILDSDVHINKTREIAIKYRLHRKMLLQKIMDALDIYQDKILF

SEQ ID NO: 40933 - protein, 165 aa, Sorghum bicolor
  unsure (1)..(165): unsure at all Xaa locations
  Clone ID: SORBI-28MAY03-C12625_1.pep
APAPHPRRANTAPPKRNPKSSSASAPPPSPPPPAPPPRPPLRAPCPLPAAPRPXPAPARAPAPPPLPPAQHPRSAPAAPPAPPSGAPPRAPPRAGAPPRPPPPPARXPPFSAGPPGPGPRRCARGSGGSSGASPAAHWGPSXPPAPPGGPIPPAALPPRPPPLPM

SEQ ID NO: 40934 - protein, 233 aa, Sorghum bicolor
  Clone ID: SORBI-28MAY03-C12658_1.pep
MAAAPPPTVTKSPPSLVPPAGPTPGGSLPLSSIDKTAAVRVSVDFIQVFPAPTSDRSPSSAIAVMREGFAKALVLYYPVAGRIAEPVPGEPEIECTGEGVWFVEAEASCSLEEARNLERPLCIPKEELLPRPPAEVRVEDTLLLAQVTKFTCGGFAVGICFSHLVFDGQGAAQFLKAVGEMARGLPEPSIKPIWARDAIPNPPKPPLGPPPSFTAFNFEKSVVEISLDSIKRV

SEQ ID NO: 40935 - protein, 195 aa, Sorghum bicolor
  Clone ID: SORBI-28MAY03-C127179_1.pep
ARGLDKIGQGTYSSVYKARDLENGKIVALKKVRFANMDPESVRFMAREIHILRRLDHPNVIKLEGLVTSRMSSSLYLVFEYMEHDLAGLAATPGLKFSEPQVKCYMQQLLSGLDHCHNRGVLHRDIKGANLLLDNNGILKIADFGLATFFNPNQKQHLTSRVVTLWYRPPELLLGATNYGAAGDLWSAGCILAEL

SEQ ID NO: 40936 - protein, 368 aa, Sorghum bicolor
  unsure (1)..(368): unsure at all Xaa locations
  Clone ID: SORBI-28MAY03-C12753_1.pep
HEEREKVNDTITTSTTSKSHTNSGLSEKEMILEPPXSFMKRTMEKIIEFILTNGKEFEEKLIEQDRTTGRFPFLLSSNPYHSYYLKFLQETEESKSHGRSPNHNDRRGSSDRRGRRSPDSDDRSFRERANRSSRERSDRSARERGDQRCSMERKDSSYGMVSSASDRSSAGPSEKQLYDKQGKGRFHPVCGVKKEPTRKVTADEAAAIVMAATRGLGAANNSLNTMKGTNDNVRTHASNDPSSSFGSFSSLQDRDALSKHISNSEADASLTSSGQPQKEGFGIIDDDWIANTIAKAAAAAASKEADSSEASMTKEQKLKAERLRRAKMFAAIIKSGDKVNDLAAASDPTSEDAKAIPDMSVSGLDLQS

SEQ ID NO: 40937 - protein, 328 aa, Sorghum bicolor
  Clone ID: SORBI-28MAY03-C127886_1.pep
TRLAYAPEQRFVCDGRPPSCRQKLPGASAMVWFQCEDCGENLKKPKLASHFRCCSAYKLSCIDCGEFFSQETVQGHTQCISEAEKYGPKGQNKPSNGVQGKADKPKPNADVDINVGLSTRPPWFCSLCKTTTTSKQTLLLHADGKKHRAKAKAFHASQKQTNGAEQTPDVKEAGAVPTKESVQVNGGMSGDRERNDDKDAAKRKRMDDMTIEEPDNTKKQHLTQSRDEKSENKVKSKADELTSGADCKSVQKQKIKWKKIITKALKTNADGVMKLKKLQKLVSKELQECGVSKDEGLHATLMDKIASSSRFSVDGKHVRLVAKNEEES

SEQ ID NO: 40938 - protein, 106 aa, Sorghum bicolor
  Clone ID: SORBI-28MAY03-C1338_1.pep
MEYDGKYSKDQQSLLNLKCDCLLFDLDDTLYPFNSGIAADIMKNIQDYMVHKLRVEETISLELCVLLYKQYGTTMAGLRARALQSQYDAFPCLGLGCCFFLVAYWP

SEQ ID NO: 40939 - protein, 321 aa, Sorghum bicolor
  Clone ID: SORBI-28MAY03-C13383_1.pep
MSDRWDPPQSRVDWVPHEAEIEVPTSRPSKDAVRAFIMSPSGDSSAATPKPSELAISTSSPPQPPKVVVPVLINCHVNVIDEVEEIIEETGGLTLCQSIASILEHLPPCSSRIEREDQEERATEEEINRYCAEVEAPAFAVLRERKASRPSAWRKEPVTFTRADAGYYREVLEGIDLHLPQLAAAPAVNSLTLRISWPPEHEMRCYPCSCFLSSSHENFLALYLGAYRPSLSRPGCYLVLDTWAKSVAVIPSLPIGWVTSESHCNTGTAGVAILRHDLGRNKYLLAELYLHRDDKSHLASNKASLFLWCSSGSGPFADHWI

SEQ ID NO: 40940 - protein, 225 aa, Sorghum bicolor
  Clone ID: SORBI-28MAY03-C13386_1.pep
MESWVRAVVEAIHSSRSQAVIYLAGGASQALGWLLSVPGASGTVLEVVVPYSRASMAQLLGKMPLQFTSKQAAEDMALAAYNRALKLSGPGLQVMGVGFTGSLASSRPKHGDHRFYVSTWTHNCLRTSHVTLSKGLRSREEEDKVSSYFLLKAIAHTCRVSATIQSDIQEPEIPEESIEEFDEDQELQQIINGQVCMKVYNFAAPVENNFSRKIILPGSFNPLHD

SEQ ID NO: 40941 - protein, 130 aa, Sorghum bicolor
  Clone ID: SORBI-28MAY03-C13403_1.pep
MAGRASIPTNNSALIAIIADEDTVTGFLMAGVGNVDLRKKTNYLLVDNKTTVKQIEDAFKEFTTREDIAIVLISQYIANMIRFLVDSYNKPVPAILEIPSKDHPYDPAHDSVLSRVKYLFSAESVASDRR

SEQ ID NO: 40942 - protein, 203 aa, Sorghum bicolor
  unsure (1)..(203): unsure at all Xaa locations
  Clone ID: SORBI-28MAY03-C1343_1.pep
MAATLQSPSAVCVPVPCAERLRTPRPISRRVPHKPALSCSRACRAGVRCSAANKPSPPPPTTPDSSEVSSMAKIRSEVLSPFRSVRMFFYLAFMASGTLGGLIALARLLPLLSGSASDPARAADTLKGLXGIDVAAVSLFAFLYARESKAKDAQVXARLAREERLSRLRLRVGAAEGRPFTLSELRGTARLVIVAGPADFVAE

SEQ ID NO: 40943 - protein, 131 aa, Sorghum bicolor
  Clone ID: SORBI-28MAY03-C13766_1.pep
MRLLTHNMLASNVRGATTGYPLTLEATKWCTKEVELNADFIRGLLPKIDWRALVDATRALGLPELLPEEQPPEEEIFAEGAADVEGSAIRRIHHALLEVHVQEGSLVCPDTSRCFPINKGIPNMMLHEDEV

SEQ ID NO: 40944 - protein, 258 aa, Sorghum bicolor
  Clone ID: SORBI-28MAY03-C130_1.pep
TRVIIHGLNEHSGRYLHFAEQLTACGFGVYAMDWIGHGGSDGLHGYVPSLDYVIEDIEVLLDKIMMENPGVPCFLLGHSTGGAVVLKASLYPHIREKLEGIVLTSPALRVKPAHPIVGAVAPIFSLVAPKFQFKGANKRGIPVSRDPAALLAKYSDPLVYTGPIRVRTGHEILRMSSYLLHSLKKVTVPFMVLHGTADRVTDPLASRELYGAAASMHKELRLYDGFLHDLLFEPERDEVGAEIIGWMDGMLRLRRQTG

SEQ ID NO: 40945 - protein, 351 aa, Sorghum bicolor
  Clone ID: SORBI-28MAY03-C13019_1.pep
MEQEPKAVARNRKVVLRGYIDRAPREDDMELVDGGALELRVPECAGGGPAVLVKNLYLSCDPYMRGRMRDFQGSYIPPFKPGSPIEGFGVGRVVDSTYPGLSAGDIVSGMTGWEDYSLITKPEQLTKIQQSDIPLSYHLGLLGMPGFTAYVGFYEICSPKKGEFVFVSAASGAVGQIVGQLAKLHGCYVVGSAGTNQKVELLKEKFGFDAAFNYKEEPDLTAALKRYFPEGIDIYFENVGGPMLDAVLLNMRVHGRIAVCGMVSQHGVTAPAGIHNLFSFISKRIEMKGFIQSDYVHLFPQFVDDITKHYRDGKIVYVEDVSIGLESGPAAFVGLFSGKNVGKQVVRVSQD

SEQ ID NO: 40946 - protein, 284 aa, Sorghum bicolor
  Clone ID: SORBI-28MAY03-C12881_1.pep
AAFSSRGPNYRAPEILKPDVIAPGVNILAAWTGAASPTDLDIDTRRVEFNIISGTSMSCPHVSGLAALLRQAHPEWSPAAIKSALMTTAYNLDNSGETIKDLATGVESTPFVRGAGHVDPNAALDPGLVYDAGIDDYVAFLCTLGYSPSLISIFTQDGSVANCSRKFARSGDLNYPAFAAVFSSYQDSVTYHRVVRNVGSNSSAVYEPKIVSPSGVDVTVSPSKLVFDGKQQSLGYEITIAVSGNPVIVDVSYSFGSITWSDGAHDVTSPIAVTWPSNGGAAAM

SEQ ID NO: 40947 - protein, 312 aa, Sorghum bicolor
  Clone ID: SORBI-28MAY03-C1305_1.pep
TRTNAIQEWIERVAMIPVDGKEGPADVCVIELGGTIGDIESMPFIEALGQFSYRVGPGNFCLVHVSLVPVLNVVGEQKTKPTQHSVRGLRGLGLTPNILACRSTKELEDNVKEKLSQFCHVPAANIISLYDVSNIWRIPLLLRDQKAHEAILKVLNLERVDSIAREPKLDEWVARAAIFDTLHDTVRIAMVGKYTGLSDSYLSVLKALLHASVDCRRKLVVDRVASTDLEDSTAVEAPDAYKTAWDLLKGADGILVPGGFGDRGVQGKILAAKYAREKNVPYLGICLGMQIAVVEYARHVMNLTDANSTEID

SEQ ID NO: 40948 - protein, 200 aa, Sorghum bicolor
  Clone ID: SORBI-28MAY03-C1314_1.pep
LAREGRYRTLVYTTPHRTRIAAATDGGATGNPMTIAAAVTAPTSAPVHVAPRHATPAVVQPRAAPRRDPSPLNPNTTPAQALRSASPAGGSSSSSAAATDGGARAHIANLDKVLGKPPQVPRPHAAASSKRDGEGQEPLNVRHGLLNALNLSFFVPMPGMRARTAADEHMSPRSLMHMQQLLSADSPRASPRCTIAPRWR

SEQ ID NO: 40949 - protein, 381 aa, Sorghum bicolor
  Clone ID: SORBI-28MAY03-C13555_1.pep
MSPFYLARGASKLVRRITSETSVELKILSDKWRLLLAGLIFQYIHGLAAHGVHYLHRPGPTLQDLGFMILPELGKERGYISETLFTFIFLTFVLWTFHPFILQTKRFYTVLIWRRVLAFLCASQFLRIITFYATQLPGPNYHCREGSPLARLPPPQNAAEVFLINFPKGVIYGCGDLIFSSHMIFTLVFVITYQKYGSIRFCKMLAWCIAVAQSLLIISSRKHYSVDVVVAWYTVNLVVFFVDKKLTELPDRSVGSTSVLPVSTKDKDTKLKEENTRLLNGNSMDSADRRPRTQMKGALIVLDCLAGCLTGATWLSRGAGASSSNGRSAHRAWVPCSLWTSGHVTTSDGGGCVTSRSSRPPSFGAQLRDLPLPSHCDPRWK

SEQ ID NO: 40950 - protein, 183 aa, Sorghum bicolor
  Clone ID: SORBI-28MAY03-C13504_1.pep
MAGARVLLIVLAAAVALLAARPVAATGGVAGVEEVCRSTPFPDLCTRTAGKHAEKYKVVDAVTVLEMQVDAFKKRVKAARRVAKQEVKTAAPTPLVRRALNLCKSYYLDAGDNLGACKRAIGFRDAVTIRATMSMVAQDMQNCDEEFRKAGSTNPMEDHNRSLIEMSEICRTLSNMVPYEHTH

SEQ ID NO: 40951 - protein, 142 aa, Sorghum bicolor
  Clone ID: SORBI-28MAY03-C13572_1.pep
SFLGDLAPAVASWRLQAPLIDMGNELVGSSDLRQLPERQHHHLKIVEMITFKSTKSLVELTCCIVKSAVSLERLTFDTFRGDVRSPCCSGDDSVVGYSKYRMEQASRAVEAIRMYIEDKVAPTTKLTVLEPCARCHATAFDD

SEQ ID NO: 40952 - protein, 305 aa, Sorghum bicolor
  Clone ID: SORBI-28MAY03-C13626_1.pep
PVDLINVQLFAQGIMNLSEYRKKLYEYLVTKMNDIAPNLTSLIGEVVGARLISHAGSLSNLAKCAASTLQILGAEKALFRALKTRGNTPKYGLIFHSSFIGRASAKNKGRMARYLANKCSIASRIDCYSELNTSIFGQKLRDQVEERLDFYDKGVAPRKNLDVMKAAIEGISAVSEDVDGNEKNDVSAKKGKKKKSKTQTDGEAMDVDKLADGEDEPQTEKKKKKKHKREEPQDEEMATEPLSDDVKQDETPKKKKKKTHEATGDVEPKKKKKKTREAYEVVEPKTATEGKKKKKKKSKTEGSDE

SEQ ID NO: 40953 - protein, 205 aa, Sorghum bicolor
  unsure (1)..(205): unsure at all Xaa locations
  Clone ID: SORBI-28MAY03-C137_1.pep
VRFGYPXRPTLFKNLNFGIDLDSRIAMVGPNGIGKSTIXLKLISGDLQPTSGTVFRSPKVRMAVFNQHHVDGLDLTVNPLLYMMKCYPGVPEQKLRAHLGSFGVSGSLALQPMYTLSGGQKSRVAFAKITFKKPHIILLDEPSNHLDLDAVEALIQGLLVFQGGVLMVSHDEHLITGSVDELWVVSEGRVTPFSGTFKDYKKMLK

SEQ ID NO: 40954 - protein, 273 aa, Sorghum bicolor
  unsure (1)..(273): unsure at all Xaa locations
  Clone ID: SORBI-28MAY03-C13320_1.pep
ILVFPLGLGVRGAALATVTSEYVIACILLWKLNSKVVLFSRNVIGGGIIRYLKSGGLLIGRTIAVLLTMTLSTSLAARQGPVPMAGHQLCLQVWLTISLLNDALALAGQALLASEYAKGNYKQARLVLYRVLQIGGVTGIALAVVLFFGFGSFSVLFTNDRAVLDIAKSGVWFVTVSQPINAIAVGAHGLHLGVAAFXTAYSMFFVGALAAAFLLAAAPKLGLGGVWSGLVLFMSLRAAAGFWSILLLCXRLGSKGGPWKQIWSDTKLINDKK

SEQ ID NO: 40955 - protein, 283 aa, Sorghum bicolor
  Clone ID: SORBI-28MAY03-C13207_1.pep
MAAPGCGVTARPHLPSAVPAAARKLFFRCRAASTMNEASASSPDAEEKKTTTVFVAGSTGRTGKRVVEKLLAKGFGVVAGTTDVSRARGSLPQDPNLQLVRADVTEGVDKLVEAVRGVDAVVCATGFRRSFDPFAPWKVDNFGTVNLVEACRKAGVTRFVLVSSILVNGAAMGQFLNPAYIVLNLLGLTLVAKLQAENHIRKSGINYTIVRPGGLTDQPPTGNIVMEPEDTLYSGSISRSQVAEVAVEALLCPESSYKVVEIIARTDAPNRPLKDMYAAIKQN

SEQ ID NO: 40956 - protein, 84 aa, Sorghum bicolor
  Clone ID: LIB3478-055-Q6-K1-A8.pep
CFLILLVITGKYSLSTNSLCIAFLLLKILQDTLYSGSISRSQVAEVAVEALLCPESSYKVVEIIARTDAPNRPLKDMYAAIKQN

SEQ ID NO: 40957 - protein, 324 aa, Sorghum bicolor
  Clone ID: SORBI-28MAY03-C13324_1.pep
MTTERQVAELGPGTACCGWNYCGRRLAAGAVDGSVSVYDSQPSPSFKWQAHEQAIVNVVWLPPEYGDAIACACADGTLSLWEEVAADDQLPTWRKCKIFEDGNSHILNVHFGLHLGSLKMVTAYSDGQVKVYELLDSLELDKWQLQAEFQNITDPISRFGKLACTSASIAWNPRRGGSQQASFAIGFNSDSPHFNSCKIWEFEEAHQRWLPLVELGSPEDKGDRVCAVAWAPNIGRPYEIIAVATCKGIAVWHIGLNTDADSGPTTRNVALLNGHDGEVWQLEWDMGGMTLASTGGDGMVKLWQANLDGVWHEQAVLDCSGSRV

SEQ ID NO: 40958 - protein, 236 aa, Sorghum bicolor
  Clone ID: SORBI-28MAY03-C13330_1.pep
MAAPANSSCPTPPAHALREAVCPPTTPPPAPMAAPANSSCFHPRATASPPSSLSVGTKVFVGLRAQTKLGSSESSCPNVSAGFYTAVNRRISLGLSNKKATRARISMMPIGTPRVPYRTPGEGTWQWLDIWNALYRERIIFIGDNIDEEFSNQVLASMLYLDSIDNSKKIMLYINGPGGDLTPCMALYDTMLSLKSPIGTHCLGFAFNLAGFILAAGEKGSRTGMPLCRISLQSPA

SEQ ID NO: 40959 - protein, 192 aa, Sorghum bicolor
  Clone ID: SORBI-28MAY03-C13352_1.pep
MAAPTAAPLDEGKAKKVLRQVEFYFSDSNLPRDKFLRETVEQSDDGLVSLPLICSFSRMKSHLGLDADVKAETLPEETVLAVAEVLRRSPVLRVSEDGKKIGRASELLKPDEIIEQVDSRTIAVSPLPYNVKLEDVQSFFTNYAKVNSVRLPRNIVNKKHFCGTALVEFSEEEEAKSIMDSSLVFAGANLEI

SEQ ID NO: 40960 - protein, 176 aa, Sorghum bicolor
  Clone ID: SORBI-28MAY03-C14004_1.pep
MYPYTLRAAASSSSSSSTGLGFALGRIGGTTTRGGGGGAAAQGLVVPAAGVARGRSVSSTPAGNAPVPGDQGVGMEQPKQQQPQVPAQDAAAGDKNKRRDDMHKTTGDVMSHSFGEGYSTRSDEEGFGGVYGGNDPVEHPGTEIHPSHPEYDTSQGSEVKEKEKARHLKDEKHATA

SEQ ID NO: 40961 - protein, 80 aa, Sorghum bicolor
  Clone ID: SORBI-28MAY03-C13909_1.pep
SKFYVSMDSLASLDIFSHIFFFSVEIITCSNYICYPLNVLYYDCGLILYTSDSIWARGVSMFSSSSKLTSTSRLRVRVLD

SEQ ID NO: 40962 - protein, 76 aa, Sorghum bicolor
  unsure (1)..(76): unsure at all Xaa locations
  Clone ID: LIB3480-057-P1-K1-A2.pep
KKDYFCKYINSFVLIIRNGHDNALISREGQRHMCLPEKSAVSAPTLLXVSSISKGSPLQYYXVSLDLVVLNTPISF

SEQ ID NO: 40963 - protein, 114 aa, Sorghum bicolor
  Clone ID: SORBI-28MAY03-C14081_1.pep
YTPTAIHPVTHPPTHPSTASQIRLRSSAHPPRFPVSLSEVSLDLSEFSRVAGKVHSTLSSFSLLISSPSCFGFVFLEQTARDPGPFRSWASDLRFLLLLLLRFGFSSLGLLVGW

SEQ ID NO: 40964 - protein, 86 aa, Sorghum bicolor
  Clone ID: SORBI-28MAY03-C140_1.pep
SSVLMAVSTLAIVCSCSPTMYTPSRVMLLGTAVHVYSFTTDLSMSSADKFSLRWVQLVVSFSPGPAAIIKTLLYLSKQDLMYVLMY

SEQ ID NO: 40965 - protein, 170 aa, Sorghum bicolor
  Clone ID: SORBI-28MAY03-C14161_1.pep
LAMAGARTLLLLLVAALCLATVNAATLAEICKGTAFPDICTSTVGPEAASNPVLDPMAVLRMQVDAFNQRTEAARAHVKEAAMTASPKARTVLDLCNSLYLDVEDNLGACRRAIGFKDAVTIRATMGMAAQDMQNCDEQFRQIGEPNPMEQFDASLVEMSENCRSLSNMI

SEQ ID NO: 40966 - protein, 143 aa, Sorghum bicolor
  Clone ID: SORBI-28MAY03-C1421_1.pep
EKRQKEIVKGDRSIKKLSRRERRKASQIEREKEREAARSVGRVSYRDPYRDQRRSPSYEAYSRGRRSRSRSRSRSPSHSRRHGRGMHAESNYRSKQKAPRVEYITEFGGSDDTSEPKVSGISPPSSPIRIDIPNRSGNSTFNI

SEQ ID NO: 40967 - protein, 180 aa, Sorghum bicolor
  Clone ID: SORBI-28MAY03-C134350_1.pep
MFPMLTGFISYGQQTIRAARYIGQGLIITLSHTNRLPITIHYPYEKSITSERFRGRIHFEFDKCIACEVCVRVCPIDLPLVDWKFEKDIKRKQLLNYSIDFGVCIFCGNCVEYCPTNCLSMTEEYELSTYDRHELNYNQIALSRLPISIMGDYTIQTIRNSPQSKIDEEKFWNSRTITDY

SEQ ID NO: 40968 - protein, 163 aa, Sorghum bicolor
  Clone ID: SORBI-28MAY03-C13465_1.pep
MAFGALVASRLARSGRTLASAVAQGPVAQRTAPPLLSRLGAVARLLSTKPAAADVIGIDLGTTNSCVSVMEGKTPRVIENAEGARTTPSIVAKNQNGDLLIGITASRQAVTNAQNTIRGSKRLIGRTFNDPQTQKEMKMVPYKIVKAPNGDAWVEMGGQQYSP

SEQ ID NO: 40969 - protein, 74 aa, Sorghum bicolor
  Clone ID: SORBI-28MAY03-C13485_1.pep
VIQFCATAFAYYAQATAAQEIFGHTLQSLRGIKYLYKYNVFQYGFVALAILTLFYYAIFGWRKRKPTGRFQLSN

SEQ ID NO: 40970 - protein, 76 aa, Sorghum bicolor
  Clone ID: SORBI-28MAY03-C13493_1.pep
QCVDPRLGDEYPPKAVAKMAAVAALCVQYEGEFRPNMSIVVKALSPLLHSRPGNRPAASPASPAAAAAAAAERSGL

SEQ ID NO: 40971 - protein, 114 aa, Sorghum bicolor
  Clone ID: SORBI-28MAY03-C13550_1.pep
IPEQDEWVYSDGKSTTCVAFILAMYKEAGIFAPFSESIQVTEFTIRDAYMLKIFEDNPARLPSWCNTDTDKLPFCQILGEYRMELPEYNTIEPYAKMNENCPSLPPTYKRPARC

SEQ ID NO: 40972 - protein, 261 aa, Sorghum bicolor
  Clone ID: SORBI-28MAY03-C14369_1.pep
EYRNQRAANTLGSKGMFQLIQRKGSSRNLMALLNTDGSVTKAWHVGTSDGNGDLNVITKSRKSAENPMLDASQIGKAEAVNLQFGPFGISAWMSDTGGTSHTGSVEDLRADNVETGGRNYSSCCSSPKMSDSTSKELMEDYSVYGSEEEEEADDPRDAETDEDLTDEERDMHEIDAGSVDEHSTKSDEEYEDLAMRDVMENGDWSDDEQVVSKTKNSPALEGIHGSGAAKDDGIKGRYHHNLDLFLKMSKEVAGTGMPCAS

SEQ ID NO: 40973 - protein, 188 aa, Sorghum bicolor
  Clone ID: SORBI-28MAY03-C14387_1.pep
HFSAMNKLKKMALRVIAESLSEEEIGGLKELFKMIDTDNSGTITFDELKDGLKRVGSELTENEIQALMEAADIDNSGTIDYGEFIAATLHMNKLEREENLVSAFSFFDKDGSGFITIDELSQACREFGLDDVHLEDMIKDIDQNNDGQIDYSEFTAMMRKGNAGATGRRTMRNSLHLNLGELLNPSKT

SEQ ID NO: 40974 - protein, 155 aa, Sorghum bicolor
  Clone ID: SORBI-28MAY03-C14478_1.pep
MDAGGDWRAQLQPERRSKIVNKIVLTLRKHLPVQVPEGQGLVELQRIAVRFEDKVYAAATTQAEYLRKISLKLLSMWSYTNTQQNPGPGSSTKGKKQKKLRCHFCKKGGHLKKDCLKRKLWFEKKGVAYDPTHKRTKAHENKNEGTVLKESGIAE

SEQ ID NO: 40975 - protein, 86 aa, Sorghum bicolor
  Clone ID: SORBI-28MAY03-C14511_1.pep
CPEGSTCCCSARGLGFCLSWSCCELDNAVCCKDNKSCCPHDYPVCDTDRGLCLKASGNSSAIEGIRRKRTFSKAPSWTGLVELMDH

SEQ ID NO: 40976 - protein, 190 aa, Sorghum bicolor
  Clone ID: SORBI-28MAY03-C1458_1.pep
HASGVKLGKAAYQELTGVKKPKLDEQGVLHWPVLLLYPEVMSSDFIEDFPDTDTFLPHLDVMFSESSPPLPWDENHAYTRDSVELYYQGGFGKPLSKSEVLRYLLEGTVDLKALPDSLLDGEDEEHDSSKCSTVTSTDGSSKWIKVKEGKTLQEVLQDKGYIVPAIPVFFVVSRKSTFYKDFKAGNWSLP

SEQ ID NO: 40977 - protein, 277 aa, Sorghum bicolor
  Clone ID: SORBI-28MAY03-C14641_1.pep
SVSPILPIHGSDGHGTAAILCTDSFQSMYSQMLCGLVARTEVLRVGAVFASGLLRAIRFLQLHWKELAHDLRTGTLSARVVEPSIRDAVAEVLTKPDAGLADLVEAECGKDNWEGIITRTRPNTKYLDVIVTGAMAQYIPTLKYYSGGLPMACTMYASSECYFGLNLRPMCDPSEVSYTLMPNMCYFEFLPMDAAASGGGDASQLVDLARVEVGREYELVITTYAGLNRYRVGDVLQVTGFHNTAPQFRFVRRKNVLLSIESDKTDEAELQPAVERA

SEQ ID NO: 40978 - protein, 246 aa, Sorghum bicolor
  unsure (1)..(246): unsure at all Xaa locations
  Clone ID: SORBI-28MAY03-C23094_1.pep
MRLSCNGCRVLRKGCSDACTIRPCLQWIKSSDAQANATVFLAKFYGRAGLLNLIAAAPNEACGPIVIPVYGSVGLLWSGNRHACQAAVEAVLKGQPVVAXDAAAAPPLMLGGRRFDIRHVAKDPDAAAAADLLRVARGRKRAASSSCTSSKPSGNKQRRASTGDNDEPLTRRPGQEAEEEPEPVVEHDHGHDEESAGSHDHHHLQAQQQGSEEDTDVEALNSHSHSHSQVSQAEPELQRHAPPASS

SEQ ID NO: 40979 - protein, 258 aa, Sorghum bicolor
  Clone ID: SORBI-28MAY03-C23101_1.pep
HTHQQNPSLPPRPRLPPRARLFPPSAAAAMPLALSFLHLPPNTAPFHSFQVHRTHHSHLHLSLRTRPASATEAANEAENPSASADVERVRGRDGVWTARSPTVVVLWDLDNKPPRGPPIPAATALIGAASLLCRVASASPFANRHPFSHLPAWGSAQRAHRRALHPADRALFVPSSCAFSGPAFHTRIHLTRHFRHLLRRLRDRERSRLRSRLRSLKGKKRQKFRERFISGNTKYEDAARELLTPKVGYGLASELRRA

SEQ ID NO: 40980 - protein, 289 aa, Sorghum bicolor
  unsure (1)..(289): unsure at all Xaa locations
  Clone ID: SORBI-28MAY03-C23562_1.pep
MAAATKTKMMNGGANNSSREEYSEQPQHTESEWEAVSSLLDAARPFLRGELGSAEDPELPSLVAVLRAAGAGECYHKHGTFLAHLEDVYRILRLWGASDAVARCGLFHSSYSNSYVDLAIFQPDTGRAQVRGIIGADAERLVHLFCVVPRHHLVFQQLQPRYTDQELRDHLAAAEAEAEIAQQPGGLLTTMSPWRQKLRSVVPXEGVVVSHIRTGEPVRLSRRVVAAFLLMTVADFSDQYTDYQDDLFDNDDGRLEFRGDNWAALWPGTGKPGLWVSAMSRLAALYGLI

SEQ ID NO: 40981 - protein, 135 aa, Sorghum bicolor
  unsure (1)..(135): unsure at all Xaa locations
  Clone ID: SORBI-28MAY03-C237_1.pep
IGAGMILKQXLRGQGMAFLVGGGSVMQKILAPREVITVDAACIVAMTTTINFQLKNPNQLRRAVFGGDNQLTTSLTGPGVVFIQSLPFHRLSQRIASRSVAGPSLRDNPKFFIQIVMFFFLAYVMIVSSIILTDV

SEQ ID NO: 40982 - protein, 204 aa, Sorghum bicolor
  Clone ID: SORBI-28MAY03-C23784_1.pep
MAVKIYVVFYSTYGHVAKLAEEIKKGAASVEGVEVKIWQVPEILSEEVLGKMGAPPKTDVPIITPQELAEADGILFGFPTRFGMMASQMKAFFDATGGLWREQSLAGKPAGLFFSTGTQGGGQETTPLTAVTQLTHHGMVFVPVGYTFGAKIFDMESVHGGSAYGAGTFAGDGSRWPTELELEHAFHQGKYFAGIAKKLKGGSA

SEQ ID NO: 40983 - protein, 284 aa, Sorghum bicolor
  Clone ID: SORBI-28MAY03-C1470_1.pep
MSDDVIWHCIRHNHCSFMAKITTGIFCRNPYNRTRKRTRSHAELAARRYVTIEEHDGVFYLYMKTAERAHLPNKLWERVKLPKNYEKAMDVINKHLEFWPKLLVHKIKQRLTKMTQYRIRMRKLQLKVREKVMTMPRKQTQRDLRRLDKAERAAQLEKNIENELKERLTKGVYGDIYNYPFKAFDVVLDMEKGEVAPEEEEEEEGEIEYVEGDDMEEMDDMEDMEDFEGLSDGGTDEDDVLDDPVSKKPKGSSSSKQNAGKRSRKVMTEVEQDEEINTRQRRRA

SEQ ID NO: 40984 - protein, 90 aa, Sorghum bicolor
  Clone ID: SORBI-28MAY03-C14810_1.pep
MAVSRGAVLFLFLLLLVAAEMGAIVVDAKTGEDDKSKEKKERICLSKSVLFEGFCFDSDKCNEVCKKESFGGGECKLDTIKRKCFCKKPC

SEQ ID NO: 40985 - protein, 106 aa, Sorghum bicolor
  Clone ID: SORBI-28MAY03-C14698_1.pep
MDTSSPAALVNAETLNMFVGRRVRTVVQVQRNEGGVVVGQSSDGHQLSIKSAMDVPVSNFMEVYGIAENNQTIRAEVCTDFGPNFDPKPFDQLCKLASDKFKHMFL

SEQ ID NO: 40986 - protein, 64 aa, Sorghum bicolor
  Clone ID: LIB5052-008-A1-XP1-F11.pep
MGIQLSIKIAMDVPVSNFMEVYGIAENNQTIRAEVCTDFGPNFDPKPFDQLCKLASDKFKHMFL

SEQ ID NO: 40987 - protein, 217 aa, Sorghum bicolor
  Clone ID: SORBI-28MAY03-C14736_1.pep
MRLQVECREVITKYDSEDEVSCVVTPDCPTRPVESTAVKDVVSDGDEAESTGIVIRSRHPAPSSSLESSFTQQGTAMRRLRLQSGLNKGLCPSSDDSSSCIIDESESQHKTEKAEIEEDASTNLTGSVDDLPGNSYDDEQKNISEHGAETAVPEAKSVLRLRKTSEESNKDVKQQEGCLEPHVRAPMQRGGFQSYIIWLVLLVALLLLLCVGAYGWV

SEQ ID NO: 40988 - protein, 105 aa, Sorghum bicolor
  Clone ID: SORBI-28MAY03-C14872_1.pep
SPGTMMVKAGAVLEHPVVVSAAEKLGKTPAQVALRWGIQMGHSVLPKSTDEERIRANFDVYDWSIPDELFAKFSEIEQEKLIRAGFFVDPEGVFKSIEEFWDGEI

SEQ ID NO: 40989 - protein, 241 aa, Sorghum bicolor
  Clone ID: SORBI-28MAY03-C14959_1.pep
GVSETLVLNMSTLTWSVVSTVEGRVPLASEGMTLVHSNYSGYDYLISFGGYNGRYSNEVYTLKLSLKSDSQSTVNEETVSDTTSRVIEPEAEISQDGKIREIAMDSADSDLNNRNDEASEQLIADLKAQKEELEATLSREQLQTVQLKEDIAQAETRNAELTKELQAVRGQLASEQSRCFKLEVDVAELRQKLQSMDALEKEVELLRRQKAASEQAALDAKQRQSSGGMWGWLAGSPPPTV

SEQ ID NO: 40990 - protein, 127 aa, Sorghum bicolor
  Clone ID: SORBI-28MAY03-C14221_1.pep
VSSPPPPIKSPPPVRSPPPPMKSPPPPTPARSPPPPVKSPPPPPPVSSPPPPVTSPPPPTPVSSPPPPVKSPPPPAPVSSPPPPALVSSPPPPAPSLSPPPAPMEVILPPIMAQKYASPPPPQFQGY

SEQ ID NO: 40991 - protein, 129 aa, Sorghum bicolor
  Clone ID: LIB3480-029-P1-K1-H8.pep
PPVKSPPPPAPVISPPPPVKTPPPPAPVSSPPPPVRSPPPPVPVSSPPPPVTSPPPPPPVPVISPPPPTPARSPPPPVKSPPPPPPVSSPPPPVTSPPPPTPVSSPPTPVKFPSPPAPVSSSPPPAILS

SEQ ID NO: 40992 - protein, 96 aa, Sorghum bicolor
  Clone ID: SORBI-28MAY03-C14304_1.pep
ANKQGLVHCVRSDDLPPSCKKCKLARTEDHHHIYGIDRRHPSLILFFFFLVGWLWFNFSSFRRRAGRGLYLQKYYSSNSSRAGGFGLFGGRRPSPD

SEQ ID NO: 40993 - protein, 183 aa, Sorghum bicolor
  unsure (1)..(183): unsure at all Xaa locations
  Clone ID: SORBI-28MAY03-C14287_1.pep
SAKKSVPGEPNISYICSRYYRAPELIFGATEYTTAIDIWSVGCVXXELLIGQPLIAGESGVDQLVEIINILGSPTREEIRCMNPNYSEFKFPQIKAHPWHKLFGKRMPPEAVDLVSRLLQYSPNLRCTAVDACAHPFFDELRDPKVCLPSGRPLPPLFDFTAAELEGLPIELVHRIVPEHMRK

SEQ ID NO: 40994 - protein, 110 aa, Sorghum bicolor
  Clone ID: LIB3480-033-P1-K1-F9.pep
IDIWSVGCVVAELLIGQPLFPGESGVDQLVEIIKILGTPTREEIRCMNPNYSEFKFPQIKAHPFFDELRDPKVCLPSGRPLPPLFDFTAAELEGLPIELVHLIVPEHMRK

SEQ ID NO: 40995 - protein, 150 aa, Sorghum bicolor
  Clone ID: SORBI-28MAY03-C14349_1.pep
MDLGATRRGRLPIHLLLASLTVLVVLTVRSSAEVITLTEETFSDKIKEKDTIWFVKFCVPWCKHCKNLGTLWEDLGKVMEGEDEIEIGQVDCGVSKPVCSKVDIHSYPTFKVFYEGEEVAKYKGHRDVESLKNFVLSEAEKAGEAKLQAD

SEQ ID NO: 40996 - protein, 76 aa, Sorghum bicolor
  Clone ID: SORBI-28MAY03-C15235_1.pep
QVVAELEKMKGMTKEEAAAFAAKAVAEAEVAIAEAEEAARVAEAAENDAEAAKAFLDAVTLSMRSRNAASVMLRAC

SEQ ID NO: 40997 - protein, 77 aa, Sorghum bicolor
  Clone ID: SORBI-28MAY03-C15300_1.pep
MESSRKIQPVVILLLLLIVATGMAPAAVQARECEKDSERYVGMCTSRVNCANVCRGEGFMSGKCSTFRDRCICTKPC

SEQ ID NO: 40998 - protein, 230 aa, Sorghum bicolor
  Clone ID: SORBI-28MAY03-C15329_1.pep
MDCAVGGDPVEDFLLGGAGDDGDLAIFCDGGLGIEGVNGDACGFDQSNLGKRGRDEPSSSGPKSKACREKMRRDKLNDRFLELSSVMNPGKQAKLDKANILSDAARMVAQLRGEAEKLKESNEKLRENIKDLKEEKNELREEKVRLKVEKDRLEQQVKAMSVAPTGYVPHLPHPASYHPAAFTPFVPPQQAPANKSAPIPAPFPGMAMWQWLPPTIVDTTQDPKLWPPNA

SEQ ID NO: 40999 - protein, 323 aa, Sorghum bicolor
  unsure (1)..(323): unsure at all Xaa locations
  Clone ID: SORBI-28MAY03-C1539_1.pep
ARGKGFKIGVICGMIGLTXYEAVAIGRTFAAMKDYQIDGNKEMVALGTMNIVGSMTSCYIATGSFSRSAVNFMAGCRTPVSNVIIPRVRLLTLLVITPLFKYTPNAILGSIIISAVIGLVDYEAAILIWKVDKMDFIACMGAFFGVVFKSVEIGLLIAVSISFAKILLQVTRPRTVLLGNLAGTTIYRNTEQYPHARHVPGVVVVRVDSAIYFSNSNYVRERILRWLTDEEDKVKADGLPKINFLVVEMSPVIDIDTSGIHALEDLYKNLQKRGIQLLLSNPGSAVIEKLHSSKLTEHIGNNHIFLTVADAVRFCTSKSMQEP

SEQ ID NO: 41000 - protein, 185 aa, Sorghum bicolor
  Clone ID: SORBI-28MAY03-C15408_1.pep
MNELPIGDSGDSAAEKSSNGVVDTASCSDRDEISDLDLDDDDDFTEEEAAVAKLVISVASDSLVVVKEAIRFITGLLKSSGNKDGANEDKVEPMEKLLSHCKEIADQVNDLGASVYPPQDSSEMKLAIKRLYNGINGMRKEVGNLGGSPESTFAALEGFEKCIGSLQAKLSDDVANEMENLNISY

SEQ ID NO: 41001 - protein, 162 aa, Sorghum bicolor
  Clone ID: SORBI-28MAY03-C14599_1.pep
APAAEKPRVAPKPSTPATTSYTDRPYVCPYEGCDKAYIHGYKLNLHLKTQHPEHGQEENGKVGASAGHHAANEQTYQYNYAEVGEIAPNPKRSKHKVHSSKAYNAKVSRAMPSDIGGVRNQWPGKATYQDDSEETEEDGGHNIEDGWRYGNNDDDEETPDED

SEQ ID NO: 41002 - protein, 245 aa, Sorghum bicolor
  Clone ID: SORBI-28MAY03-C1461_1.pep
MKRTMEFYHDHLTSGTKTKWKIKEFTAFQHATAGEICTPMMPRSEMSLCQLYTELAANPDCSPAGVQYDEKLSVKQNKIPAEEPSVESDIVQTRKHADKRKRRVDETTKTVVTIASPDVNDGYTWRKYGSKQILGSNYPRDYYKCTQRRGCPARKHMQRRDGEPILYDVCYFGEHSCDLQQGHSSEQGSETNTISGGWEAALPLSVPHAHGISSVEAMISSGSLTARPNPGSPPCGRVHGTSQVV

SEQ ID NO: 41003 - protein, 95 aa, Sorghum bicolor
  Clone ID: SORBI-28MAY03-C14632_1.pep
MMSPSEVELLPGLDGICTELLQEDGITDVQFGRQASEKRVVSQDLELWLSNAPAKDNKFTLLARAGRQVQEVYLTTSLDQEGIKKAVQRVLGRVP

SEQ ID NO: 41004 - protein, 66 aa, Sorghum bicolor
  Clone ID: LIB3480-022-P1-K1-H7.pep
VDQAALTGESLPVNKHSGQGVFSGSTVKQGEIEAVVIATGVHTFFGKAAHLVDSTNNVGGRSRKCI

SEQ ID NO: 41005 - protein, 307 aa, Sorghum bicolor
  Clone ID: SORBI-28MAY03-C14686_1.pep
IFSPAATGLWERARSFAGEAAKRSQELSAEAAKRSSALVSETAKKSKEIFSETASKSREIAAEATKQADLLAGQIMHLASDLPVPSIPPIPAIPPIAAAASSESDTAELERYGITDDLREFVKGMTLSTFRDFPLQDEPEMSDVPTVSNVRQDLNEWQARHATLVLSAVKEISKFRYELCPRYMKERKFWRVYFLLVNSYIAPFEKKYFEELKVKAEEEKKDSPKEASQASTTAEPKDTKAPSKSSSTNPEHDLDVFLLGDLGSDDEGPVDGDDGLDDDFDRIDATTGLESDDDDKIPATGKAEDAK

SEQ ID NO: 41006 - protein, 229 aa, Sorghum bicolor
  Clone ID: SORBI-28MAY03-C15609_1.pep
MEAAVEKKEAEQEEQQLPHARKDDAPAAAEEDEADAEETERRNRDLKAGLHPLRRKLVLWYTRRTPGARSQAYEDNIKKIIDFSTVESFWVCYCHLARPSSLPSPTDLHLFKDGIRPLWEDPANQNGGKWIIRFKKAVSGRFWEDLVLVLVGDQLEYSDDVCGVVLSVRFNEDILSVWNRNASDHQAVMALRDSIKRHLKLPHSYLMEYKPHDASRRDNSSYRNTWLRG

SEQ ID NO: 41007 - protein, 222 aa, Sorghum bicolor
  Clone ID: SORBI-28MAY03-C15618_1.pep
RHDVQSQIKQTRQTKMHFQKMKRRIQKLHIAGLNNAINSNTGVAVLIATAAFAAIFQLPDNCLEDITQAPYPDMTLGQALIASDPAFIIFLVFDALALFISLAVVVVQTSLIVVEHNAKKKMVFVINKSMWLACLCISAAFIALTYVVVGRDDEWLAWCTMAIGTVIMVATLGSMCYCIVAHRMEEKSMRKIRRTSTSQSFSISIDSETELMNSEYKKMYAL

SEQ ID NO: 41008 - protein, 170 aa, Sorghum bicolor
  Clone ID: SORBI-28MAY03-C15777_1.pep
MPSEPNTEFGIPSQYSYMTVCAPSCHDCSTLRAWWEEDEGRRSRFYKTVVGSDEEPPSRCTPEVVHFIVQQHFDAPSMWAIFPLQDLLALKDKYTTRPAPEETINDPTNPKHYWRFRVHVTLESLLDDKDIQATIKDLVTSSGRSFPGKKAEGADESGEKLSKVQLNGKA

SEQ ID NO: 41009 - protein, 194 aa, Sorghum bicolor
  Clone ID: SORBI-28MAY03-C15824_1.pep
RKPEVASIAAEGVSDMVDQAVAMAFGHSRTTNYIRIQGTGGRCGGGGGRAPRACGGETKQEAVWKAEAMLLQRSVARGLFQGRKLAGETNADKVERFARELAKEHARRKQQQLVSPAGGGGAPVVAVASVAAPNNGNDEQPTTTTKATAASATAPTAVAPRRRRRQITTAATKHAPATSSRPAVAGGCTAAGTR

SEQ ID NO: 41010 - protein, 264 aa, Sorghum bicolor
  unsure (1)..(264): unsure at all Xaa locations
  Clone ID: SORBI-28MAY03-C1585_1.pep
MATTEGLVPITRTYLARYYDNYPLPPLPDATTDLAARLRVLSADLAAVAPITPDEELLEQEAAGIPAHKIDENLWKNREQMEEILFLINTSRRPVALQQKSTPEDAQIVCTLDDIEAKLKDMLKKLEQFQLENADSVFNTVMTYMPQDFRGTLIRQQRERSERNKQAEVDALVSAGGSIHDRYALLWKQQMERRVQLAQLGSATGVYKTLVRYLVGVPQVLLDFIRQINDDNGPMEXQRERYGPALYTLTKLVLAIRLYLHVSL

SEQ ID NO: 41011 - protein, 100 aa, Sorghum bicolor
  Clone ID: SORBI-28MAY03-C15853_1.pep
TDGFLFFQVQCCQWPMNRTEQVASSSSPAPRLAITMGGRQRSRDILSCLKPVLPALLIQQHATVSGWHKQRLMPACLSLTPDSQQQSTLFVVSSSILPQI

SEQ ID NO: 41012 - protein, 145 aa, Sorghum bicolor
  Clone ID: SORBI-28MAY03-C14991_1.pep
GRGAASGSVRQGRRRRHRMRGWRCRLRRGRHRRSRGRHRRSPGRQRAAAAAPRRRRRSAGCRAGGADGPGRGGGCQGQGVRRPLIDPRVNRHGRGVPTFPYAASQGLRINIRPKTAKFYPFPYVFLIIILTCFIHPSYCDCDRLR

SEQ ID NO: 41013 - protein, 136 aa, Sorghum bicolor
  unsure (1)..(136): unsure at all Xaa locations
  Clone ID: SORBI-28MAY03-C15044_1.pep
CIPQSYLLTLRDFSVSTTNCHAVLKVLERWKPXENAFGVAGXLKEHAYSRKEKHEIIPDVRLRFVRQHSXLLQNVNAMSSAXSVVMHVLRAMKDMGVLVGKGGFYGNVFRVPPPLCFTKEDSDFFIEVMDIALSKL

SEQ ID NO: 41014 - protein, 121 aa, Sorghum bicolor
  Clone ID: SORBI-28MAY03-C15048_1.pep
ACKRKYGKGEYQIKAAELVTNWQEELKKPSWHPFKMVEVNGENKEILVDDDAKLKHLWIEYGDDVCNAVKTALMEINEYNPSGRYVVPELWNFRKGRKATMKEVLKYLFSQMDTTTKRRRG

SEQ ID NO: 41015 - protein, 126 aa, Sorghum bicolor
  Clone ID: SORBI-28MAY03-C14994_1.pep
EIFGGLLLAAWLLPLQTKKLCGLVVLWKCVTEIPVGAVMLFFFLYFFSQFSPYPLYLGSVSLFRRRGMTILLSQTTRIEQRNISEDGTIWHVFISFAVRLVSYIMYSSLSTFEVEKCKSYMERQYF

SEQ ID NO: 41016 - protein, 104 aa, Sorghum bicolor
  Clone ID: LIB3480-030-P1-K1-H10.pep
EIFGGLLLAAWLLPLQTKKLCGLVVLWKCVTEIPVGAVMLFFFLYFFSQFSPYPLYLGSVSLFRRRGMTILLSQTTRIEQRNISEDGTIWHVFKKKKKRAPLAI

SEQ ID NO: 41017 - protein, 90 aa, Sorghum bicolor
  Clone ID: SORBI-28MAY03-C15165_1.pep
TRQALHTDEEMGMIQMTSAVSQNGDNHLHHANGTDHSCADSQANSKPHSQVGSSQCCDHSKKTDRTPLGLGLGLGRNSASRQYVRSLIPL

SEQ ID NO: 41018 - protein, 195 aa, Sorghum bicolor
  unsure (1)..(195): unsure at all Xaa locations
  Clone ID: SORBI-28MAY03-C16089_1.pep
KFLKKAAALKFEDNEQQKRYEKIXFREIQDEVQELKDLLDTMHAPVVYAHNDLLSGNLMLNDLEGKLYFIDFEYGSYSYRGYDIANHFNEYAGFDCDYNLYPDKDAQYNFFRNYLRPDRPSEAQAQDMEVLYVETNTFRLASHIYWALWALIQAKVSPIDFDYLGYFFLRYGEYKKQREPCFSLAQSFLSKPRNV

SEQ ID NO: 41019 - protein, 57 aa, Sorghum bicolor
  Clone ID: SORBI-28MAY03-C16067_1.pep
PTSTSIQGPHEITLIGRFSQQSLEFKLTAMASVNDGNINFQRSSLSAHTSYASQVNA

SEQ ID NO: 41020 - protein, 37 aa, Sorghum bicolor
  unsure (1)..(37): unsure at all Xaa locations
  Clone ID: LIB3480-053-P1-K1-B9.pep
KVDYIVNLHRLAYSAPSTQKVFLNNPLNSKLXRNGLS

SEQ ID NO: 41021 - protein, 138 aa, Sorghum bicolor
  Clone ID: SORBI-28MAY03-C16132_1.pep
LSNTFGFKIQDKQGRMHRFNCETSSLTDLITSILQRVGDDIDRKHLPQILYEDEDHDKVILSSDSDLIAAVDHARQIGWKSLRLHLDYAGVGRRKRGGGSSDFEYAGKDAWASAYSAVAAGAALVAGLGVMAYLKRSG

SEQ ID NO: 41022 - protein, 275 aa, Sorghum bicolor
  Clone ID: SORBI-28MAY03-C16233_1.pep
TRRKRWMRLPRMPCDECFSCADKESLAVGTQLLVFGREYTGLAIWMYNLLTRSWSPCTPMNLPRCLFASGSSGEIAIVAGGCDKDGQVLRSVELYNSEIGHWETIPDMNLPRRLSSGFFMDGKFYVIGGVSSQRDSLTCGEEYNLETRTWRRILDMYPGGTSASQSPPLVAVVNNQLYAADQSTNVVKKYDKVNNAWNIVKPLPVRADSSNGWGLAFKACGDRLLVIGGHRGPRGEVILLHSWCPEGGEDGADWEVLSVKERAGVFVYNCAIMGC

SEQ ID NO: 41023 - protein, 184 aa, Sorghum bicolor
  Clone ID: SORBI-28MAY03-C16282_1.pep
TREKSNVIFRQLLRTRRPFVAEITDATRNEIFKVRRPFWWINSSIYAEVDGKEIGVVHRRWHLWRRIYDLYLGNRQFAVVENPGFWNWTFSLVNEDDKLLAQIDRNWRGIGFELFTDAGQYAIRFGDEGQSHKFALAADVDELHVVRQLTLPERAVALALAISLDSDYFSRRGGWGLPFLIATE

SEQ ID NO: 41024 - protein, 110 aa, Sorghum bicolor
  Clone ID: SORBI-28MAY03-C15464_1.pep
GVRPSVPFRCNPQACCIPRKDRHGRLWWWCCCCSPRPRRRPRRPLRLRVGCGGQAQRQGDVLVHGAPGAVPECHDQAGGPGRRAGAGAGEVGLRSISSCLHAFTIYNIVL

SEQ ID NO: 41025 - protein, 78 aa, Sorghum bicolor
  Clone ID: SORBI-28MAY03-C15422_1.pep
ILSTSTTTTTTTPVLNKIKVEINRVGTLYALADFMVIEAGTDEWAPIILGRPFLNLGIYRCALLSCFQCQDFGLSLSV

SEQ ID NO: 41026 - protein, 64 aa, Sorghum bicolor
  Clone ID: SORBI-28MAY03-C15496_1.pep
RTRGLKAVMQTDGFDYLQQSCPSLLTELLEYVAKVGDHSVSPCLYSTEVLDGGDANGRRVKPRI

SEQ ID NO: 41027 - protein, 375 aa, Sorghum bicolor
  Clone ID: SORBI-28MAY03-C15510_1.pep
MKIQCNACGAAEARVLCCADEAALCVACDEEVHAANKLAGKHQRAPLLTDADAAGTAAAAPAVPKCDICQEASGYFFCLEDRALLCRDCDVAIHTVNSFVSVHQRFLLTGVQVGLDPADPVPPIAEKHVNAAGGSVNQPVKHLPRRSPTVQFSVEGSASVPSKNVTNGDYSRQNSVPTARAEVVDWTMNNSTIRSVESPPKYMSEESPTLLQSSQTTTAFNQINGNSDGPYHLSFSGGNVTDSLPDWPVEEFFSNSEYGPNFGFSEHGSSKGDNAKLGNAGGSPQCRLAEGSVAEELLGQVPGLITDEYMSRVPENSWTVPEVPSPPTASGLNWHGNLCFPAYDSTMFVPEITSLQTSQNQFAVPSSFKRRRREY

SEQ ID NO: 41028 - protein, 204 aa, Sorghum bicolor
  Clone ID: SORBI-28MAY03-C15546_1.pep
LFTSLNERLLVPLAARLTGRPQGLTSLQRVGTGLALSVAAMAVSALVEKKRRDASNGPGHVAISAFWLVPQFFLVGAGEAFAYVGQLEFFIREAPERMKSMSTGLFLVTLSMGFFLSSFLVFAVDAVTGGAWIRNNLDRGRLDLFYWMLAVLGVANFAVFIVFARRHQYKASNLPAAVAPDGAARKKETDDFVAVAEAVEGMDV

SEQ ID NO: 41029 - protein, 231 aa, Sorghum bicolor
  Clone ID: SORBI-28MAY03-C16525_1.pep
PYWNPPHNPRGASLAAAGAAGLFPPPRIRIRITKSSPLPPPRRLQFGTTKIWTSGSRACLAAASASTPSAPGGGLYSAATYELTPENVDRVLDDVRPYLISDGGNVTVVAVEDGVISLKLEGACGSCPSSTTTMNMGIERVLKEKFGDAFKEIRQVFDEDQPPAETTPEAVNRHLDILRPAIANYGGSVDVLAVDGEDCLVRYDGPESIGSGIKAAIKEKFPDITNVVFTL

SEQ ID NO: 41030 - protein, 257 aa, Sorghum bicolor
  Clone ID: SORBI-28MAY03-C16652_1.pep
MVLSFERAGLQFVGKDELGNGMGVLVPPSHGFWGVQGIHLAAKSARENNVPYLGICLGMQIAVIEFARSVMKLRGANSTEFDPATTSPCVIFMPEGSKTQMGATMRLGSRRTYFHVNGCKSAKLYGNASSVDERHRHRYEVNPDMVPDFERAGLQFVGKDESGKRMGIIELPSHKFFIGAQFHPEFKSRPGKPSPLFLGLIAAASGQLEPLLQRSNLTTKACPISKIPKLKLYPTGPVNPLNSSVNGYYPNGTGIHT

SEQ ID NO: 41031 - protein, 416 aa, Sorghum bicolor
  Clone ID: SORBI-28MAY03-C16725_1.pep
MSASGDPLDALPAAVLADVLGRVADAGDIAACRLASRALLAASYLCPRVRLCAADCARRRCEGGGGFPAFCATTANLASLLGPHLRSLHLTSGEAAPAWAATSTAAVLRELEIADYWPQACWRKAEALPLISHYCQNLVKLGLKNAWLSVEGLKKMPNLTHLTLEFIRLDDEDLNQLNECFPCLHTLNLIGVGGLKDPKIDLLHLKACRWEVSNVPRSLVVRAPDLVFLELKCIRPDTLILDTPSLSTLKLTIDKLGANVRVDGLLRLTNLHIESLDFSSLFLVFIDNRGIRTLELELPEFASQYELLEAVNPDYLLKMLASISEVKLAPRFSCELKLCLALCKGSQFGSCLKKLLIHVPQPGSCSHLLPLFEICAPLCEVTVLFHTESADAVRQGAISICMQNFPDIRWQWGTWQ

SEQ ID NO: 41032 - protein, 232 aa, Sorghum bicolor
  Clone ID: SORBI-28MAY03-C16787_1.pep
MAPAFTSLLPAATSAAAATASRLPSAPAGAASTFARLPHHPTGWAGASVAAPRTAAARRRAPGVAYATAATDKSIYDYTVKDIDGKDVPLKKFKNKVLLIVNVASQCGLTTANYTELSHIYEKYKTQGFEILAFPCNQFGAQEPGSNTQIKQFACTRFKAEFPIFDKVDVNGPNTAPIYKFLKSSAGGFLGDLVKWNFEKFLVDKNGKVIERYPPTTSPFQIEKDIQKLLAA

SEQ ID NO: 41033 - protein, 199 aa, Sorghum bicolor
  unsure (1)..(199): unsure at all Xaa locations
  Clone ID: SORBI-28MAY03-C1682_1.pep
QILDDGRVTDSQGRKVSFTNXIIIMTSNVGSQYILNMDEEVGSSDSAYENIKKRVMDAARSVFRPEFMNRVDEYIVFKPLEREQINSIVKLQLARVQKRIADRKIKLEVSPGAIEFLGSLGYDPNYGARPVKRVIQQYVENELAKGILRGDFKDEDSIFVDTQVTVPSNGQLPQQKLVFRKVGEQSKAAAEDEKFLPAV

SEQ ID NO: 41034 - protein, 228 aa, Sorghum bicolor
  Clone ID: SORBI-28MAY03-C15938_1.pep
ARGIIVRNTLVTYDRHNEKIGFWKTNCSELWERLHISDAPSPAPSSDTNSETDMSPAPAPSSLPEFDVGLITVDMSINVTYPNLKPHLHELAELIAKELEIDSSQVRVMNITSQGNSTLIRWGIFPAESDNAMSNATAMGIIYRLTQHHVQLPENLGSYQLLEWNVQPLPRRSWFQEHVVSILLGILLVVLVTLSALLVVLVWRKKFSGQTAYRPVDSVAPEQELQPL

SEQ ID NO: 41035 - protein, 277 aa, Sorghum bicolor
  Clone ID: SORBI-28MAY03-C15976_1.pep
HEALGELSRALDKKEALLVELRHMNEEVSGNQRDGEIIRDLEHFRKQYAMVLVQLRDSNDQVAAALLSLRQRNTYHGNPGSKSMENGIAFAGASDPYNLFSYINPESDSQVIEVIETSKCRARMMVDVAIQAMCKVSEGENAFAKIGEALDHLNSRGTGSGSSILGIRRIPPDSGQSNASYHDNCTTAPAANSSSKVPNGCDSETQFPKELISSCVATMLMIKNCTEKQYHPAEVAHILDSALSSVQPCSSQNVPIFRDIEMCMGIIKNQMLARVSS

SEQ ID NO: 41036 - protein, 286 aa, Sorghum bicolor
  Clone ID: SORBI-28MAY03-C15963_1.pep
MKDEKKKEGDKDVGEEEKHKKRENKDKDKKDKKHEEKDGSEPKGSSDEKQEKGKDKKKKDKKSEEMEQKEDHLENKNDKAAQKDVHMNKELAGAADSGTREIKLTDTEPQEKEIDSEDSEGKKKNIEKDKDETKKRKKDDGEDDEGEKKDKEKKEKKKDKGDKKGDGKKKEGDGDGDEGKEGKKKDKEKKEKTKDKGAKEKTTDPVKLKAKLEKVDAKLQDLQAKREDILRQLKELEGGGKGKTNGEKPPAQVQEDKGKDSGEVPAQILEQGGESKVKEQNPVAAA

SEQ ID NO: 41037 - protein, 184 aa, Sorghum bicolor
  Clone ID: SORBI-28MAY03-C16009_1.pep
TCLTKVLGLYQITAKNLRDGKELKMDVMVMENLFFKRKVSRIYDLKGSLRSRYNPDTSGNNKALLDLNLLETLHTKPIFLGSKAKRRLERAVWNDTSFLASVDVMDYSLLVGIDEERKELVMGIIDYLRQYTWDKQLETWVKATGFLGGSKDVLPTIISPDQYKKRFRKAMSKYFLALPDQWSP

SEQ ID NO: 41038 - protein, 205 aa, Sorghum bicolor
  Clone ID: SORBI-28MAY03-C16062_1.pep
KTCPRNVAGDAIHDSKNAALKIISAGALFALFAVIGLKCLPRKKSLPALKSEYGSVAVADSVDGLGADEEPLEIPRMDAKLAEDIVRKWQSIKSKALGPEHTVTALQEILDGNMLKVWMDRATEIERHGWFWEYTLSDVTIDSITVSMDGRRATVEATIEEMGQLTDVADPKNNDAYDTKYTARYEMSYSKSGGWRITEGAVLKS

SEQ ID NO: 41039 - protein, 191 aa, Sorghum bicolor
  Clone ID: SORBI-28MAY03-C16981_1.pep
MTGGGTWESTRDRSPVLFSWPVADEAHGKTATEKPWKGRGGSRTSRGGEKIRMGAKKQGGGGGGDQKGLLWRLPKVTSKELGKIGPALGIGIGCGAGAGVGFFGGAGLGYGFPGLTLGFGVGAGCGVGIGFGYGLGKGIAYDENKRYSNVGKMFQEAPHLPTDTVVGLFDELVINTKKFVSATSKGIEKWR

SEQ ID NO: 41040 - protein, 182 aa, Sorghum bicolor
  Clone ID: SORBI-28MAY03-C17122_1.pep
MRKLKFHEQKLLKKTNFLEYKRERGHREALVTQRYGLVERDDYKKYNGICLMVQKLVNIIKQMDPRDPFRIEMTDMLLDKLYNMGVISTKESLIKCEKLSVSAFCRRRLATVMVKLKFAEHLKEAVTYIEQGHVRVGPETVTDPAFLVTRNMEDFITWVDSSKIKRKVMEYNDALDDFDAMF

SEQ ID NO: 41041 - protein, 138 aa, Sorghum bicolor
  unsure (1)..(138): unsure at all Xaa locations
  Clone ID: SORBI-28MAY03-C17113_1.pep
PAGRVVFALSSILPASNIWRRGEREREXESGGGDGERREGTQRDWGVFPAEGRVEEAPDGGESAAPRHTGARHRYRRLRDLPRRRGRLQPPLPPLRRPPLDRRPGSVTPRSSSWSQLYQALVLIFLQFELIRSAMTML

SEQ ID NO: 41042 - protein, 218 aa, Sorghum bicolor
  Clone ID: SORBI-28MAY03-C17237_1.pep
MPVRVVDTATPSSQPSPGQETNTGHPSPPSCSLLSAGRSFAGTQNVSSLQKDEAWKVNVRIHGCDLEQGYLCGTMEALNVPLADTPVVTFWEGEIVDAKNYTLFTGKWEASPEDDIRHWSKFPSFTPLLSQIETDGGKSLDFSNYPYIFMRWKEQYFVNVGADCGLTIAGFYYVCFSCSDGSISGFYYDPNSSPFQKLELKCTNEKNSGFTFSSYELQ

SEQ ID NO: 41043 - protein, 199 aa, Sorghum bicolor
  Clone ID: SORBI-28MAY03-C17246_1.pep
MGKVRSFFSRSRSGGSKRGAAGAPGASSPFSSAPPSPLPRRSPSAARAADETEGRAGKFDANGDGQISRCELAALFASVGHAATDDEVSRMMEEADADGGGCISLTEFAALMDAASADAAAVEEDLRHAFMVFDADGNGLITPAELARVMRGLGESATVAQCRRMIQGVDRNGDGLVSFDEFKLMMAAGGGGFGRIGAA

SEQ ID NO: 41044 - protein, 127 aa, Sorghum bicolor
  Clone ID: SORBI-28MAY03-C17273_1.pep
SAGCGVPHRSRAPCQPYPQPPLVLVLGWVGGAVLVVDVASVNPPFLGKHVEQEATEELELGSRHKEVRSRGRQQGEARQVTYTLLANGYTGCWRVEGGRDGGARDRVEGETERGGCCETTGERRARD

SEQ ID NO: 41045 - protein, 181 aa, Sorghum bicolor
  Clone ID: SORBI-28MAY03-C16311_1.pep
VLPTREIRLFPSVAQVHLDLLLSSSLPLVMLPVVNLLPWGPFSRPGGDLFRELESAMHLVLVRAPFALLEGCRGDTYFVRRCKGCFDDMNLERLRLTMAMKTPEDQMFNFDPKTVDWNDYFTKIHIPGVLKHLARLHLVSQFTLVLSHRNEIAQSVRSLDKRVSVIMKEINHTISQLYIVS

SEQ ID NO: 41046 - protein, 445 aa, Sorghum bicolor
  Clone ID: SORBI-28MAY03-C16361_1.pep
ARGSKAEWEMVLNNDSWFVSPVLPEVPQAVYVSYVDLPSHLKECFLHCSLYPEEYPIQRFDLVRRWIAEGIVNPRDNELLEESAEEYYVELISRNLLQPDPESVERCWITHHLLRSLARLLIADESILIYGQQKLNTSLSKPRHLTLCNMESSLDIPISLKQQMSLRSLALFKSPTVRAIDLLTESASCLRVLDLSNTAVEALPKSIGNLVHLRYLNLDGTQVRDIPSSIGFLINLQTLSLQGCQSLQRLPWSIRALLELRCLCLEGTSLSYVPKGVGELKHLNHLDGLIIGHDNNVPEGCDLDDLKALSELRHLHVESLDRATSGAAALANKPFLKDLYLSEQAPVIENQESPEDKDETEKEEEEEQEGSNDQCRGDESAKASEKIWNELTPPHSIEKLVIKNYKGIKFPNWIRGPKLGASFPSLVFLDLENCMSCTKLPSLGL

SEQ ID NO: 41047 - protein, 251 aa, Sorghum bicolor
  Clone ID: SORBI-28MAY03-C16433_1.pep
RGDSVGPPNSPYRSHSAILADDIVSPSAGREHISLDVPRGRYKMTSLPVPGLGSSRGSQLLGGSYNGNHDMISTNTLQNMAGIPPGPAWLESDAAANAYLESKDEVHDFASLRHAVLEQDRQAFLMGNNPLTKDLTLKELYSIQTRMVQEKARESTYRQRFQMPELQGLIQEQNPPIDLCGLHVSEAIHVLNYELNNRRKIVRSTGRRLQAVIISSARTPARLTAAVEQYLMEHGLQYTQAQPGLFRVLLY

SEQ ID NO: 41048 - protein, 307 aa, Sorghum bicolor
  Clone ID: SORBI-28MAY03-C16478_1.pep
KPLIWWREPPLPPRSRAVAVSSVSASSGDATQTKREMFNNLAPLMWHSLGSIIILIQEILSVYPALSPPTLTACASSRVCNAVALLQSVASHPETRTPFLKAYIPIYLYPLLNTVSSARSFESLRLTCLGVIGALVKADDTEAIGFLLQSEIIPLCLRIMETGEEPSKTVATYIVERIVLDEAGLQYICFNMGRFFALASVLQTMVISLAEQPSARLLKHIICCYHRLTDHPRALEALRIRLPEALKNGTFVHCLKDDPVARNYLRQLLSTLAAPRVEAPQPPGPTEGGAPHAGPGSSQAGPSRVRR

SEQ ID NO: 41049 - protein, 91 aa, Sorghum bicolor
  Clone ID: SORBI-28MAY03-C16593_1.pep
FELLTSLQSLIFEDYRALQALPSLQELHINISLQLKISYGCSYLYYDECQNSTRTRPLSIQVPSCLTRSPGILLFLIIAHSNIIWLTISLL

SEQ ID NO: 41050 - protein, 143 aa, Sorghum bicolor
  Clone ID: SORBI-28MAY03-C17522_1.pep
MTIRFVLFVNKQGQTRLAQYYEHLSLDERRALEGEIVRKCLARTDQQCSFVEHRNYKVVYRRYASLFFLVGVDNDENELAILEFIHLLVETMDRHFGNVCELDIMFHLEKVHFMLEEMVMNGCIVETSKQNILAPIQLMEKTS

SEQ ID NO: 41051 - protein, 227 aa, Sorghum bicolor
  Clone ID: SORBI-28MAY03-C17599_1.pep
IGYDGCPNMVGYPTYLPQNYATYLSSGTFQQAYPSNGPFHQSAAALLGSGMKYSTPEYKNNLSATGLQQQHQPQPQPPSSVISGYGGFGSSGNIQGNFTLNQSTGSASTLGFDEALSRQYKDTSQYMALQQGDNSGMWLHGSGSRATSTLPPNHFYGYQGQSQLGGFRQAQQPQPSQFGGHGYPTFYQSQGGLTQEHPQNLAEGSLNGFQVAPSQPSHPNWQHQHTY

SEQ ID NO: 41052 - protein, 276 aa, Sorghum bicolor
  unsure (1)..(276): unsure at all Xaa locations
  Clone ID: SORBI-28MAY03-C17643_1.pep
MDCCFPCLRGAKKKEKQPPEKPQIRPASVVDAEKPKQRPSSSVTKQDSFDFNMESANKGIVLSNGSGHNQIAAQTFSFRDLAAATSNFRADCLLGEGGFGRVYRGYLDSVSQVVAIKQLDRNGLQGNREFLVEVLMLSLLHHPNLVSLIGYCADGDQRLLVYEYMPLGSLEDHLHDPSPDKARLDWNTRMKIAAGAAKGLEYLHDASPPVIYRDLKCSNILLGERYHPKLSDFGLAKLGPIGDKTHVSTRVMGTYGYCAPEYAMTGQXTPKSDIYS

SEQ ID NO: 41053 - protein, 151 aa, Sorghum bicolor
  Clone ID: SORBI-28MAY03-C17571_1.pep
FLRLKCLAGPESSSSTIYRENHCGGSPKSRPRFLALVARGCPLRLNLASGGNAAYCISSSPTPSWPLPSPPPGGLSAPSPADPVRRIRPGWHSCKDGSEWIFTNRRVDEAHQFTMHVNFGKSKLERSHHSRDSRRIWRDSATSVICSWHQE

SEQ ID NO: 41054 - protein, 118 aa, Sorghum bicolor
  Clone ID: LIB5052-001-A1-XP1-H1.pep
CAALRRRVRPHPRKSPVVVRSSPPSVGTFRRRWLNPSHERPPFPTPWTAAAAAVKIASLASRCTRTVAPSLVLTAVDSIKRADDLNDRPNIFICSYWLATSIPIGCTLLDLSRRACSL

SEQ ID NO: 41055 - protein, 180 aa, Sorghum bicolor
  unsure (1)..(180): unsure at all Xaa locations
  Clone ID: SORBI-28MAY03-C17713_1.pep
MGVYLSTPKTDKLSADGENSRVRFGLSSMQGWRTTMEDAHAAFPDLDDCTSFFGVYDGHGGKGVSKFCARHLHKQVLINDANSSGDLPASVHKAFLRMDEMMKGQRGWRELTELGDKGNKISGMLEGIIWPPKGGDSDKIEEDWDNEEGPNSNFPGPTSGSTACVAVIRXDQLIVANAGD

SEQ ID NO: 41056 - protein, 220 aa, Sorghum bicolor
  Clone ID: SORBI-28MAY03-C17910_1.pep
MAGGGDHNSAQTNGGGHDQRAMEEGRKEAEYADHQGCAAMVVSVPFIQKIIAEIFGTYFLMFAGCGAVTINASKNGQITFPGVAIVWGLAVMVMVYAVGHISGAHFNPAVTFAFATSGRFPWRQLPAYVLAQMLGAVLASGTLRLMFGGRHEHFPGTLPTGSDVQSLVIEIITTFYLMFVISGVATDNRAIGELAGLAVGATILLNVLIAGPVSGASMNP

SEQ ID NO: 41057 - protein, 149 aa, Sorghum bicolor
  Clone ID: SORBI-28MAY03-C16870_1.pep
MAKPQLLLCFLVAAAATLLVATAKKSGDVTELQIGVKYKPESCSIQAHKGDKVKVHYRGKLTDGTVFDSSYERGDPIEFDLGTGQVIKGWDQGLLGMCVGEKRKLKIPSKLGYGPQGSPPTIPGGATLIFDTELVAVNGEPANQSDNEL

SEQ ID NO: 41058 - protein, 136 aa, Sorghum bicolor
  Clone ID: SORBI-28MAY03-C1693_1.pep
RVSVVCRVEAPIIAATSLLTEAWISDQVVTKRLPGPTKTPQSSGAAPLVQTHSAEKREKRVSVERCVELTIIAATHGLKEAWISYQPVLTVMYLVQYMPTVGYWLMDKVGAKRLDAAAKKGNTYSWNLIFGSKKSA

SEQ ID NO: 41059 - protein, 171 aa, Sorghum bicolor
  Clone ID: SORBI-28MAY03-C16873_1.pep
GAFFFFFFQEQSKDLSHYQANCQETPLVLVSSKCVRITSRERRQIETRATRPPGKISVLSPPSAPRKKKPKRWKKEERDPRTRTGLGGAGGGGKDPRPDEVGEEAGEGEQEGVVHRDEQRRGSVAPVLGRLLPGSGAELIGLVHLAFPPPFSGSGDVVRRCGAGWVKRPLA

SEQ ID NO: 41060 - protein, 102 aa, Sorghum bicolor
  Clone ID: SORBI-28MAY03-C16965_1.pep
DAEAILGDIRGECRDPIQYTLMKDPVTLPSSKVTVDRPVIIRHLLSDSTDPFNRSHLTQDMLIPNTELKLQIEEFVRSQQSRKRSAAVSEIGEADGADDMAE

SEQ ID NO: 41061 - protein, 211 aa, Sorghum bicolor
  Clone ID: SORBI-28MAY03-C16968_1.pep
MGGRKTGEHEHEALIDGIQADDSPAVADDDVCPANFAVIVASLPSGFWCSTVFFLHLPRGFCVLSGVLLRLQTPHALFLERRPADILLASFPKSGTTWLKALAFATARRSVHSPLNGAAGHPLLSSSSHNCVALLDILGLLESNDDDGNDDTMAPPPRLLSTHLPYSLLPRRATADGGGGNSSGCWYVSIRREPAAVLRSERPTAAAAGAT

SEQ ID NO: 41062 - protein, 122 aa, Sorghum bicolor
  Clone ID: SORBI-28MAY03-C18233_1.pep
MDGSSLKSAQLLELMRQHLATDAGKELTKKVGLVYQLNIAPKKIGVDEEIFVVDLKKGEVTKGPYQGKPDATFSFTDNDFIGIATGKTNPQIAFIRGAIKIKGSINAAQKFTPDIFPKPAKL

SEQ ID NO: 41063 - protein, 99 aa, Sorghum bicolor
  Clone ID: SORBI-28MAY03-C18248_1.pep
MAWRASLSRSVKEIRVLFCQSSPASAAAREFVKKNYGDIKARNPALPFLVRECSGVQPQLWARYDMGVERCVNLDGLTEAQIDKKLEELAKAGESLKTK

SEQ ID NO: 41064 - protein, 184 aa, Sorghum bicolor
  Clone ID: SORBI-28MAY03-C18262_1.pep
MAPRPQPWGHQVLTLLLLVVAAATAAAVVVRADDEKCSNPCGNPCGEPCVYASPPPPALPPPVYYPPPAPVYSPPPPEYYPPPTPTTPTPTTPYCPPPPSGGGGGYEPSPGYTPATPYTPGGYNPTTPSCGGGGCFSPPYTPGMLYPQDPGFRPNAAPARAEAWRAVLLVSAAATAAACACFGL

SEQ ID NO: 41065 - protein, 250 aa, Sorghum bicolor
  Clone ID: SORBI-28MAY03-C1834_1.pep
ARGSGEGAERPQDEKDRQEGSEDEDQQRGGGGGSLFLMEKILRPVTGDLEVLFYGNGRRTSHCKLLPPPPYIHEPSKIGSYAVVGNGAHVCISVNGRGTYFLDTAGHTWNKAGDWTLPFHGKVEYVPELELWFGLSANAQQLIAADLSTTDSQPQPVYSWKLFQPLEEWIEHKDAQLVNLGSGRFCIARFFKHDFDFVEQDDSPRDCIVLTGLEVVPRVLNGKVKLEMFHHKSMRHTTLPIYGNSVDLVF

SEQ ID NO: 41066 - protein, 99 aa, Sorghum bicolor
  Clone ID: SORBI-28MAY03-C18417_1.pep
MASGGPALEPLVDQVISVITNDGRNIVGTLRGFDQATNIILDESHERVYSRKEGVQQLVLGLYIIRGDNISVVGEVDEDLDSRLDMSKLRAHPLKPVIH

SEQ ID NO: 41067 - protein, 97 aa, Sorghum bicolor
  Clone ID: SORBI-28MAY03-C28740_1.pep
KKGHEACPFFYALGFHSLGFGALVSRAPLPRSYCCCSCPPFAPSSAFLSFDLRSVSWAYREYSYLFNKSYVRIVLLCLSSTPALVVPSSFKPATLRP

SEQ ID NO: 41068 - protein, 150 aa, Sorghum bicolor
  unsure (1)..(150): unsure at all Xaa locations
  Clone ID: SORBI-28MAY03-C28772_1.pep
MHACKRLNQTPPPMPPPPPAPPPXPPPPPEPRPPPAPAPPPXPPPAPPPXPPPAPPPAPPPXPPPEPPPAPAPPPYPPPVPPPAPPPXPPPAPAPPPXPPPAPPPAPAPPPYPPPVPPPAPAPPPXPPPAPAPPPPPRTPPPPEPPPRPP

SEQ ID NO: 41069 - protein, 161 aa, Sorghum bicolor
  unsure (1)..(161): unsure at all Xaa locations
  Clone ID: SORBI-28MAY03-C28801_1.pep
LGPHGSKGVRRERGRKRKRRHRDTEDASSEREATGGSRESRRQGRVRQGARKRALGALXLDTHGSKDKKRDKEKKHKRRHHDTDDVSSERDDKDDSKKSRRHSSDRKKSRKHAHGSDSDSENRHKRHKKDRDSSRRNGGHELEDGELGEDGEVIDSFRWPP

SEQ ID NO: 41070 - protein, 199 aa, Sorghum bicolor
  Clone ID: SORBI-28MAY03-C2897_1.pep
VRDLGINKLEVSKGAVEPHEAWSKNVLERLTSDAQRLLSIQASIEELKHKMEGPSKGKSPMNSEYSSVSTQLHETEGFVLEQINFNNKLTRKAENYPALSDNMNTEREGYSSRRKISEQVQKGSENVARLELELQKIQYVLLKLEEEHEYRRLKVSDKRTRVLLRDYLYGRKDRGGGQKKKKKRVPFCGCVRPKSRTEP

SEQ ID NO: 41071 - protein, 80 aa, Sorghum bicolor
  Clone ID: SORBI-28MAY03-C28921_1.pep
MWAEQWPFSCRGACRMRPGRCLKVRLRCGLSNELNDVDEPSRCEYVAVLSTPAVCVEDKLKELQNKLDAMSSKQPGHDEL

SEQ ID NO: 41072 - protein, 345 aa, Sorghum bicolor
  Clone ID: SORBI-28MAY03-C18996_1.pep
AGLGDNCHLNGGEKANGARDTRIGKVRIRLSTLETDRVYTHSYPLIVLTPGGVKKMGEVQLAVRFTCSSLLNMMHLYSQPLLPKMHYVHPLSVIQVDNLRRQATNIVSTRLGRAEPPLRKEIVEYMLDVDSHMWSMRKSKANFFRIMGVLSPLIAVAKWFDQICLWRNPLTTILIHVLFVILVLYPELILPTIFLYLFLIGVWYYRWRPRQPPHMDTRLSHAETAHPDELDEEFDTFPTSRPPDIVRMRYDRLRSVAGRIQTVVGDLATQGERLQSLLSWRDPRATALFVVFCFIAAIVLYVTPFRVVVFLAGLYVLRHPRFRHRMPSVPLNFFRRLPARTDSML

SEQ ID NO: 41073 - protein, 150 aa, Sorghum bicolor
  Clone ID: SORBI-28MAY03-C19100_1.pep
ATPKCPLEHTHSLFFNPPLPPLSLSLSPAFLGLHGSAARRANHNGGGAIQAAVDEDQACQAPDEPRHDRGGRQGGSHGVTVTKGAAAASAQCELRRRGGHRRHPYALRRQAGLPRPHGEDRVPQDQSLSLVGERDEGEGIMELESLALLF

SEQ ID NO: 41074 - protein, 69 aa, Sorghum bicolor
  Clone ID: SORBI-28MAY03-C19151_1.pep
MSDPKYAYPYPAQGYYQGPYQGPPVMAPPQYAAPPPRREPSFLEGCLAALCCCCLIDECCCDPSIIFVS

SEQ ID NO: 41075 - protein, 163 aa, Sorghum bicolor
  Clone ID: SORBI-28MAY03-C1903_1.pep
MSTLPGGFLSVRVLRGINLVSCDAKGSDPYVVISLDGQKLKTSVMKKTVNPVWNEDLTLAVMDASAPIKLEVFDKDTFSKDDMMGDAEFDIEALVQMIQMDLEDIRSGTVVRTVRPGGKDSCLADESHIIWDNGQVVQDILLKLRNVHTGVVHLQLKWVTIPD

SEQ ID NO: 41076 - protein, 163 aa, Sorghum bicolor; identical to SEQ ID NO: 41075
  Clone ID: LIB3480-046-P1-K1-G7.pep

SEQ ID NO: 41077 - protein, 93 aa, Sorghum bicolor
  Clone ID: SORBI-28MAY03-C1917_1.pep
MDHWTAIQELLRHFWSSYPITSAVLYNKVQRVKEAMTQIYQKLQLIKESAQPDVRHEISRLVKPMTQALDAAFNHDLEQQQKSSKTGNRHNGF

SEQ ID NO: 41078 - protein, 439 aa, Sorghum bicolor
  Clone ID: SORBI-28MAY03-C1946_1.pep
SESIREGERVLVTAPSNAAVDKMVESLSRTGLNIVRVGNPVRLSPFVASKSLGEIVNCRLRQFRKELERKRTDLRKDLRQCIEDDSLAAGIRQLLKQLGKDLENKEKETIREVLSDAQVVLSTNTGAADPLVRRTGSFDLVIIDEAGQAIEPACWIPILQGKRCILAGDHCQLAPVVLSRKALDGGLGKSLLETASSLHDGLLTTRLTVQYRMHDSIAMWASKEMYHGLLKSSDLVASHLLADSPVVKATWITRCPLLLLDTRMPNGALNIGCKEHLDPAGTGSFYNEGEADIVTQQVLNLVHCGVSPRPFVVPSPYIAQVQLLREKLQEYPGLCPVEVSTIDSFQGREADAVIISMVRSNPLGAVGFLGDSRRINVAITRARKHVTVVCDTSTICHSTFLARLLRHIRRYGQVKHVAPGSLDGASGLGFSQPTLPSIS

SEQ ID NO: 41079 - protein, 148 aa, Sorghum bicolor
  Clone ID: SORBI-28MAY03-C17924_1.pep
MVSGHLLLSAGVLLSVLAACAATVDVTACAPGLAIPAPPVPTCRIYTVSRTCGLGGPYGPVDPSPVLKQRCCRELAAVPSRCRCAALGFMMDGVDAPLQDFRGCTREMQRTFARRLTRAAECNLPTIDGGMCHSLNSPRPVLESVSTY

SEQ ID NO: 41080 - protein, 139 aa, Sorghum bicolor
  Clone ID: SORBI-28MAY03-C1795_1.pep
MSNSASGMAVCDECKLKFLELKAKRSFRFIVFKINENVQQVVVDRLGEPGESYDAFTACLPADECRYAVFDFDFVTDENCQKSKIFFISWAPDTSRVRSKMLYASSKDRFKRELDGIQVELQATDPSEMSMDIVKSRAL

SEQ ID NO: 41081 - protein, 273 aa, Sorghum bicolor
  Clone ID: SORBI-28MAY03-C17926_1.pep
AGRAGPEDEFSVLSRRSARDGAVPQNNLPSATRNERPYPSPLLPPPPASKRPVYTEASSIDYLSGDSYKSEKVPDDFINPTAPSNISTSSHSKPEVYPPPSYGSRPDSVSDDFINPTAPSFSAPSRPTNEEPTHSSVKRQESLPDDDFINPTALPGFSSSSASKESSEDLPKAPWESQAAAAGSLPPPPARYGQRQQYFEQNVYSGGSNGGGYDGLMTQTENLSLNPRSSESASRPTASRQAKPEDSLFKDLVDFAKTKPSSPSKPANSRRTR

SEQ ID NO: 41082 - protein, 140 aa, Sorghum bicolor
  Clone ID: SORBI-28MAY03-C179_1.pep
RQIFTPHGEISYVKIPVGKHCGFVQFTSRSCAEEAIQMLNGSQIGGQKVRLSWGRTQNRQASQQDANSQYNGNSYYGYRQQGYEGYGYAAPNTQDPSMQNYYGYPGYGNYEQQQQQQSTQEQQQQPPPAQEQQQQQPPQQ

SEQ ID NO: 41083 - protein, 151 aa, Sorghum bicolor
  unsure (1)..(151): unsure at all Xaa locations
  Clone ID: LIB3481-049-Q6-K1-G9.pep
FRSSAFRGRTQNXQASQQDANSQYNGNSYYGYRQQGYEGYGYAAPNTQDPSMQNYYGYPGYGNYEQQQQQQSTQEQQQQPPPAQEQQQQQPPQQVGHRQSLLFKSYYPFIVGIRKSTVKNITILNQPTAGLLVIQCYVTSLLCWDVDKADE

SEQ ID NO: 41084 - protein, 91 aa, Sorghum bicolor
  Clone ID: SORBI-28MAY03-C18109_1.pep
MSAQSAVASAVERLQAAAQDAAKSSSRSAGAFSEQAQQALVPRAAGRVVSLSTCTKVSAISFAVGIVVGFTLKKRLRRWAARLLKRIKDDD

SEQ ID NO: 41085 - protein, 73 aa, Sorghum bicolor
  Clone ID: SORBI-28MAY03-C1970_1.pep
PPLMHTCSAIVNLGQMHHSESAPFLPIASTSCTCTNKNCTTTMQHSLLGVMLCPRSFLFFQPSSFPSQCIMIY

SEQ ID NO: 41086 - protein, 137 aa, Sorghum bicolor
  Clone ID: SORBI-28MAY03-C1972_1.pep
ENVITKSVEKVKETTTTVLQGTQLLAIDTGAAMGLLKRALIGDELTQKEKQALQRTLTDLASVVPIGILMLLPLTAVGHAAILAFIQRYVPSMIPSTYAPDRLDLLRQLEKVKEMEVAEGSSEDILEAVGSRTEQVK

SEQ ID NO: 41087 - protein, 153 aa, Sorghum bicolor
  Clone ID: SORBI-28MAY03-C19677_2.pep
MSSSEQTFIAIKPDGVQRGLVGPIISRFENRGFKLVAIKLVTASKEHLETHYADLAGKPFFPGLVAYMGSGPICAMVWEGRDAVKTGRVILGATNPLASQPGTIRGDFAIDVGRNVCHGSDAVESAQKEIALWFKPEELQSWKQASHDWVYEK

SEQ ID NO: 41088 - protein, 152 aa, Sorghum bicolor
  Clone ID: SORBI-28MAY03-C19677_1.pep
MTTEQTFIAVKPDGVQRGLIGPIITRFENRGFKLAGIKMVTPSKEHLEKHYADLSDKPFFPGLIAYMGSGPVCAMVWEGRDAVKTGRSILGATNPLASAPGTIRGDYALDVGRNVCHGSDSVENGKKEIALWFKDGEVQSWKSAQHDWVYEK

SEQ ID NO: 41089 - protein, 104 aa, Sorghum bicolor
  Clone ID: SORBI-28MAY03-C19762_1.pep
HEDRLRDKFPAVSFTGGLTLSEAGFDLLNRLLTYDPEKRISADDALDHDWFREVPLPKTKEFMPTFPALNEQDRRVKKYMKSPDPLVEQQMKEQGSIGDRGLFG

SEQ ID NO: 41090 - protein, 389 aa, Sorghum bicolor
  Clone ID: SORBI-28MAY03-C19867_1.pep
MSKIGKKTESNKKRRKERNNVGVDLRRNAPAGEGKNGKGIKERKMCEDENDDGEREKENMAKRKDKGRRVSFTDDVEVFNIGGSDDVEGDGSGEIELVHGRRFTSEEDAKLMEAMVKYAEMRQLGEKGLEMIGDCKKYPELKGCWPEAPGSLPHRPTDAVYKRARILLQRSAERKWTEEEREIVRRFVEENGRNWRVLAKELGKNEIHVKDLWRRMKPKNLRRGHWTQDEYQNLFDLVNLDLRMKAHQYFDPGHRQIRDNISWEAISDKLTTRNNHECCQKWYLQLASPLVKEGIWADKDDYLLVEALQNVDAVCVEEVDWENLVEHRSGELCRQRWNQMVRLLGGHRDKPFIEQVEVLARRYCPEMLPYRESKAGDLSAGELAGGSDL

SEQ ID NO: 41091 - protein, 143 aa, Sorghum bicolor
  Clone ID: SORBI-28MAY03-C18498_1.pep
TAPSPCVPGRTYLESYIQMKIYGHFLKSIAAVSQVPPRLRRAVAGDEQPTGKGRRRRKRRMGEFDDYWARAYRGDAAVPHSDPQRLISTWTGAFALGATACVCHHASALASHLKSLPATWQDMTLVLDQKRWKKALEKKERQA

SEQ ID NO: 41092 - protein, 181 aa, Sorghum bicolor
  Clone ID: SORBI-28MAY03-C18644_1.pep
MRPATSVSRPTSTSTTSPAAIPAAAAAAAAALPASPWHSPVPYLFGGLAAMLGLITLALLILACSYWKLNNYLGTGDATASASSGPGRPGATDGDGSKSPAASPATFADLVAVVMAGEKMPTFLAAPIVRRAHSNGATAIVTGEGSSPETEEEQESRGKAGEGESGVVADAERERQLADQV

SEQ ID NO: 41093 - protein, 107 aa, Sorghum bicolor
  Clone ID: SORBI-28MAY03-C1847_1.pep
MEKKPTILMNRYELGRMLGQGTFAKVYHGRNLASSQSVAIKVIDKEKVLRVGMIDQIKREISVMRLVRHPNVVQLHEVMASKSKIYFAMEYVRGGELFARVARGRLK

SEQ ID NO: 41094 - protein, 245 aa, Sorghum bicolor
  Clone ID: SORBI-28MAY03-C18870_1.pep
MATTAPILPLILLLLLLLSTSSAVLTTTLAADSNGTTHLSLFMHDITSGSNPTAVKVIKGPGTTLTAPTLGMTFGDTMVIDDPVTATSSPTSAELGRMQGIYMLASQSGAALMVCANLLLTSGAHNGSTLALMGRDDTGEDVREIPVVGGTGTFRMATGYVLWKTPEGINGTDATVQLDVYVTTDGNAVDALAPASGGGDSSSGGGGSPGSGGSSKSSSGSAATARTMTAGWVVAAVVGSSWVWW

SEQ ID NO: 41095 - protein, 280 aa, Sorghum bicolor
  Clone ID: SORBI-28MAY03-C1897_1.pep
RHLELGEPSSGKGGHGKSKRSAAADEVVQANTIVQSLNAFSSVAHISGMGLKVMPMIAPFSTLRAVNLSSNFIVHISPGSLPKGLHSLDLSRNKIANVEGLRELTKLRVLNLSYNRISRIGHGLSNCTAIRELYLAGNKISDVEGLHRLLKLAVLDLSFNKITTAKALGQLVANYHSLLALNLVGNPVQANVGDDALRRAVTGLLPSLAYLNKQPVKPQRSAREVATDSIARAALGGSCSRSSRKKTSRRLTQSPRSSSLTRGRGGGGASPTPRNPSRRR

SEQ ID NO: 41096 - protein, 125 aa, Sorghum bicolor
  Clone ID: SORBI-28MAY03-C20402_1.pep
KCPTFAFTEYTSILCLHTKPPIAGQIHMAGTGLSRANSRCDREGSSPAERRCADWFVSGTTDASPAARVWPEEAVAADLDLRKVGARDVGVVAAGVVGDAPARARRRLHGGAAVDFRFLHFRFRP

SEQ ID NO: 41097 - protein, 237 aa, Sorghum bicolor
  unsure (1)..(237): unsure at all Xaa locations
  Clone ID: SORBI-28MAY03-C20428_1.pep
MDRVQLVLLGLPILLFCSDVVTLFAPLPPAAPEPDKAAHAFHPGDPSAAADASALVEPQVDGPGSGTTVDLKFCASCSYRGTAMTMKRMLETSFPGIHVVLENYPPPFPKRALSKAVPLLQFGAMATLMAGDQIFPRFGMVPPPWYYSLRANRFGTMASIWLFGNFAHSFLQSFGAFEVYCNGQLVFSKLSEQRFPSDXELQELIGSRIPDPPILENLEKDLVLDDADADADDAMRD

SEQ ID NO: 41098 - protein, 65 aa, Sorghum bicolor
  Clone ID: SORBI-28MAY03-C2044_1.pep
MEVRPMVALRAALVGGVAAFAKIGGAMKAAGGVKIGAAAAAVTAAASAAVSGKDAKEDASKAETK

SEQ ID NO: 41099 - protein, 112 aa, Sorghum bicolor
  Clone ID: SORBI-28MAY03-C2049_1.pep
MKFVAAYLLAVLAGNNDPSVEDLKTILESVGAEIDTEKMEHLLSQVSGKDITELIAAGREKFASVPCGGGGVAVAAAAPAAAGGAAPAAEKKEEKVEEKEESDDDMGFSLFD

SEQ ID NO: 41100 - protein, 230 aa, Sorghum bicolor
  unsure (1)..(230): unsure at all Xaa locations
  Clone ID: SORBI-28MAY03-C2050_1.pep
MEDVDVSRQLKQMTDFIQKEAVEKAXRSRAAAAEEFQIEKLQLVEAEKKKIRQEYDRKEKQVGIKKKIDYSMQLNASRIKVLQAQDDLVTDMLESARKDLLCISRDHQTYKKLLKILIVQSLLRLKEPAVLLRCRKEDLELVDSVLESASNEYADKANVYPPEIVVDRHIFLPSAPSHYQAPGPSCSGGVVLASRDGKIVCENTLDARLQVVFRKKLPEIRQSLFVQVAA

SEQ ID NO: 41101 - protein, 172 aa, Sorghum bicolor
  Clone ID: SORBI-28MAY03-C20621_1.pep
QEHTNLVILKMDSQDANGYSCKALEATSRPLMTLPPTTAASDILIHNTKFFVLLKSLSIILSRYWTFLTPAIVNDFPRPPARRTRDLRQSMLRSSPLQRPRGSAHRSRAATGSCKPPRRASPEFGPKDPHRADGPKDRKLSIPTHDSAIFMLTPQPQITIRSRSQEAEGPPW

SEQ ID NO: 41102 - protein, 131 aa, Sorghum bicolor
  Clone ID: SORBI-28MAY03-C1929_1.pep
SGAAVAEDAFVVEEFDEAFASGPKTRDFVAALQRWGLDPKQKAMFFATEFDDNVRLSGRNIGSLKMLTPRTLNLYDILDARKLFFTPAAVDYLNSRYGASASDDYYTDDEDDGEEELVEQEAEEGTTAEAA

SEQ ID NO: 41103 - protein, 73 aa, Sorghum bicolor
  unsure (1)..(73): unsure at all Xaa locations
  Clone ID: LIB3481-013-P1-K1-A12.pep
IYDILQTSQNLVLCDSQMQLKRARQTTVPRWEVVDLCFLFAMXTLGESVLEFFLTAFAAYYSXYVSTKRCYKS

SEQ ID NO: 41104 - protein, 108 aa, Sorghum bicolor
  Clone ID: SORBI-28MAY03-C19461_1.pep
KQGVPSLNKPSIRGDHLFTVKVAIPKRISGRERELLEELASLSNGGFARTDAKPKPAQPKRVHQEKEVGASQEDTDKSKEAEGDWLKKLTDFAGSIVNGAAKWLNDNL

SEQ ID NO: 41105 - protein, 216 aa, Sorghum bicolor
  Clone ID: SORBI-28MAY03-C19418_1.pep
GSSEVAGPMVMRPQHGVEFSMKELNSTSWNVGETPNILVPIANGTEEMEATMIIDILRRAKANVVVASLEDKLEIVASRKVKMIADVLLDNVLKEQYDLILLPGGLGGAEAYAKSDKLMDLIKKQAEANRLYGAICASPAIAFEPHGLLKGKKATSYPAMWNKLADQSECVNRVVVDGNLITSQGPGTSMEFSLAIVEKLFGRERALELAKTMVFV

SEQ ID NO: 41106 - protein, 181 aa, Sorghum bicolor
  Clone ID: SORBI-28MAY03-C19612_1.pep
RPRGSSGPEVSLPATGETGGRVLRSSPATGSSPLPGGIMIVCVAVVGHQNNPLYLQSFTEADDALKLHHIVHCSLDVIDERVNNPKRSAPTLNETFLGLLYPTENYKVYGYLTNTKVKFIMVTTDLDVKDADARNFFRKFHAAYVDAVSNPFHVPGKKIASRSFGARVSTIVKSFGSGITS

SEQ ID NO: 41107 - protein, 77 aa, Sorghum bicolor
  Clone ID: SORBI-28MAY03-C1962_1.pep
NFIYVTWCPYHTIQNDSKFGGVSGMTCCRIGPHTISLLCLTTTVCYSRLLYTYIRMLYTHTAKTTCHPFILMRGEKG

SEQ ID NO: 41108 - protein, 164 aa, Sorghum bicolor
  Clone ID: SORBI-28MAY03-C2143_1.pep
MWGSTDGGTPEVTLETSMGAVTVEMYYKHAPKTCRNFVELARRGYYDNVIFHRIIKDFIVQGGDPTGTGRGGESIYGAKFEDEIKSELKHTGAGILSMANAGPNTNGSQFFITLAPCQSLDGKHTIFGRVCRGMEIVKRLGSVQTDKNDRPIHEVKILRAIVKD

SEQ ID NO: 41109 - protein, 116 aa, Sorghum bicolor
  Clone ID: SORBI-28MAY03-C21610_1.pep
MAKVAPPLLAAGSCTAITAQPSSRKGAAGLFASHIVSKRARIIAKLGGDGELKPPGKKKFITREEEPGQYWQTAGEREGENPMMTPLPYIIIFGMSTPFVILAIAFANGWIKVPVR

SEQ ID NO: 41110 - protein, 135 aa, Sorghum bicolor
  unsure (1)..(135): unsure at all Xaa locations
  Clone ID: SORBI-28MAY03-C21061_1.pep
PAGLGNVVTRHDIKDRKTMGKMSEAYPHLILDNFSTXGRVGERTATILKHLFPVPKPDSKRIITFANRDEYISFRHHVYEKSGGPKSMELKEVGPRFELRLYQIKLGTVEQNEAQSEFVLRPYINTAKKQKTLGA

SEQ ID NO: 41111 - protein, 59 aa, Sorghum bicolor
  Clone ID: SORBI-28MAY03-C21558_1.pep
PGAPGCGAAALPHSGASPMAPPGLRGLSPSAACVWFPRPSSFCCWSIFQPVKFQLLNHR

SEQ ID NO: 41112 - protein, 65 aa, Sorghum bicolor
  Clone ID: LIB5048-011-R1-XP1-F4.pep
MSIHIPPSYFHSSQLNVGLILGQLCRSIANLHGPMCAYLAEMDGDNQRIPIPWQICQVAVSRKPG

SEQ ID NO: 41113 - protein, 217 aa, Sorghum bicolor
  unsure (1)..(217): unsure at all Xaa locations
  Clone ID: SORBI-28MAY03-C2165_1.pep
VGEEKVEGWMRESIAEIVRHIGEAPFLVHLFSNDDGEGERVTVRREPAAPESWADGGRRWGPGGQRKPDGIILVEQVAADGGASASEAARQVWGLVVQARGMECASCYVLDTCRVRSPAGFCTHFCLARVQCFGDPVEXPAPQCLAQPPRRPPIAARWSLLLLLILLLIVFDSMRQGPNATMMPPLRWQERGREACRLEAGKANRIHQIFSFSSVSP

SEQ ID NO: 41114 - protein, 254 aa, Sorghum bicolor
  Clone ID: SORBI-28MAY03-C19898_1.pep
MVLCQGVSVGNAQLLAFPGRSSSLKRTQFHVKANHFPARALRVVTDSIHHGMPTSFLRENSVRGIPSLSRQHNLHPRSVSCQASSLASFSYPELTSKPRWWWRTLACVPYLLPLHNMWSYADVIYQLHTYLQGFSLLYTFIDTMTLCPGWLFLVIFMTVYFFVVRRKWSPHFLRFHVILAILLDTGSQAVATMCTWMPSIVYQGKAMQYFWMSIAFIQIFTVLECLRCALCGMYPDVPFISHTAFIHSDLNLFR

SEQ ID NO: 41115 - protein, 150 aa, Sorghum bicolor
  Clone ID: SORBI-28MAY03-C2000_1.pep
RPPETKKPRVKIYTDKETGRKKGDALVTYFKEPSVALAVQLLDGTSFRPGVKIPMSVSPAKFEQKGDVFISKKTDKQKKRKIKKVEDKMLGWGGHDDKKLMIPTTVILRHMFTPAVVRADEELLSELETDVSVSWIMMQRCHDWIGLERS

SEQ ID NO: 41116 - protein, 185 aa, Sorghum bicolor
  Clone ID: SORBI-28MAY03-C20063_1.pep
MASIIVQAVVILLDVIAFGLGVAAEQRRSRATVTPDAAKEYDFCVYDSDIATGYGVGALLLLAAGQVVLMVASRCFCCGRGLKPGGSRACALILFLFTWVTFLIAEACLLAGSVRNAYHTRYRGIFYGDSLSCETVRKGVFAAGAAFTFFTAILGEVYYLSYSKSRDAAGGAPYGGSSIGMGPYN

SEQ ID NO: 41117 - protein, 125 aa, Sorghum bicolor
  Clone ID: SORBI-28MAY03-C2024_1.pep
MASVAFGSTVAAAVAPTSGRTRPARRSVLAVPPAATRGGPAPAKEEKGLGEIIFGFIFKKDQLVETDPLLNKVAGASAAASSRAKPPPRGAATTSGKKAAAADDGGSGGGFNLPGLGGFFAKKSS

SEQ ID NO: 41118 - protein, 157 aa, Sorghum bicolor
  unsure (1)..(157): unsure at all Xaa locations
  Clone ID: SORBI-28MAY03-C20282_1.pep
AGRAYALSRGGTYPVGQQRSHPAPPRDPKSAVSAAAAAAAASITGGIRGAPCSXAMNTDITASTKPEYPVVDRNPAFTKVVGNFSALDYMRLSTISAVSVTVGYLSGIKPGIRGPSMVTGGLIGVMGGFMYAYQNSAGRLMGFFPNDAEVARYKYKL

SEQ ID NO: 41119 - protein, 306 aa, Sorghum bicolor
  Clone ID: SORBI-28MAY03-C2215_1.pep
SIGNIAGSLLAAFLLKFGWGWSFAVPSLIMALVGLMVYIFLPVNPEVMEIDIDSGEFNCEKDAVKEPLLEPGQEVKHQAVGFLEAWRIPGVAPFALCLFFSKLVAYTFLYWLPFYISHTRIGGQYLSDAMAGSLSTIFDVGGVLGGVLAGHISDRLNARAITASSFMYCAIPALFLYRTYGSMSIMWNISLMFITGMFVNGPYALITTAVSADLGTHSSLNGNSRALATVTAIIDGTGSVGAAIGPLLTGYISSKSWSAVFTMLMAAALLAGLLLTKLVCAELKGKTPSNASKDVADAEGTYSDEV

SEQ ID NO: 41120 - protein, 85 aa, Sorghum bicolor
  Clone ID: SORBI-28MAY03-C2207_2.pep
MMMQKMAVEYNERIENVNRERKFHQQNTGGQLHALTMEWQELCQKNIAIQAACVDLQNQIDQLKIEAKELGMPIDDNNGTNSQAS

SEQ ID NO: 41121 - protein, 97 aa, Sorghum bicolor
  Clone ID: SORBI-28MAY03-C2207_1.pep
WKLQNKQMESVLSRMQKMAVEYNERIENVNRERKFHQQNTGGQLHALTMEWQELCQKNIAIQAACVDLQNQIDQLKLEAKELGMPMDDNNGTNSQAS

SEQ ID NO: 41122 - protein, 185 aa, Sorghum bicolor
  Clone ID: SORBI-28MAY03-C22218_1.pep
TRPKVTGVDWRKKLETQRGAVLATELKNNANKLARWTAQALLAGADMMKLGYVSRLHPRDHYNHSILSVIGYKPRDFAAQINLNTANMWGIVKSIVDVCMKLGEGKYVLVKDPVKPQVRLYEVPNDAFENDYVEEPLPEEEQVRPFSEDVDATAQEMDAAAEAEATGTTAGAEGDAEKSNDVAAV

SEQ ID NO: 41123 - protein, 108 aa, Sorghum bicolor
  Clone ID: SORBI-28MAY03-C22261_1.pep
NNFCGRVQQEHGLRPRPTNGFMSPNMGRAVGDIEMGRKPVAWDEPRMAAEIGDLGAGLSNLLEDKDGRFRSASPDLSRDALAVGGGLEEQGSSAMNPGRSSWGVEAGR

SEQ ID NO: 41124 - protein, 122 aa, Sorghum bicolor
  Clone ID: SORBI-28MAY03-C22282_1.pep
QAYGQQVGVYTTWVNQKQISRICQSFFSSVFLHGLSAKRTRGFDHFGSDCRQAFQFFSVSAACNSSSSAISQMAGLRDGRPPSWIFFFFWGVCWWKEHWTGGEIRIGIATVRIKLLITSVVL

SEQ ID NO: 41125 - protein, 100 aa, Sorghum bicolor
  Clone ID: SORBI-28MAY03-C2233_1.pep
HTTQTRTMATLPRAHFLACFKLGERHCQKLGTRPNLQGFLQLVSLSGGKNVLEAWHDPVGPGVHVEADPVVPAADADGEPELGGGVRGVVGVGCAAGARG

SEQ ID NO: 41126 - protein, 189 aa, Sorghum bicolor
  Clone ID: SORBI-28MAY03-C20682_1.pep
MDALPVESERESQTDSHPLLMEHVIGIPRDDVASTSTPRRDNNDGMDHLPRDSESSSGTTAAYNSPNTPIARRDDNRRRRQQSLNSGFWISIELAVNLSQIIAAICVLSVSRNEHPHAPLFEWVIGYTIGCIATLPHLYWRYLQRNQLPTVQGSNQNYVPRHSFESNSFTGISPPHVSEAGVVTVTNGV

SEQ ID NO: 41127 - protein, 149 aa, Sorghum bicolor
  Clone ID: SORBI-28MAY03-C20951_1.pep
AGRFRRRNPFFEPPFVAPQIHRRSFGSRFRRTFPANLRREFPAASVIPCENRRHREVRVDLLYTGTPFFSRIRHPLTVFLVFSFISGELHHSHGRCHLPGRMGHGRGHRGAPCLAPRAGPHHAECHAPPPNAPSRRPSASLRKHQMVRT

SEQ ID NO: 41128 - protein, 173 aa, Sorghum bicolor
  unsure (1)..(173): unsure at all Xaa locations
  Clone ID: SORBI-28MAY03-C209_1.pep
RVRPASAAFPSLNSGRSQTQPRXQPIRVEGLSDLSLVDIAAGGWHSTALTIEGEVYAWGRGEHGRLGFGDDKSSRMVPLKVELLAGENIVQVSCGGTHSVALTQDGRMFSYGRGDHGRLGYGRKVTTGHPMEVPIDLPPPKSSSNPDGQWQAKYVACGGRHTLAIAERTEPTD

SEQ ID NO: 41129 - protein, 143 aa, Sorghum bicolor
  unsure (1)..(143): unsure at all Xaa locations
  Clone ID: SORBI-28MAY03-C20990_1.pep
MTGTGDSGGEHYSHYSRQVRELCALLLTIVYPTAPGRGASSVSMSMSPAAAASMLGXASVALMLCGSVTFAIGFFLMPWVAGLALLFGFAGAVNTLSSGLFLCTNTKQPPAAAAAAVPCKHPRGRIIGPPTTTPVMRSDALVA

SEQ ID NO: 41130 - protein, 119 aa, Sorghum bicolor
  Clone ID: SORBI-28MAY03-C21248_1.pep
MAEAPETAAPTPPPSPPAPVTSSPPPKSGIPPRYDLDAKWDACLDLSIRRVAYSSLAGAFAGLLLFRSPTTRWASVALGAGVGIGAAYTECSYLFNGAPPKWSPKVSTIPSAHSEGGDK

SEQ ID NO: 41131 - protein, 114 aa, Sorghum bicolor
  Clone ID: SORBI-28MAY03-C22877_1.pep
GLELTVQWTTLLIPPTTLLLLNFIGVVAGISNAINNGYESWGPLFGKLFFAFWVIIHLYPFLKGLVGRQNRTPTIVIVWSILLASIFSLLWVRIDPFLAKSDGPLLEECGLDCN

SEQ ID NO: 41132 - protein, 325 aa, Sorghum bicolor
  Clone ID: SORBI-28MAY03-C22921_1.pep
MFSRALQVILREKKSRTIGPALVHAFNSASSSQTQRLAGKVAVITGGASGIGKATAAEFVRNGARVVIADIQDDLGRAVAAELGPDNACCYTHCDVADEAQVAAAVDLAVARHGQLDVMFNNAGITGSPGCGWPPLGAVDLADFDRVMAVNARGVLAGLKHAARVMVPRRRGSIICTASVAGLCGGMVAVAYSASKATVIGLVRAVAAEMASAGVRVNAISPYAVPTPLALAAVASRQSMRGLSAEEIKRRVEIDSNVMYGTKLEEDDIARAALYLASDDAKYVNGHNLVVDGGFTVSREVPKILAQARPRSDERSAWILLRGRC

SEQ ID NO: 41133 - protein, 138 aa, Sorghum bicolor
  Clone ID: SORBI-28MAY03-C22972_1.pep
MAEKEGAKVGAEEMEEREQEGEAEEVEVKFRLFDGSDIGPIRCNAAATTVAALKDRVVADWPKDKSIIPKTASDVKLISGGKILENDKNVAQCRAPFGDLPSSAITMHVVVQPSSAKSKPDKKANKLPKTTRCSCTIL

SEQ ID NO: 41134 - protein, 286 aa, Sorghum bicolor
  Clone ID: SORBI-28MAY03-C23010_1.pep
MAASPPAAEGPDAVEIREVWAGNLEEEFAVIRAVVDAYPYVAMDTEFPGFVVKPSAEYRFTCDRNYAALEGNVNVLKLIQLGLTLSNGAGALPPCGTGGRGCIWQFNFRGFDPHTDPSSNDSIDLLRRSGIDFDRFAAEGVDSTRFAELMMSSGIVLNDDVQWVTFHSGHDFGYLLRLLTGREMPNTLDEFLKLTKTFFPVLYDIKHLMKFCGGGLYGGLSKLGELLKVERVGIGHQAGSDSLLTLQCFMKLKQLYLNESVKLYDGVLFGLIPGEVEIKPAAPPIE

SEQ ID NO: 41135 - protein, 310 aa, Sorghum bicolor
  Clone ID: SORBI-28MAY03-C2306_1.pep
MAGNLHLPVVDLASPDLRAAAESVRQACVEHGFFYVTNHGVDRGLLQAVFAQSKGFFDLPMEEKMALLRSANHRGYTPPYAEKLDASSQFVGDLKESFYIGPIDDGDMHNDVNQWPSEERLPSWKETMKLYIAAILDTGTRILSLIALGLDLDAEFFHKIGALNCPSTFLRLLHYPGEVNESDSGNYGASAHSDYGVITLLVTDGTPGLQICREKDRNPQLWEDVHHIDGALIINIGDLLERWTNCVFRSTLHRVVAVGKERYSVAFFLDPNPDTLVQCLESCCSEACPPRFPPIKSSDYIFGRINSTYK

SEQ ID NO: 41136 - protein, 229 aa, Sorghum bicolor
  Clone ID: SORBI-28MAY03-C21673_1.pep
MSHPENGGASNGHAAEEHQDVMMEVEPKQRRAPRLNERILSSLSRRSVAAHPWHDLEIGPEAPAVFNVVVEITKGSKVKYELDKKTGLIKVDRVLYSSVVYPHNYGFIPRTLCEDNDPMDVLVLMQEPVLPGAFLRARAIGLMPMIDQGEKDDKIIAVCADDPEYRHYNDISELSPHRLQEIRRFFEDYKKNENKEVAVNDFLPAAAAREAIQYSMDLYGQYIMQTLRR

SEQ ID NO: 41137 - protein, 105 aa, Sorghum bicolor
  Clone ID: SORBI-28MAY03-C2175_1.pep
TGGHALRREGNLPSGDCRAVSGGSMNPARTLGPALASNLYTGLWIYFLGPVLGTLSGAWTYTYIRFEEAPSTHKDMSQKLSSFKLRRLQSQSVAAEDDELDHIQV

SEQ ID NO: 41138 - protein, 266 aa, Sorghum bicolor
  Clone ID: SORBI-28MAY03-C21958_1.pep
MTDEMRMAAVFGEAKPEKSDNQADALPRRPVLFRAHSHSQGSLRVVATDLNSLAWHTSLDLDGLRDLQDDVGIAGSWSDFLDYLNSSLSSGHVRLLFPDAARGPDTVELVATKAKGLPRITISLDRVAASELKDVIADFSLALYESYKTKQEHASREHQQVSQLMQSLASEREKNEVMQKQLEALSFLDKRKATKPKLVTDQVPSVSSVPPSSDQIIVPAQQQTPVALPSKVPPAKATKRLAPVSRRARVRGALLQDTEENDDDDS

SEQ ID NO: 41139 - protein, 108 aa, Sorghum bicolor
  Clone ID: SORBI-28MAY03-C220_1.pep
SAMAFSSSKTTRLLVLLQIALFVMSALIMPRSVCHGARSVGLGSIGYEPFDPNHPVCLAGRCPVPGKPYGRGGGGDPYENRPGHGGGGPRSYYPDKPAIPSYGETSNP

SEQ ID NO: 41140 - protein, 109 aa, Sorghum bicolor
  Clone ID: LIB3481-050-Q6-K1-E11.pep
GGGSDQSRICSGFVRIGTRPATTPTTRAVLVGIATTTTDVGLATNWAPPSKAHRTVWLQRQVTNGTWPNASGSMADGARHDQRGHDEHSDLQEHEDQAVPLWRTPRAER

SEQ ID NO: 41141 - protein, 136 aa, Sorghum bicolor
  Clone ID: SORBI-28MAY03-C22139_1.pep
GGGSGVLSVSQLPVHMEGSLPADIRDRVFYLEGDHMHSSIQKVPALVLDCEHDIDFNKDIEAKQQYARQVAEFFEFVKKKKESPTAEMTDGNNKSINKQIVLPHRGGLWVPGGSPLPESALKSFDFRRTMSSFLST

SEQ ID NO: 41142 - protein, 190 aa, Sorghum bicolor
  Clone ID: SORBI-28MAY03-C2398_1.pep
LIELIILQDTTRINSTTEIKPGRLVIHSCLQGDGLQFLTVFIIYNVGVPIATNTYRLTALVLATGPAFSTRYLAHCQRRMKLSALPFGSPPPVEKHRQLSRLRTAAGRSGGGAGRKTWWISIPFPPMDATEGPQLRRPNIAILDRSAAIPILSSFLSSLSLARSLHLHLSLSLREKGWLLACRWVPRPGR

SEQ ID NO: 41143 - protein, 272 aa, Sorghum bicolor
  Clone ID: SORBI-28MAY03-C2404_1.pep
KRILDFNQRIVIALDVAIALTYLHLCSGEALICYNLRTSNILLTENYRAKVCCSELSESGNVVLSTGTGGYIDPEYFETSELTAKSDVYSFGIILLEIISSHGPQDWDVLMNHRQSSVVQWALEKFYDDLMNEILDYRMEDRVDGDVLRDWLSLALSCVVSHGIDRPSIEVVGERLWKIWKDHRRNMGEQHEYEGSWAAFAVQEGILRHQKSVLKRNWGPSATEEDWSGYLRQIELIQEGHSVTEEEHSVTEGQHISRSRSFSLDDITVSPR

SEQ ID NO: 41144 - protein, 247 aa, Sorghum bicolor
  Clone ID: SORBI-28MAY03-C2439_1.pep
TRDRWEFANEGFLARRKHLLKTINRRKPSLQGNSQPQQPQLQNAPVPSCVEVGKFGLEEEIERLKRDKNVLMQELVRLRQQQQTTDHQLQTLGKRLQGMESRQQQMMSFLAKAMQSPGFLAQFVQQNENSRRRIVAANKKRRLPKQDGGLDSESAAASLDGQIIKYQPLINEAAKAMLRKILKLDSSHRFESMGNSDNNNFLLENYMPAAQAFESSSSTRNSGVTLAEVPANSGLPYVSASSGLSAI

SEQ ID NO: 41145 - protein, 213 aa, Sorghum bicolor
  Clone ID: SORBI-28MAY03-C24371_1.pep
HEAKIEEGITSKKKGLPPPASKPARRTRAARGNQHTKIDDGGSEESGPCETGQDDQKLDTDYISNMEVDNSDKDCGPPPGAQLFTLGEQEAKGVKLNTVEEKPDSPFQRTTAAEAMSSAPGDKIEQMADPLHAMLLDMLPLLGKKGTEDASRAPLPKAEKDPPAGGSSTSNSEILAPDAGTSGVPAPDPNAAPPPKKKKVSYKDVASELLKDW

SEQ ID NO: 41146 - protein, 413 aa, Sorghum bicolor
  Clone ID: SORBI-28MAY03-C24409_1.pep
MATSASTSGEWLKGALQELRERKGSSLEFDSDLISGLVSFCELAPPSDATSYLENFIGKEAAQDIIQEYLRRRGHIGSSNGTESFQSSNLQPYVKPSADAAATQTKKQTRTQKDSASSSSQSSKSQSAAESQLPSRRGSKKKGAKVISLAEAAKGSIVFKQGKPCSCQARQHNLVSNCLSCGKIVCEQEGEGPCSFCGALVLKEGSTYAGLSDVGLPLSEAEAAAEAYAKRLVDYDRNAAARTKVYDDQSDYYEMEGNSWLSSKERSVLKQQQEEAEEAAQSQKGKVIVTFDLVGRKVILNKDGTTELETEHPIMRPPEEKDQSHRIQPNPTIREQPVFVETGPVKPKPARAKQSKRLAKNGLCLEVTGRLQHDDKDIESILSGKVKKGDHLAYSSFGQAREGDDVECSPDFD

SEQ ID NO: 41147 - protein, 142 aa, Sorghum bicolor
  Clone ID: SORBI-28MAY03-C24562_1.pep
ARGDLLGGGYSGPAAFPARPGFFLCISSRRRTPVAEEYLRGFNPRAPNFLPLELDPDAEKVDLKHQMMDERKNAEEWMIDYALRRAVTNLAPAPQGLVDPLAQAFGAVVPLVVDVLFLASRPSPVQPRFCSHSSLWFLYRRP

SEQ ID NO: 41148 - protein, 183 aa, Sorghum bicolor
  Clone ID: SORBI-28MAY03-C22464_1.pep
MSTQQEVTENYANPKTCFFHVLFKASALAFYILSTLFVNNFVIIFVITVLLAALDFWVVKNVSGRILVGLRWWNEINDEGESVWKFECLDGESLARMNKKDSWLFWWTLYLTAAAWIILGIFSLIRLQADYLLVVGVCLSLSIANIIGFTKCNKDAKKNIQDWTRNALLSGSVRSHLQSAFGV

SEQ ID NO: 41149 - protein, 145 aa, Sorghum bicolor
  Clone ID: SORBI-28MAY03-C2255_1.pep
GRPRVREDIYGFFDPEYHSESKIKPEGGSASLDRRPNGRPPSNGRSNSRNPQSRTQKAQQAQAASERSSSSSHSSASSNHDWREGSSVLDLKGENYFSCAVGRKRSNARYLLSSSEEVVSFLKELATATAGFQSSCADYMFLDRQ

SEQ ID NO: 41150 - protein, 180 aa, Sorghum bicolor
  Clone ID: SORBI-28MAY03-C2259_1.pep
NSAGAELDESEGASISLDKVLNCATSCISVAFPQDIINQKKNVLELILNSLSPEESWQVKLSSFLCIKELCLKFHSSGDSNTWPQDTACLVQELFHLVSPKLVDSIRLVKIAQVHIAASECLLDLSKLYRDFPLLERTEAKFEDELTELCESEKSEQAKAILKECLAILKTLPGVTMTTD

SEQ ID NO: 41151 - protein, 136 aa, Sorghum bicolor
  Clone ID: SORBI-28MAY03-C22456_1.pep
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 41152 - protein, 124 aa, Sorghum bicolor
  Clone ID: SORBI-28MAY03-C22631_1.pep
MGAAGDEKAAAAAGTGATAAEGEGAVDSKDLQQQSKALDKLTDHVEDRQLDSSRVQSAMAALASSKEADWNAMRLREKELAAVKINPTDVEIIANELELDKKIAERTLREHKGDAVAAVRFLLH

SEQ ID NO: 41153 - protein, 482 aa, Sorghum bicolor
  unsure (1)..(482): unsure at all Xaa locations
  Clone ID: SORBI-28MAY03-C24794_1.pep
TREILRVLTHYNRPIFKVERQHSEAECSSTSDQATSSDSTDKKSNNSPGNESDRKPLRPLTPWITDILLAAPLGIRSDYFRWCGGVMGKYAAGGELKPPTTACSRGSGKHPQLMPSTPRWAVANGAGVILSVCDEEVARYETANLTAAAVPALLLPPPTTPLDEHLVAGLPPLEPYARLFHRYYAIATPSATQRLLFGLLEAPPSWAPDALDAAVQLVELLRAAEDYASGMRLPKNWMHLHFLRAIGTAMSMRAGIAADTAAALLFRILSQPTLLFPPLRHAEGVEVHHEPLGGYVSSYKKQLEVPASEATIDATAQGIASLLCAHGPDVEWRICTIWEAAYGLLPLSSSAVDLPEIVVAAPLQPPTLSWSLYLPXLLKVFEYLPRGSPSEACLMRIFVATVEAILRRAFPSETSEQSRKPRSQSKNLAVAELHTMIHSLFVESCASMDLASRLLFVVLTVCVSHQALSGGSKRPTGSDNHS

SEQ ID NO: 41154 - protein, 325 aa, Sorghum bicolor
  Clone ID: SORBI-28MAY03-C24876_1.pep
DTTMEERQPYGQIKVLAMTSVNGMLGPGSLTLETIQQVESEVQRLNQLKASKMKELFLKKRAEVDEICKKSHMDMPYQTEMDKIMNLIMSGDVVHDDLLKTMDEYIYKAKEEATSRKDIMDKVEKWMASCDEERWLEEYSRDERRRPRGRGAHTPGRRAERARIIVNKIPGLVEQLMAKTQFWEQERNKIFYYDELPLLAMLKDPIISQDDVDFINICLRENKKIQTLLVKRPENSIMLRPNTSFSRPSSRGFNTSPGSTSIWTSQVSAKVQLPDSENSPAGKGKRATRTGSRRMQGVQGNNRSCSTSHEDKAEVSTVKQGLSPI

SEQ ID NO: 41155 - protein, 146 aa, Sorghum bicolor
  Clone ID: SORBI-28MAY03-C25050_1.pep
MAAARGRGSAAGGSRAPPLVAGAAFLCLAVLLLAVATPAAEAGTTYLVGDAAGWTLRPKVDYGQWVAGKTFHAGDILVFKYNTTYHDVAWVSKGGYRNCIVSPKGGRAPVYHTGHDAVTLPRGTHYFICGTPGHCSAGMKLAVTVY

SEQ ID NO: 41156 - protein, 134 aa, Sorghum bicolor
  Clone ID: SORBI-28MAY03-C24977_1.pep
QDCRQLLARIFVANPAKRITIREIRNHPWFLKNLPRELTEAAQAKYYKKDNSAPTFSDQTVEEIMKIVEEARMPPESSTPVAGFGWAEEEEQEDGKKPEDDEQDGEDEEYDGEDEYDKQVKQVHASGDFQHLIK

SEQ ID NO: 41157 - protein, 221 aa, Sorghum bicolor
  Clone ID: SORBI-28MAY03-C2511_1.pep
VLDLCNKWDVDNLEYCDAPSFLPGPFDTVGLVAENQFFDIGNSGIQNQRYQYTTEVRTHNQAALNVRSHMKHDHVVLSSHASGTMNIHAANEVNNQSSTASQSWFNAALSALLDSVPSSPALAAEIENTVINRTLQCISSFRSQQTAGEENTFINRTLQHISSFKSQQATREEPGTPSIQVTRGSRLMLISLLVILASIIWTFTSGSALNFCKGFWKSSST

SEQ ID NO: 41158 - protein, 206 aa, Sorghum bicolor
  Clone ID: SORBI-28MAY03-C33488_1.pep
HPRPPPLPPPLRRRLSPSPARGSAPPSPSARGSTPPAPLLRLFPWIWPSRSHGAFPCRRHPSPQSLLPSIGKMVANKRSGGAISRSLNENKRTCSAREATKSSLSDGLWDSKDGVWSKLSEQVALNLSKSVVSLVLSDGDTVLFASSGIAIECHGHVSRFLTSAGLVRALNNEENGHDNVKIEVHHKGRAVTGFLEEYDLDYDIAV

SEQ ID NO: 41159 - protein, 314 aa, Sorghum bicolor
  Clone ID: SORBI-28MAY03-C33465_1.pep
AGIPGPRGTACVVVVSPGVVPGPHRAGFLPVVSPPPRLGIKFVLVPGTHVQIDKLLAERGKKAKYAGRYRITDSDSLDAAMEAAGRIRLTLRAEPSPAPPVFFLRRRAVAPRRLGCSVCGASAVFLGAKRRGVVAGIVCGFTGDVKTIDVSRIRQRLRSVSMLLVGHRGSATTVLDVYGMFNELTSACATCKKAIMELYAGRYRITDSDSLDAIMEAAGRIKLTIEEKLIQPVRLSLSSESVSHSAVFFSHNIQRCFSLTTNQPIVLSAMAFCRYGVNGRWHEISDNVASGNFLGARVSTIMLVLYCISSFIYM

SEQ ID NO: 41160 - protein, 167 aa, Sorghum bicolor
  Clone ID: SORBI-28MAY03-C33597_1.pep
MAGLLVSSSGVWTVLGQASNVAQLVGVDALGLVSMVVQAALAARRHRDACRRLAQHVEVVGGLLRELELAELMRREATRRPLEQLQGALRRCYALVTACQDCGYLRSLFLGARMADELHAVEKEIDMFIRFVPLIALVDSTHDRHAKETAGGVPVVIMTRVSRLLDP

SEQ ID NO: 41161 - protein, 201 aa, Sorghum bicolor
  unsure (1)..(201): unsure at all Xaa locations
  Clone ID: SORBI-28MAY03-C33602_1.pep
MAQDLEMAARNGSGSGAGADGAHYYPQQPRDGGAGGQELDDDGRKKRTGTVWTASAHIITAVIGSGVLSLAWSTAQLGWVVGPLTLMIFALITYYTSSLLSDCYRSGDQLTGKRNYTYMDAVAAYLGRWQVLSCGVFQYVNLVGTAVGYTITASISAAAVHKANCFHKKGHDADCSTYDTMYMVVFGIVQIFFSQLPNXSD

SEQ ID NO: 41162 - protein, 277 aa, Sorghum bicolor
  Clone ID: SORBI-28MAY03-C25443_1.pep
MGGASPVPAPAPVSDQEDGAGIGDSDKEDGAGIGIGDGEVVDNASGTQQPAQRLPARLLNIPLSNVERLRSTLSAVSLTELIELVPQLVSRSSISADAHPDKKKLFSVQDFFRYAEIEGKRFFEELDRDSDGQVTLEDLEIAMRKRRLPRRYARELFRHTRSNFFSKSIGWKQFLSLMEQKEATILRAYTTLCLSKSGTLHKNQILTSLKGAGLPANEDNATAMLRYLNSDSEGSISYGHFRNFMLLLPSERLEDDPRNIWFEAATVVAVPPPIEIS

SEQ ID NO: 41163 - protein, 313 aa, Sorghum bicolor
  Clone ID: SORBI-28MAY03-C255_1.pep
AIALSGQPLLGQAVMVKPSEAEKNLVQSNATSGGAASGGARKLYVGNLHSNITEDQLRQVFEPFGQVELVQRPLDPMTGLCKGYGFIQFARLEDAKAAQSLNGQLDIAGRVIKVSAVTDHVGVQASGATTGDLDDDEGGGLALNASSRAALMLKLDRSGTATSLTGGIGAAGVSLPATSVIGAPGAASLLSPTVAAVGSVPGAPVLPVTTQNVIMSTPTEFLLLKNMFDPALETDPDFDLDIRDDVQDECSKFGAVKHIFVDKNTAGFVYLQFDSVAAAGKAQQALHGRWFAGKMITATFMSAQEYSTKFPNL

SEQ ID NO: 41164 - protein, 150 aa, Sorghum bicolor
  Clone ID: SORBI-28MAY03-C25531_1.pep
MEVVASAPGKVLIAGGYLVLERPNAGLVLSTTARFYAVVRPIRDSLPADSWAWAWTDVKVTSPQLSREATYKLSLTKSTLQLTSARESTNPFVEQAIQFSVAAAKSIITDKDKKDAIDKLLLQGLNITILGCNDFYSYRKQIEARGLPLT

SEQ ID NO: 41165 - protein, 135 aa, Sorghum bicolor
  unsure (1)..(135): unsure at all Xaa locations
  Clone ID: SORBI-28MAY03-C25587_1.pep
PYPKLAFKYYGPYRILEKIGAVAYKLELPSHSDIHPVFHISQLKPFTPNFSPVYSTLPTXVTDLQATDAEPATILQRRLVRKGSTAVPQVQVTWTGLPDTVVTWEDYNVLRDRFPSAPAWGPAGSSAGGDVTTRG

SEQ ID NO: 41166 - protein, 143 aa, Sorghum bicolor
  Clone ID: SORBI-28MAY03-C25596_1.pep
ARLLVDNAAHVTTVVAGTFGYLAPEYLQNGHATEKSDVYSFGVLLLELVTGKRPTDSCFIKKGLNIVGWLNTLTGEHRLEDIIDEQCGDVEVEAVEAILDIAAMCTDADPGQRPSMSAVLKMLEEEILSPCMSELCYEQHLEL

SEQ ID NO: 41167 - protein, 140 aa, Sorghum bicolor
  Clone ID: SORBI-28MAY03-C25624_1.pep
MILQLITLVNPEHEVSREGGLYSNLFTAHPPFQIDANFGFPAAVSEMLVQSTGTDLYLLPALPRNKWPQGYVKGLKARGGVTVNISWKEGSLHEALLWSSGGQNSLARVHYGDQTTTVNLSLGQVYRLGRDLKCLETLPL

SEQ ID NO: 41168 - protein, 164 aa, Sorghum bicolor
  Clone ID: SORBI-28MAY03-C24575_1.pep
ACFRPLGANSAHKLHLSDKLCFPIIIEKHWFVFIVDLKNKLFVFLDSYFSDNHNFQVRARTKLINAFKDSWHQYAEGNVDVDTFSVFYPPVSKQNNVVDCSVFALKFMELWDRNVDLRDLLDHSDIPDIRVKLGIDLFFSKGNCIDKSLVMNLYKQGVDPRVCN

SEQ ID NO: 41169 - protein, 266 aa, Sorghum bicolor
  Clone ID: SORBI-28MAY03-C24603_1.pep
MALFAAARRAAASSVPILLRASASSGSHRSAALLRPLAAAVARPKPRAMPFPSAPATRPSSDAELLSVIDSEIKYAEDCDDHDRVEEIPDNFPFKISDEKGTNVVTLKRTYQGEQIEVVAHMPSLVTGDEPDHDRDGEDEGEDKEGDDDAEDEGQKPEQSSVPLTVTITKGDGPVLEFACTAYPDEVLIDALSVTQPSGDDEHDMIVYEGPDFNDLDENLQRAFHKYLELRGISPMTTNFLHEYMINKDSREYLLWLRKLKDYFKQ

SEQ ID NO: 41170 - protein, 165 aa, Sorghum bicolor
  unsure (1)..(165): unsure at all Xaa locations
  Clone ID: SORBI-28MAY03-C24635_1.pep
XWLAKHGDASRLFLAGDSAGGNIAHNLAMRAGQQQGGAAARIKGVALLDPYFLGRYVSGGSQRSWDFICAGRYGMDHPYVDPMAALPAEVWRRLPSARVLMTVSDQDRLGPFQREYVDALRASGWRGQARLYVTPGEGHCYFLNNLASPKAAMHMATLAAFINGS

SEQ ID NO: 41171 - protein, 161 aa, Sorghum bicolor
  Clone ID: SORBI-28MAY03-C24749_1.pep
MDRGQRLGRALDAFGGDMWALVDAALDAAARDRPDDLRARRDGIVERLYAAATAGCSNCAGRPPPLAALAAAGLDEEDGEEAAPASSAVALEAEADAQAGGAEERAEELGAGAPGLESKIVAIRDFLDDPNQPEDELVRLLQSLADMDVTYSALQETDIGR

SEQ ID NO: 41172 - protein, 172 aa, Sorghum bicolor
  Clone ID: SORBI-28MAY03-C24792_1.pep
KTVLLVKAAAVALTQPPVVNASCRGGLPCPCCCCGRLRGPAPRAPGLLAPVLEDADKLDIYLLAQKWRVLLKKARMKQLQPNEYNSGTFTLSNLGMFGVDKFDAILPAGQGAIMAVGASRPTVVADKDGFFSIKSEMLVNVTADHRIIYGADLAAFLQTFAKIVEDPESLTL

SEQ ID NO: 41173 - protein, 160 aa, Sorghum bicolor
  Clone ID: SORBI-28MAY03-C25885_1.pep
MIQLLFSLLAAEGAVAATLLFKTPLRRLSVVALDRLKQGRGPVMVRTIAATVLVVLASSLHSMTKIRSRADGELDGAGIVGLTPTDQVLLARHVLEASLMGYSLFLALVIDRLHNYVKENRRLRKKLEEVSKQNETMLEATHGPKESKLDQKDIFDAKDN

SEQ ID NO: 41174 - protein, 127 aa, Sorghum bicolor
  Clone ID: SORBI-28MAY03-C25910_1.pep
MPPGPQPGWVTAHARGAAGSPGGLVFKGGAVQAAGGGGQTYLGRAWNAFAAVVFYRTRMDGVVVPQGWQAWNAAGNVSSVTFAEVECTGPGSEMGRRVDWEKRLSEDEVQRFVDIKFIDDGWLSNQP

SEQ ID NO: 41175 - protein, 149 aa, Sorghum bicolor
  Clone ID: SORBI-28MAY03-C25961_1.pep
DISEVRVEGLETLDYLDNLQDRARFTEQGDAIVFESELDRIYLGTPSKIAIIDHEKKRTFVVRKGGLPDAVVWNPWDKKAKAMSDFGDDEYKRMVCVEAAAIEKPVTLKPGEEWTGKLELSAVPSSYYSGQLDPDRVIQDSTVPEDSIS

SEQ ID NO: 41176 - protein, 185 aa, Sorghum bicolor
  Clone ID: SORBI-28MAY03-C25971_1.pep
TLIGGNYGLLDTETFLPNPDYYSALLWHRLMGNGVLSVDINAPRQIRAYAHCRRQQQGITLLLINLSNTTGYNVTLQNDINVSLGKRPDLEKRSSFTHRLKKAVSWLGRKPTSDTKRREEYHLTAKDGDLQSKTMLLNGVPLELGDAGSIPAMDPVLVAVDSPVHLAPTSIAFVVLPKFEAKACS

SEQ ID NO: 41177 - protein, 178 aa, Sorghum bicolor
  Clone ID: SORBI-28MAY03-C26000_1.pep
MAPPMDPPDVEMEMDPAPQPPAPAVAPAPAAVGEGWSMLSRARGLLEEGKPSLALQAVLLAIRSQGGEQALMQTMNRARELYAQRLQATPSVDELASLLAQCAIAEAQSTNTNPSQGPGSDPVDMLNSDEACILAESGRKQIILDAFADGSSFICLKCGGLFSTSRKDEHLAYWCGTA

SEQ ID NO: 41178 - protein, 99 aa, Sorghum bicolor
  Clone ID: SORBI-28MAY03-C2603_1.pep
SAAILEPLEESVPEENGLASAEDDEDDSSDTENNDELVPADSTPKLDLQSDKKKGIQVQLDLKSNGNGSSGKKAPAARSRATGSSGKAAAGGSAGKRKR

SEQ ID NO: 41179 - protein, 316 aa, Sorghum bicolor
  Clone ID: SORBI-28MAY03-C25272_1.pep
TRLRYIYNHQNEDGGWGLHIEGHSTMLSSALNYVALRLLGECPNGGDGAMEKGRNWILDHGGAIFMAAWGKFWLSVLGVYDWSGNNPVPPELWLLPHYLPFHPGRVVCYCRMVYMPMSYIYGRRFVGPITPLVLELRKELYTDAYDEIDWNKARTECAKEDMYKPHSLVLDISMTILHKFEQIMFHWPWRKLRNKALAFTMRHVHYEDESTHYINLGGVPKVLNMLARWIEDPNSEAFKCHIARVYDFLWIAEDGMKMQLHQQLYVWLKERYMDERCEKLLLFSFTSLRSFVGAQKKELDTMSYFGKGCLAKYMSQ

SEQ ID NO: 41180 - protein, 260 aa, Sorghum bicolor
  Clone ID: SORBI-28MAY03-C2528_1.pep
LEHLPKAFSSPLHLPTLRRLTPTSSLRVAAATMSSSSAVATPIEHFVLFKARPEAVTSGATAAMVSSLQALATVVPGLAYIHAGPVLRLRSPAAEALGPTHLLHSRYATKEDLASYATHPAHVAAVQSHVLPNALDITAVDWVNAAPLPSPAGPGSAVRLTLAKVKEGVEVAQLVEKVAAVTKAAGDAKGAKVSFGENFSPARAKGYQFGMVAVFDSVEELDAVEGDGKVEEAKAAVRPLLDEVMVLDFVVGDASTPASL

SEQ ID NO: 41181 - protein, 179 aa, Sorghum bicolor
  Clone ID: SORBI-28MAY03-C25309_1.pep
MRMLSKACSIVASSLPRCSSSAAPTMRGQPSLLPSVRKQWPGKPLLYGIGTLLVMPLRTLYGVGRVFGAGRFLCNMTSVSSSLQIELVPCLRDNYAYILHDVDTGTVGVVDPSEAMPIINALEKRNQNLTYILNTHHHYDHTGGNLELKAKYGAKVLRSATVFVLSFPILFSDSDTYNM

SEQ ID NO: 41182 - protein, 103 aa, Sorghum bicolor
  Clone ID: SORBI-28MAY03-C25366_1.pep
RREIQEQAIALDGFSEEAWIERELETGIVTKQEANCAAISDELSDEAWIERELESGIVVGPSNEQAITFDGLSENDWIERELESGIIVEPAPAIKKRRLESRC

SEQ ID NO: 41183 - protein, 133 aa, Sorghum bicolor
  Clone ID: SORBI-28MAY03-C25386_1.pep
TYGKWTEVATNQDQELIVRSLLAARDASLEIRLHMREMGIAAGVPIEPDSQTQLLDATMNMEGVLLAGVPGAGGFDAVFSVTLGDANNAVANAWSSAGVLPLLVREDCRGVSLEDADPRTREVSAAVSSIQIN

SEQ ID NO: 41184 - protein, 88 aa, Sorghum bicolor
  Clone ID: SORBI-28MAY03-C26434_1.pep
NIRNKKKKQQQLSLCNRSKIEVDWLTSSRLPLIVFTQGSCSARQFDRGHASTTTTTTTTTCRCYKHGRARAHAHTNLLVAEQARANGT

SEQ ID NO: 41185 - protein, 156 aa, Sorghum bicolor
  Clone ID: SORBI-28MAY03-C26519_1.pep
NVKEPAPGAGATPDARRASADDKEEPEVLNAFHLISLSEGFDLSPLFDHGRGVGRSSAGGAGFATGAAAGSVDTRQETQVGPGRGAEQGGPRGGGGGGRPAGAAEHFRGARPAVLLVDVKKDGGDTMEYQSFCSEELRPALKDVVWASGEDTPGAA

SEQ ID NO: 41186 - protein, 156 aa, Sorghum bicolor
  Clone ID: SORBI-28MAY03-C26465_1.pep
MESTALMTARLPLPTSGSRSKPLSPASFTRVARLLASVPFCSGSGGFVLLSRRSRDYAGVGPLVSAAAASGDTADAGSESILLSVQGMMCDGCAASVKRILESQPEVTSATVDYKEASAVVWTTDEAKGTQGWQKQYGEKLAKHLGTCGFESRVQE

SEQ ID NO: 41187 - protein, 113 aa, Sorghum bicolor
  Clone ID: SORBI-28MAY03-C26605_1.pep
QGRTPLNTDADAQPVRVCDRCMAEVTQRLNNAREVTNRPIVQSHEDLAKKLQEAMDINKRSSSGTRSSDASGKRMREVACPICTVHLQVEVPTSGSETIECGVCQHPFLVSAR

SEQ ID NO: 41188 - protein, 90 aa, Sorghum bicolor
  Clone ID: SORBI-28MAY03-C26640_1.pep
PKAYGFETATEACCGQGRFNGMGLCTMVSSLCADRDSYVFWDAFHPTERANRLIVQQFMSGSVEYIAPMNLSTVLAIDEELERQQQSTLP

SEQ ID NO: 41189 - protein, 46 aa, Sorghum bicolor
  Clone ID: SORBI-28MAY03-C25684_1.pep
MAAEEGAMSPTRMLAEGHLRVATGGGAPADGEIAVRHLPHHHPTKK

SEQ ID NO: 41190 - protein, 327 aa, Sorghum bicolor
  Clone ID: SORBI-28MAY03-C25717_1.pep
MADGSASASPPSVSPHHQYHRDAIKSSVRNTAANRRREQALAIGKERREALMRAKRVCRAPLSGSDEAAAEDGDMVTDEGKADLEARTTQAVEELKSALSSQGKGAQKRKTEVLRALRRLLSQSEVPPVDAAIKAGAVPLLVQYLSFGSSDEQLLEAAWCLTNIAAGEPEETKSLLPALPLLIAHLGEKSSTLVAEQCAWAIGNVAGEGAELRSTLLAQGALWPLARLMLSNKGSTARTAAWALSNLIKGPDSKAANELIGIDGVLNAITRNLEKADEELATEVAWVVVYLSALSEKATSQIVRSAVPLLLIGRLLASENLQLLIPV

SEQ ID NO: 41191 - protein, 165 aa, Sorghum bicolor
  Clone ID: SORBI-28MAY03-C25752_1.pep
MSAAVRSRAAAAALSAARRIHAGLAAEQKQQGGNSPGALRRPWTLFRRQQQQQQQEQSHVPRAAAPVLDAVADHRAGGSDGGEPPEIWRQPGEAPVASAGADAIGRIDVVRVAAPGGEGFDGKDGAEESGGWGGSNLGRRFPTPKEICRGLDKFVIGQQRAKKVL

SEQ ID NO: 41192 - protein, 252 aa, Sorghum bicolor
  Clone ID: SORBI-28MAY03-C25865_1.pep
MGRPRRYKYTQKWHEQLQRAPVGSSLESCFWAVVEELQAEMADGRAFEDLRDRVVKLENDAHGGFASPPSGSAAVRGGAAGGPAPCGLPEVDPALFPSLRAVGSGIPARTNAAFLGAFRRLLDGSTLQSEVTRAVAEEKRVVFTGHSSGGSIATLAAIWFLEKCTRRGSVNQAHPFCVTFGAPLVGDNIFNHAVKREGWSQCILHFLLPLDIVPRIPLTPLASFREEIQAVLDWCISSDAKQLPCWEVPCHT

SEQ ID NO: 41193 - protein, 151 aa, Sorghum bicolor
  Clone ID: SORBI-28MAY03-C26980_1.pep
MCIAAWIWQAHPVHQLLLLLNRDEFHSRPTKAVGWWGEGSKKILGGRDVLGGGTWMGCTKDGRLAFLTNVLEPDAMPGARTRGDLPLRFLQSNKSPLEVATEVAEEAHEYNGFNLILADLTTNIMVYVSNRPKGQPATIQLVSPGLHVLSN

SEQ ID NO: 41194 - protein, 306 aa, Sorghum bicolor
  Clone ID: SORBI-28MAY03-C27029_1.pep
PFFLFIERTRVLCFLTLYYRHLQSKKTSPLEPTEWPIVGHLPGLVANIHHFHDWATGVLTGAGCNFEARGGRTGLRYFITCDPSNVRHIFTSNFANYPKGEEYAVIFDVLGGGIFNADGESWRRQRVMAQMLMTGPRFRAFTARCSRDKVERSLLPFLAHHAADEGSSRPPCDLHDVFLRLTFDMTCSLVFGVDPGCLAVGLPVVPFARAMDDALETLFLRHITPVAYWKLMNVLEVGQEKKMAAARRTIDSFVAATVAKRRADKLKECEGVSNSFDLLSSFICHEDSSSGANDDVFLRDTTVNLL

SEQ ID NO: 41195 - protein, 450 aa, Sorghum bicolor
  Clone ID: SORBI-28MAY03-C27_1.pep
MSFRSIVRDVRDSFGSLSRRSFEVTIAGLSGLTVHHRGKSQSTVHEVCDTDLIIQESRWANLPPELLRDVIRRLEASESTWPNRKHVVSCAAVCRAWREMCREIVLSPEFCGKLTFPVSLKQPGPRDGMIQCFIKRDKSKSTYHLYLCLSTAVLMENGKFLLSAKRNRKTTCTEYVISMDAENISRSSSTYIGKLRSNFLGTKFMISDTQPPYNGAVVPHAGRTSRRFNSKKVSPKVPTGSYNIAQVTYELNVLGTRGPRRMHCVMHSIPASAVEPGGIVPGQPEQILPRALEESFRSTTSFSKSSIMDRSMDFSSSRDFSSARFSDIAGGAAIAGDEEGQNKERPLVLRNKAPRWHEQLQCWCLNFRGRVTIASVKNFQLIAAPSPAPAPAARAPTPSSQPVPQDQDKIILQFGKVAKDMFTMDYRYPLSAFQAFAICLSSFDTKLACE

SEQ ID NO: 41196 - protein, 243 aa, Sorghum bicolor
  Clone ID: SORBI-28MAY03-C27040_1.pep
MAQDEAVATQKTGNTASPSKDYPTPSPYPDWSTMQAYYGPGVLPPTYFAPAIAPGHPPPYMWGPQPIMPPPFGTPYAAVYPHGGAYPHPLVPMMSTPLSMEPAKSANSKEKNSNKKLKEIDRTAVSAGSGNSKRTMSSSEDYSAEGSSDVNDQKVNKTSRKQNSDDGPGAETTTGANTECVLAPNHTMGNGAILPHHWFPAPVIKPSATNVANSRVIGTAISPSPSVMVPAHTALPADLSVKD

SEQ ID NO: 41197 - protein, 172 aa, Sorghum bicolor
  Clone ID: SORBI-28MAY03-C27138_1.pep
MMVRKRLVYRSRGRRIPTMPRVPNSARGKRSTRRNKDENDMCAFDLLATVAGNLLADQDNSSNVPNTNAAKAKKRKSFKEEHFDEILPLKDVAMEKDVGSGSVSAFPRQANNCLAENSSTRNEAESILESLTMKSDMLAKIPECGSHGIHHPGPSSSVEPEQVQKAEPKVIR

SEQ ID NO: 41198 - protein, 99 aa, Sorghum bicolor
  Clone ID: SORBI-28MAY03-C27177_1.pep
HEERMEIIELPTHRFFVGVQFHPEFKSRPGNPSPLFLGLVAASSGQLDQRGVISKTSRCISNTGGASKLKACQNGHLMKPLKGLVNGHYSTTSNGAIPI

SEQ ID NO: 41199 - protein, 120 aa, Sorghum bicolor
  Clone ID: SORBI-28MAY03-C26067_1.pep
AADGGEGPVAKGGGGPVPWWKLSLDALRVWALRAARSAWSVPFAVALRACAVLGRRLYRMRRQSKAVARVRLVLDEKKVSQFKGQSSRLNESMTMVRRTPIIKPMLPANGVTPWPVLGHL

SEQ ID NO: 41200 - protein, 192 aa, Sorghum bicolor
  Clone ID: SORBI-28MAY03-C26177_1.pep
MQCLPCGPSTNAPAAHAAGRSVSRRRVVVDGVASATHDSDEAPSRSMRATCDLGAMSSKALLLVSKRKLIALSAFCLSLHSSRYFPALALGDTSVKIEDVTPKIFPSGPLFPTEKRIAELFETNTYSVVNIFDATLRPQLNVTGVVEIPEGNGSGVVWDDSGHIVTNYHVVGSALSKNPKPGDVVARVNILA

SEQ ID NO: 41201 - protein, 137 aa, Sorghum bicolor
  unsure (1)..(137): unsure at all Xaa locations
  Clone ID: SORBI-28MAY03-C26376_1.pep
XRHIVAYSVRRVTDFNEIPHHFLHCIQVHLDHTRPKAQINASTATLGHTNQVRPFNNQAATFSASGNAAGNNVSDLVMSVFNDPAAIDREHGLHIKDVANRLKLSEDVVRAVIQHHVDQGDIYNTIDDNHFKSAANG

SEQ ID NO: 41202 - protein, 278 aa, Sorghum bicolor
  Clone ID: SORBI-28MAY03-C2641_1.pep
SGNIRLKIQQSPDYADQPDYEAGLEDFKERVINYEKVYEPVGEGSYIKMIDMVKGQDGQLQVNNISGYLPGRIVFFLVNSHLTPRPILLTRHGESLHNVRGRVGGDTVLSETGELYAKKLANFIEKRLKYEKTATIWTSTLQRTILTASPIVGFPKIQWRALDEINSGVCDGMTYEEIKKNMPEEFESRKKDKLRYRYPRGESYLDVIQRLEPVIIELERQRAPVVVISHQAVLRALYAYFADRPLREVPDIEMPLHTIIEIQMGVLGVEEKRYKLMD

SEQ ID NO: 41203 - protein, 94 aa, Sorghum bicolor
  unsure (1)..(94): unsure at all Xaa locations
  Clone ID: SORBI-28MAY03-C26416_1.pep
NRGKDFSFLGPFLFASLIVLLVFALIXILFPLGKLSQMIYGGLASLIFSGYIVYDTNNIIRRFTYDQYVWAAVSLYLDVINLFLSLMTLFRAAD

SEQ ID NO: 41204 - protein, 248 aa, Sorghum bicolor
  Clone ID: SORBI-28MAY03-C27629_1.pep
HEGSSLAVVHSDPAILPAPAQQIPPATQDVKALADQHVPAIPEVKQADSETTPAREWKPLCDLTSNRRIDWCELDGDVRVLGANASVTLVAPPGADDRTFRAESWRIKPYPRKADPNAMHVVRVVTVQSVSGGGAPACTDRYDVPALVFSDRGYTGNYFRGPSRDMGLRYLEYRITPEESTLIDQYPRDHPIFTDPNGIKSKGWESLKDAYLDKQDVRLDMKRFRPTLKKAIAHLRKAKAKATNGGGN

SEQ ID NO: 41205 - protein, 214 aa, Sorghum bicolor
  Clone ID: SORBI-28MAY03-C27812_1.pep
MEVEIKLRLPDAAAHRRLSAFLAPRLRRTHAQRNLFFDAAARTLAAATAALRVRLYDGPDDRNPLRAVLALKRRPRIDAGVSRVEEIEETLDPALALACADDPARLGGLDSPIIRLVAAEYGVGGDDAPFICLGGFRNTRAVYDYELEDGGGGLVLELDETRFDFGTSYELECETAEPDRVKEVLERLLTVAGVPYEYSQSNKFACFMAGKLLP

SEQ ID NO: 41206 - protein, 193 aa, Sorghum bicolor
  Clone ID: SORBI-28MAY03-C27852_1.pep
ALKYIPDRIAGAAMMAPVVNYWWPGFPPELAAEVYAKQEVGDQWALRVSHHAPGILHWWMDQSWLPTSTVVAGTTPLPNARDAEIRRNMQADGTFQQKREQATQQGIHESYYRDMTVMFGKWEFDPMALPEPPCPVHLWQGDEDGLVPVVLQRYLAGKLAWVNYHELPGTGHFLSAVPGLGDTVLRTLFGQKQ

SEQ ID NO: 41207 - protein, 177 aa, Sorghum bicolor
  Clone ID: SORBI-28MAY03-C27890_1.pep
LVGGARGDRLRHGEREYSIDETPAFRFRTPSARVLRLIPCIAPAVPDTPGLYGDDDHRYFFAAAAAREMDDEEGARGGYCCYGGDDPRSARDVVEEEEEELMSRCGDDEQLLERVVAEACRASTGAAGSVVPGDGAGEDAGVDVKAEEFIARFYAQMKLQRQISWLQYSEMMERSIS

SEQ ID NO: 41208 - protein, 171 aa, Sorghum bicolor
  Clone ID: SORBI-28MAY03-C2792_1.pep
VREKMLNVLQIVQKRNSDPALTGEEVELDFDELDIETLWELDRFVVNWRKALKKSQRNSMMNGDAAAMNGDAIDVTIVPDDDDMVEVAVNPSVVVEIGESETDIPKKREMEAEDEYVDIGDEMPTVNYQSVEIEPDSPAASSSSGSGSGSSSSSDSDSDSESDGDDASAPH

SEQ ID NO: 41209 - protein, 125 aa, Sorghum bicolor
  Clone ID: SORBI-28MAY03-C27972_1.pep
LDEIIDYVKFLQLQVKVLSMSRLGAPGAVLPLLTESQTEGYHGQPLSAPTNTQGLLDALDSEDAFVFEEEVVKLMETSITSAMQYLQNKGLCLMPVALASAISTQKGVSAAAIPPERRNKDMLLP

SEQ ID NO: 41210 - protein, 206 aa, Sorghum bicolor
  Clone ID: SORBI-28MAY03-C26731_1.pep
MVSLSTLFRYAAHKFEYSISLSRKKYNVGQINSTELTDAIWKNYIHGKLTYTHWTKGGEAMAPIVSPTGGTLLVRKLANLSPTQVFVGDVVLLKDPEKSDDLIIRRLAALEGYEMVSNDEKDEPFVLEKDQCWVLADNLALKPKEARDSRLFGPAPMTDILGRVIYSLRTAVDHGPVENSGMAMKQDGPVLAVELDVEEMAKNNKA

SEQ ID NO: 41211 - protein, 151 aa, Sorghum bicolor
  Clone ID: SORBI-28MAY03-C26827_1.pep
QCPVEMASQDTSASSQAIIPVSPAPSDIGALAIVPLCKSKRSEIGQRRIRRPFTVGEVEALVGAVEQLGTGRWRAVKTLAFDNIEHRTYVDLKDKWKTLVHTASISPQQRRGQPVPQELLDRVLAAQAYWSQHLQDKPRGKARLLPEICFP

SEQ ID NO: 41212 - protein, 98 aa, Sorghum bicolor
  Clone ID: SORBI-28MAY03-C26778_1.pep
PLRAMPDFARVYSFLGSIFDPDTSGHLQRLKAMDPIDVETVLLLMRNLSTNLRSPDFEQHRRLLSSYSYGGGDHVKSEGMENHGSAQSGHLPFLVTSE

SEQ ID NO: 41213 - protein, 201 aa, Sorghum bicolor
  Clone ID: SORBI-28MAY03-C26925_1.pep
HEEELNPVPRRCSGTPKVLIPVANGSDEMEVLVTVDVLRRANADVVVASAEGGDAEVVVVARHGTRIVADALLVDAVAAGQQFDFVVVPGGMAGAKTLAGTEALVALLKEHAAAGRAYGAIGAATAEVLEPHGLLELEGKKATTTCASMADSRECGSRVVVDGNLATSSGPGTAMEFALAVVEKLLGAEAAREVAEALLFV

SEQ ID NO: 41214 - protein, 161 aa, Sorghum bicolor
  Clone ID: SORBI-28MAY03-C26950_1.pep
LELRSVAESRNEEIESQLHEVLEKVAQKEAEVTDLTEKLALLEAENEKLTGVNGALKEEVDAKLAMFDELQERFSSTHAEKEEAAEKLAVHERTISQLTEVHTRTLELHSVAESKNEEIEAQFREALETIAQKEGEVKELCKKLDALEIELGYYEQQLHLV

SEQ ID NO: 41215 - protein, 187 aa, Sorghum bicolor
  unsure (1)..(187): unsure at all Xaa locations
  Clone ID: SORBI-28MAY03-C28315_1.pep
FQHRRPRFLLPLFFSGRDCLGVTSHAGASFAPPQGIFPVCTXNITVVASSPNSRHTDPKALVSKNYQGTCFAGPCIENGKKLSWWMVDIGQDYQLMCNYYTVRQDGSTTFMRSWALQGSMDGRNWTSLRVHDDDPTICHPGQFASWPIVGPAALLPFRFFRVALTGPAAGCAWNLCICFLELYGYFR

SEQ ID NO: 41216 - protein, 160 aa, Sorghum bicolor
  Clone ID: SORBI-28MAY03-C28414_1.pep
AAHAGAAEVLAAPPPVRVRLHPQLARGRPTPSGTAGPSAPNDKGKGPSTGRPFRLMDWNPTARTFQWEESPGPESSEPSLRRPHLPSPRRAPVSPLPPGENKNRRRRARKWCFLEEEALRQGVEQYGSGNWKDILNNNPDVFIGRTPVDLKDKWRNMINR

SEQ ID NO: 41217 - protein, 190 aa, Sorghum bicolor
  Clone ID: SORBI-28MAY03-C2842_1.pep
MAAPEAPSCYVGIARQSAAFRLMKQMGWEEGEGLGKDKQGIKGHVRVKNKQDTLGVGVDSPHNKWVYDTTQFDNILKKLKVQSANPIQEEVAAVKSDSPDVTPKEDKSAKAEVTKVTRPQGRYKKRERGKSVSSYSATDLQGILVRKNEDNSQVDQKLEPTCLDEPDPIICPDAVSQADDVNWWGHKFGF

SEQ ID NO: 41218 - protein, 126 aa, Sorghum bicolor
  Clone ID: SORBI-28MAY03-C28498_1.pep
HEAAPGMMQPQISRPPMPNLSAQPVSYPQVVRPPQGMPPPMRPGMQPQMPMPFRPPGVPPAPFPGAPQQFMRGPPPMGPPQVRPGMPGPPPPGMRPGMAPPPCARPRPGMQPPPPGPQQPGQNPPQ

SEQ ID NO: 41219 - protein, 138 aa, Sorghum bicolor
  Clone ID: SORBI-28MAY03-C2850_1.pep
FERAKMQIKVETEGEEKINNSYQSIYKQFIEILNSLGVEDVETVGKPFDPMLHEAIMREDSSEYEEGIILQEFRKGFKLGERLLRPAMVKVSAGPGPEVSAGPGPEVSRDDDPTVVEDSVAPQKIEDVEDDGVDGDAE

SEQ ID NO: 41220 - protein, 120 aa, Sorghum bicolor
  Clone ID: SORBI-28MAY03-C28598_1.pep
QEKLEAEIQCLVMLKARQNWQVRAEDRMALEEHRALSAGDKSRMLLKLRETESKIVMLKEQVDKLEVREKELYRTTEVLKMQSRTFKVSLFGLLQLVMMCLSLKMFFARVSAPFDEVVPT

SEQ ID NO: 41221 - protein, 216 aa, Sorghum bicolor
  unsure (1)..(216): unsure at all Xaa locations
  Clone ID: SORBI-28MAY03-C27293_1.pep
MASLTLPPAPPNPRQDAIDLHKAFKGFGCDSTAVINILTHRDSVQRGLIQQEYRAMYHEELFHRISSELSGNHKKAMSLWILDPAGRDATVLREALSGDTMDLRAATEIICSRTPSQLQIMKQTYYARFGTYLEHDIGHHTSGDHQKLLLAYVGIPRYEGPEVDPTIVTHDAKDLYKAGEKRLGTDEKTFIRVFTERSWAHLASVSSAXHHMYDRK

SEQ ID NO: 41222 - protein, 350 aa, Sorghum bicolor
  Clone ID: SORBI-28MAY03-C27427_1.pep
DLGNAMTEDEGIGLDDLQILKLVGQGAFGKVFQVRKKNTSEIYAMKVMRKDRILEKNHSEYMKAEREILTKVDHPFIVQLRYAFQTKYRLYLVLDFINGGHLFFQLYKQGLFRELARIYTAEIVSAVAHLHANGIMHRDLKPENILLDADGHAMLTDFGLAKEFCENTRSNSMCGTLEYMAPEIVLGRGHDKAADWWSVGILLFEMLTGKPPFVGNRDKVQQKIIKDNLKLPSFLSSEAHSLLKGLLHKEPNKRLGSGPGGSNEIKNHKWFKPINWRKLEARQIQPSFRPNVGGLTCIANFDECWTKTPVLDSPVTTPAGGGHSHFAGFTYVRPAPILEEVNASSSKVKD

SEQ ID NO: 41223 - protein, 174 aa, Sorghum bicolor
  Clone ID: SORBI-28MAY03-C2749_1.pep
LSKYCKFKTVGQVFTKSGWRFAFPRDSPLAEDLSTAILALSENGNLQRIHDEWLSATECSADNNGAASNSLSLSSFWGLFLICGLACLVALVIFFLRIFCQYSRYSNQVEAQFPEPQQILNRPARLTTIKSLISFVDKKEEEVKNALKKRPNASEHPSIGSTEEQSTLPPTSIA

SEQ ID NO: 41224 - protein, 199 aa, Sorghum bicolor
  Clone ID: SORBI-28MAY03-C27615_1.pep
DKTFFIAALLAMQYQRALVLLGSMAALSLMTIVSVIIGRIFQSVPAQFQTTLPIGEYAAIALLAFFGFKSIKDALALPDNANGNLQGNSESGELAEAEELVKEKVSKKLTSPLDVLWKSFSLVFFAEWGDRSMLATIALGAAQSPLGVTSGAIAGHLIATALAILGGAFLANYLSEKLVGLLGGVLFLLFAAATLFGVF

SEQ ID NO: 41225 - protein, 274 aa, Sorghum bicolor
  Clone ID: SORBI-28MAY03-C27752_1.pep
MASPAPASPAAAAAHAPAPRIGLAGLATMGQNLALNIAEKGFPISVYNRTAAKVDSTLSRARDEGALPVLGHRDPRGFVLSLARPRTVVLLVQAGPAVDATIQALTPYLEPGDAIVDGGNEWYQNTERRIEEAAARGILYLGMGVSGGEEGARNGPSLMPGGHVDAYNNIRDILEKAAAQTEDGACVTFVGPGGAGNFVKMVHNGIEYGDMQLIAEAYDVLRRVGGLSNSEIADVFAEWNKGELESFLVEITADIFTVADPLEGSGGALVDKIL

SEQ ID NO: 41226 - protein, 160 aa, Sorghum bicolor
  Clone ID: SORBI-28MAY03-C29116_1.pep
MKPPQFATMKNVNYLPNVLSIMDAEDRGAFASVWVDDEGYVAEGPMVNVAFVTPDNHLVLPAFDKILGGCTAKRMLALAPRLVESGLLAGVSTRNITVEDAKGSVEMAFVGSGLPVLPVVHWDDKPIGDGKVGPLMQALSDLLWEDMKSGPDRIPVPYKH

SEQ ID NO: 41227 - protein, 291 aa, Sorghum bicolor
  Clone ID: SORBI-28MAY03-C2914_1.pep
HEARAPSARACASARVIAGNIDQLVGRNIGVLSESYTVYAIDLLGFGASDKPAGFSYTMETWAELILDFLEEVVRRPTVLVGNSVGSLACVIAASESNREAVRGLVLLNCAGGMNNKAIVDDWRIKLLLPLLLLIDFLLKQRPIASALFNRVKNRDNLKDILLSVYGNKDAVDDELVDIISGPADTEGALDAFVSTVTGPPGPSPIPLMPRLADLPVLVLWGDRDPFTPIDGPVGKFFSKLPSELPNVTLYMLEGVGHCPHDDRPDLVHARLLPWLEALPPPAAGTVTTTV

SEQ ID NO: 41228 - protein, 108 aa, Sorghum bicolor
  Clone ID: SORBI-28MAY03-C29160_1.pep
MRREGRQHGWVFTVDPSLVDAEGKQCRSRAVQVDGAAAANGGFVRAPRKPTNHTKPAVGRAYKALIGKGEAGSGRGRHKFKHDEAKMYHLYLEGADDAYADAMLEFDW

SEQ ID NO: 41229 - protein, 161 aa, Sorghum bicolor
  Clone ID: SORBI-28MAY03-C2919_1.pep
MTSSSSPSRKALSKIACNRLQKELAEWQLNPPAGFKHKVSDNLQRWVIEVTGAAGTLYAGETYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDTV

SEQ ID NO: 41230 - protein, 69 aa, Sorghum bicolor
  Clone ID: SORBI-28MAY03-C29214_1.pep
HSYCHGVLGRSMDKVFHLVISERIWCGGTILSVCNSSTTIFGQDCKLRGTNRKQTCAHHLHVSFTSVAS

SEQ ID NO: 41231 - protein, 103 aa, Sorghum bicolor
  Clone ID: SORBI-28MAY03-C28149_1.pep
MPLTSTYTLLPIFLLLAVVGVCIMLRRTRKQDGEPAYQKLDMSDLPVSVGGKKETDDQSDKWDDNWGDDWDDEEAPMTPSKPLPNPSSKGLASRRSTKDGWKD

SEQ ID NO: 41232 - protein, 392 aa, Sorghum bicolor
  unsure (1)..(392): unsure at all Xaa locations
  Clone ID: SORBI-28MAY03-C28221_1.pep
SSRSEAPARPACASAPQGVGEVVPAREATEGGASAAKGPVVVTGASGFVGSWLVMKLLHAGYTVRATVRDPANVAKTKPLLDLPGATERLSLWKADLAEEGSFDDAIRGCTGVFHVATPMDFESKDPENEVIKPAVEGVISILRACKEAADAGGGTVRRVVFTSSAGTXVSVEERRRPVYGDDGWTDVDFCRRVKMTGWMYFVSKTLAEKAAMAYAAEHGVDLITVIPTLVVGPFLSAGMPPSLVTALALVTGNEAHYSILKQVQFVHLDDLCDAHLFLFEHPAAAGRYVCSAPDATIHGLAAMLRERYPEYDIPRRFPGIDDDLQPVRFSSKKLLDHGFTFRYTTMEDMFDAAIRTCREKGLIPLATAGGGGGSASARAPAPPGTAPPSSA

SEQ ID NO: 41233 - protein, 67 aa, Sorghum bicolor
  Clone ID: SORBI-28MAY03-C28260_1.pep
DGTSLTVVSVDDEGGWFDFMLVRYTQDNIVLPTKKVGDKVNLEADILGKYVEKLLAGRVEAMAKVDS

SEQ ID NO: 41234 - protein, 189 aa, Sorghum bicolor
  Clone ID: SORBI-28MAY03-C28325_1.pep
MDVPDSGGGAPDAGEPIWDWGNLLDFVVQDDDSLVLPWDDAAAGIAAAADPTEAATAPLLPASPPLPQPVEVEPEPEPEPEPEPGPVLPPPPLRVQGIGRRVRKRDPRLVCPNYLAGRVPCACPEVDEMVAAAEVEDVATEFLAGARKKTKTAAAAARRSKAAAAGAAPGAAGGGAARAAAAEMKCQVH

SEQ ID NO: 41235 - protein, 153 aa, Sorghum bicolor
  Clone ID: SORBI-28MAY03-C29496_1.pep
MIHDNLTDRTALVPATHHSNFCPSLQRNASVPPDQSSPSPPPHAQAPYASTPGVDSRPGYSQPEPRPSYSQPYPSSYGAPPQQPPYSAPHPGQYQPPAHQPPPGHDYGQPAYPGWRGPYYNAHQPQQSAPYPQPPYNAPGAYPPHQSNYYRPQ

SEQ ID NO: 41236 - protein, 180 aa, Sorghum bicolor
  Clone ID: SORBI-28MAY03-C29537_1.pep
NPRSYYKCTYAGCSVRKHVERASNDLKSVITTYEGRHNHEVPAARNSNGHPSYGSSAAPQGSSLHRRPEPPQFSMPHAAAAAAYGSLCLPPQLNAASGGFSFGMLPPAMAMAIPVPSLGNFMPAQMPGHGSPMQGCSGLMLPRGEEKVNPEQQSRLPVANGNAAATYQQLMGRWPQGHQM

SEQ ID NO: 41237 - protein, 94 aa, Sorghum bicolor
  Clone ID: SORBI-28MAY03-C29634_1.pep
MAASQQAEKAAELQDPEIRAALDRRVREEGETVIKSGTGGTNLEAQERLAEGRKKGGRSRTTESGKERAEKEGGVVIEPDEKQLQEAMKDIGRN

SEQ ID NO: 41238 - protein, 148 aa, Sorghum bicolor
  Clone ID: SORBI-28MAY03-C2971_1.pep
SDLTEEEEEEYWMVVSAIFEGKETCSLPSESSYADKSSSEPPSSTPLSDPINNKVHLLRTMLQWEEQVRRGASLAEKSLGVNTCTKPILREVAIIFWPNGKIMRMSTGSTAADAARRMGVEGKLLWVNGQVVLPQTELKDGDIVEVRV

SEQ ID NO: 41239 - protein, 171 aa, Sorghum bicolor
  Clone ID: SORBI-28MAY03-C37372_1.pep
AIAGVTAVYVCFGACGYLAYGDATKDIITLNLPSTWSAAAVKVVLCIALALTFPVMMHPIHEIVEARLLAPGGWLRKRGGPVERAALHASRVAVLVALSAIACFVPAFGSFASFVGSTVCALLSFVLPALFHLRVVGHAAGAAQRAADWAILLFGLAFAAHGLYAAVLSRN

SEQ ID NO: 41240 - protein, 147 aa, Sorghum bicolor
  Clone ID: SORBI-28MAY03-C37508_1.pep
MGEGGEEKSFNFLQVLLEGSIAGGTAGVVVETALYPIDTIKTRLQAARGGSRIEWKGLYSGLAGNLAGVLPASAIFVGVYEPTKRKLLETLPENLIAHFTAGAIGGIAASLVRVPTEVVKQRMQTGQFKSAPDAVRLIVGKEGFKGL

SEQ ID NO: 41241 - protein, 152 aa, Sorghum bicolor
  Clone ID: SORBI-28MAY03-C37519_1.pep
MPTGGVFSGSVNLKYVKLGYQYLVNHFLTLLLVPVMAATALELARLGPGELLSLWRSLELDLVHILCSVFLVVFIGTVYVMSRPRPVYLVDYACYKPPASCRVPFATFMEHTRLISDDDESVRFQTRILERSGLGEDTCLPPANHYIPPKPS

SEQ ID NO: 41242 - protein, 454 aa, Sorghum bicolor
  Clone ID: SORBI-28MAY03-C37682_1.pep
TRLKGAAKSATPVNEEVPPLLEGGGKLEVWCIDGNAKTALPKEDIGKFYSGDCYIILYTYHSGDKKEEYYLSYWIGKDSLVDDQVSASQITNTVWNSLKGRPVLGRIYQGKEPPQFVALFQPMVILKGGIGSGYKKLIEEKGATAETYSTEGIALIRVSGTSIHNNKTLQVDAVATSLSSTECFVLQSGNAMFTWFGNSSTYEQQQWAAKVAEFLKPGIAVKHCKEGTARSAFWFALGGKQSYTNKNAPQDIITREPHLYAFSFKNGRLEVTEIFNFSQDDLLTEDMMILDTHGEVFIWIGQCVESKEKQKAFDIGQKYVEHANSIEDLSPYVPLYKVMEGNEPCFFKTYFSWDNTKSLVHGNSFQKKLSLLFGLRSEGASRSSGNGGPTQRASALAALSSAFNPSSQQRLSNERPKSTGDGPTQRASALAALSNAFKTSLKPNKTPPPSRSGQ

SEQ ID NO: 41243 - protein, 90 aa, Sorghum bicolor
  Clone ID: SORBI-28MAY03-C29901_1.pep
CLPPCSHSRFAEFASLILIRVVPSLPSITPIIASSLHIQHKHLHVKCYKNIIILRVPGCCGPLLALLFLRCPPLPHAFRFRQGCRAWYLM

SEQ ID NO: 41244 - protein, 141 aa, Sorghum bicolor
  Clone ID: SORBI-28MAY03-C29924_1.pep
APCNAKNCTFNGVWNGGGGAGQDNLYVASFFFDKASQVGFIDSEAPSVKSTPSAFKAAAEKVCLLSADEAKAGYPDLYDVPYICMDLIYQYTLLVDGFGLAPTKEITLVSRVKYGEFDVEAAWPLGTAIEAVAPKKMNQDA

SEQ ID NO: 41245 - protein, 93 aa, Sorghum bicolor
  Clone ID: SORBI-28MAY03-C29928_1.pep
RRYIRFMTSSDLLMHTTCHISRHLVYILMTHCILSTRLATFTEQGKMKSKQLSHTNRGANQAPLMQYTTPWHPADIFSPEHYDFIPKTQYLLA

SEQ ID NO: 41246 - protein, 347 aa, Sorghum bicolor
  Clone ID: SORBI-28MAY03-C30017_1.pep
MDMDGVLQAADAKDWVYRGEGAANLILSYTGSSPSMLGKVLRVKKILNDKSQQAPSCMVFSSHEQLLWGHIPELIESVKQDCLAQAYAVHVMSQHLGARLGVGGLPVRASRDLLGLVGEDALCRRPAWGVIARAFGFAADAALLIPDHSLFSGNPKGSSCIAVEIKAKCGFLPSSEYISEDNSIKKQVTRYKMHQHLKFHQGEISKTSEYNPLDLFAESKERIRMAIKSFFSTPQNNFRIFVNGSLAFGGMGGGADNVHPADTQKCIEDLSKVSGLDLPDFTELLSETIFKSGVLGKLLTTQKLDDHDIEGAIHLYYNIISQPCLVCKNLTDVELLRKYTLLHSLPL

SEQ ID NO: 41247 - protein, 236 aa, Sorghum bicolor
  Clone ID: SORBI-28MAY03-C30021_1.pep
KKKKKKKPARRFILPSPRMMSPTKDEIGATSSSSTDADGVASRSKAARDVARGAVVELPLHLTEKILCCINPLASARLATVCKSWAATISDRLARPVPHLFVYLPADNKSDRRGRVVSVPIGYDGDDAGAGAGAALPVPAVIPNRVLLADTNGLACIGAMPSGHLAFASWWSKILLLINPITGDRQSVQVEEPRRSLVLAAGGGDDSFISVGTDEHILWRRRAGGGGEEWSRWTEP

SEQ ID NO: 41248 - protein, 132 aa, Sorghum bicolor
  Clone ID: SORBI-28MAY03-C29274_1.pep
HAAGASGGDAGGGKGGKGKGGKSADGLGTCTYVKARHVLCQMLGNVNEAYKNFHDGWLDNGDKVPPAEFAKVAQEYSECPSGKKGGDLGWFPRGKMAGPFQEVAFNTPVGACSAPFKSTHGYHFILCEGRKN

SEQ ID NO: 41249 - protein, 115 aa, Sorghum bicolor
  Clone ID: SORBI-28MAY03-C29255_1.pep
LSRMSILQGLELRLSTSTRLKACLYSFTSPGGPTYPTRAVRHAAWNTLDLLFPIGRYPRHVISLFFRLLYPWYWPSSCWNFVMTCAMTVYYYILNLLVSSWEKLRRPSHQRRHGE

SEQ ID NO: 41250 - protein, 145 aa, Sorghum bicolor
  Clone ID: SORBI-28MAY03-C29306_1.pep
IICLGTMDTSSSPTCGNFSMVKIATSSYRSLSPLRDPDIMIRNLPGPTSPIPSTSNRRITALNPSTVRMNMSLPVSPCSSPLRQYRQSNRSCLPSPPHPAYSAGAANYSPINNALYPMRPSSGLTDPWLEISRPKTQTFDSPRRL

SEQ ID NO: 41251 - protein, 106 aa, Sorghum bicolor
  Clone ID: SORBI-28MAY03-C29420_1.pep
MEFYVDEKWKFSKKSRNNGSRRVPGAGGAGGGDSLLKRSSSMRDVPAIGRRGSGAAGAAAAAAAAGGCAPQPSFSSRCAGLVKEQRARFYIMRRCVTMLVCWKDCS

SEQ ID NO: 41252 - protein, 134 aa, Sorghum bicolor
  Clone ID: SORBI-28MAY03-C29422_1.pep
RSSSKQPKVMEGEIEIEDDAPIRKPSLEEIDALEEARLAIEYIVIPGGEPVELLPRCSEIVARQLELVESYQLLAETFGSDSNPRLQILPVKITKKGSSKDNGVSKPTKQTGSDLIVSENGGGSSFSRLPFLPK

SEQ ID NO: 41253 - protein, 399 aa, Sorghum bicolor
  unsure (1)..(399): unsure at all Xaa locations
  Clone ID: SORBI-28MAY03-C29307_1.pep
MARRELFLALLWLAALALATGPADATRKMVGVYELRKGDFSVRLTNWGARVMSVVLPDCKGNLADVVLGRDTIAEYVNDDVYFGPITGRIAQRVARGRFVLDGKVYHMHRNDGRNTIHGGDRGFSRSIWTVKEYVAGGESPYITFYYRSSGGEQGLPGNVDAYVTYRMSGPYTLGVHMNATALDKATPVNFLLHVYWNLRGEGNGDVLGHTLRLHASRYAVLDDELLPSSGRIEPVAGTPLDFRTPXADRLAHPPGRRHGRPRRRVRHQLHRRRRGRDDAARGAGPGPRVRQGVGAVGKPADHAALHGELSQPHQGKARQGVRQVRWVLPGDDGVRGRREPPXVSVSDTQARPGVQARYGLQVLVLGDARCKTQFTIVVRAHSGISVRYWCLTEANKRV

SEQ ID NO: 41254 - protein, 189 aa, Sorghum bicolor
  Clone ID: SORBI-28MAY03-C37684_1.pep
MAAEAKAPLLEEARRGATPAQTIGNIVVSIVGTGVLGLPFAFRTAGWLAGALGVAGAGAATFYCMLLLLECRDKLREQETEEDGEQHQRCCNYTYGDLGERCFGRIGRHFTEATIILSQTGGTVAYLVFIGQNVSSVFAAEDGHGPLTPATVVLALLLPVQAALSLVRSLSSLGQFSILADACTVLAVA

SEQ ID NO: 41255 - protein, 161 aa, Sorghum bicolor
  Clone ID: SORBI-28MAY03-C30464_1.pep
MGTKNQFDLLVDVDNDDPSHLIAAAEKKAAASPKPAPAAPAKLPTKPTPPAQAVKESRNYGAPARDGPGRGRGGFRGGRTGPRREFGEGNANGVEGGYGGGGFGDSGFQRREEGDGKAMERGRGPRQPYRGGGRRGGYADGEAGDESARPPRRAYERHSGT

SEQ ID NO: 41256 - protein, 236 aa, Sorghum bicolor
  Clone ID: SORBI-28MAY03-C30474_1.pep
MSLRPSERVEVRRNRYKVAVDAEEGRRRREDNMVEIRKNRREESLLKRRREGLQAQFPAPPSGVEKKLESLPAMVSGVYSDDNNLQLDATTQFRKLLSIERSPPIEEVIKSGVVPRFVQFLTREDFPQLQFEAAWALTNIASGTSENTKVVIDHGAVPIFVKLLGSASDDVREQAVWALGNVAGDSPKCRDLVLANGALMPLLAQLNEHAKLSMLRNATWTLSNFCRGKPQPSFDQ

SEQ ID NO: 41257 - protein, 109 aa, Sorghum bicolor
  Clone ID: SORBI-28MAY03-C30524_1.pep
MEWDSESDGAGSVGAGEEEQEQEEEEEERRSEGGGGDAGGAGGMFTFAIEGMLRASGPCGLVVTDALEPDCPIIYVNRGFEEATGYRAEEVLGRNCRFLQCRGPFARRR

SEQ ID NO: 41258 - protein, 161 aa, Sorghum bicolor
  Clone ID: SORBI-28MAY03-C30575_1.pep
MRAKIANFGLAKTGHNAVTTHIVGTQGYIAPEYLADGLVTTKMDVFAYGVVLLELVSGREAADESGEPLWADAEDRVFRGRDERLEARVAAWMDPALAEQTCPPGSVASVVSVARACLHKDPSKRPSMVDVAYTLSKADEHFADYSGESVSVDGSGDIAAR

SEQ ID NO: 41259 - protein, 142 aa, Sorghum bicolor
  Clone ID: SORBI-28MAY03-C30598_1.pep
KIGYNSKLSTLWFAVGIIVYSLEATISVRVSGGSWQDGFHAQIAAHTVSIGCEELILLDSGDDNVPVAGDGAITLSRCVASVEVNGELVVSVRAWQGDEVVHRERGFKPKKAGRSCGTLDIGFCQMDVSVAWSLVSSYRGEW

SEQ ID NO: 41260 - protein, 151 aa, Sorghum bicolor
  Clone ID: SORBI-28MAY03-C29629_1.pep
DLDYIDKLLRLIEKEEIPAPGPIEQRWTARSKSPMSPASSSEEEDIFSWVGIIMYLPTSDARQRKEITEEFFNYRSLAQSLWDDYSAYEHWAKIEVPKDKDELAEVQARLRKRFPVDAYNKARLELDPHKVLSNAKLEKLFPVLEPVHQTK

SEQ ID NO: 41261 - protein, 117 aa, Sorghum bicolor
  Clone ID: SORBI-28MAY03-C29735_1.pep
CPGFPDNVRTNEKGEFWVAIHCRRSLYARLMSRYVKMRKFFLSLPIPAKYHYLMQIGGKLHAVIIKYSPEGQVLDILEDTKGEVVRAVSEVEEKDGKLWIGSVLMPFIAVFDLAKAS

SEQ ID NO: 41262 - protein, 73 aa, Sorghum bicolor
  Clone ID: SORBI-28MAY03-C29770_1.pep
AFAWAFDSPPKGQKLHISCKNNSKFGKKSFGKVTIQIDRVVMLGSVAGEYTLLPESKSGPNRNLEIEFQWSNK

SEQ ID NO: 41263 - protein, 192 aa, Sorghum bicolor
  unsure (1)..(192): unsure at all Xaa locations
  Clone ID: SORBI-28MAY03-C29835_1.pep
TRQRNCIDTIXNVANVCCVQFSPYSSRMLAFGSADYKIYCYDLRNTRIPWCTISGHGKAVSYVRFLDPETLISASTDNTLKIWDLNRTNCSGLSTDSCSLTLNGHTNEKNFVGLSVHDGYITCGSETNEVFSYYKTFPMPITSHRFGSIDPITGQVTNEDNQQFVSSVCWRGKSNMVVAANSSGSIKVLELV

SEQ ID NO: 41264 - protein, 191 aa, Sorghum bicolor
  Clone ID: SORBI-28MAY03-C2988_1.pep
MLASSRSALHSFPVREPPKILDGEGVATQKLIPRHMRNGGSLLDGHITAAVPVVDFSARLQPNEHAMDHRVSFELTVEDVARCLEKKTAISGDSGTASFHLAPTSNGDHHRESNEARAGLYVDETYHDLPEKARRSLSLRLAKDFNFNNVDVANVEPSVGSDWWANEKVAGMTSEPKKNWSFHPVAQPGVS

SEQ ID NO: 41265 - protein, 122 aa, Sorghum bicolor
  Clone ID: SORBI-28MAY03-C2976_1.pep
MAMVASTSFTYHKPRLAVVCRKNKDGRDRERERDGKEHKHPFKVVEITPPPRCLGVRCFPTVANIHCGESVTIEGQAYTVSAVTHRYQLRKGRYEPSEKRLDVLSTGRYILNLYLQNLLDQS

SEQ ID NO: 41266 - protein, 82 aa, Sorghum bicolor
  Clone ID: LIB3480-030-P1-K1-A4.pep
DAWGRGHGWRRTDGRTDTGYAKQNIHCGESVTIEGQAYTVSAVTHRYQLRKGRYEPSEKRLDVLSTGRYILNLYLQNLLDQS

SEQ ID NO: 41267 - protein, 173 aa, Sorghum bicolor
  Clone ID: SORBI-28MAY03-C3090_1.pep
SDQVELSYDGTLLDAASMAAGVSSPNFSAPAKWQQDILSQLNLHGEGAILKVSLGGPDIVDGRLLAALRVLLADDPEALHKHDLKTLMSLDVQAPLGPAIEASALRTVLALCAIALQHFHTKIMDDEAILRGGPPLTTELAVQFRLQKKFMIVDVMQNVSRRIKMLSPQKSTA

SEQ ID NO: 41268 - protein, 176 aa, Sorghum bicolor
  Clone ID: SORBI-28MAY03-C30905_1.pep
TRARSNPGAWLIVRADTTGSSDSWQPWGRLEAWRDAAAASGGKDTVRLRLHLLPDRHDDCVLVSEAPLSSDKGGEFFIDMDRQAPSATAAEHCAASLGAACAGGGFVMSCRVEGEARSSRPFVQLAMRHVTCMEDAAMFVALAAAVDLSVKACRPFRRKPNKKAGSPSPDLLELDT

SEQ ID NO: 41269 - protein, 182 aa, Sorghum bicolor
  unsure (1)..(182): unsure at all Xaa locations
  Clone ID: SORBI-28MAY03-C30938_1.pep
PPPAPFAAGATFPLYAPAPPRLARAAHRPRPGGGPEPPPPAAPGARRGAAPLDAASAAGLAGARVRAPPRPEQNGGGCAGAGARRGVADIEVALAESHANVKVLAPRRPRQLLRMVVALQCLGLTXLHLNVTTTADHLAFYSLSLKMEDECRLSSVDDIAAAVNEILAKISDECAASHLLAA

SEQ ID NO: 41270 - protein, 152 aa, Sorghum bicolor
  Clone ID: SORBI-28MAY03-C30942_1.pep
HEAKEDFHEAGSKALSLFAYGQKVALENGLILVDTKYEFGKTADGTIVLIDEVHTPDSSRYWIANSYEDRFKSGLEPENVDKEFLRLWFKNNCNPYEDAVLPEAPEELVCELAWRYIFLFETITKTKFEILETQEPIHERISRNVAQALLDL

SEQ ID NO: 41271 - protein, 334 aa, Sorghum bicolor
  unsure (1)..(334): unsure at all Xaa locations
  Clone ID: SORBI-28MAY03-C31038_1.pep
ARGSAFPTEFFDRVEAIKPVWAPYYTIHKIMQGLLDQYTVAGNSKALDMVVNMANYFSDRVKNVIQKYSIERHWESLNEETGGMNDVLYQLYTITNDLKHLTLAHLFDKPCFLGLLAVQADSISGFHSNTHIPVVIGAQMRYEVTGDPLYKQIASFFMDTINSSHSYATGGTSAGEFWTDPKHLAGTLSTENEESCTTYNMLKISRNLFRWTKEIAYADYYERALINGVLSIQRGTDPGVMIYMLPQAPGHSKAVSYHSWGTKYDSFWCXYGTGIESFSKLGDSMYFEEKEDLPALNIIQYIPSTYDWKAAGLIVTQKVNTLSSSDQYLQISLS

SEQ ID NO: 41272 - protein, 243 aa, Sorghum bicolor
  unsure (1)..(243): unsure at all Xaa locations
  Clone ID: SORBI-28MAY03-C30213_1.pep
TRAILKAAELAAEAVFXAGTIIGMGEPLPFTLRELLEAGPNGYCTSASVRNKSGSGNDNPVTETLEVDATANFNKSGRKRGRKPKCDQALPSSEPSSSCKELQPSGVHPGHGVVEDVPVTVSLDGNNVTAPISIIWNGIEKGSAVEVLSDKCGFGVAWFSAKVIDINANNAFVNYGDHNGTGPGEEWVPLRQEGDKPPRIRLAHPATLSKFKTRKRRXETAGSCLWVIGDHVDAWVIIAVGER

SEQ ID NO: 41273 - protein, 155 aa, Sorghum bicolor
  Clone ID: SORBI-28MAY03-C30251_1.pep
PPESNSSVHDSTSSPSPLGSSFSLHRIELFHHPNRAHCRRIEVSAGRARALEKEEETGEQGDQTGGGKHAKQASAFGVPSLTGARVRARARAELQPHFHGPRRPLFPLPIVGLLLVRPLLPSSHSTGFGLECPTWSGDLPEQGIDSSSGVTAWCF

SEQ ID NO: 41274 - protein, 217 aa, Sorghum bicolor
  Clone ID: SORBI-28MAY03-C30356_1.pep
VASLIAGTVNRSAFMEDWMLPSPSPRTLMPSFFNEEFSSAPFSNIFSDDRSNKPLDEIEKSKTFIGSSAQETSQDTKDHPQTESNLFSANQKSTSPGGLAERMAARAGFGVLKIDTSRVSSSGAPIRSPVTIPPGVSPRELLESPVFLPNATSQPSPTTGKLPFLMPNNFKSTMPSVPEKSEDHSHEDSAFSFQPILRSKPSTLWTAKKGSSVGHQT

SEQ ID NO: 41275 - protein, 155 aa, Sorghum bicolor
  Clone ID: SORBI-28MAY03-C30408_1.pep
MASISGAAAPPSSAACRLRLLPRHLLLRPSHLRLLRAPHSIADLSRSSSSNSAPTPAQPLPENGSGVRAVEKDPIKLWERYVEWLYQHKELGLFVDVSRMGFTDDFLQQMEPRMQQAFAAMRELEKGAIANPDEGRMVGHYWLRDPALAPNSFLR

SEQ ID NO: 41276 - protein, 241 aa, Sorghum bicolor
  unsure (1)..(241): unsure at all Xaa locations
  Clone ID: SORBI-28MAY03-C30462_1.pep
MSRYDGRAADAGSYRDRRSEGAFGGGSRAFAAPSKADASAAASELDGLPRFEKNFYVESPSVAGMTEEEVEAYRRRREITVEGRDVPKPVLEFRDVGFPEYVLQEITKAGFVEPTPIQSQGWPMALRGRDLIGIAETGSGKTLAYLLPAIVHVNAQPILAPGDGPIVLVLAPTRELAVQIQQEATKFGASSKIKSTCIYGGVPKGPQVRDLXKGVEIVIATPGRLIDMIESHHTNLRRVTY

SEQ ID NO: 41277 - protein, 253 aa, Sorghum bicolor
  Clone ID: SORBI-28MAY03-C3128_1.pep
GDGHPFLARLGFVLSSTIPSSVARSLPAASRKFLRDLLYIRCAGPAVVVVSAHPASRQPPPAVPIPGTFVASGDAFSNHRHRTMSMNYDGDRSEDRQSEEVQSAYKRDSDIGEEMIISSEEQNDENEWSWVNQDRNGDPLAESVSSLHTTQQVLENEIQKLSELGKELEAEESTSGNKDQDVIVLPYAVVDMLELNEKMEHLEQKVKEASNTIREKDLKLSKLQVLIGTTDRAALEEATASIDQLETELEHHL

SEQ ID NO: 41278 - protein, 136 aa, Sorghum bicolor
  Clone ID: LIB3481-018-P1-K1-E10.pep
MFVLTTSVFCVYCLEIQKLSELGKELEAEESTSGNKDQDVIVLPYAEVDMLELNEKMEHLEQKVKEASNTIREKDLKLSKLQVLIGTTDRAALEEATASIDQLETELEHHLQEKLEAEISGLVMLKARQNWQVRAE

SEQ ID NO: 41279 - protein, 221 aa, Sorghum bicolor
  Clone ID: SORBI-28MAY03-C31948_1.pep
MAGGDLETAAAPLLPPPASSLADEPSSASPPPEDRLGFAYLIFFTLGAGFLLPWNAFITAVDYFAFLYPGAPVDRVFSISYMVSAFLPLVVIVLFFPKSSAPFRINTGLTLFTLALLIVPAMDAVYVKGKPGLYGAFDVTVAATALCGIADALVQGGVIGFAGELPERYMQAVVAGTAASGVLVSAMRVFTKALYPQDAHGLRQSAIIYFIAGIVLMIICI

SEQ ID NO: 41280 - protein, 147 aa, Sorghum bicolor
  Clone ID: SORBI-28MAY03-C31957_1.pep
HEEEVHDYLKSLCPDLHITRGEYDEDARYPETKTLTIGQFKLGLCHGHQVVPWGDLDSLAMLQRQLDVDILVTGHTHQFKAYKHEGGVVINPGSATGAYSSITYDVNPSFVLMDIDGLRVVVYVYELIDGEVKVDKIDFKKTATMHA

SEQ ID NO: 41281 - protein, 130 aa, Sorghum bicolor
  unsure (1)..(130): unsure at all Xaa locations
  Clone ID: SORBI-28MAY03-C3209_1.pep
TRAMSRAFGDYCVKDYGVISVPEVTQRRIAAGPLVASPSADGVPFVASSLLFYGGRPCLMTDDDTXTSAGGVWDVLSNDEAVRIVAGTPDREKAAKRLVECAVHAWRRRRRGFAVDDCSAICLFFHSPSS

SEQ ID NO: 41282 - protein, 361 aa, Sorghum bicolor
  Clone ID: SORBI-28MAY03-C32117_1.pep
MSVAAAAVDRTDELRALDATLAGVRGLVASGAKQVPRIFRVPYPEEQPPAAAAATVPVIDLSGGGDRAAVVDAVRGAAAEWGFFQVTGHGVPEQVMSAAVAAMRAFHEAGGGEGSDKARLYSREPGKAVKYHCNFDLYQAPVANWRDTLYLRIAPDPPAAADLPEICRDALFEYAKQVKDLGDRLFELLSESLGLKPSYLTDIECNQGQIILGHYYPPCPQPELAIGTSRHSDSGFLTILLQDGVGGLQILHDDQWVDITPTPGAFIVNIADLLQLISNDKFISVEHRVVAKNAEPRVSIACFFSTHFHPASTRMYGPIKELLSEENPPLYRETLVREYVARYYSVGLDGKQKTALADFRL

SEQ ID NO: 41283 - protein, 113 aa, Sorghum bicolor
  Clone ID: SORBI-28MAY03-C30729_1.pep
HEAQLVPRTGGREMNAGLSVIGRLNEEFEQRSQVFADDAKFLVEVKSGQADASLNPDMELRRLKQNFDSWKKDFSGRIRETKVILNKLGNGNESSPNSVKRKWWGRLNTSKFS

SEQ ID NO: 41284 - protein, 152 aa, Sorghum bicolor
  Clone ID: SORBI-28MAY03-C3076_1.pep
HEASFSIGFVLFVRPLFFRGSLAYIFTESQAVAKAVADLSPLLAFSILLNSVQPVLSGVAVGAGWQSVVAYVNVTSYYLIGIPLGAVLGYVVGFEVKGIWIGMLLGTLVQTIVLLFITLKTDWEKQVAVAQERLKRWYMQENRRLQGLSGNS

SEQ ID NO: 41285 - protein, 115 aa, Sorghum bicolor
  Clone ID: SORBI-28MAY03-C30772_1.pep
LFIVFVAYFWRQSSCFSRGTSSYRGVTRRKDGKWQARIGRIGESRDTKDIYLGTFETEEEAAEAYDLAAIELRGVHAVTNFDISNYCEVGLRKLEGPSEVVNLEGPSEVMKHAGQ

SEQ ID NO: 41286 - protein, 126 aa, Sorghum bicolor
  Clone ID: SORBI-28MAY03-C30786_1.pep
GHAWTTDYGCSDKEEEFQWLIKYSPLHNVRRPWEQSSGNHCQYPATMLLTADHDDRVVPLHSLKLLATLQHVLCTSTEDSLQTNPIIGRIDRKSGHGAGRPTQKLIDEAADRYSFMAKMLGASWTE

SEQ ID NO: 41287 - protein, 155 aa, Sorghum bicolor
  unsure (1)..(155): unsure at all Xaa locations
  Clone ID: SORBI-28MAY03-C30859_1.pep
RQEAIESLGADEFLISRDPEEMKAATGTMDGIIDTVSAWHPITPLLALLKPLGQMVVVGGPSKPLELPAYAIVPGGKGVAGNSVGSVGDCQAMLEFAGKHGIGAEVEVIKMDYXQHGDRAAREERRSLPLRHRRRRQPRLCCLGMAEKFESEPNN

SEQ ID NO: 41288 - protein, 187 aa, Sorghum bicolor
  unsure (1)..(187): unsure at all Xaa locations
  Clone ID: SORBI-28MAY03-C32807_1.pep
ARGPTPYSGGSMMGAGGMYGMPMDRYGPIPVGPGPMGTRAGSYSDEGSQKKPAGAGRDNDWECPNCHNINFGFRTVCNMRKCNTPRPENQGSKPDGLRGSKPKMPEGSWKCEQCNNINYPFRTKCNRPQCGAEKPSQTNNVNDSATDQDNHNEGQGGPASSSRFSXMWGTSVSVVAAVVTSFFPLRP

SEQ ID NO: 41289 - protein, 224 aa, Sorghum bicolor
  Clone ID: SORBI-28MAY03-C32910_1.pep
MDSTQDFQPRTFSIKLWPPSESTRLMLVEKMTKNLSTESIFSRKYGLLGKQEAHENAKRIEELCFASADEHFKREPDGDGSSAVQLYAKETSKLMLEVLKKGPSTTAELETPVADTPLVPADTVLDISGGKRAFIEALDISGGKRAFIEADEAKELLSPLTKPGNSYQRICFSNRSFGIGAANVAGPILESVKNQLTEVDISDFVAGRPEDEALDVMRIFSKAL

SEQ ID NO: 41290 - protein, 304 aa, Sorghum bicolor
  Clone ID: SORBI-28MAY03-C32969_1.pep
MEIEEAAGGGEIGEMEAPAVSTVAVAVSGGRSSKHALKWAPRGFVPEGRVLFRILHVHPAITMVPTPMGNFIPISQVREDVASAYRKEAEWQASNMLVPFQKMCAQRKVEAEAVLLESDDVASAISEEIGKFNICKLVLGSSSKNIFRRKLKGSKTATKISECIPSFCTAYVISKGKLSFVRSATSDIAETPRSISSSTVSSPSTRSLSSCGPSEWGDTYGTANVPLHQPSLPLQRDQALAIINKLSNRRASSSSSVVSEVSYNDEPALTRSHSIISEMQFSSGSSGNSVYKSFQRDNLPDNSD

SEQ ID NO: 41291 - protein, 151 aa, Sorghum bicolor
  Clone ID: SORBI-28MAY03-C3292_1.pep
LCVQLKATNCLIYDKCSNWIQSSSVVDIYENCIISSWNSQKSKPRPERSQLQNKERAFQLLRANPYEKKLREQQESIRNQRKMQVGTGARSEKIRTYNYKDNRVTDHRLKMNYELTGFLLGDIESAVQSCATLEQQELLEEMASSVGAVNV

SEQ ID NO: 41292 - protein, 77 aa, Sorghum bicolor
  Clone ID: LIB3478-032-P1-K1-B2.pep
EIGNRVGPYEKFCHPLWSVLLPVQLKVGTGARSEKIRTYNYKDNRVTDHRLKMNYELTGFLLGDIESAVQSCATLEQ

SEQ ID NO: 41293 - protein, 419 aa, Sorghum bicolor
  Clone ID: SORBI-28MAY03-C32971_1.pep
TTSLAPLPVLAAARPAPLRGRNRATQMRLFDFFRARPDLQTPVELTTAAHRELCYRQLRALVREAGVRPLTLMANDPAEYFAVMEAAGGADISLGVKLGVQYSLWGGSVINLGTKKHRDKYFDAIDNLDYPGCFAMTELHHGSNVQALQTTATFDPVTDEFIINTPNDGAIKWWIGNAAVHGKFATVFARLILPLQGKGGEPADMGIHAFIVPIRDLETHAVLPGIEINDCGHKIGLNGVDNGALRFCSVRIPRDNLLNRFGDVSRDGKYTSSLPTINKRFAATLGELVGGRVGIAYWSVGVLKVAVTIAVRYALLRHQFGPPKQPEISVLDYQSHQNKLMPMLASSYAFHFATVMLVDKYSEMKKTNDEDLIADVHVLSSGLKAYITSYTAKSISICREACGGHGYAAANRFGALRND

SEQ ID NO: 41294 - protein, 180 aa, Sorghum bicolor
  Clone ID: SORBI-28MAY03-C3104_1.pep
VRTCFLDIEKACQGLDQSIGSDGVLNMTIFRQGKEIDLIVGTDVRDGNGTTRMVNWCGCIIQDPHSAVRALGFLPEEGHGVYVARWCHGSPVHRYGLYALQWIIEVNGQPTTDLETFIQVVKGLEDGEFVRVRTVHLNGKPRVLTLKQDLHYWPTWELSFEPETATWRRRIIKALQSTKA

SEQ ID NO: 41295 - protein, 185 aa, Sorghum bicolor
  Clone ID: SORBI-28MAY03-C3116_1.pep
VRWYTASSGLPPLFDEHKIRTALQKIFEFNVMKVKGGRMGAVNGMTPKGKVDETCMQSREIWTGVTYAVAANMLLHGMEHQGFTTAEGIFIAGWSEEGYGYWFQTPEGWTTDGHYRSLVYMRPLAIWAIQYAVSPPKAILEAPKVNLMDRIHISPHMARAISEISIRKIAPDNRCFPSSAFHCEC

SEQ ID NO: 41296 - protein, 193 aa, Sorghum bicolor
  Clone ID: SORBI-28MAY03-C31108_1.pep
MASRFRGSPSFSSSSPPSSKANPWPAPSAPPLYPTLSMADLAPVEIGPVASSPTAPASPSEYDNAPPPSEDVLLRVPGAQLHLIDRSRSHPLAAGDLSLLRIRSGDTSLAAIALLEPVQWPLARDVAAVKLDPCHYAFSLTVPASADDPSPDPLHYGLTLAHPDARLDGILAAYTSFSVHAVVGTKELEGRVR

SEQ ID NO: 41297 - protein, 203 aa, Sorghum bicolor
  Clone ID: SORBI-28MAY03-C31093_1.pep
MAEPAATPTTAAGRKTRVGPYEVGKTIGEGSFAKVKHARDSRTGAVRAIKVLDRNHVLRHKMVEQIKREISTMKLIKHPNVVQLHEVMASRTKIYMVLEFVDGGELFDKIVNSGRLGEDEARIYFHQLINAVDYCHSRGVYHRDLKPENLLLDSHGTLKVSDFGLSAFAPQTKEDGLLHTACGTPNYVAPEVLADKGYDGMAA

SEQ ID NO: 41298 - protein, 122 aa, Sorghum bicolor
  Clone ID: SORBI-28MAY03-C31423_1.pep
VDKVAINSTAEIIGIRRGDVIVSVNGVCSQTMPELEEYLLSLGWKFLERKNKSSKIVLKLKVYDPIKCLEHTLSLPLGFYCLTAVKERVKVQVTEKISPDIKRKKTTTVPIPSGRVLRPRKK

SEQ ID NO: 41299 - protein, 119 aa, Sorghum bicolor
  unsure (1)..(119): unsure at all Xaa locations
  Clone ID: SORBI-28MAY03-C31781_1.pep
MDRIVGGKFKLGRKIGCGARGQHDLASPVVXAAKIYNTLQGGSGIANVKWCGVDGEENVLVIDLLGPSLEDLFCYCGRKFTLKTVLMLAEQMIXRIEFMHSKGYLHRDIKPDNFLMGLG

SEQ ID NO: 41300 - protein, 168 aa, Sorghum bicolor
  Clone ID: SORBI-28MAY03-C33246_1.pep
LLDPSLLESLPPPAPPPLISRRPPAAPYRCCTPAPPPSLPGRRRQRRHRPSSPPPPRPPHPSPAPPRPWPRPGSAPPPSPQPAPPPLLPPTALTSIEERSKQNQLFSFLVLGLVCVSLVVGGVGDSDTTKEGGEEGGGVKRRKEKRNDGKIKTGARRRFERGSWPGER

SEQ ID NO: 41301 - protein, 120 aa, Sorghum bicolor
  Clone ID: SORBI-28MAY03-C33333_1.pep
PEADARARLLANKEVLHHIQSLNPYPNSCETEVAGIRRLRGLASSLTKRSAATSRPKASGTARDSESRRPEATARARELTGEEVLIDEEVEILKGSSISIVSSYTNIIVPCSTTNPGISP

SEQ ID NO: 41302 - protein, 253 aa, Sorghum bicolor
  Clone ID: SORBI-28MAY03-C3335_1.pep
TRNQCKNKIESMKKRYRAESAAVARAGPAAAGPSWRFFGRMDGLLKGPPVCSAQVQPPELVNSIDLRAPAKPEAAEVEADFPTQLRDAVPGALSDLMNIDANGAAVPEKAEKVDNSMHKECRPADSDANVSSPRSKVANEDVEEVNNVWDRTKKRKSTDFDIAKSIELLASSFLKIEHARLEMYRETERMRVEAEIKKGEMELKRTEIMAKTHLQIARLFAKKLKQSSGKNGGSSSVTAEVDTLTKKGENGSG

SEQ ID NO: 41303 - protein, 246 aa, Sorghum bicolor
  unsure (1)..(246): unsure at all Xaa locations
  Clone ID: SORBI-28MAY03-C33367_1.pep
LCPRASIRFEAPRPEGISRARRCGPPPALRRPPPPRPPPPPAPPATXPPPGPPPXAAPRPWRGRPPTPPRRPPSPPPPPPPPPRRPPRPPPAPAPAAAPAGPPAPPGPPPRPAPPPRPPARGPPAPPPPAPPPPPRAPPRAPPPPPPAPAAPPPPRGRRRAAPRAPXPPCSPAPAGAPSPSPSPPGLARPRAPPPPPSRXPPPQGPRQEGPPLPRGPAPPPVRHDHGQPGIRCLAQGREREARERQ

SEQ ID NO: 41304 - protein, 191 aa, Sorghum bicolor
  Clone ID: SORBI-28MAY03-C33407_1.pep
MQPDNAGKPIRCKAAVSKAAGQPLEMEEVEVAPPRAHEVRVRIICTSLCHTDITFWRMKDFPAMFPSILGHEAIGVVESVGDHVHEVGVGDAVVPVFLPQCGECADCVAWWRAWGSMSRRWPWGTRWCRCSCRSAASATTACPPAATSAPCWRTARAAGPRPAPRAARAPPPARPPAPACPPPAAVTTGVG

SEQ ID NO: 41305 - protein, 257 aa, Sorghum bicolor
  Clone ID: SORBI-28MAY03-C33414_1.pep
MDSTPAPEAAPGASSSSAAAAEDLAGAVAAMSLDERFDLLRGIGEECIQEDELRNLLQKKPVPICYDGFEPSGRMHIAQGIVKTINVNKMIRAGCRVKIWIADWFAQLNNKMGGDLKKIQTVGRYMIEIWKAAGMNLDGVEFLWSSEEINSRAHEYWPIVMDIARKNNVKRITRCCQIMGRSESDDLTAAQIFYPCMQCADIFFLKADICQLGMDQRKVNMLAREYCDDIKRKNKPIILSHRILISDFDCVIFFFSF

SEQ ID NO: 41306 - protein, 67 aa, Sorghum bicolor
  Clone ID: SORBI-28MAY03-C32185_1.pep
PSASGRDLLDFGPPGLPLLLLGFAPPSSPHRGLPSDPLRAVFICPPCSFLMFYFVSLLLTGEAISSH

SEQ ID NO: 41307 - protein, 129 aa, Sorghum bicolor
  Clone ID: SORBI-28MAY03-C32317_1.pep
FIDLFFILSSIWLGRFYYVFGFLLVVLLLLIVVCAEVSVVLTYMHLCAEDWRWWWKAFFASGTVALYVFLYSINYLVFDLRSLSGPVSAMLYIGYSFIVSVAIMLATGTVGFLTSFSFVHYLFSSVKID

SEQ ID NO: 41308 - protein, 96 aa, Sorghum bicolor
  Clone ID: SORBI-28MAY03-C32338_1.pep
QQNWWCEATRDMEVVLSVNVTGSSSTEAVTHRITVRHCCPVPSAPPPVNPHSISDSPSDAESGSKNNQLNHLLRSDFAKFGSSEVHDLCGVRKRSL

SEQ ID NO: 41309 - protein, 267 aa, Sorghum bicolor
  Clone ID: SORBI-28MAY03-C32500_1.pep
TRLNRFAELLIHKPGEGFLLWLLATLLAPLRWLFSKFAESYYSIPMKKYDMVPDHSLFQALATCLVAIEPKGFYKRLEEGSIVLKKSKTFTFCKDGVVVEGEELSPLEGDIVIYGTGFRGDLKIKDMFTSEYFRSIAVGSTCTTVPLYRECIHPKIPQLAVLGYSESIANLYTSELRAKWLAHFMDGGFRLPNVTAMQKDILEWEKCMKRYAGRYFRRSCIGLLHIWYNDQLCRDMGCDPRRKKGFLQELFGIYGPGDYADLHPKKD

SEQ ID NO: 41310 - protein, 150 aa, Sorghum bicolor
  unsure (1)..(150): unsure at all Xaa locations
  Clone ID: SORBI-28MAY03-C32681_1.pep
EINAKAALDLAECLTAMQSLKKLTLAENELKDDGAVIIAXSLEDGHTDLKELDVSTNMLQRVGARCFARAVADKPAFVQLNINGNFISDEGIDEVKEILKAGKKSLDVLGSLDENEPDGEPDDEEEDEDAEDNEDELDLKLQSVKVEQDD

SEQ ID NO: 41311 - protein, 137 aa, Sorghum bicolor
  Clone ID: SORBI-28MAY03-C33645_1.pep
MQCPMDTAASGTSPVLQFHSNADESTSHSSPLPTLIERSQRHCCGDGIPGEFPLAVSPSIVLHVLSACDLDPKDLANLEATCTFFSKPANFAPNFALSLPELAAFDMCQKRTMFKLMKQEDQECLKQRCGGSWKHVL

SEQ ID NO: 41312 - protein, 197 aa, Sorghum bicolor
  unsure (1)..(197): unsure at all Xaa locations
  Clone ID: SORBI-28MAY03-C33650_1.pep
MAGQSSDSNPTDVLEEYMLLEKDPDLYRMVFSGPSQISPWIDPSVLNLKHRIGRGPFGDVWIATHHQRTEDYDRYHEVAVKMLHPIKEDQLQFFSARFDEIFSKCQGLGNVCFLHGISTQNGRICIAMKFYEGSVGDKMAQLKGGKLPLSEVLRYGADLARGVLDLHTRGILILNLKPCNFLTDENDHAVLGDFGIX

SEQ ID NO: 41313 - protein, 163 aa, Sorghum bicolor
  Clone ID: SORBI-28MAY03-C33658_1.pep
SRLPPTRPPVPQASPLSVPLPSCTPRSLRRPAAGALRRRSAPAAPRRRSSHPRPLPSPFCWGVAPPGRRCPPPRTPPLAPTQLRPHLASPPSPSLFPAGSCVVVRTAAPAMCGPPAAAPPGSLPSGLAPVVGVLSHVGHGQAVSRFALVPLAVLFLCGAALNC

SEQ ID NO: 41314 - protein, 170 aa, Sorghum bicolor
  Clone ID: SORBI-28MAY03-C33680_1.pep
GYGHRLPRLPHFPSSRRREEAGRRATRPRAAEMDPDFSPGGGGPSFEFAFNEVNFSDRELRIEVVAGDDDAPGSSGGGAGGGGLADWARHRKRRPEELLKENQAAPLASVQASPPGVGPDGGDAHGVDPAGPVAGTPVSRVKTIYISSAILAAKSPFFFKLFSNGMKESD

SEQ ID NO: 41315 - protein, 207 aa, Sorghum bicolor
  unsure (1)..(207): unsure at all Xaa locations
  Clone ID: SORBI-28MAY03-C33695_1.pep
MSDLASTCKDKLAYFXRIKELKDILNQLGLPKQGKKQDLVDRVLAILSDEQGQRHHGWGRRNAVTRETVAKVVDETYRKMQVCPPDLPSRSHSGSDFNHFRPKEESTDFYHVETKVRCLCNSTMLNDNMIKCEDGKCQVWQHITCVLMPVSPPVGGGPDLPPLLSGDWRRLHPADPFAVTAGNPLLPVKFMSSGVGNDGASVPQIVE

SEQ ID NO: 41316 - protein, 135 aa, Sorghum bicolor
  Clone ID: SORBI-28MAY03-C33720_1.pep
MASSSAAAATSDDSQGLKARDVCIVGVARTPIGALLGSLSSLPATKLGSIAIQGALKSAKVDPALVQEVFMGNVLSANLGQAPARQAALGAGLPNSVPCTTVNKVCSSGMKAVMFAAQSIHLGINDVVVAGGMES

SEQ ID NO: 41317 - protein, 103 aa, Sorghum bicolor
  Clone ID: SORBI-28MAY03-C33001_1.pep
MGSRFPSHQLSNGLYVSGRPEQPKEKAPVICSSAMPYIGGDIKKSGELGKMFDLHRKSGLVRFRPPCLAPVGRPGHNSGPVSNAVGRSNYSGSISSAVPGTGG

SEQ ID NO: 41318 - protein, 188 aa, Sorghum bicolor
  Clone ID: SORBI-28MAY03-C3300_1.pep
RPINIILGAAKGLSYLHHDCSPRIIHRDIKSSNILLDGNFEARVSDFGLAKLLEDEESHITTIVAGTFGYLAPEYMQFGRATEKTDVYSFGVLVLEILSGKRPTDASFIEKGLNIVGWLNFLAGENREREIVDLNCEGVQTETLDALLSLAKQCVSSLPEERPTMHRVVQMLESDVITPCPSDFYDSE

SEQ ID NO: 41319 - protein, 123 aa, Sorghum bicolor
  Clone ID: SORBI-28MAY03-C3312_1.pep
QALTRYLTDAMRESRVLEFLHALEPLAYRKMDFEEFCAAAISPYQLEASERWEEIAGTAFQHFEQEGNRVISVEELAQELNLAPTHYSIVQDWIRKSDGKLNFLGFTKFLHGVTIRGSNTRRH

SEQ ID NO: 41320 - protein, 181 aa, Sorghum bicolor
  Clone ID: SORBI-28MAY03-C33045_1.pep
TRDTFAFEDFDPDSQIVYIDGAFDLFHAGHVEILRLARELGDFLLVGIHTDQTISSTRGRHRPIMNLHERSLSVLACTRVDEVIIGAPWDVSKDMITTFNISLVVHGTIAENMDFAEDDSNPYAVPKAMGIYRRLESPLDITTSTIIRRIVANHEAYQKRNEKKEASEKKYYESKSFVNGE

SEQ ID NO: 41321 - protein, 112 aa, Sorghum bicolor
  Clone ID: SORBI-28MAY03-C33170_1.pep
REARLLSLPALHEAFLLPPLFSTDQESLHRLFAGHFISVGAFFRPIGGNRRVVCVSFLYLLQALSWGVEFGRLLLQAVFYRAGFWYPVILACCRRQGEELGLAPGQIRALLR

SEQ ID NO: 41322 - protein, 407 aa, Sorghum bicolor
  Clone ID: SORBI-28MAY03-C34099_1.pep
MAAPPSPSSPSSSGEVAAHRFGGTMDASSSPSRTELVAMVKKHSHLIGWTIVDAEDDASDVGMDDKFWHEMLDLFFVRGRQPKRSEDDDLVFFVNNMKLHGYGFNDNMEDPPPFFVRRWAPTLEKISINTVEVDWERSFYLNLIAHTSYTVTVAIFGIGDLRNRAAKSKQLSPVYKVTKTVYASPSRVNFHLDRRKAVETVPAYPNIFFSVDDFDDTFDAVVLSDPEHCYCVILNAHDGAAFPEETESKNPVSNIQPGVSCGSAQEKPPKRTLFSGYVSYQNVREAYDAGRSKFGSFLSLGHDHNKLDRLFMRGPEGRGEVEVAVCGIADQSREKSKKDPGDSFRVLVHRAASAASKLAKHAYDSASANKRMDDELVPLKCCLMSVSLPWDYIAHDLLHKDTPPLDL

SEQ ID NO: 41323 - protein, 128 aa, Sorghum bicolor
  Clone ID: SORBI-28MAY03-C34178_1.pep
APYITESKRNYVFGGISSVAANASIKALAQMKSINLLGVQQICRNSIALEQALAAIPSIDSEAVQQRLDRVRTFYELLNLPFESLLGFIAEHEYLFSAKEYLSVLKVNVPGREIPVDAERRISQILGH

SEQ ID NO: 41324 - protein, 127 aa, Sorghum bicolor
  Clone ID: SORBI-28MAY03-C34190_1.pep
SPCNPASSADLAATQPPLKKMATDATANSMASASMGGNMQGAMDGFSNQLANPGMMQASSSGQMVESIPSAAIRRDQGSDLAQRVSAVLRQAWKEDQDTGHLLGSLYEVFGEAIFSFVQPPEISLFV

SEQ ID NO: 41325 - protein, 123 aa, Sorghum bicolor
  Clone ID: SORBI-28MAY03-C34206_1.pep
VVEPPESIESVPDAPSIEEVDDTIILCLGQMAVTARSDVLWKPLNHEVLMQTRSDKVRPKMLGLKVIRYMVQHLKEEYVVLLPETIPFLGELLEDVELPVKTLSQEILKEMETLSGESLRQYL

SEQ ID NO: 41326 - protein, 184 aa, Sorghum bicolor
  unsure (1)..(184): unsure at all Xaa locations
  Clone ID: SORBI-28MAY03-C41701_1.pep
ARGNAEARGFCSASLVQGLCYMRCHGNVDVSLSSISCLQRLVQLSWSVDRVIQGAKKSCSECFNESGTGVAGKLLGEGISSLWHNDLLHLLTSLLPMISSQWSISQNIEMFGRGGPAPGVGFGWGACGGXGFWSLKCLLAQLDSQLVVELMKCFSSVQGSPVILDEGVKSDNVTNTVVTASNWI

SEQ ID NO: 41327 - protein, 327 aa, Sorghum bicolor
  Clone ID: SORBI-28MAY03-C41789_1.pep
HEAAITSVAEESLAKVKLSQVTNARAGSYSGGMKRRLSVAIALIGDPKLVFLDEPTTGMDPITRRHGSGIIEEAKKGRAIVLTTHSMEEADILGDRIAIMAKGKLRCIGTSIRLKSKFGTGYIANVNFSGNGHMQSPNINSITEALANPNIEAVKWFFKERLDINPKEESKTFLTFVIPHHKESLLTRFFGELQDREGEFGISDIQLGLTTLEEVFLNIAKQAELESSTAEGTLVTLNLTSGATIQIPKGARFVGIPGTETEEHPRGLMVEVYWDQDENGSLCISGHSDEMPVPVHAEPRRPPSLSRRASMGRGGPVGYVIDLNQAP

SEQ ID NO: 41328 - protein, 132 aa, Sorghum bicolor
  unsure (1)..(132): unsure at all Xaa locations
  Clone ID: SORBI-28MAY03-C419_1.pep
MGVKGFVEGGIASIVAGCSTHPLDLIKVRMQLQGEAAAAPQPALRPALAFHAGGHAVTLPHHDIPVPPPRKPGPLTVGAQILRSEGARGLFSGVSATMLRQTLYSTTRMGLYXILMTKWTPPADNNGNGGVL

SEQ ID NO: 41329 - protein, 340 aa, Sorghum bicolor
  Clone ID: SORBI-28MAY03-C41902_1.pep
ARGLLDTYVMGIGEADAFSERLKQELVALEAANVYQLLESEPLIEEVLQGLDAASATVDDMDEWLRIFNLKLRHMREDIASIESRNNGLEMQSVNNKGLMEELDKLLERLRIPQEFAASLTGGSFEESRMLKNVEACARGTGAIRTLEVPNLDPCYVNMRAVREKKAELEKLKTTFVRRASEFLRNYFSSLVDFMISDKSYFSQPRRLKRPDHADLRYKCRTYARLLQHLKSLDKSCLGPLRKAYCHSLNLLLRREAREFANELRASTKAPKNPAVWLEGSGGSGHNGSSADTSTVSDAYSKMLTIFIPLLVDESSFFAHFMCFEVPALVPAGSPNANKS

SEQ ID NO: 41330 - protein, 246 aa, Sorghum bicolor
  Clone ID: SORBI-28MAY03-C41908_1.pep
MAKEKKRKQPPADAAPPPGDDGEGRSGRKGKKARKEKAEAILPSQIKNKDKRREVHAKLKREKKAQKRALARERGQAARRAEELGEQPPERQVPRTIENTRGPGETVCRPDDQELFAGNDADEFNAVLKQHITPKILITTCRFNSGRGPAFIDELMQVIPNSHYVKRGTYELKKIVDYAKNRDFTSLIVVHTNRREPDALLIIGLPDGPTAHFKLSKLVLRKDIKNHGNPTSHKPELVLNNFTTRL

SEQ ID NO: 41331 - protein, 67 aa, Sorghum bicolor
  Clone ID: SORBI-28MAY03-C34562_1.pep
GIAELKKRTCKPKRPTIKSLFETADCDDQPSDGGFLNLLPTQLELPESLEPSPHSSISSEDSQARNR

SEQ ID NO: 41332 - protein, 133 aa, Sorghum bicolor
  Clone ID: SORBI-28MAY03-C34606_1.pep
EKYFHPDHMSSEEKMKLELQRVRDEFKMSENDCGSARVQIAQLTLKIKHLSAVLHKKDKHSRKGLQEMVQKRKKYLKYLRRTDWDSYCLVLSKLGLRDVPEYKAPDYKSKATTKAKSKKSKSKSKGKKRKVKA

SEQ ID NO: 41333 - protein, 132 aa, Sorghum bicolor
  Clone ID: SORBI-28MAY03-C34633_1.pep
MSRSLGIPVKLLHEAAGHVVTVELKTGEVYRGSMVECEDNWNCQLENITFTAKDGKVSQLEHVFIRGSRVRFMIIPDMLKNAPMFKRLEARIRGKGSAVGVGRGRAVAMRARAAAGRGGGPVGRGGAPPVRR

SEQ ID NO: 41334 - protein, 178 aa, Sorghum bicolor
  unsure (1)..(178): unsure at all Xaa locations
  Clone ID: SORBI-28MAY03-C34676_1.pep
PGQRHRRPGRARRDEGCLLPELHHQAEGGDRRRRQLRGLLRLVPARQLYSYDWHAEFVYERNGVPIGPRLHCXANSDWLYIVPWGLYKAVTYVKEKYGNPTMFLSENGMDDPGNVTVAQGVHDATRVAYYRNYITKLKEAIDGGANCVGYFAWSLLDNFEWKLGYTARFGLVYVDFKT

SEQ ID NO: 41335 - protein, 228 aa, Sorghum bicolor
  Clone ID: SORBI-28MAY03-C34760_1.pep
HEVPLKATSCCHGGADDDDTSYAEAEPVGLTEVAVGEHYEVVVTTFAGLYRYRLGDVVKVAGFYNSTPKLKFVCRRNLMLSINIDKNSEQDLQLAVDSAAKILAAEKLEVVDYSSHAEVSRDPGHYVVFWELNADGNDDVLQSCCDELDRAFTDPGYVGSRKASGIGPLELRVLQRGTFQKVLRHYLSLGAPVSQFKSPRCVGRSNNSGVLQILSANVVKVFFSAAYD

SEQ ID NO: 41336 - protein, 356 aa, Sorghum bicolor
  unsure (1)..(356): unsure at all Xaa locations
  Clone ID: SORBI-28MAY03-C33785_1.pep
ARGPAIWITAAKLEEANGNAQSVNKVIERGIRSLQREGMDIDRAPGLKEAEAAERAGSVLTCQAIVKNTIGIAVDDEDRKRTWVADAEECKKRGSIETARAIYAHALTVFLTKKSIWLKAAQLEKSHGTKESLDALLKKAVNYNPRAEVLWLXWLSLAGLEEKVSGLSKSRAVLTMARKKNPATPELWLAAIRAESRNGNKKEADALLAKALQECPTSGILWAEAIEMAPRPQRKGKSTDAIKRSDHDPHVIATVAKLFWLDRKVDKARSWLNRAVTLAPDIGDFWALYYKFELQHGTVDTQKDVLKRCVAAEPKHGEKWQEVSKAVENSHLPVEALLKKAVVGLHVEENLNPAGA

SEQ ID NO: 41337 - protein, 218 aa, Sorghum bicolor
  Clone ID: SORBI-28MAY03-C33847_1.pep
SKLWIVHRDLKPKNILLDHDMNPKIADFGSARTLSSDFAEECTSRVVGTSGYKAPEYTSRGVYSLKTDVFSFGVMVLVTISGRKNTILENQGDSVGTLVRDAWQLWNDGRLQELVDPMLGDEFELAEVMQYAQVALLCAQEESTDRPTMSDVVSLLNFQSISLLPDPKQPSELCKGGATGDKLSTYVSQSSRTIDITITSSAPISTRVRITVDPETSK

SEQ ID NO: 41338 - protein, 166 aa, Sorghum bicolor
  Clone ID: SORBI-28MAY03-C33894_1.pep
WHAAAFGADGRVCTWGWGHTGCLGHGDEEYKAVPTLVEGLRDVKAVHLSTGEYTTFVVAENGDVYSFGSGESLVFQEDDEAEEGPDFSTPSIVSSLKALNKKVVQISPTNASYWLNSEMGHPHTFAVMDSGDLCAFGGGIRGQLGVKLLEGVEKVSVPMHVPIVLN

SEQ ID NO: 41339 - protein, 94 aa, Sorghum bicolor
  Clone ID: SORBI-28MAY03-C33896_1.pep
YRSNTNHEHDQPPHLRLRDPTIPEQVNVPLYAGPESRYCPARVYEYVSDEKGDPKLQINAQNCLHCKACDIKDPKQNIEWTVPEGGGGPGYTVM

SEQ ID NO: 41340 - protein, 145 aa, Sorghum bicolor
  Clone ID: SORBI-28MAY03-C33932_1.pep
AEPLLRQRFSPEPSLLLKGLVACTGNQFCGQAIIETKARALQVTREVEKRVSVPRPVRMHWTGCPNSCGQVQVADIGFMGCLTKDSDGKIVEAADIFVGGRVGSDSHLADVYKKSVPCKDLVPIVADLLVERFGAVPREREEDEE

SEQ ID NO: 41341 - protein, 146 aa, Sorghum bicolor
  Clone ID: SORBI-28MAY03-C3399_1.pep
VRPRVRRFIGDENGKVKALEVVRVKWEKVDGRFQLKEIEGSEEIIEADLVLLAMGFLGPEATIAEKLGLEKDNRSNFKAQFGDFATSVDGVFAAGDCRRGQSLVVWAITEGRQAAAAVDKYLSRYDQNAAGDITPSGAGLVQPVAA

SEQ ID NO: 41342 - protein, 136 aa, Sorghum bicolor
  Clone ID: SORBI-28MAY03-C34840_1.pep
TRRRHIDLIYSDLMKSCKYEAAFPKNVIEMGRVSLAVNSALASCRPDLPRRADQNHAHALDSGDWSLCLLLPSGVNGAEAKDKWGGSTVRSELDHVHASYCARRELPRCALVPAVLLLHRRRVSYLGANEGRAGWW

SEQ ID NO: 41343 - protein, 137 aa, Sorghum bicolor
  Clone ID: SORBI-28MAY03-C34931_1.pep
NILICTDVASRGLDIQGVDMVINYDIPMNSKDYVHRVGRTARAGRSGYAVSLVNQYEAQWFVLIEKLLGKQIDQRKVDRDEVMILKGPISDAKRIALTKLKDSGGHKKRRKAGDDDEEVEDYSHSKRPKSFKKSNRR

SEQ ID NO: 41344 - protein, 130 aa, Sorghum bicolor
  Clone ID: SORBI-28MAY03-C34944_1.pep
IVEKVILRWRRKGAGLRGFRSTEGAMEGNSSSSSNLIQNKPAEDDYDFLQQGRKQTEERLQKALARVKSMAQYPDARDQYQRILTVVTKIQESQAMQEKMLDESTEMDEGFFMSEFKELWDDDVPMPSWS

SEQ ID NO: 41345 - protein, 154 aa, Sorghum bicolor
  Clone ID: SORBI-28MAY03-C34956_1.pep
FLIEMEGFDTGNEQILLIGATNRPQELDEAARRRLTKRLYIPLPSSEARAWIIRNLLEKDGLFMLSEEETSAICKLTEGYSGSDMKNLVKDASMGPLREALQRGVEITKLSKEDMRPVMLKDFENAMQEVRPSVSSSELGTYEEWNMQFGSLSI

SEQ ID NO: 41346 - protein, 164 aa, Sorghum bicolor
  unsure (1)..(164): unsure at all Xaa locations
  Clone ID: SORBI-28MAY03-C34961_1.pep
KGPLAPAQQXQVIVELTKDPKLVYYCGMTPQKLPDLVEHNPLIAVEVLSKLIHSPDIPGYFDVLVHMEMSLHSMEVVNRLTTAVDLPTEFVHEYITNCIQSCQNIKDKYMQNRLVRLVCVFLQSLIRNKIINVQDLFIEVQAFCIEFSRIREAAGLFRLLKSLE

SEQ ID NO: 41347 - protein, 162 aa, Sorghum bicolor
  Clone ID: SORBI-28MAY03-C34223_1.pep
GMGTAEWRASKSPAYYKRGDYVPGLKVDGMDVLAVKQACKFAKEHVLENGPIILEMDTYRYHGHSMSDPGSTYRTRNEIAGIRQERDPIERVRKLILAHEFATAQELKDMEKEIRKQVDAAIAKAKESPMPDPSELFTNVYVNDCGLESFGVDRKVVRTVLP

SEQ ID NO: 41348 - protein, 139 aa, Sorghum bicolor
  Clone ID: SORBI-28MAY03-C34260_1.pep
WSKRYTHQLPRSFQEFPGEVIGLSFPPQSSSSVVVYSTRAMCYIDFGLPVVEDVDLPNRSAGPVEKSDAKKTTKSRQKRKAHDEESKQEKRNNFNFFAFKEPVLFVGHLLDSSILIVEKRWMDVVEGFSAPVHRHIYGT

SEQ ID NO: 41349 - protein, 125 aa, Sorghum bicolor
  unsure (1)..(125): unsure at all Xaa locations
  Clone ID: SORBI-28MAY03-C34323_1.pep
RRSARASSWSTSWPTPRSPPPWSPXPRRAPLPLPPDPAPPPRGPPPPPXPPTRSPNPPSTRSSSWPRSPPPPPQSPPPTSPSRPTSRSPRPTSTSPWGRSSRAPTAARASRSTREGPPRSPPMRS

SEQ ID NO: 41350 - protein, 400 aa, Sorghum bicolor
  Clone ID: SORBI-28MAY03-C34446_1.pep
PRRSSGPGHGSAPPRPASGPPSSSSPPPPRPGGWRVLARPFAAPAPPAAAGAPGRLAPAPARPRGRGLLPAVRPPGVAAVGRRGDGGGGVAAAVAPLPPPLPPDDEAASAGGVAAVAALHGGVVVFFLLLVGGDAASTRGESNKCPSVALMFQVGEKATFYNMGGCKDMPGSCTSKSCRRQVVVMLLSSGGAAPPRRLGGGHLVDAAAGGGDGCGRHLVDVYAWNPHCRYLDGLGPKENNLDAQNDWHGAWWHSSLTVHSGFVDDDNPYGKQDEKGTYYFEFSRPLRTMDQFQQDAQFTIGHPSNMAVAFWYPTDGKAWSKSDHYSASCNWLVLDIQRSSEAAYYRPAPNRSWDAATAFALLLSVVAICLSIFVGYRFSRNRSTAQFTPLEQIQFAEERH

SEQ ID NO: 41351 - protein, 190 aa, Sorghum bicolor
  Clone ID: SORBI-28MAY03-C34466_1.pep
MGKSSKKAAAVAAAPAAVPKGKKREAEDEIEKAVSAKKQKAAPPPKAVVPSKKDAKKAKKQPPPKKVESSSSGSEEDSESEEEVKVPKKAPAAKIAKQESSDDDSSDATSESDEEPAKKPAVVKNGSKTAKKESSSDEDSSDDESDDVEPAKKAAAKPMGAVAKNGLKKGKQESSSDEDTSDESDDDDKP

SEQ ID NO: 41352 - protein, 313 aa, Sorghum bicolor
  Clone ID: SORBI-28MAY03-C34573_1.pep
TSSHGVEFNFPTAFHGYCMRHVSETFKKEFNNPVLVNLLWEAAHALTVIEFETKLLEIEDTSSEAVVWIRHLPPRLWATAYFEGTRDGHLTANITESLNSWILDASGLPIIQMMECIRRQLMTWFNERREASMQWNTILVPAAERRVQEAIERARGYQVARANEAEFEVISAHEGTNIVDIRNRCCLCRGWQLYGVPCAHGVAALLSCRQNVHRYTESCFTVATYRKTYSQTIHPIPDKTLWNETADHEVADQGQAEETKMEMVINPPKSLRPPGRPRKKRIRAEDRGRVKRVVHCSRCNQTGHFRTTCAAPI

SEQ ID NO: 41353 - protein, 115 aa, Sorghum bicolor
  Clone ID: SORBI-28MAY03-C3533_1.pep
MPTLNLRTNVPVDAVVAADILKDCSKAVARIIGKPESYVMVSINGSVPMSFAGSEEPAAYGELVSIGGIGPGVNGKLSAAVAEVLETKLSVSRSRFYIKFDDVQRSNFGFNGSTF

SEQ ID NO: 41354 - protein, 109 aa, Sorghum bicolor
  Clone ID: SORBI-28MAY03-C35503_1.pep
MVAAAAERVVAELREACAAPAARLNEVAAAMEAEMRAGLREEGGSKIKMIISYVDNLPTGNEEGVFYALDLGGTNFRVLRVHLAGKDKRVAKRESKEVSIPPHLMSGNA

SEQ ID NO: 41355 - protein, 141 aa, Sorghum bicolor
  Clone ID: SORBI-28MAY03-C3558_1.pep
QECGASEVTIDVRSTTRVSDGLDLLERLAFGTERLLASAVTDLRRIASPSQYGGSASSSNPQNNEPAVDGARIAGAPSADQASNSSTVAVIQGDAGISESAGEPSNAGSSRSLRRRGRSNILGSLDVDGGGLQQNKRRRMN

SEQ ID NO: 41356 - protein, 190 aa, Sorghum bicolor
  Clone ID: SORBI-28MAY03-C35480_1.pep
MRRWVLAIAILSAASAAALFLGAEAQAVQQQGHQTERISGSAGDVLEDNPVGRLKVYVYDLPSKYNKKLLKKDPRCLNHMFAAEIFMHRFLLSSAVRTFNPEEADWFYTPVYTTCDLTPSGLPLPFKSPRMMRSAIELIATNWPYWNRSEGADHFFVTPHDFGACFHYHEEKAIGRGILPLLQRATLVQT

SEQ ID NO: 41357 - protein, 131 aa, Sorghum bicolor
  Clone ID: SORBI-28MAY03-C35580_1.pep
IFTATPLANAGTVTAGVAEGAPVIQAALDRMDDGYCRSPLDYLELQPDLSALVRGAHTFRCPNLGLTSWVRLPIHDADFGWGRPVFMGPGGIAYEGLAFVLPSANRDGSLSVAISLQAEHMEKFRKLIYDF

SEQ ID NO: 41358 - protein, 235 aa, Sorghum bicolor
  unsure (1)..(235): unsure at all Xaa locations
  Clone ID: SORBI-28MAY03-C36300_1.pep
MAGSPSVDFRGTDYQLIPFGAGRRICPGISFALPVLELALVSLLHHFEWELPAGMRPADLDMGEAPGLTTPRHVPLVLVPLCKTLAQALRLHAPAPLLVPHESTTPAVVQGYQIPAKTALFVNVWAIGRDPXWDAPDEFRPERFMGGSRSVDFRGTDYQLIPFGAGRRICPGISFAVPVLELALVSLLRHFEWELPAGMRPVDLDMGEAPGLTTPRRVPLVLVPKCRTLVQAALQ

SEQ ID NO: 41359 - protein, 119 aa, Sorghum bicolor
  Clone ID: SORBI-28MAY03-C34771_1.pep
VPIFPQPERSMYRGGEFGYTRLVATREKLTLTYVGNHDGQVHDMVEIFSGLVSSNSSVAVAVHDTKLGTEVSTVRKISPLYLEIGGSVLFALLLGFSFGFLIRRKKEAAQWTPVKNEES

SEQ ID NO: 41360 - protein, 163 aa, Sorghum bicolor
  Clone ID: SORBI-28MAY03-C34791_1.pep
MEYLHGKNIVHFDLKSDNLLVNLRDPQRPICKVGDLGLSKVKCQTLISGGVRGTLPWMAPELLNGSSSLVSERVDVFSFGIVMWELLTGEEPYAELHYGAIIGGIVNNTLRPPVPEPCDPQWRSLMEQCWSAEPSERPSFTEVGKSLRAMAAAAPTKAQQQSK

SEQ ID NO: 41361 - protein, 282 aa, Sorghum bicolor
  Clone ID: SORBI-28MAY03-C34804_1.pep
HEAPPYGSSPAPSAPPYGETKPPKEGKTSSSSSSGGSAPPYYGGAPPPSHPSYGGGGGYGAPPPQDGAPPPQQYGAPPPQSYGGGPPAPYGGGGYGGSPFASLVPSAFPPGTDPNVVACFQAADRDGSGMIDDKELQSALSGYNQSFSLRTVHLLMYLFTNTNVRKIGPKEFTSVFYSLQNWRAIFERFDRDRSGRIDTSELRDALLSLGYSVSPTVLDLLVSKFDKTGGKSKAIEYDNFIECCLTVKGLTEKFKEKDTAYSGSATFTYEAFMLTVLPFLIA

SEQ ID NO: 41362 - protein, 195 aa, Sorghum bicolor
  Clone ID: SORBI-28MAY03-C3483_1.pep
MALQLLRHALVSLLVVAVHAAGATRAGGDMHHLQMVTSTAGTARAVASCASWRLGVETNNIRDWYSIPAECRSYVRDYMYGDLFRQDCAVVAGEAAAYAEGLELAGDGEEVWVFDVDDTTLTNLPYYADTGFGAEPYNATYFDEYVANATAPALPEVLELYEKLLSLGIKVVFITGRHDDEEAATVKNLRSAGYH

SEQ ID NO: 41363 - protein, 171 aa, Sorghum bicolor
  Clone ID: SORBI-28MAY03-C34836_1.pep
IVAKKLEENLEITGASLEARKLVVEICDIVATRAARLAAAGLAGILMKLGRDCSVEDQRSVIAIDGGLFEHYTKFRQCLETTLGELLGDEASKAVAVKHADDGSGIGAALIAASQSLYKNDLVAVKHADDKHADDKHEDADDKHEDDGKGVKHADDGSEIGAALIAASQSQ

SEQ ID NO: 41364 - protein, 144 aa, Sorghum bicolor
  Clone ID: SORBI-28MAY03-C36235_1.pep
LIGHPVENLRIVLTDGASHQVDSSELAFKLAAIYAFRQCYTSAKPVILEPVMKVELKFPTEFQGTVTGDMNKRKGIIVGNEQEGDDTIVVCHVPLNNMFGYATAIRSVTQGKGEFTMEYLEHNVVSQDVQMQLVNSYKAAKGTE

SEQ ID NO: 41365 - protein, 79 aa, Sorghum bicolor
  Clone ID: SORBI-28MAY03-C36245_1.pep
LPLAWAHLPASDVCPVPGATRAGDRNRSVGALPAISTPVGLAAPAAYPAAPHAWRDRYPQLPPAWGGSVSPPLSSWKSE

SEQ ID NO: 41366 - protein, 114 aa, Sorghum bicolor
  Clone ID: SORBI-28MAY03-C36248_1.pep
FLGAKDWNSDIPGDADNDQTLDTNKKGKDSRSMKLFKSACAGLGIGVLKPSWRQGNMSTEAFKTIVRKTVDKVSNSVPSSHIPKTPARIKHYVQSSQKKVTKLVMGYVDKYVKP

SEQ ID NO: 41367 - protein, 104 aa, Sorghum bicolor
  Clone ID: SORBI-28MAY03-C36275_1.pep
LYDMLQKEVISLRKTCHEKDQILKDKDDAIEMLAKKVDTLTKAMEVEAKKVRREVAAMEKEVAAMRASKEQEIRAKRLGTKGSGSSQLLPGRNAPRSGSMRNFQ

SEQ ID NO: 41368 - protein, 172 aa, Sorghum bicolor
  Clone ID: SORBI-28MAY03-C35019_1.pep
IGLVQQEPALFATTIYDNILYGKDGATEAEVVEAAKLANAHSFISSLPEGYKTKVGERGVQLSGGQKQRIAIARAIVKDPAILLLDEATSALDVESERVVQQALDRVMKNRTTVMVAHRLSTIKNADVISVLQDGKIIEQGAHQHLIENKNGAYHKLVNLQQQQQMQTQQSS

SEQ ID NO: 41369 - protein, 181 aa, Sorghum bicolor
  unsure (1)..(181): unsure at all Xaa locations
  Clone ID: SORBI-28MAY03-C35082_1.pep
TSSRGRRRRVTAAAAATARPSPTRSRRXRGRGEEDAAAAAAAAKRAEPASVLALTTTEAASPVSSSAALATAVARRRSLFSLGMSLAVGAVAWSADAPCLPLLAGLFAVVAVSMCSVSRLRRRRAGAGDAVALLSLNWFLLGLLTSPMLPGVAHAVVPRAGRTLGPALTWLAAATPLPPSL

SEQ ID NO: 41370 - protein, 143 aa, Sorghum bicolor
  Clone ID: SORBI-28MAY03-C35129_1.pep
TRENDSVEGLRPNARGPGLVTFGPDRVMEFCNNNDLQLIVRAHECVMDGFERFAQGHLITLFSATNYCAPANNAGAILVLGRDLVVVPKLIHPLPPAITSPETSPEHHIEDTWMQELNANRPPTPTRGRPQAPNNDRGSLAWI

SEQ ID NO: 41371 - protein, 230 aa, Sorghum bicolor
  Clone ID: SORBI-28MAY03-C35155_1.pep
TRLIINVVAAVSSGNVPLNAVQLLWVNLIMDTLGALALATEPPTNHLMERPPVGRREPLITNIMWRNLIIMALFQVSVLLTLNFKGISLLQLKNDDKAHADKVKNTFIFNTFVLCQVFNEFNSRKPDELNIFKGISGNHLFIGIIAITVILQALIVEFLGKFASTVKLSWQLWLVSIGLAFFSWPLAFVGKLIPVPRRPLGEFFTCCCRGSKQAPDDATSNDKEDNKPEP

SEQ ID NO: 41372 - protein, 130 aa, Sorghum bicolor
  Clone ID: SORBI-28MAY03-C35166_1.pep
FRTGGMHAHAAQNSGGSTVRMLIQLLPVLLLLLLNFLPSSEPVYSLSRSYPYEHKFQTPRGVAYYVKMSNFEEQYPHQSTERATLERHVERDYYSIITQNCRVELQRRQWGLSYQTPHCDMLKKFEATAE

SEQ ID NO: 41373 - protein, 205 aa, Sorghum bicolor
  Clone ID: SORBI-28MAY03-C36676_1.pep
MAFGRRSPGSSRHRPALTIVSALLLAFLSSAAAAAAASSSTDAMHNNNWAVLVCTSRFWFNYRHMANTLSLYRTVKRLGIPDERIILMLADDMACNPRNSYPAQVFNNENHQLNLYGDNVEVDYRGYEVTVENFLRVLTGRHESAVPRSKRLLSDEGSHILLYMTGHGGDEFLKFQDSEELQSHDLADAVKQMKEKHRFKELLIM

SEQ ID NO: 41374 - protein, 394 aa, Sorghum bicolor
  Clone ID: SORBI-28MAY03-C36716_1.pep
MRTRSGSRYSNGGEVVALVGQKRKRSALAVAGECACGGRRKRLAGGPDYLDALPDDLVLSILTKLAASSSAPSDLLPVHLTCKRLNELGGHDMVFAKASPASLAVKAAAWSEPAQRFLKRCADAGNLEACYILGMIRFYCQGSRSGGAALLARAAVGGHAAALYSLAVIQFNGSGGAKSDRDLRAGAALCARAAALGHVDALRELGHCLQDGYGVRRDPAEGRRLLVAANARELTLALSAATASRHAVTALPFAAAAAAAAAAGGVGGGGCPLLSDFGWSLPEAEPHAANQFMVDWWASRCAAQAGGKKPDGDSSGVDGSDGAELRLCSHVRCGRRETRRHEFRRCSVCGAANYCSRACQALDWKRAHKAQCVAMDRWLLAGVGGGGEVPQPQQ

SEQ ID NO: 41375 - protein, 266 aa, Sorghum bicolor
  Clone ID: SORBI-28MAY03-C36727_1.pep
MAKKKEKAVNVSGKPRHSNDVNRPNDKKGAGGGAGGGSRSAATVRRLKMYKTRPKRDRAGKVLRNDFQSKELPNTRIVPDRRWFGNTRVVGQQQLAFFREELTSQLSDNFSVILKERKLPLSLLQDHQKQARAHLLDVEPFEHAFGPKGKRKRPKLTALDYESLLKKADDSQDAFEQKYASSKLPREEEEDGLRDLVRHTMFEKGQSKRIWGELYKVIDSSDVVVQVLDARDPMGTRCYHLEKHLRENCKHKHLVFLLNKCDLIPA

SEQ ID NO: 41376 - protein, 90 aa, Sorghum bicolor
  unsure (1)..(90): unsure at all Xaa locations
  Clone ID: SORBI-28MAY03-C36782_1.pep
EQAEKEEEMVXVRVDKAEKQRHLHEEDETQVRTSSQYREETHFRSTHETHYHHEESHVSRSTQYHEGIHVRSDTDSPSPPHFVYHYDIQP

SEQ ID NO: 41377 - protein, 224 aa, Sorghum bicolor
  Clone ID: SORBI-28MAY03-C375_1.pep
RSPSVRPRVRWGDSLGGFTTLFTATEVPELVRGVVLLNSAGQFGDPNKPAAAPAEEEEGSPLSRFIVKPLKEAFQRVVLGFLFWQSKQPARVEKVLKSVYIDSSNVDDYLVGSITAPAADPNAGEVYYRLMSRFMSNQSRYTLDRLLGKLSCPLLLLWGDLDPWVGPAKAARIQEFYADTAVVHLQAGHCPHDEAPEQANRALLEWLADLDARAKPAEPSLQTV

SEQ ID NO: 41378 - protein, 151 aa, Sorghum bicolor
  Clone ID: SORBI-28MAY03-C35721_1.pep
PGAQGVPMNQVTPSQGSDEAKPSDATVADAAAATSEGTAAPPAAEGTAAPSSEEPNAAAPGNEEGTAHPVNEEATAAGVPDAAGSPDVPAPAAPAPAPATVAVADTSSSDAPAVTPSEVTVSAPSTEAPELTDKPSSTEASLPPPPTVSGV

SEQ ID NO: 41379 - protein, 282 aa, Sorghum bicolor
  Clone ID: SORBI-28MAY03-C35853_1.pep
MAAAGSSPSSSSSKRLEGKVALVTGGATGIGEAIVRLFTEHGAKVCIADIQDEAGQQLRDALGGDAQGVMFVHCDVTSEEDVSRAVDAAAERFGALDVMVNNAGVTGAKVTDIRAVDFAEVRRVLDINVHGVFLGMKHAARVMIPQKRGSIVSLASVASAIGGLGPHAYTASKHAVVGLTKSVAAELGRHGVRVNCVSPYAVPTALSMPHLPQGARADDALTDFLAFVGGEANLKGVDAMPKDVAQAVLYLASDEARYVSALNLMVDGGFTAVNHNLRPFDD

SEQ ID NO: 41380 - protein, 403 aa, Sorghum bicolor
  Clone ID: SORBI-28MAY03-C36016_1.pep
TRALLGVTYRTSRRISPLTATAISTVQSMPLSGFGGSGSSFASDDPFSSKEGPPQNFQLYSWETYQPVSGLLAQPEWTVWDQTVEYCAFAYQQYIVISSLRPQFRYLGDVSIPFATGAVWHRRQLFVATPTTIECVFVDAGVAAIDMETKRRKEEMKAREAQSRAVEEHGDLALITVEAPQVTVSEKVSLRPPMLQVVRLASFQHSPSIPPFIVPKPPGFDGDDSVFHKELDDRRYAEVAVAGGGVSVAVTRFPPEQKRPIGPLVVVGVRDGVLWLVDRYMCAHALSLSHPGIRCRCLAAYGDPVSAVKWATRLGREHHDDLAQFMLGMGYATEALHLPGISKRLEFDLAMQSNDLKRALACLLTMSNSRDVGQETAAADATDVTQILNLAVAKQAKQESLAD

SEQ ID NO: 41381 - protein, 242 aa, Sorghum bicolor
  Clone ID: SORBI-28MAY03-C35648_1.pep
MASLFKDPSKLSAYRDRRFKGTQEEYEATLLASTTLYIGNMSFYTTEEQAYELFSRAGEIKKIIMGLDKNSKTPCGFCFVLYYSREDAEDAVKYISGTMLDDRPIRVDFDWGFEEGRQWGRGRSGGQVRDEYRTDYDPGRGGYGKMVQRELEAQRELVDYGGSFQPNAPPPYERGERKRGYGDSHRNDRGDYQRKRYRNDDRSAPEESKRAPDSDPAEKNPRFREKGDSDEEEDDYDKRRRR

SEQ ID NO: 41382 - protein, 357 aa, Sorghum bicolor
  Clone ID: SORBI-28MAY03-C36142_1.pep
ARGRRELIRVYLSNVEQICRRFIDERRSKLSRLIEDKLGWSSFCGFWLAMDPSVRRHMTREKTETILKVLVKQFFIQKEVTSTLVIDSPRGGLKALEYQSKNKKAIPKLTETDARSTPMVLIDQDMFVLADDVILLLERAALDTLPHQPLPTKDDKSSQNRTKDGNSGEEFSKDSIERDDRRLIELGWKTLELFALAHIFSRIEVAHQEAVALKRQEELIREEEAAGLAEIELKAKRNAAEKEKRAKKKQAKQKKNSRKSNKGKSGKSDINKEILMDSSPSDDRILDDFSGQTEEMSSNADNPEEVSDISDSRDDNSDVLHVDIEDRESSPVNWETDAETQATVPGSSEVQNDHAGK

SEQ ID NO: 41383 - protein, 225 aa, Sorghum bicolor
  Clone ID: SORBI-28MAY03-C3622_1.pep
RRRHRPCSLSRSPPLRSTGPPAAVPAASSSRAAASAGPRAAGPAARRRRGAATARCGATWLAARRRSSPDAALGSWLMSEAAQAAAGGEAASAGAGGGGGGGAEGGGRRHGGRGADGQLSLPPLKLPAPEDAPGGTGYPRRAALDARGAKRSAGGRGRGAARRGRGGHGHGERTDGNVSASERTCGAACRAKAGEGNGYSERGWEELALAAGITASERERFPWTS

SEQ ID NO: 41384 - protein, 305 aa, Sorghum bicolor
  Clone ID: SORBI-28MAY03-C37055_1.pep
TRQQGTREFLAEVEMLSRLHHRNLVKLIGICTEGHSRCLVYELVPNGSVESHLHGSDKGAARFDWDARLKIALGAARALAYLHEDSSPRVIHRDFKSSNILLEHDFTPKVSDFGLARTALGEGNEHISTRVMGTFGYVAPEYAMTGHLLVKSDVYSYGVVLLELLTGRKPVDMLRPAGQENLVAWAGSLLTSRDGLESIIDPSLGSSIPFDSIAKVAAIASMCVQPEVDQRPFMGEVVQALKLVCNEGSEFNETTSFSQDLHIQDVEAMSRASMDIDVDPTLSAELFTSSARYDAMDASGSFRRY

SEQ ID NO: 41385 - protein, 275 aa, Sorghum bicolor
  Clone ID: SORBI-28MAY03-C37178_1.pep
MPEQELAATQANSHGDKPLPKQELAATQANSNAEKPLPEQELAATQSNSNGDKPVPKQELAATQANFNGDKPVPEQEFAATQANSNGDKPVSEQELAATQANSNGDKPASEQELAATEANSNGDKPVPEQELAATEANSTGDKPVPKQELAATQSNSNGDKPVPEQELAATQANFNGDNKQTEANNQSEVSMTDEDFNGDNKQTEASKQSEVSMTDENPLVEDDKRTILGKHPRDFSMADEASAFVEDDKRKRPRDDNDAEQKCNGEVGVDVSKT

SEQ ID NO: 41386 - protein, 109 aa, Sorghum bicolor
  Clone ID: SORBI-28MAY03-C37201_1.pep
SRRKCAMFRLTKSSPSAHNLRGALDSKCNTGEGTREGSKRKCRQDSSSPHTHTTTKLIKMTPSLSPQHKLLGPAVQHGVNSYSDQNLEALPAPFTFLGLQVNKHIDSGE

SEQ ID NO: 41387 - protein, 192 aa, Sorghum bicolor
  Clone ID: SORBI-28MAY03-C3726_1.pep
EGMSIACYGSRDTSSPKGTMWKTVPHRLLFGRSSTPCWGTGGVAFLNPEINYNEKSYVCMYKITLEQFNDILFQENRRPLKDGKDGNVVYPDSPLIGSSEIKFISTNKAIHLEPIKDSWYSNVLYLGNEGELPILTMTCPASDIERFKSGELPLAPPSETYAATLIRGLVEGKQLDADGAANYINACAAKGL

SEQ ID NO: 41388 - protein, 213 aa, Sorghum bicolor
  Clone ID: SORBI-28MAY03-C36320_1.pep
TRAESSVTKQLEVAEIYKPSSHVKPIFVAVEADMEKYYSAPEASDIVFRYVEKENLVKPTDKTKVILDVTLCDALYKGAIKKGSAYPTEIHKKDLGSTFLNRMQVHHKVSRGTQEVIRKGAIRTIQIMTERRQGNKKMTRLSGLECFLMDPDSLASELQKKFACSTTTAELPGKKGQCEVLVQGGVIDDLAKHLVDHYGVPKRYIEVYDKTKR

SEQ ID NO: 41389 - protein, 301 aa, Sorghum bicolor
  Clone ID: SORBI-28MAY03-C36341_1.pep
APLETSSLSQSLYIKQASSAISIVDEEDSEPEWMEYKIKETNMFTVDKYQQIGFFPEKKAFALRYQTAGMLETVLRVGVLGEDDTGEESPKNLKIPSRKPSIVCENCLYSLEGNGRMRAFHIMDPKGMLDTLLVFHEKRQGSEVPQSIKHHSVGTTSASSDRINTLLGKWEGHSVTKRSGVYGATLAEADTAVVLKMGSNGQLIQDTLSTKVGTGTTTTVNWTGSPNVLSLLLAGGSESTLPPAGWAWACPSHISKSVSQLDSFHLEFCWMESPGKRQRLVRTYDSAGLAVSSTYFSETKV

SEQ ID NO: 41390 - protein, 349 aa, Sorghum bicolor
  Clone ID: SORBI-28MAY03-C3646_1.pep
MSTLAQPRFAPLPTERIESQTDAGAAGYQFRLVSYNILAQVYIKSTFFPHSPSACLKWKSRSKAILTELKSFDADLMCIQELDEYDTFYKNNMENSGYSSIYIQRSGDKRDGCGIFYKPKSAELVQKEGIHYNDLVEKYVPSDHVNSAQENNSLTEEDRNAKPDNSKRGDPNDPRVRLKRDCVGLLAAFKLSDPCDHILIVANTHIYWDPEWIDVKLAQAKYLLSRVSQFEQLISNKYNCKPSVIIAGDFNSTPGDKVYNYLVSAGGETPIKLSSLYAANGGEPEYTNYTPGFTGTLDYIFLSDGSSIKPTSLLCLPRGDSEDVKGGLPNFQHPSDHLPIGADFLVVNS

SEQ ID NO: 41391 - protein, 177 aa, Sorghum bicolor
  unsure (1)..(177): unsure at all Xaa locations
  Clone ID: SORBI-28MAY03-C3658_1.pep
VVIKNLDITTNFTDLGEQEILLMAAEFKLSINAYLSDLLYSXVRSLAQIIAFNKAHPVEERLKDFGQPDLIAAEQTNGIGTRERAAIQRLKEISTNGLEKLMKEHQLDAIVAANSDASSVLAVGGYPGIAVPAGYDKQGVPFAICFGGLRGYEPRLIEIGYAFEQATKVRRPPTYKS

SEQ ID NO: 41392 - protein, 469 aa, Sorghum bicolor
  unsure (1)..(469): unsure at all Xaa locations
  Clone ID: SORBI-28MAY03-C36584_1.pep
MARRQQQQLPPPPQHPPPQAGGGGGDFYRGPPMRQLSAASSTNLPPDYAAHPGPPPQQQHQPPYDAYGDSFGAKRMRKPVQRRTVDYTSSIVRHVQARMWQRDARDRFTLQPTPAAVLDMLPSVAYPDNPSTSFAAKFVHSSINKNRCSINRVLWTTTGRRLITGSQSGEFTLWNGQSFNFEMILQAHDLPVRSMVWSHNENWMVTGDDGGAIKYWQSNMNNVKVNKTAHGESVRGLSFSRTDLKFCSCSDDRTVKVWDFARCQEEKSLTGHGWDVKTVDWHPTKSLLVSGGKDYRARLWDAKSGRELSSFHGHKNIVHCVKWNQNGNWVLTASKDQIIKLYDIRSMKELQSFRGHTKDVTALAWHPFHEEYFVSGSFDGAIFHWLVGHEAPQVEISNAHDSSVWDLSWHPVGYLLXVGAMIMLQSSGVETGRVILPAIDTTVARCKVMVTNNLLVLVEWVDSRCLNSN

SEQ ID NO: 41393 - protein, 221 aa, Sorghum bicolor
  Clone ID: SORBI-28MAY03-C36626_1.pep
MSPYLLLAAAALFAPPASFSSPWSTSRPPSPPSRPLRRHRHLRGPLAHPSSPAPRPRPGAGGGLPFPQLGPSPTCVAAAAAPAAGPLRHRHRACAAPAPSPAPPARTAGRGNVSFAPYGENWRLGKKIAVVHLLSPRRVESFAPVRAAEVAALVAWTRCAAEAREAVEMRELLYGCTNAVVTPAPTRAAPAPPPVPPRRLRNAEALMAGFQPEDVLPDAPA

SEQ ID NO: 41394 - protein, 94 aa, Sorghum bicolor
  Clone ID: SORBI-28MAY03-C37750_1.pep
AHRAWRTRFPTSKIDDCAVVCLFLNTNEASESSSSLANNLADAVEVSSAQRSTTIQVSTGASIDVTALVTDGNEESVVETVTRPVTLMDLPKDG

SEQ ID NO: 41395 - protein, 105 aa, Sorghum bicolor
  Clone ID: SORBI-28MAY03-C38001_1.pep
SAGPPLFGCALPLLSPHEATLSAFPLERTKPTAPPFKEGQASTRRRRREETTTSHSIHTRIDRSTIAPRVIPASRLLRRRRLLLLRCGSGAGSLTWKSLRTEYFC

SEQ ID NO: 41396 - protein, 155 aa, Sorghum bicolor
  Clone ID: SORBI-28MAY03-C37774_1.pep
ITNKVFVVHGGLFSVDGVKLSHIRSIDRFCEPPEEGLMCELLWSDPQPQLGRGPSKRGVALSFGADVTKKFLQENNLDLIVRSHEVKDEGHEIEHDGKLITVFSAPNYCDQMGNKGAFIRFTAPEMKPDIVTFSAVPHPDVRPMAYANNFLRMFQ

SEQ ID NO: 41397 - protein, 163 aa, Sorghum bicolor
  Clone ID: SORBI-28MAY03-C38057_1.pep
MDATATDLQRAEEFKLKANDAFKANKFSQAIELYSQAIELNSSNAVYWANRAFAHTKLEEYGSAVQDATKAIEIDPRYSKGYYRRGAAYLAMGKFKEALKDFQQVKKICPNDPDATRKLKECEKAVQKIRFEEAISVGDAERGSVADSIDYHIIEVEPHYAGP

SEQ ID NO: 41398 - protein, 228 aa, Sorghum bicolor
  Clone ID: SORBI-28MAY03-C38058_1.pep
MAASLAPLLAVAFLAAAAQAADPFAFFDWDVSYITASPLGVPQQVIAINKQLPGPIMNVTTNYNVVVNVLNSLDEPLLITWDGIQQRKNCWQDGVLGTTCPIPPGWNWTYNFQVKDQIGSFFYFPPLGMQRAAGGFGGITVNNRAVISVPFDTPDGDITLFIGDWYKMNHTHLRKMLDDGKELGMPDGVLMNGKGPYRYNDSLVPDGIEHETIKVEPGKTYRFRVHNG

SEQ ID NO: 41399 - protein, 62 aa, Sorghum bicolor
  Clone ID: SORBI-28MAY03-C36880_1.pep
MFSEPRAGMNMRPDEDERLNSVPRNGSYRNLDDFGRPGDRPRDNLQFGVPRRPNSSNGRREV

SEQ ID NO: 41400 - protein, 169 aa, Sorghum bicolor
  Clone ID: SORBI-28MAY03-C36907_1.pep
NIPKDLSSDEANRYLIEACAKYDVKCPPPQTTSRLLDKLVGHFLEEMCVNPTSIINHPEIMSPLAKWHRSRPGLTERFELFVNKHEVCNAYTELNDPVVQRQRFEEQLKDRQSGDDEAMALDESFCTALEYGLPPTGGWGLGIDRLTMLLTDSQNIKEVLLFPAMKPQE

SEQ ID NO: 41401 - protein, 157 aa, Sorghum bicolor
  Clone ID: SORBI-28MAY03-C36921_1.pep
RAWTAEPSPPPPSRPERPPDSGPATQNVHQQPLAPQLSLPSGNNGGGKPAAASAEMAAIEKFLQFQDAVPCKIRAKRGCATHPRSIAERVRRTKISERIRKLQELVPNMEKQTNTADMLDLAVDYIKDLQKQVKVLNDGRANCTCSAGKLLQDQFTS

SEQ ID NO: 41402 - protein, 191 aa, Sorghum bicolor
  Clone ID: SORBI-28MAY03-C37010_1.pep
MAAVDLTPKQPRKAYGGEGGSYYEWSPADLPMLGVASIGAAKLSLAAGGLALPSYSDSAKVAYVLQGTGTCGIVLPEATKEKVVAVKEGDALALPFGVLTWWHNAPTASTDLTVLFLGDTSKGHKPGQFTNFQLTGSTGIFTGLTTEFVSRAWDLPEADAAKLVSSQPASGIVKTSIALPTGSPKDREGMA

SEQ ID NO: 41403 - protein, 208 aa, Sorghum bicolor
  Clone ID: SORBI-28MAY03-C37037_1.pep
FVHEVVSGRGGAGRLAVPGLGAVVVPGEKAREDVVRGGGVVRWWTVPCPCAASRGRSRSRSRGEVLIPAHDLAEQRARRRPVPQQSRGAHLLLLVRWRSRTGPGGRLRQGCCWQVQVLGHRCAVHHPPPPPPIAINPGRLAPCPTRQYDCGGWSARTVNGESETDRTGGGRRQAGKVGGGRGVAVAAVRAGGRRGLCVDEESSRAEVC

SEQ ID NO: 41404 - protein, 150 aa, Sorghum bicolor
  Clone ID: SORBI-28MAY03-C3706_1.pep
MGLKRLMTCCCCIAKQHADDEDKIDFGGGNVHVVTSKEDWDQKIAEANKDGKIVVANFSASWCGPCRVISPVYAEMSQTYPQLMFLTIDVDELMEFSSSWDIRATPTFFFLKNGQQVDKLVGANKPELEKKVAAIAGASSQADAASSKTV

SEQ ID NO: 41405 - protein, 115 aa, Sorghum bicolor
  Clone ID: SORBI-28MAY03-C38379_1.pep
IQNNSHILGVCSFRSPSEYYGTRPYAFLQSVAGFSYTWSSWKGEFSYPRWMLLQIHILPETCELLVTAGLTDNAERQLHFRILARCRENELMDVVSCSLAVYVILVPRPAQLCKT

SEQ ID NO: 41406 - protein, 225 aa, Sorghum bicolor
  Clone ID: SORBI-28MAY03-C38391_1.pep
WVNAIAGVVLGMFIVNESITIGAETGERLRSLILKYIREKSLIGHKYGWEHWRVDTRTKQFVLLSVMIILMSSFWVLSIVLTVVKMHSLADGAVLWMGCSVAPPGVWLRWYLARLNGQGIGKQRSLKWLPIGTLVANVLAAGIMAVLAVTSKAVHTKRSTTILSGIQLGFLGCLSTVSTFAAEVYTMRRSGQIARAFVYAASTFLLSFVLGTLVYSVPVWEKHYK

SEQ ID NO: 41407 - protein, 160 aa, Sorghum bicolor
  Clone ID: SORBI-28MAY03-C38400_1.pep
IQCPVVLDNKLSNQVPNMSAVPPVSNPITAGSSDISIPEFSDLADLVNEDSVNIPGGAFEMPGPEFPLPEGDDSVPIETDETMYNNDETQSLPGIIDSFWEQFLVGSPLSADNDEVDSGGLDARGSPQENGWSKVGNISNLTEQMGLLSSTNHRDSGNGL

SEQ ID NO: 41408 - protein, 185 aa, Sorghum bicolor
  Clone ID: SORBI-28MAY03-C38470_1.pep
MAARWCLVLLVLVLAAAAAGAEKGEWDPVIRMPGEEEPAASSHSHSGEGFEGEEDVAVGTRWAVLVAGSSGYGNYRHQADICHAYQILRKGGIKEENIVVFMYDDVATSALNPRQGVIINHPQGEDVYAGVPKDYTGDQVTAKNFFAVLLGNKTAVTGGSRKVINSKPDDHIFICYSDHGGPGVL

SEQ ID NO: 41409 - protein, 116 aa, Sorghum bicolor
  Clone ID: SORBI-28MAY03-C47578_1.pep
VVINDRHRVAAASAGGTKDPMVTEAAVPRSNLKRPRATEQEVDTRKIQIIGEHVQRRKRKPNTPISTATLRRSPRLAEALDGHKPEVISASKKPISKNKSRARKITLQTDLLDNRN

SEQ ID NO: 41410 - protein, 91 aa, Sorghum bicolor
  unsure (1)..(91): unsure at all Xaa locations
  Clone ID: SORBI-28MAY03-C47674_1.pep
CGMSEAIGXVHVKARPRVLSLSWGGAVLLHLLSEAYGRVKRLLKKHEKQLHALANALLERETLTADEINKVVHPYQEEPQFSFQDEEFALT

SEQ ID NO: 41411 - protein, 366 aa, Sorghum bicolor
  Clone ID: SORBI-28MAY03-C47608_1.pep
SGTVIVWVQENIGSGVGFAVPMVFMVFGLAAFVAGRKVYRYKKLSGSPLTRVAQVVVAAVRNCHLQLPEDTSALHHDTFFPAEPNFKTEAARQFRFFDKAAIILPWTGEKGTAAPSSPWRLCTVSQVEELKMLLRMLPVWATMVLFFAVTSQMSSTFIEQGAAMDDRVGPFTFPPASLATFEVISVMVCIPVYDAVLVPLARRVTGNDRGLSQLQRLGVGLALSVIASGRAALPVPTRRGRAQADLPPARFWRLAPVCAVLGPARGSAAGRVRGLLYDQSPDGMKSLGNAFAQLSMAAGSYFNSAVLSAVAATTTARGVEPGWIPDDLNEGHLDYFFWMMAALSMVNLLHFVHYSIRYRGNNRTAS

SEQ ID NO: 41412 - protein, 244 aa, Sorghum bicolor
  Clone ID: SORBI-28MAY03-C47856_1.pep
MASRVGEAQRHEVLIRRLRQRPASMRCVNCGDLVGLAARLLVRPLAVSRRVGGGRHRASAQGPHFPCATVGPAVSTMSSGALRAPAHRVKSVSMAKFTAQEVTALQEGGNERAREGSCKEWDPQRNGYPDSSNADKLRNFIKHVYVERRYTGERSTDRPPRAKDDKDEYSENRRSDGNWGGSRSPPNGSYSDRRSYSGRSDDRNSRYSYGDRSPGYDQNDYKKSPRYFEVVDDRSGKITPVQRF

SEQ ID NO: 41413 - protein, 175 aa, Sorghum bicolor
  Clone ID: SORBI-28MAY03-C4770_1.pep
KDADTGAEGSKITDGDTEAIELDNSEKIPLKEAANSIARKRDLKIRDRLLSLTHAKPVGTGPKEMEVQKRSSVPKHKEVSTPGSKFNEGSDKAKRKASALSYQGQSCASGVVKKVKVNQQPSNKGKQSKTSEIGASARKAKRPAVAARKAKNTAMKRKVDVSIPENTDRSRSPRK

SEQ ID NO: 41414 - protein, 257 aa, Sorghum bicolor
  Clone ID: SORBI-28MAY03-C38751_1.pep
STSRRRRRAAGASWRRSSRSSSSPASRSSTSTSRWISARPALPLPRKRITRSPVAIAFAGGPPGPGRQPPALTPCRAGLSSATPTCPSARSGRTTLLPPTRWAPGRFLHPDVMAIYDFIFLWDEDLGVESFNPRRYLDIMVSEGLEITQPALDPDLSTDIHHRITIRNKMTKVHRRIYDNRPSMNCSDESKGPPCTGWVEGMAPVFSRAAWKCVWHLIQNDLIHGWGLDMKLGYCAQGDRTEKVGVIDSEYVVHQGI

SEQ ID NO: 41415 - protein, 85 aa, Sorghum bicolor
  unsure (1)..(85): unsure at all Xaa locations
  Clone ID: SORBI-28MAY03-C38837_1.pep
MTADYAVMTPQKRAAMRAFRARQMTYTVCYDAVRYADGPFPECDNSDEERESFSAWGESKTVVMRPRXRPPPGTQGRRRCQGTAG

SEQ ID NO: 41416 - protein, 54 aa, Sorghum bicolor
  Clone ID: SORBI-28MAY03-C3881_1.pep
HCLLSHPTLIRLLISGAHRWETTNTYLQDIYCIVKPWIQKNKSISQIKMCMCGE

SEQ ID NO: 41417 - protein, 194 aa, Sorghum bicolor
  Clone ID: SORBI-28MAY03-C38977_1.pep
MEMLSMLKAGYTILRSETPATDLVNTFMDWAARRSLVLLAIFLPPYYIYKLTTSAFAAAVPEDVAGKVVLITGASSGIGEQIAYQYAKKGARLALVARRVGSLHDVATRAKDVGSPDVLVVAGDVANLEDCQRFVQATVEHFGRLDHLVNNAGVAYVCWFEEVPDVADLKQVLAVNFWGAVYPTHCALPHLKKS

SEQ ID NO: 41418 - protein, 119 aa, Sorghum bicolor
  unsure (1)..(119): unsure at all Xaa locations
  Clone ID: SORBI-28MAY03-C3876_1.pep
PGSRSGQRRGNRRRRXGKESLPPQSRVPPAATTITAMISILAQERLLGFALGSVSMGGFVLHQRRAIYRSIAEADGSPYFYQPGEIASRRSSTELAHVWNKAVDETLGRLVVYLSSRGW

SEQ ID NO: 41419 - protein, 239 aa, Sorghum bicolor
  Clone ID: SORBI-28MAY03-C3808_1.pep
SAFEAVCEGLGAAVAKEDTPVPAAIPVRQRVAVCIWRLATGEPLRLVSKRFGLGISACHKLVLEVCAAIKAVLMPKARHRHLAPRPAAGVSATFEAASGIPGVVGAMYTTHIPIIAPHANAALYYNRRHTERNQKTSYSITKLGVVKRDRRHVHHPHPHHRAQDLGGGLLRPALHAPRPAAGLLQRPAGRGGARRPLVGRLLRPAALHARPPAQHVFNERVDGVRAVARDAFQRLKSRW

SEQ ID NO: 41420 - protein, 172 aa, Sorghum bicolor
  Clone ID: SORBI-28MAY03-C38193_1.pep
MEPTSSASIARQTWELENNIPAAATDPDAMDAIYRYDDSVQARAQQEKPWANDPHHFRRTKISALALLKMVVHARAGGTIEVMGLMQGKCEGDAIIVMDAFALPVEGTETRVNAQADAYEYMVEYSTINKQAGRLENVVGWYHSHPGYGCWLSGIDVSTQMLNQQFTEPFLA

SEQ ID NO: 41421 - protein, 181 aa, Sorghum bicolor
  Clone ID: SORBI-28MAY03-C38200_1.pep
MGAFAKEEHQFLAELGLAQRNPGAFVCGAWGGSGPAVTSTSPTNNQVIAEVVEASVQDYEEGMRACFDAAKTWMAFPAPKRGEIVRQIGDALRAKLHHLGRLVSLEMGKILPEGIGEVQEIIDMCDYAVGLSRQLNGSIIPSERPNHMMMEVWNPLGVVGVITAFNFPCAVLGWNACIALV

SEQ ID NO: 41422 - protein, 509 aa, Sorghum bicolor
  unsure (1)..(509): unsure at all Xaa locations
  Clone ID: SORBI-28MAY03-C38304_1.pep
NTVLAACARATDPPVPFDMLLGLFAEMRHDASPSVRPDLTTYNTLLAAAAVRSLADQSEMLLRTMLEAGVSPDTVSYRYIVDAFASAGNLSRVAELFSEMAVMGNTADASAYLGLMEAHTRVGATAEAVAVLRQMQADGCAPTAATYRVLLDLYGRQGRFDGVRELFREMRTAVPPDTATYNVLFRVYGDGGFFKEVVELFHDMLETGVEPDMVTCENVMAACGRGGLHEDAREVLEYMTREGMVPTADAYTGLVEALGHAAMYEEAYVAFNSTTEIGSLPTLETYNTLAFAYARGGLFQEAEAIFSRMSNNAGIQKNKDSFDALIEAYCQAPRLDDAVKAYMEMRKSRFNPDERSLEGVLNAYCIAGVIDESKEQFEELQSSVTLPSIIAYCMMLSLYARNDRWADAYDMLEEMKTNRASSTHQVIASLIKGEYDDSSNWQMVEYALENSTMEGCDYSLRFFNALLDVLWWFGQKGRAARVLDQAVQFGLFPELYRDTKLVWSLDVHX

SEQ ID NO: 41423 - protein, 176 aa, Sorghum bicolor
  unsure (1)..(176): unsure at all Xaa locations
  Clone ID: SORBI-28MAY03-C38318_1.pep
MEYRDKLVLAPMVRVGTLPFRLLAAEYGADITYGEEIIDHKLLKCERVTNESLGTTDFVEKGTDSVVFRTCPEERGRVVFQMGTSNAVRALKAAQLVCQDVTAIDINMGCPKSFSLSGGMGAALLSKPELIHDILTTLRRNLDTTVTCKIRLLNTPXDTVELARRIEKTGVPALAV

SEQ ID NO: 41424 - protein, 98 aa, Sorghum bicolor
  Clone ID: SORBI-28MAY03-C38371_1.pep
RQDYVKKNPKLINPSDEASTITSKSFQPEEVNPIAWAVPTAHEGDASEEASLADETLPSEVVLTRKRKAESSSSVEPNHLSDELEPKLADAQNGETSN

SEQ ID NO: 41425 - protein, 192 aa, Sorghum bicolor
  unsure (1)..(192): unsure at all Xaa locations
  Clone ID: SORBI-28MAY03-C39404_1.pep
MDYGKSRRSNSKKRTYSNSEDRKRKRLNSRHDDTSMSSEPVETIYRILCPVKKIGSVLGRGGDVVKALREETKAKIRVADPIPGADERVIIIFNYQNQPELTDEAAETKFSDGLGNMKPHCFAQDALLKIHDKIVADEIHDGVAHEEKSESADDVTARILVQGNQVGCLLGKGGSIIQQLXSDTGAGIRVLP

SEQ ID NO: 41426 - protein, 268 aa, Sorghum bicolor
  Clone ID: SORBI-28MAY03-C39410_1.pep
MARRGLMEQDLSKLDVTKLHPLSPEVISRQATINIGTIGHVAHGKSTVVKAISGVQTVRFKNELERNITIKLGYANAKIYKCEDDRCPRPMCYKAYGSGKEDSPLCDVPGFENTRMKLLRHVSFVDCPGHDILMATMLNGAAIMDGALLLIAANESCPQPQTSEHLAAVEIMRLQHIIILQNKIDLIQESAAMNQHEAIQKFIQGTIAEGAPVVPISAQLKYNIDVICEYIVKKIPIPERNFTSPPNMIVIRSFDVNKPGSEVDEIRG

SEQ ID NO: 41427 - protein, 227 aa, Sorghum bicolor
  Clone ID: SORBI-28MAY03-C39569_1.pep
MSLSSARQRRATAASPPTDDGYAKDAKDRRRRPGGDGDGEDEGIKWFLPFLALGLLRHMSASSNLIHDCDEVFNYWEPLHFLLYRSGFQTWEYSSDFALRSYLYLFFHALVAGPASLIFGENKVRVFYSLRIFLGLISTITETVLVVALSRRYGKRLACYVLAMLCLSSGCFFASTSFLPSSFSMYAVTLSSALFLLEKYAGAVSVAAAGVILGWPFSILVFLPVTC

SEQ ID NO: 41428 - protein, 330 aa, Sorghum bicolor
  Clone ID: SORBI-28MAY03-C3938_1.pep
MAEVPAVVAAASSCEVDLGNLMAYDPSHHVVSAAAAASREELRQECLRKGTELAQAVADALFALPPSEDRDGPIVHLPPPTVRLPREKHLPKPKPPTKWELFAKAKGITKRKKNKREWDEQTQSWKRTYGYDRVNDDKDIPIVEAKLTDEPGVDPFAQRRDEKKKRVEKQEKNRLENLKKAAKIGALPSHIQLAAKALPITGTKADLPKKSRKEDLESVVGMASSATASGGKFDEKLPGEKPPKHSGKHRKFLPVAEGKGMGSLEKQQNDKILNSLLARNSDEPLDVGKAITMYKVKKEKQRRKEKDMSSKSDKLKPQKKPHKKSSKKKA

SEQ ID NO: 41429 - protein, 176 aa, Sorghum bicolor
  unsure (1)..(176): unsure at all Xaa locations
  Clone ID: LIB3481-031-P1-K1-H7.pep
MAKERGAATIAASSYEVDLGNLMAYDPSHHXAASREELRQECLRKGTELAQAVADALFALPPNEDRDGPIVHLPPPTVGLPREKHLPKPKPPTKWELFAKAKGITKRKKNKREWDEQTQSWKWTYGYNRVXMPIIEAKSTDEPGVDPFAQRRXEKKKRVEKXEKNKLENLKKAAKI

SEQ ID NO: 41430 - protein, 231 aa, Sorghum bicolor
  unsure (1)..(231): unsure at all Xaa locations
  Clone ID: SORBI-28MAY03-C3960_1.pep
FAATELGELRSVLKKSLVDSCGKDLFQSLYASWRHSPMATISLCLLAQXYSHASCVIQSLGEEDINVKFLVQLDKLIRLLETPVFAYLRLQLLEPGKHTWLLKTLYGLLMLLPQQSAAFKILRTRLKTVPFSENLKRTSSANPYSQILQVTEDGNRNQDTQNYSAINFPFLLQQFENMQLQHRNHLKDQLQSRKSASALTLSQEIQRYEEAHSSSLSEINRPPSRTSKGIL

SEQ ID NO: 41431 - protein, 85 aa, Sorghum bicolor
  Clone ID: SORBI-28MAY03-C38552_1.pep
PFVQVLLRSRCPAFQGFRPGHSSALHPLPRPMHVVVGKPIEVNKNPQPTIDEINEVHEQFIIALRDLFEKYKGKAGYPGLHLRVL

SEQ ID NO: 41432 - protein, 117 aa, Sorghum bicolor
  Clone ID: SORBI-28MAY03-C3857_1.pep
ANTDCRVLIRGRGSIKDPAREEMMRGKPGYEHLNEPLHILVEAELPVEIIDARLMQAREILEDLLKPVDESQDFFKKQQLRELAMLNGTLREEGMQRSGSASPFHNSLGMKRAKTRG

SEQ ID NO: 41433 - protein, 424 aa, Sorghum bicolor
  Clone ID: SORBI-28MAY03-C38623_1.pep
ARRCVLLAGAHRASAPGGVAARPRLRLLPSTDASWATAVLALCGRWGLSREGPAAQDWRRLLAPTWEALRLRCAALLGQWSRVLPSSRREPWSFSERVRGARCPSLMVPVNILSSCSGSFMKDELAISRKPSKSPQTLMKELVSSLLESKGMPPQLLEQLPARWETLGDVVILPKTCFKNPLWESVSEELWPRVAMAPGALRPAPQGFILPFASRGCSLELLLGDNGWVTHYENGICYSLDATKCMFSSGNRSEKLRMGQLNCRDEVVVDLFAGIGYFVLPFLVKANAKLVYACEWNPHALEALRPNVSDNSVEDRCIILEGDNRVTAPKGVADRVCLGLLPSSECSWATAVEALRIGGGILHIHGNVNDSDETRWLDNVVESISNIAKNHGLSWNVLVEHVERVKWYGPHIRHLVVDVRCRQI

SEQ ID NO: 41434 - protein, 75 aa, Sorghum bicolor
  Clone ID: SORBI-28MAY03-C38658_1.pep
METPQIEMGGFKVNSPQVPNGGLRPTVSSSWNSRGTVERAIKSIRIVVFTSKLNVLMPFGPASIILHFTTRRHGL

SEQ ID NO: 41435 - protein, 221 aa, Sorghum bicolor
  Clone ID: SORBI-28MAY03-C38691_1.pep
MASSCPPAPSGAALCRPRRPRCRVVACSAADAEPAWAKGAGRLACGVLAAWAVASASNPVIAASQRLPPLSTEPNRCERAFVGNTIGQANGVYDKPLDLRFCDYSNEKTNLKGKSLAAALMSEAKFDGADMSEVVMSKAYAVGASFKGTDFTNAVIDRVNFEKADLTGAIFKNAVLSGSTFDDAKMDDVVFEDTIIGYIDLQKLCTNTSISPDSRLELGCR

SEQ ID NO: 41436 - protein, 131 aa, Sorghum bicolor
  Clone ID: SORBI-28MAY03-C38736_1.pep
MPINGVPVASFPANVRFHNAAAAEPALLPQVAPTETGSDQSGLAFQSAFGNIWSDPCIEFAFKTLTGDIPVLDDTTAVTDYFPEQQDLNKGPAQNGAGSVFDNSRNHTQVDVNLPPPTPDDFCNGSWFPPQ

SEQ ID NO: 41437 - protein, 433 aa, Sorghum bicolor
  Clone ID: SORBI-28MAY03-C39789_1.pep
ARGSKMYLEACPKLIERFREREENVKMDIFNTFIELLRQTCNVTKGQGDIDESSPRWLLKQEVPKVVKSINRQLREKSIKTKVGAFSVLKELVVVLPDCLADHFGSLVPGIEKALNDKSSTSNLKIEALVFTRLVMASHSPSVFHPYIKALSAPILSAIGDRYYKVTAEALRVRGELVRVLRPNLETSSVDFRPYSGPIYNAILGRLANQDQDQEVKECAISCMSLVVSTFGDGLQRELPACLPILVDRMGNEITRLTAVKAFSVIANSPLRIDLSCVLDHVVSELTAFLRKANRALRQATLGTLNSLVVTYGGQIGSSSYETIIAELSTLISDMDLHMTALALELCCTIMVDRKSIKNVGLAVRNKVLPQALVLIRSALLQGQALQALQRFFASLVQSANTSFDALMDSLISAAKPSQSGSLAKQALTSIAK

SEQ ID NO: 41438 - protein, 112 aa, Sorghum bicolor
  unsure (1)..(112): unsure at all Xaa locations
  Clone ID: SORBI-28MAY03-C39807_1.pep
MLATPPRRCRSRARPCPTRNAAPPSPAEAARPHPPLLEPRSPRISRAAPASDCRSCAHPRPPEPRXADPLPPEPRSPEPRPLEPRSPEPRPSEPRSPEPRLPESLEGRPCAC

SEQ ID NO: 41439 - protein, 187 aa, Sorghum bicolor
  Clone ID: SORBI-28MAY03-C39811_1.pep
MMRECGIIDTRLDESMKGHPGIPSDILSDLFDDGSIKFDANLPSKKIRGHLRSLKPGDACKLLENLVSAWIIRSGSTEVVLRWIYCLLVIHGRFIPSEKTTKVISNLHKMCAERYKATEDLLKLSGRLRLITAQVDKAASSMSEPTSEEMQDAAFQSDEDEDEDVDETVFGQDSQNSDDDDDHDDAK

SEQ ID NO: 41440 - protein, 128 aa, Sorghum bicolor
  Clone ID: SORBI-28MAY03-C3984_1.pep
MADPELEAIRQRRMQELMAQRGGANQQNAGQQKAQEDAKQEAEERRQMMLAQILSSEARERLSRIALVKPDKARGVEDVLLRAAQTGGISEKVSEERLISLLEQINTQTNKQTKVTIQRRRSVLDDDD

SEQ ID NO: 41441 - protein, 67 aa, Sorghum bicolor
  Clone ID: SORBI-28MAY03-C39180_1.pep
LASFVKLRNAGCVPSVILFSGVMLVIEEMGLMLAGCVPSVSQGPRCVFCLMHLTGGVSAARLLHVEA

SEQ ID NO: 41442 - protein, 155 aa, Sorghum bicolor
  Clone ID: SORBI-28MAY03-C39198_1.pep
GQGRTREGKRQGEQEKESGSVAANICWIWRLAAVLWNLFFEGCCAPGLLPSVCITVFLLVTFFLISLWFSFFLVTTRLRRGHAAISASCDYVVRRLPGGYLCRIAEDCIINCILSSNRMYIKYWCIRYMYHIGLFANIQTELFAYIVSNKVCIDS

SEQ ID NO: 41443 - protein, 106 aa, Sorghum bicolor
  Clone ID: SORBI-28MAY03-C3922_1.pep
TDDPLQIHLTKEPLVEEYSIAASLWKLSSCDLCEIARNSVYQSGFSHAQKSHWIGKNYFKRGLAGNDIHRTNVPHIRVQFREMIWRNEMKLVYSDNEILIPDELDL

SEQ ID NO: 41444 - protein, 242 aa, Sorghum bicolor
  Clone ID: SORBI-28MAY03-C39238_1.pep
MAAAVAPPLCTWLVAACLSAACGDGEKEKQRRHRGVGGLFGSHRRLGSGRRGGARSGMAMSVALQPERTAVESKKPDMKQRRVVVTGMGVVTPLGHDPDEFYNNLLRGISGISEIEAFDCSHYPTRIAGEIKSFSTDGWVAPKLAKRMDKFMQYLITAGKKALENAGITEEVMDELEKSRCGVLIGSAMGGMKVFSDAIEALRVSYKKMNPFCVPFATTNMGSAILAMDLGWMGPNYSISTA

SEQ ID NO: 41445 - protein, 87 aa, Sorghum bicolor
  Clone ID: SORBI-28MAY03-C39314_1.pep
LDLYYLWSKPNFRNYFTSFCEQLVLDICISRGLIVYCLLVTQVIIEYIIKATQPKGYEVFALIVHGIKLLGFIPSRSLPFRCPNPRA

SEQ ID NO: 41446 - protein, 107 aa, Sorghum bicolor
  Clone ID: SORBI-28MAY03-C40333_1.pep
ITEGIGINRVTKNFMMAELDGAYRGSDREAVEMSRFLLKNDGLFVGSSSAMNCVGAVRVAQDLGPGHTIVTILCDSGMRHLSKFFNEQYLADHGLTPAATALEFLDK

SEQ ID NO: 41447 - protein, 186 aa, Sorghum bicolor
  Clone ID: SORBI-28MAY03-C40283_1.pep
TKRNKDSDDEQNRVRKYRKKHQESDEEEDESEESYKHSRKRHRPEHSRGRSKDVHKHKHKSHSKDRESRHHRHRYNSLEDEQEHERRSSKSRHRHRDDHHYSDEEEHRSHKHRRREHHSSSKRKHEEDRYQSEQSQGRLEVSSPSRSGAKFESDKLPDDTAQSTEGATAVPSELRAKIRAMLLERL

SEQ ID NO: 41448 - protein, 143 aa, Sorghum bicolor
  Clone ID: SORBI-28MAY03-C40352_1.pep
TVGAQGVAFGAEAGYDTATGKFTKYTAAIGVTKPDYHAAFILADKGDTIKVSGVYHFDEKQKPSAVAELTRRLSTNQNTLTVGGLYTVDPQTSVKARLNNTGTLAALLQHELKPKSVLTISGEFDTKALDRPPKFGLALALKP

SEQ ID NO: 41449 - protein, 214 aa, Sorghum bicolor
  Clone ID: SORBI-28MAY03-C40377_1.pep
SARWKFKKGPEYGNGVSALSVPKQYSSSTKQSSGNKFQSISSARVAPWLETGDAVANMYSESRGEARDFARVRNACFEQARQAYLVGNKALAKELSMKGQAYNAQMKSAHEKAREAIYRQRNPVSSQRGGDRLIDLHGLHVNEAIHILKGELTALKSAARAAGERMQVMVCVGTGHHTKGSRTARLPIAVEQFLLDEGLQYTQPQAGLLRVMVY

SEQ ID NO: 41450 - protein, 104 aa, Sorghum bicolor
  Clone ID: SORBI-28MAY03-C40415_1.pep
SLEMCAERAVAYFKDQIILKLVAGKHVMIAAHGNSLRSIIMHLDKLTSQEVISLELSTGIPMLYIFKEGKFIRRGSPAGPSEAGVYAYTKNLAQYRQKLDGMFQ

SEQ ID NO: 41451 - protein, 214 aa, Sorghum bicolor
  Clone ID: SORBI-28MAY03-C39666_1.pep
MAGAAGRKKRVGRYEVGRTIGQGTFAKVKFAVDADTGAAVAMKVLDKETIFTHRMLHQIKREISIMKIVRHPNIVRLNEVLAGKTKIYIILELVTGGELFDKIARHGKLRENEARKYFQQLIDAIDYCHSKGVYHRDLKPENLLLDSRGNLKVSDFGLSTLSQNGVGLLHTTCGTPNYVAPEVLGSNGYAGSAADIWSCGVILYVLMAGYLPFE

SEQ ID NO: 41452 - protein, 209 aa, Sorghum bicolor
  Clone ID: SORBI-28MAY03-C3968_1.pep
MASSLARLGAALPRARPCATARALPPGRWDAAALGASRRAALNACRCQVHSDVKVAPASDLKDGSKSETWRIKMLYDGDCPLCMREVNMLRERNKSYGAIKFVDISSKDYSPDNNQGLDYETAMGRIHAILSDGTVVTDVEAFRKLYEEVGLGWVYAVTKYEPVATMANAVYGVWAKYRMQITGRPPLEEIMASRRAAGECKDDKVCKM

SEQ ID NO: 41453 - protein, 108 aa, Sorghum bicolor
  Clone ID: SORBI-28MAY03-C39715_1.pep
TRATHAPAVSLPPSRPPSAAATAGVSGHRHSLPPSPCLTPLFASRSRFSRSTPHRFRLARSRYPLTETAPAVPLRSDSSPSSSPLGAAGVERRSDPPGAEELIPSLAV

SEQ ID NO: 41454 - protein, 101 aa, Sorghum bicolor
  Clone ID: SORBI-28MAY03-C3964_1.pep
FGRRVTGGARGDERRRGQPPTAAGAPNAASTAATVPVPPLTTTAVADMSQMKISVSLVHQEHSSSLACILSSQSHSQKGIYLSSAQSGAAALVLRYLLSLK

SEQ ID NO: 41455 - protein, 68 aa, Sorghum bicolor
  unsure (1)..(68): unsure at all Xaa locations
  Clone ID: LIB3481-032-P1-K1-D11.pep
WKGENTVFAFVSELFYQPAERIFHINLENDQEEHVRDQLNKGVVPEDISVHCYXXLPYMYLYRRIKEA

SEQ ID NO: 41456 - protein, 207 aa, Sorghum bicolor
  Clone ID: SORBI-28MAY03-C39744_1.pep
MAKPPSSAAAAAAGGRGPVHNRTRLLLVLLVAVAASASTAGFLLRGALRDPCDGRGDPAALNTAVAAGSPLGFMRSKLVLLVSHELSLSGGPLLLMELAFLLRHVGSEVVWITNQRSEETNDVTYSLEHRMLSHGVQVLPARGQEAVDIALKADLVILNTAVAGKWLDPVLKDHVPKVLPKILWWIHEMRGHYFKVEYVKHLPFVAG

SEQ ID NO: 41457 - protein, 364 aa, Sorghum bicolor
  Clone ID: SORBI-28MAY03-C39770_1.pep
ARGLKSVLSGVVVKEETGEGKKDAAKATGKGDAASDGGPTGAPRPDKKLLLFILDRLQKKDTYGVFSEPVDAEELPDYFDIIEQPMDFSTIREKLLNDSYSKLEQFEDDVFLLTSNAMSYNSADSIYFRQARSIEALAKKDFENLRQPSDEEEEPKPPARRGRPPKNPRTEGDVSPDLSNVKTNKTEDNVDTFRKRSTGDRTRNTNTPMKDPSSFHNMLGSSSAKRADKIGDYSGSSKWGKKPVVTLDDDRRSTYDQHYSRNSSMFAALDDERKLLGPVGVQQQHAYARSLARFASKLGPVGWDVATNRIRRALPPGTSFGPGWVVDGEPPQNSQWAPVASTNPSECTAPPNMPSKNDVLHHKS

SEQ ID NO: 41458 - protein, 145 aa, Sorghum bicolor
  Clone ID: SORBI-28MAY03-C40784_1.pep
ESPRSPGVVVSFDPKPIPGDWNGAGAHTNYSTKSMRSDGGYEVIKKAISKLGLRHREHIAAYGDGNERRLTGRHETADINTFIWGVANRGASVRVGRDTEKEGKGYFEDRRPASNMDPYVVTSLIAETTILWEPSHSNGKGAAAP

SEQ ID NO: 41459 - protein, 98 aa, Sorghum bicolor
  Clone ID: SORBI-28MAY03-C40814_1.pep
HSVGGFSYGVLAPSSYCLRAATVLRIPVRNTHVYAFAEHGTDLGSSKDVKGNPTEFFRRVGHGSSYGVGVKLGLVRGEYIVDHNAGTGTIFFRFGERF

SEQ ID NO: 41460 - protein, 171 aa, Sorghum bicolor
  unsure (1)..(171): unsure at all Xaa locations
  Clone ID: SORBI-28MAY03-C4086_1.pep
VRLAELALLDPKRAKRIXXNRQSAARSKERKIKYTSELERKVQTLQTEATTLSAQLTLLQRDTSGLTTENRELKLRLQAMEEQAKLRDALNDALREEVQRLKIAVGQVPNMNGNPFNGGLPQQQQMPSYFSQQQQMQYFGSHQGQHHNPNHHPQNSSNGGGQSLSDSMDFM

SEQ ID NO: 41461 - protein, 191 aa, Sorghum bicolor
  Clone ID: SORBI-28MAY03-C40884_1.pep
SNQEHGDGIGGTIPATIGSGGLDAPPESPLPQPEVVVATTGITQPNKDMEDVLPPAIEDGALQATLEHAVGILEVTPDDGLEDVAPSAVGESGDDMEIMPPAIAEPRVGKDPDPIASPPDSQEKPSIMQDTETGMEVEVDKVIDDSPGVGRVGSILGTKLDVAATDGDSEALLVESRVNLSRIPNSPESTH

SEQ ID NO: 41462 - protein, 182 aa, Sorghum bicolor
  Clone ID: SORBI-28MAY03-C40914_1.pep
MRVKVISRSTDDYTRERSQDLQKVFRNYDPALRSQEKAVEYTRALNAAKLEKIFAKPFIGAMDGHIDAVSCMAKNPNHLKAIFSGSMDGDVRLWDIAARKTVCQFPGHHGAVRGLTTSTDGDFLVSCGVDCTVRLWKDPMLKMVDNSDPARLWKLPSPVFAGTRALWGADPQPSAVYTWKHA

SEQ ID NO: 41463 - protein, 217 aa, Sorghum bicolor
  Clone ID: SORBI-28MAY03-C3989_1.pep
MNTAMATTSLSLQGRPSHAPTRKLSSPFLGAPASFLRPLAPAPAAAPSSRRTLAVRAMAPPKPGGKAKKVVGLIKLALEAGKATPAPPVGPALGAKGVNIMAFCKEYNAKTADKPGYIIPVEITVFDDKSFTFVLKTPPASVLLLKAAGVEKGSKEPQRAKVGKVTADQVRAIAQEKLPDLNCKSIDSAMRIIAGTAANMGIDIDPPILVKKEKVLL

SEQ ID NO: 41464 - protein, 168 aa, Sorghum bicolor
  unsure (1)..(168): unsure at all Xaa locations
  Clone ID: SORBI-28MAY03-C40034_1.pep
QAIPAQALEAGLLLPRKSLNFKATPMPSFYKEPPPPKVELKKIPTTRATPPWLDRAPYTXPGAPKLGRSLHPAPGGTEGNSNPPAHSARLSLDERVSQNGVKKAPAANAVKKPQRKSLPKLPSEQATKVDIAASVSSAEELENKSSSTCLVREAIRAQVTPDEPGLSA

SEQ ID NO: 41465 - protein, 121 aa, Sorghum bicolor
  Clone ID: SORBI-28MAY03-C39969_1.pep
ADVKATTSDGLGPHAALLVATNEKPFQQATQYIRSRGTVVCIGLPANAQFSAPVFDTVVRMISIKGSYVGNRADTAEAIDFFRRGLIKVPFKTVGLSELNEVYKLMKAGQIVGRYVVDTSR

SEQ ID NO: 41466 - protein, 152 aa, Sorghum bicolor
  Clone ID: SORBI-28MAY03-C40077_1.pep
PKTSTGGTPWVYYSTYAFLVFVFNIFDIANLPKEISDYLNKMSARVPRIKPGRATVDYLTKIQTSTRFWGGLLLSLLATSSLLLDRYLRQINEGFSIRAPPAWLSGGASHALASPRPLIFCCSSPAIRALTDADSIMESKVIYYLEQCGLGV

SEQ ID NO: 41467 - protein, 63 aa, Sorghum bicolor
  Clone ID: SORBI-28MAY03-C40086_1.pep
TPAQNGDVGKATVNPVQGAGHDPKIANDNNSAHPSLNSGVQPSGSPPRGKLANPKHPDLALQL

SEQ ID NO: 41468 - protein, 253 aa, Sorghum bicolor
  Clone ID: SORBI-28MAY03-C4017_1.pep
PRVRAEKAKVTKKQKVVTKEKKFSTPEAKKDAKQDSDRRTEEKGGNSAEEDNSHSSAEEDNKRKRQQTPAYGKQVEHLKSIIKSCGMTIPPNVYRRVKQAPENKREACLIKELQDILEKEGLSKNPSEKEIKSVKKRKERAKELEGIDMSNIITSSRRRSTSSFIPLPPPPKIEVDSDDEEEDDDAEDDDEVDEENVKGGDEDTDEVDEENVKGGDQDNDEVDEENVKGGDEDNNDTAEAGDGSADAAEKESD

SEQ ID NO: 41469 - protein, 315 aa, Sorghum bicolor
  Clone ID: SORBI-28MAY03-C41229_1.pep
TRAEAARLGQPMSMVLPGVVGFKLSGKLKNGVTATDLVLTVTQMLRKHGVVGKFVEFYGQGMSELSLADRATIANMSPEYGATMGFFPVDAKTLDYLKLTGRSDDTVAMVESYLRANKMFVDHSQVEAERVYSSYLELNLEEVEPCLSGPKRPHDRVTLKNMKSDWLSCLDSDVGFKGFAVPKESQGKVAEFSFHGTPAKIKHGDVVIAAITSCTNTSNPNVMLGAALVAKNACELRLEVKPWIKTSLAPGSRVVKKYLDKSGLQKYLHQLGFHIVGYGCTTCIGNSGQLDESVSAAITENDVAAAAVLSGNMNF

SEQ ID NO: 41470 - protein, 85 aa, Sorghum bicolor
  unsure (1)..(85): unsure at all Xaa locations
  Clone ID: SORBI-28MAY03-C41510_1.pep
XRPHHRQPRRAQPARGRQLASTRGGHSTRRQACSGSEDSSVRLHRSASCRPYPYLYVGYLGMDECVAARNRRRGMSRVILFCRHG

SEQ ID NO: 41471 - protein, 92 aa, Sorghum bicolor
  Clone ID: SORBI-28MAY03-C41366_1.pep
TKMHIRIFLLYLLVGLLNLNFIACCCVLWPFLGHVHLLAARVCWPVGGDFRHRPHLVSTLVPLLQRDQAPMVYMAMVQADAGIHAHKWDLIK

SEQ ID NO: 41472 - protein, 56 aa, Sorghum bicolor
  Clone ID: SORBI-28MAY03-C41533_1.pep
RDDAAVYIIAANVPYRYNSFFPYYIFSLFFCNCTNCFCIMYVNWLDSIYWSSQTTT

SEQ ID NO: 41473 - protein, 124 aa, Sorghum bicolor
  Clone ID: SORBI-28MAY03-C4157_1.pep
VRLEPFHKLTWEQVGLVVGKGLIDNVLSDYLWAKAILLTTTTVATAGLTIQVPIAAIVDTLTGHAPHLLDYIGAAAVLVGFAGINIPVGESPQVVQQEQETPIVSMVDDPVHLPSSTNATDVVS

SEQ ID NO: 41474 - protein, 237 aa, Sorghum bicolor
  unsure (1)..(237): unsure at all Xaa locations
  Clone ID: SORBI-28MAY03-C40476_1.pep
MAFAARRSIATRLSHHLTRRVHPCVPHALTSHSHDEQASPSPPLPPLHAPLQQRSRAAQTLGFLPFSLHLAGSTRRSFSSSSSAPAPNLEDAPAAEVDAAGVLADAAEAAASVPAPFPGEVAAAAADSFPPVAALQHIIDAIHTFTGLNWWACIALTTLIIRSATIPLLVNQLKATTKXRAINPEMEAIKDQMNSMDPKSAQEGXAKMKALXKKHGVSPFTXMKGLLIQGPMFMSFY

SEQ ID NO: 41475 - protein, 296 aa, Sorghum bicolor
  unsure (1)..(296): unsure at all Xaa locations
  Clone ID: SORBI-28MAY03-C40598_1.pep
EKNHDMAAYXLEVSFRTLRVRDQALSRIKSNIELMVATNGGNRVVVIPHSMGVLYFLHFMKWVEAPPPMGGGGGPNWCEKHIKAVMNIGGPFLGVPKAVAGLFSSEAKDVAVARAIAPDVLDSDFLGLQTLRHLMRMTRTWDSTMSMIPKGGDTIWGNLDWSPEDGLECKAKKHKTNDTEVSKDSNGENVEVQPEPINYGRLVSFGKDVAEAPSSEIEQIEFRDAVKGNSIAHSNTSCREIWTEYHELGWGGIKAVEDYKVYTASSVIDLLHFVAPRMMQRGNVHFSYGIADNLDD

SEQ ID NO: 41476 - protein, 129 aa, Sorghum bicolor
  Clone ID: SORBI-28MAY03-C40700_1.pep
IDSSGSSHNIELDSFEPPKADLLMPFSAKLVDGINRNDSRRRALMIFCFEYFNVIARNAVMLSIDHHGFDVLAKVPERTILTDVPRQYHWKEFRFTFKEPAKDAEDFCRMLVGLEDEVLKSLKSYSGLG

SEQ ID NO: 41477 - protein, 130 aa, Sorghum bicolor
  Clone ID: SORBI-28MAY03-C40655_1.pep
FVLGEVVHIFRPLVYVLLIRKFGIKSWTPWLVSLAVELTSLGIHSHATDLNHRLGKVHHLSSAERDELKRRKMMWALYLMRDPFFASYTKRHLQKAEQVLNPVPLIGFLTGKLIELLEGVQTRYTYTSGS

SEQ ID NO: 41478 - protein, 94 aa, Sorghum bicolor
  Clone ID: SORBI-28MAY03-C40783_1.pep
MAQKSTNCCRLIPRHTYDRTGSSVGASIGNWQPSPLIRILNSRSLLRFGQCTTTSSSCRQPQCMCKHSFSCSSLLFLQAFSSNSSSISCAAPLA

SEQ ID NO: 41479 - protein, 302 aa, Sorghum bicolor
  Clone ID: SORBI-28MAY03-C41968_1.pep
MESLAATSVFSPSRAAVPAGGARVRAGTVVSTRRRSSSRSGAIGVKCSTVAPQASSAVSRSAVAAKAAEEDKRRFFEAAARGSGKGNLVPMWECIVSDHLTPVLAYRCLVPEDNVDAPSFLFESVEQGPQGTTNRVAFLGRYSMVGAHPVMEIVAKEHKVTIMDHEKGHVTEQVVDDPMQVPRNMMEGWHPQQIDELPESFSGGWVGFFSYDTVRYVEKKKLPFSGAPQDDRNLPDVHLGLYDDVLVFDNVEKKVYVIHWVNVDRHASVEEAYQDGRSRLNLLLSKVHNSNVPTLSPGFVKL

SEQ ID NO: 41480 - protein, 279 aa, Sorghum bicolor
  unsure (1)..(279): unsure at all Xaa locations
  Clone ID: SORBI-28MAY03-C4195_1.pep
VRNNNLSDEESRQLDKRSRQIQSEIRTVGHMRQADLLPLAAHVPRPDCHXAGHGYMKNGSLHHALKAGNSAVEVEDGGGGEDGGTGTCTGTSGGLSWPARLRVAVGVAAGLEYLHVSHQPQIIHRDLKPANILLDDDLEPRIADFGLAKAMPDSHTHVTASNVAGTLGYIAPEYYQTVKFTAKCDVYSFGVILAVLATGKEPSDQFFTETEEVVGLVKWLRRVMESGEHAQAIDPAIAGAGHDEQILLLLRIALFCTKDDPKERPTAKDVRCMLSQIKT

SEQ ID NO: 41481 - protein, 148 aa, Sorghum bicolor
  Clone ID: SORBI-28MAY03-C42066_1.pep
VLRSDEAEKLSRQLGGKCKEKGLVVPFCPQLEVLAHKATGCFLTHCGWNSTIESMATGVPMAAMPQWADQPTTAKYVESAWGIGVRMRKGLVRREEVERCIREVMEGERKDEFRQNAARWMKKAKEAMQEGGSSDKNIAEFAAKYLSV

SEQ ID NO: 41482 - protein, 154 aa, Sorghum bicolor
  Clone ID: SORBI-28MAY03-C42187_1.pep
LREVEVPLELDVYEFCSDELKQKLQAPRQMLRDAENAKFGLKAHGKASSSKENEESSSAGESSSMDIDKAESSLPKKQLTGVYDLVAVLTHKGRSADSGHYVGWVKQDDGKWIEFDDDNPNIRKEEDILKLSGGGDWHMAYICLYKARMAESKS

SEQ ID NO: 41483 - protein, 269 aa, Sorghum bicolor
  Clone ID: SORBI-28MAY03-C42401_1.pep
TRALRARHAPPCLPAPPSAPAAASAPAPPPNPPPPPSRPVPAGRAVPAPRRFAPPRPFSHGVAFSLPGVIGLPADAGVPAAPLARPAPLSRPGPPSPPGAVSEATMAAAMASLGAAAVVHCNTEPHAQAAIVRAAKSRRLPFVSSVPFFSPSSAPTLNDFAGNEYALVTQHRHSLSTLVGVAAAARPPSRPVPVSVSPLLCPAPRLASASFDFEKAAAFLADEGLDYAPLVSDDGEVVDLITAKDVERIRSYPKLGKPSLGADGKFVVA

SEQ ID NO: 41484 - protein, 189 aa, Sorghum bicolor
  Clone ID: SORBI-28MAY03-C40919_1.pep
MASASPPAPRRSARARRLPPRLADSAIQASTSARPRTARARRPLPQPADGAMASTSSAPRRSSRVRRLPPRLADSAIEASTSARPRAARARRPLPQPASTSARRRAARGPAAQPVFLPEEIWEYIFLRLDAAVDLVHASAACSSFRRIVSEPQFLRRFRSLRSPAILGLITSSGYRRFFPAGPPHRSAP

SEQ ID NO: 41485 - protein, 293 aa, Sorghum bicolor
  Clone ID: SORBI-28MAY03-C41007_1.pep
MGLAKDGAELEEGSLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLDISGSSINPSERTYPEEMIQTGISTIDVMNSIARGQKIPLFSAAGLPHNEIAAQICRQAGLVKTLEKSAKHKESGVEDNFAIVFAAMGVNMETAQFFKRDFEENGSMERVTLFLNLANDPTIERIITPRIALTTAEYLAYECGKHVLVILTDMSSYADALREVSAARE

SEQ ID NO: 41486 - protein, 216 aa, Sorghum bicolor
  Clone ID: SORBI-28MAY03-C41038_1.pep
QHCSATKARESRGIEGEQSFVGAAMAGTWVKMEQKGGGPGARSSHSITLVGHTAYSFGGEFTPRVPVDNTMYAFDLGTQTWSALDDATGDVPPPRVGVTMAAVGGTVYTFGGRDLEHKELNELYAFDTATRAWTLLSSSGGGPPHRSYHSMVADAEGGRVYVFGGCGDAGRLNDLWAYDVASGRWEELPSPGEACRPRGGPGLAIAGGKVWVVYGF

SEQ ID NO: 41487 - protein, 87 aa, Sorghum bicolor
  Clone ID: SORBI-28MAY03-C41157_1.pep
LWFCRSCRASLSLTFSAITLTATFLWMLTSTGSEITGEFSDNVRSSPVEYLLLSAFDSFTLVEPDLVDFFPKSTDLIHFPGDLPIVA

SEQ ID NO: 41488 - protein, 373 aa, Sorghum bicolor
  Clone ID: SORBI-28MAY03-C41163_1.pep
MTGGHHFNNILLGGRGGTNPGQFKVYSGGLAWKRQGGGKTIEIDKADVTAVTWMKVPRAYQLGVRIKDGLFYRFIGFREQDVSSLTNFIQKNMGVTPDEKQLSVSGHNWGGIDIDGNMLTFMVGSKQAFEVSLADVAQTQMQGKTDVLLELHVDDTTGANEKDSLMDLSFHVPTSNTQFVGDENRPPAHILWETILKFADVGSSEEPVVTFDGIAILTPRGRYSVELHLSFLRLQGQANDFKIQYSSIVRLFLLPKSNNPHTFVVITLDPPIRKGQTLYPHIVIQFETEAVVERDLALSKELLVDKYKDRLEESYKGLIHEVFTKVLRGLSGAKVTRPGSFRSCQDGYAVKSSLKAEDGLLYPLEKGFFFLPK

SEQ ID NO: 41489 - protein, 114 aa, Sorghum bicolor
  unsure (1)..(114): unsure at all Xaa locations
  Clone ID: SORBI-28MAY03-C41208_1.pep
MVAIENNQSQVQVAVAAEAVPVPVPGPRIPREARSLLHELAAAWADVADCRALEVVPLKGAMTNEVYQVRWLTGPAAAGEKEEPRREREXVRKVLVRIYGDGVDLFFDREDEVR

SEQ ID NO: 41490 - protein, 80 aa, Sorghum bicolor
  Clone ID: SORBI-28MAY03-C4285_1.pep
MSRSGQPPDLKKYMDKKLQIKLNANRVVIGTLRGFDQFMNLVIDNTVEVNGNEKNDIGMVVIRGNSVVMIEALEPVAKAQ

SEQ ID NO: 41491 - protein, 208 aa, Sorghum bicolor
  unsure (1)..(208): unsure at all Xaa locations
  Clone ID: SORBI-28MAY03-C42894_1.pep
MRLPAGARLALLLARRSLSSSASSSSRLPRAHRGIWSDAARVVPSRSSPFSSPSSAHRFFHGTRPVAARDYYDVLGVSKNASQSDIKKAYYGLAKKLHPDTNKGDADAERKFQEVQRAYETLKDEQKRSLYDQVGPDQYEKAASGGGGTGFEGGFGNPFEDIFSGGGGSGGMNDFFRNIFRDRDFGGRDXRLHLNYHLWKQFKGAAKR

SEQ ID NO: 41492 - protein, 134 aa, Sorghum bicolor
  Clone ID: SORBI-28MAY03-C42922_1.pep
RAARSVRPIIGAHGSAEATSAIFTRDERYVLSCGKDSCVKLWEVGTGRLVKQYAGAIRRQFRCQAVFNETEEFVLSVDEQNNEVVVWDALTAEKVARLPSGSTGAPRWLDHSPVEPVFVICGNDRSIRFWKQTV

SEQ ID NO: 41493 - protein, 118 aa, Sorghum bicolor
  Clone ID: SORBI-28MAY03-C42931_1.pep
ISSLIYLQFERLFQFNRKVEELTYTIAAEEIPFQLGLSKTDLRRVLKSSLSGIDKSIGAMYRRLQKTLTSDELFPSLWDKCKKEFLDKYESFVQMVTRIYGNEPIMSVNEMKEVLASF

SEQ ID NO: 41494 - protein, 205 aa, Sorghum bicolor
  Clone ID: SORBI-28MAY03-C43075_1.pep
SYPELTAMQARAIFEAAIAVNDQGFQVFPEIMVPLVGTPQSDVFQELEQQMSVIHQVAHKVFANPETTIRYKIGSMIEVPRAALIADEIAELAEFFSFGTNDLTQMTFGYSRDDVSKFLPTYISQGILQHDPFEVFDQKGVGELVKIATARGRRSRPDLEVGICGEHGGEPSSVAFFAKAGLDYVSCSPFRVPIARLAAAQAALE

SEQ ID NO: 41495 - protein, 186 aa, Sorghum bicolor
  unsure (1)..(186): unsure at all Xaa locations
  Clone ID: SORBI-28MAY03-C5506_1.pep
MTSRLLRTGCSQADVRRQLRSAAHGRPLPRTPTTLRLEEHVRSRVLEPATRGTINVLRSCVRAGTVRRVVFTSSVSTLTAADAEGRRKAVLDESCLRSLDDVWRTKPVGWIYILSKRLTEEAAFRFARENGVHLVSLVLPPAARPSLEAAFRFARENGVHLVSLVLPTVAGPFLTXSVPTSIQLLL

SEQ ID NO: 41496 - protein, 305 aa, Sorghum bicolor
  Clone ID: SORBI-28MAY03-C55097_1.pep
ARGEIWAAEGLVEHQHTGEQYFDQLAHLSFLQKYPRSHENYVMHDLMHDMAQLVSKDECFIVKEKNDLPKIPQNVRHLSVLKGGDVQCSDLLKHDMAQHRKLRTLFCHLSLKSETDNTMMKKWCNELRCMRVMVCSISKWGLPGSISNMKLLRYLQILNSSLCKSLPSAFCCLYNMQIFYAAKWVIDDIPSSIGMLINMQKFETGTCQFHHRRIHSVDVRESASATDKGQRGQFRIGNYKGEFFPSWSHPQNLEQIPSYDSTNSTFSSPTDVKIINCRNLSSIDQFLQPAYMPIINKIEISCWAS

SEQ ID NO: 41497 - protein, 145 aa, Sorghum bicolor
  Clone ID: SORBI-28MAY03-C55200_1.pep
RSTAVNSAAANAVTAGVFMAVAAGNDGRDATNYSPASEPTVFTVGATDSSDRLASFSNYGTSVDILAPGVSILSTWIGGRTNTISGTSMATPHVAGLAAYLLGLEGKKTPAALSTRIQTLSLKTKISGVPSSTKNYLAFNGNPSA

SEQ ID NO: 41498 - protein, 149 aa, Sorghum bicolor
  Clone ID: SORBI-28MAY03-C55212_1.pep
LASVTQCHEKHEASLRKAVSPISSNMVPVKQQISDNGNYPILLEPQTPIETHSIVKETPGATPLERFNVLQSNLKEALVQPYLEVLNVANKEELQKLKGIGTKRAEYILELREDSPRPFTTLEDLENIGLTSKQIQELLKKVAATGIFK

SEQ ID NO: 41499 - protein, 112 aa, Sorghum bicolor
  Clone ID: SORBI-28MAY03-C55251_1.pep
SCIMCPPTPTENPLSAPQKSQRVQKEIRKQRKAHHVTAHRINTVPVIHLQIVHQLDRRSRGLSLDRPSSIKRAHGNRLVSHVFDKHGGNSRAGLLVRLVDQSRAATPGAKVR

SEQ ID NO: 41500 - protein, 197 aa, Sorghum bicolor
  Clone ID: SORBI-28MAY03-C4366_1.pep
IVAKLVDIVHVLNFEIRRAFLKNHGDQSVAPVTKLHQTLGPTGLALHYANVILQINTLVLASPAAVSYKARDALYQALPPCIKSKLRECCHRERTMNVAEVRAEMDRILQWLVPVAESTTSYYKNGAFGEWINMVMPEDIVVEEPYWPGEEERQTIAGASAIQRHVVNKIETLYHADKQKTEGYILDLIRGLHRLVC

SEQ ID NO: 41501 - protein, 47 aa, Sorghum bicolor
  Clone ID: SORBI-28MAY03-C43538_1.pep
DSLTVESLLELLDEDSLRKDTALPSPEWSSDHIALLAEFRCKPRVRR

SEQ ID NO: 41502 - protein, 151 aa, Sorghum bicolor
  Clone ID: SORBI-28MAY03-C43745_1.pep
AFLSSTSALRLLWLIELARCFHRQSNREMATTQFAMVEELASLIKDNLHSKHLILSTEESLIAALQQLHCRDGDGDLEEDGDAADTIELQPAGAYHRLLLHRLAEIYGFAHESVGEGEDRHLVLQRCPETAIPSVLVSDMLWKFDYSDDLT

SEQ ID NO: 41503 - protein, 176 aa, Sorghum bicolor
  Clone ID: SORBI-28MAY03-C43758_1.pep
MRRLPKSLLLACLSRPLRHRPPLPLLHPSPPQPPRPGARLLPFSTQTLAPAPPPPPAPDAASTAEPAGLALLEAAERRESEGDHQEALALALKALAPLQASHGGWSLPVARALRLAGTAATRAGSLSDALESLGAAAEIVDYPAPARREGVPKEVAAVGATVYEQLARAKTAMGHR

SEQ ID NO: 41504 - protein, 468 aa, Sorghum bicolor
  Clone ID: SORBI-28MAY03-C43762_1.pep
HEALPMLTVLTDKGTGIVTSVPSDSPDDFMALQDLVTKPALRAKYGVKDEWVLPYEIIPIIHIPEFGDKAPGKVCHDLKIKSQNDKEKLAEAKRMTYLKGFTDGTMIVGEFSGRKVQEAKPLIKSKLLEEGTAVLYSEPEKKVMSRSGDECVVALTDQWYITYGEAEWKQKAAKCLDRMNTFSTETRNGFEHTLGWLNQWACSRSFGLGTRIPWDEQFLVESLSDSTLYMAYYTVAHHLQNGNMYGKEISSVRPEEMTDEVWDFVFCDGPAPKSDIPAALLNKMKQEFEYWCPFDIRVSGKDLIQNHLTFCIYNHTALLPEHHWPLGFRCNGHLMLNSEKMSESTGNFLTLEDAIKKYSSDATRFALADAGDGMDDANFVTDIANSAVLRLTKEISWMEEVTAAESKLRTGPPTTYADRVFANEMNIAIKETEKSYDAFMFKEALTSGFYDLQSARDEYRLSCGAAGM

SEQ ID NO: 41505 - protein, 134 aa, Sorghum bicolor
  Clone ID: SORBI-28MAY03-C42454_1.pep
MMAEAAWTPVLFPPTVPCFWQPDTHPVFWRRGDAWTAEENKKFEKALALIDRNAPDRWEKVAELLPRKTADDVRNHYHDLENDVGYIEAGLVPFPHYSSSVPSSGFTLERSRGSDQERKKGVPWTEEEHKLFLM

SEQ ID NO: 41506 - protein, 254 aa, Sorghum bicolor
  Clone ID: SORBI-28MAY03-C42532_1.pep
MMAAARMAFASCARLLPSSSSPLTLARPRAGAVSFLAARPSPRSGRNLALFCSSSPTSLPLTDAVEETKPPVPSGDDKAEPTVEDLVGLLDVRVGRVLKAWRHPEADTLYVEEVDVGEAEPRTICSGLVNFIPIQDLQDSNVIVLANLKPRNMRGIKSNGMLMAASDASHENVELLIPPEGSLPGERVWFGSEEEKHRQSDPASPNQVQKKKIWEAVQPHLRTTDNCIVVLGDKQMRTSAGPIFCKSLQGARVS

SEQ ID NO: 41507 - protein, 255 aa, Sorghum bicolor
  Clone ID: SORBI-28MAY03-C42555_1.pep
MPPPLFVCVLILLVAVPRPWSVAGEPPRPAAKPRAFPLRARQVPAGALPRPPSKLRFHHNVSLTVSLAVGTPPQNVTMVLDTGSELSWLLCATGRQGSAAAGAAAAMGESFRPRASATFAAVPCGSTQCSSRDLPAPPSCDGASRQCHVSLSYADGSASDGALATDVFAVGEAPPLRSAFGCMSTAYDSSPDGVATAGLLGMNRGTLSFVTQASTRRFSYCISDRDDAGVLLLGHSDLPFLPLNYTPLYQPTLPL

SEQ ID NO: 41508 - protein, 219 aa, Sorghum bicolor
  Clone ID: SORBI-28MAY03-C42584_1.pep
HEDSHQCPSPTIPPGTKPNPPGRGSQAAAMEPSTVGDGGSAERWRAEAARAFQHYLDRAAPHTAGRWAGTLVAAAVYALRVYYVRGFYIVTYGLGIYLLNLLIGFLSPMVDPELEALEAGPGLPTRGSDEFKPFIRRLPEFKFWYAITKAFCIAFVMTFFSVFDVPVFWPILLCYWIVLFVLTMKRQIVHMIKYKYVPFSIGKQRYGGKKGPGASASKE

SEQ ID NO: 41509 - protein, 83 aa, Sorghum bicolor
  Clone ID: SORBI-28MAY03-C42717_1.pep
MVMPSRPRPSAARGPREGAAKTHRAGSGPAERAGGGGGKGGRGGGRGGMAGGGVAGATAAGGRRGREGRCGGAGCRGGVRAAC

SEQ ID NO: 41510 - protein, 153 aa, Sorghum bicolor
  Clone ID: SORBI-28MAY03-C4411_1.pep
SGEVNLQLVIHNSEAHKILVRVVGFDVMPEKSQTVHPHDSNSAQGGWYDVSLENDVKAISSSKSTHQEKQSSKSISPYVWCSLSCAQTELQPDSCARVPLKVCIFAPGTYNFSNYELQWKVHPSEGPHVDENEKLLSGGGLGHPFYVTVLQSV

SEQ ID NO: 41511 - protein, 143 aa, Sorghum bicolor
  Clone ID: SORBI-28MAY03-C44127_1.pep
CHIQGPESFDIFRGHSRATLFLICNNAAQGILSSFFFKYADTILKKYSSTVATIFTGLASAAFLGQPLTVNFLLGISIVFISMHQFFSPLAKVKDEKPAGTVELGDSQNHRSSESSFVNMTAGATDDARHLNATDERKPLLPI

SEQ ID NO: 41512 - protein, 214 aa, Sorghum bicolor
  Clone ID: SORBI-28MAY03-C44210_1.pep
EKVAESLELPWHDGSLGCPEIFPYYSKIKHEAQCSFRPYNCPYAGSECAVAGDIPFLVAHLRDDHKVDMHSGCTFNHRYVKSNPREVENATWMLTVFHCFGQYFCLHFEAFQLAMAPVYMAFLRFMGDENEARNYTYSLEVGGNGRKMVWEGTPRSIRDSHRKVRDSHDGLIIQRNMALFFSGGDRKELKLRVTGRIWKEQTNPDGACIPNLCS

SEQ ID NO: 41513 - protein, 102 aa, Sorghum bicolor
  Clone ID: SORBI-28MAY03-C44284_1.pep
MERVASSCVSLLAQRRAYSVAAAMAKGVARRGADEKKAAAAAVTKRVMGKKEVNTAAAAAAEEKKAWVPDPVTGYYRPAGSAAKEVDAAELRAKLLTEAAAN

SEQ ID NO: 41514 - protein, 212 aa, Sorghum bicolor
  Clone ID: SORBI-28MAY03-C4433_1.pep
MATAKPILYNAWISSCSHRVRIALNLKGVDYEYKSVNPRTDPDYEKINPIKYIPALVDGDIVVSDSLAISLYLEDKYPEHPLLPKDLKRKALNLQIANIVCSSIQPLQGYAVIGLHEGRMSPDEGLHIVQTYIDKGFRAIEKLLEGCESKYATGDDVQLGDVFLEPQIHAGINRFQIDMSKYPILERLHDAYMQNPAFESALPKNQPDAPSS

SEQ ID NO: 41515 - protein, 270 aa, Sorghum bicolor
  unsure (1)..(270): unsure at all Xaa locations
  Clone ID: SORBI-28MAY03-C43326_1.pep
MERILKSARESGSLNLSNRSLREIPKEVYNNLDTGSQDEKWWEGVDLQKLILAHNNLEVLREDLRNLSSLVVLNISHNNISSLPAAIGDLPLLKSLDISFNQINTLPEEIGLATALVKVDFSNNFLTELPPSLAKCPDLSELKASNNNISRIPDVLAGCSKLSKLDLEGNKLVMLSENXFVSWTMLTELNLAKNLLTAIPSSIGALPKLIRLDMHQNKITSIPPSIKGCSSLAEFYMGNNLLSSIPADIGMLSKLGILDLHSNQLKEYPV

SEQ ID NO: 41516 - protein, 143 aa, Sorghum bicolor
  Clone ID: SORBI-28MAY03-C43383_1.pep
SITTSVVIGLVFWCLILYFDDKIALLFTSSAVVLDAVHHLSVLLAFTILLNSVQPVLSGVAVGSGWQALVAYVNVGTYYLIGVPLGIILGWPLQFGVGGIWSGMIGGTAVQTIILAYLTVKCDWDEEARLASMRMQKWADDLK

SEQ ID NO: 41517 - protein, 119 aa, Sorghum bicolor
  Clone ID: SORBI-28MAY03-C43475_1.pep
MRGEELEGLSVEELQQLEKNLETGLHRVLQTKDQQFLEQISDLERKSTQLAEENMQLRNQVSQIPPAGKQAVADTENVIAEDGQSSESVMTALHSGSSQDNDDGSDVSLKLGLPCVAWK

SEQ ID NO: 41518 - protein, 114 aa, Sorghum bicolor
  Clone ID: SORBI-28MAY03-C43506_1.pep
EAYGGADGGPLAGVKVKNLLNGEVSDLQVAGLFFAIGHEPATKFLGGQLELDSDGYVATKPGSTHTSVKGVFAAGDVQDKKYRQAITAAGSGCMAALDAEHYLQEIGAQEGKSD

SEQ ID NO: 41519 - protein, 106 aa, Sorghum bicolor
  Clone ID: SORBI-28MAY03-C4352_1.pep
ARGKVITSLPPPEEGPNLSFYTLDEQLELLSKVLNAGDDMIGVERLEEDSDGKALLRARRSAGSMSAFSGAGGMVYMEYSTGKGKGAPKKHKDPSKRHHLFKKRYA

SEQ ID NO: 41520 - protein, 159 aa, Sorghum bicolor
  Clone ID: SORBI-28MAY03-C43598_1.pep
TKIKNIKKNKTTGGFSVTFLGDIVATGLKVEDQLSLGKRLSLVASTGAMRAQGDTAYGANLEARLKDKDYPIGQSLSTLGLSLMKWRRDLALGANLQSQFSIGRGSKMAVRLGLNNKLSGQITVRTSTSEQVQIALLGLIPVAASIYRSFRPSEPSFAY

SEQ ID NO: 41521 - protein, 156 aa, Sorghum bicolor
  Clone ID: SORBI-28MAY03-C44906_1.pep
MEQATGVSGPEHIIDIPREIGPSASVSRSVGRENHEELNPVDRPSTRALVPALQAPSAIGAVPNAGQTSGTRRNDNYVRRHRSPLNSGLWISIEVIVNVSQIVAAIVVLCLSRKEHPQAPLLEWVIGYTVGCFATLPHLYWRYIHRNIVNGEHEPA

SEQ ID NO: 41522 - protein, 167 aa, Sorghum bicolor
  Clone ID: SORBI-28MAY03-C44945_1.pep
RKLVFTNGDRAHASRALKRLGIEDCFEGVVCFETLNPTSPPPVPAEELQIFDIMKHLTHPQPGVELPKSPILCKPSREAMLQALKVASINPQTTILFDDSFRNIEAAKQIGMRTVLVGTSERKKGADHALESLHNMKEALPELWEEAVKDEDVRNSSKAGIETSVIA

SEQ ID NO: 41523 - protein, 119 aa, Sorghum bicolor
  Clone ID: SORBI-28MAY03-C44963_1.pep
DAGLGLGDVLKPDLVLPLIENLPIEQLASHLPEGSWTPADIIELLQSPPLRQQLDAFTHVLRTGQIDLAQFGVDPSKYKFTVASFLEALEDSVGRGASEAGDKDGEAQRGSGNDAMDES

SEQ ID NO: 41524 - protein, 115 aa, Sorghum bicolor
  Clone ID: SORBI-28MAY03-C45323_1.pep
PAACIVSGDMCRILVFGVMLSRSLSKGLWNRMLLRFLKVGLQRQISHLEHHSSRWRFLVWLLRKHPLYPPQRRDPLVKCHITGVGMRQDNWNYLCGSICNDVCIWWCYVIHGSCC

SEQ ID NO: 41525 - protein, 329 aa, Sorghum bicolor
  unsure (1)..(329): unsure at all Xaa locations
  Clone ID: SORBI-28MAY03-C451_1.pep
MAHTPAMENSYVQVHHLATSMAIHTHKPFLAPPKHVHLAFHSPTSAPSRLLATTRSRPGLSQPAAMMAETDADKLRFIEEVTADVAAVQERVLAEILSRNADAEYLSTRCGGATDRATFRAKVPMVTYEDLQPYILRIAHGDRSPILSGSGYPVSELLTSSGAGDRKLIPVVDDDHDRHHRLHSLVGAVVNQYVPGLDKGSGLYFLFVKSETTTPGGLPARTILTRIFTSDGVWKLPYNPRRGLTSPAAAVVCEDTFQSMYAQMLCGLCHRHSVLRVGAAFASGXLRAIRFFQRNWPELAGDIDAGTITDRVTDHVLRQALSSVIHIFT

SEQ ID NO: 41526 - protein, 144 aa, Sorghum bicolor
  Clone ID: SORBI-28MAY03-C43806_1.pep
MEAYKLWVRRNRDLVRPLESLANGLTWILPERFANSEIAPEAVYALLGVVSSVNQHIIDAPTENHSFASKEQSIPWGLVVSVLKDVEAVVEVAAQHFVGDDRKWSFLAVTEAVKAGVRLAAFRESGYKMLLQGGEVANEEEVTV

SEQ ID NO: 41527 - protein, 107 aa, Sorghum bicolor
  Clone ID: SORBI-28MAY03-C43816_1.pep
VEGLRQLLDNGAAHQRLHVGARRSVVALAQLRLRRRRRGPRRSQRYDDRGDHAPPPRRRRPPRPHCGSPQLIPLLTSPPSLSLSLSLSLSTSTRLLLPLPPHLSVWR

SEQ ID NO: 41528 - protein, 108 aa, Sorghum bicolor
  Clone ID: SORBI-28MAY03-C43930_1.pep
SIYQMEGNDLPPGNMLQGVPYDTLDLRGSSMQKHTPNSGKQIFSSSQMPGTFTMSMIRATEPDDFPGFQFKEHGKSDDHHHQHHSHHSKNCKSDGEEHDVAEDAIDTP

SEQ ID NO: 41529 - protein, 292 aa, Sorghum bicolor
  Clone ID: SORBI-28MAY03-C44008_1.pep
MFQHIPNCTRLSAAHWPRGPPSMPSASLRLAVVGAGAAGLVAARELRREGHAPVVFERAAAVGGTWLYTPPATSSDPLGAAATHSSLYASLRTNPPRETLAVPHCPCAAAAAAAGSPRDPRRFPGHEEVLRYLEAFARRFDLLRLVRFETEVLSVRREDGGGGRWAVTSRKLGEKGSGQEEFYDAVVVCNGHYTEPRIAVIPGVDAWPGKQMHSHNYRVPEPFLDQVVIVIGASASAFDISRDITSMAEEVHIADRSAPASTCKKEPGYDNLWLHSMIDHAQEDGTVVFQDG

SEQ ID NO: 41530 - protein, 171 aa, Sorghum bicolor
  Clone ID: SORBI-28MAY03-C44010_1.pep
MHPSSGAGDYAPYYPPYPSPASAPPPAAAYPSVSAPASAPPYSSYPADFAPVPSYPAYPPADLSHYAPPATAPAPAPPQPYYPYEPAPPLPHNPVPPYPSLDRAGTYGYGSGPGSGYGQELYPPKPAGGGGGGWSDDGAYAYDGGDAPEPYGARGTAPRLGSGSALFDDYG

SEQ ID NO: 41531 - protein, 249 aa, Sorghum bicolor
  Clone ID: SORBI-28MAY03-C45961_1.pep
MEEKVLSEAASRGEDDFRSCCGDEEEWEDTEESFTAGIGKGELDEASVRLFFKGVSSPEAEGKKLSGIGVVMERSPGVPVLKVQKKLDFYVEELVAEHLALMDGLLVALQNGIRKIFAFTNSEKLYFQIAEAEILEDQLLVALGHRILELVDKLEDFDLILLPSFELERPLQLAKEAIGIRYLSPYEVGTCPICREEKLGSQMIKAGCSHTYCYNCLTGYIEDKLLTSKLPIRCPQLRCKYIISASECK

SEQ ID NO: 41532 - protein, 334 aa, Sorghum bicolor
  Clone ID: SORBI-28MAY03-C45988_1.pep
MSRDLDCPVQTQMAVAVLDRSFSSEYPGGSRTEGRQLSWKRVFVQTDNGSVLGIELERGENVQTVKKKLQIALNMPTDESSLTFGDLVLNNDLSSIRNDSPLLLKRNQIHRSNSTPCLSPTGKDVWQRDPRGPIEILGCSSPSSRMKQLAKDVIKAIKNGVDPVAVNSGMGGAYYFKNIWGERVAIVKPTDEEPFAPNNPKGFVGKALGQPGLKRSVRVGETGFREVAAYLLDYDHFANVPRTMLVKITHTIFNVNDCVGCKTKVFCNKSEAVSKIASLQEFIPHDFDASDHGTSSFPVSAVHRIGILDIRIFNTDRHAGNLLVKKLGPGADNF

SEQ ID NO: 41533 - protein, 291 aa, Sorghum bicolor
  unsure (1)..(291): unsure at all Xaa locations
  Clone ID: SORBI-28MAY03-C45973_1.pep
MMKSLLPQSQLRRSSAAAARSSSGGGAAGGDGAMADGGGAGPRAPASSTFWFLLHALCCLISLFLGFRFSRLLFFLLFSTTALYHSTTSSSSAAVLRATTTTTTTTTTTTTTTNTFTLSFAAANTPPSGPANRTALEAAGDNKGAASSGNPQSHVVXVGRHGIRIRPWPHPDPVEVMRAHRIMERVQEEQRRWYGVKEPRQVLVVTPTYSRAFQALHLTGLLHSLRNVPYPLTWIVVEAGGTTNATASMLARSGLTFVHIPFPDRMPHEWADRHATENRMRLHALRVIRER

SEQ ID NO: 41534 - protein, 166 aa, Sorghum bicolor
  Clone ID: SORBI-28MAY03-C46012_1.pep
LEADNLLWLAEILADRNAADEFAVIWASQRELAGLHSKLPVKSRHLVSCVTARLFVAIGKGEMLPSKDTRRLLLDVWLQPLMDDYNWLQHGCRSFDRKVVEEGIGRTILTLPLEDQQTILLSWLGSFLKVGDSCPNLQKAFEVWWRRTFIRPYAEQQGNRSQSGRS

SEQ ID NO: 41535 - protein, 339 aa, Sorghum bicolor
  Clone ID: SORBI-28MAY03-C46080_1.pep
HEGRVLLALYHPRNRYILHLDAEAPDSDRTSLAADLASHPAIAAAANVRVVDRANLVTYRGPTMVANTLHAAAAFLWGHAGDGGSQWDWFINLSASDYPLVTQDDLIHVFSKLPRDLNFIDHTSDIGWKEFQRAKPVIIDPGLYMKKKADVFWIPQRRSVPTAFKLFTGSAWMALSRPFVEYCIWGWDNLPRTVLMYYSNFISSPEGYFHTVVCNADEFKNTTVNHDLHYISWDNPPKQHPHYLTVEDLDRMVASDAPFARKFHEDDLVLDKIDEEILGRGVDMPTPGGWCAGTRENGSDPCTMIGNTSLLQPGRGAVRLQRLITLLLSEEKFHPRQCK

SEQ ID NO: 41536 - protein, 275 aa, Sorghum bicolor
  Clone ID: SORBI-28MAY03-C46049_1.pep
YRAPLDELLLNDDDEFEGVGARPSVPSPPAAPAIPAPRRRSADAPLPGAGESNAVQFTLEHDLGDGKGFVPAGTFSARLKTFAHGTQTLTKLRFTRNDLNEDDKVAFKKLLQEDGFYTIRLPSNVLDTTKKHNVASSIKARCIPRDSLDEHIVIHMDGVNILAVNYGSVGGCQYPRPMKLPSKWTFSSYTILKTAEQAPRTPSFADQLIEADNGLGEVMKPPEKSFWAKYWMYIIPLGLIVMNAVTAAANIPEEAAGQGQPGAQRAPAAAAGRRR

SEQ ID NO: 41537 - protein, 42 aa, Sorghum bicolor
  Clone ID: SORBI-28MAY03-C44782_1.pep
PSRLLTGEERNNAPKGCHELDPAATPVDLLKIITDVKEDTTQ

SEQ ID NO: 41538 - protein, 188 aa, Sorghum bicolor
  Clone ID: SORBI-28MAY03-C44815_1.pep
MAAPALVLLPEWGTGHLMSMLESCKRVLLSGGGGGGGGGKAFTITLLVMRPPTAEATSEVEAHVRREAASGLDIRFHRLPAVEAPSDAAGVEEFIARYIALHAPHVRDAVAAMSCPVAALVLDIFAAPLVDVARGLGVPSYVFMSSTAALLALMLHLPVLHESVPVEFDEVEGEVQVPGLPPVPPESM

SEQ ID NO: 41539 - protein, 279 aa, Sorghum bicolor
  Clone ID: SORBI-28MAY03-C4453_1.pep
MAATAMVAITNLGCRHDPLSSLPRATSAPARSCTLPPRRRRCRPLTPRSSCCSPPSSSVSPRRVLRPTAALKRIPAGDTSFVGPANNDATTLNHRSSSSDLRRSLIIPNSTASTGHATASSGVLPSILGVAHLAVSLGIMLAADKFLKKAFVAAGIKFPSALFGMFCVFSVLVVFDIFAPPVAKAFMNFFEPATMFIKRWLPVFYVPTLVVFPLAITEIPAASALKIFAITCMYYSRSRSHFSFHQNINKLERLLLYCFCFDLIFPAFSVGGWFATLTV

SEQ ID NO: 41540 - protein, 86 aa, Sorghum bicolor
  Clone ID: LIB3481-040-P1-K1-A11.pep
SATMFIKRWLPVFYVPTLVVFPLAITERPAASALKIFAITFGGWFATLTVAGYTVLAVRNLVKTELIPDTEPVSKPSPFSTSEILS

SEQ ID NO: 41541 - protein, 295 aa, Sorghum bicolor
  Clone ID: SORBI-28MAY03-C446_1.pep
PKNTSLVVLPTYATNPGEADRLRFLASAAGKDEYAQWVVASQRSLLEVMAEFPSAKPPLGVFFAAVAPRLQPKYYSISSSPSMAATRIHVTCALVHETTPAGRRHKGVCSTWIKNAVPSEESKDCSWAPIFVRQSNFKLPADPSVPIIMIGPGTGLAPFRGFLQERLAQKESGAELGPSVFFFGCRNSKMDFIYEDELNNFLEQGALSELVLAFSRQGPTKEYVQHKMAQKASEIWDMISQGAYIYVCGDAKGMARDVHRVLHTIVQEQGSLDSSKAESFVKNLQMEGRYLRDVW

SEQ ID NO: 41542 - protein, 77 aa, Sorghum bicolor
  Clone ID: LIB3480-007-P1-K1-B1.pep
AIVSTLPVIVVHMCNANECLSPEYHFFFIFHNRFLPHIPQISALHLEILHKALGLRTVEGALFAKNVDNCMRNNRCR

SEQ ID NO: 41543 - protein, 98 aa, Sorghum bicolor
  Clone ID: SORBI-28MAY03-C44826_1.pep
MRTIPAVLLLLILVAAAAASFQGLTVAADTSGAVPDGVCDGKCRSRCSLKKAGRCMGLCMMCCGKCQGCVPSGPYASKDECPCYRDMKSPKTQRPKCP

SEQ ID NO: 41544 - protein, 217 aa, Sorghum bicolor
  Clone ID: SORBI-28MAY03-C44859_1.pep
MASSGLAYPDRFYAAAAYAGFGAGGATSSAAISRFQNDVALLLYGLHQQATVGPCNVPKPRAWNPVEQSKWTSWHGLGSMPSAEAMRLFVKILEEEDPGWYSRVPEFNPEPVVDIQMHKPKDEPQSVPASTNGTSIPEPKIISENGSSVEIQDKDVILEGLSTVSSHDEWTPLSVSGLRPKPRYEHGATVLQNKMYIFGGNHNGRYLSDLQALDLKS

SEQ ID NO: 41545 - protein, 116 aa, Sorghum bicolor
  unsure (1)..(116): unsure at all Xaa locations
  Clone ID: SORBI-28MAY03-C46479_1.pep
MRRFAADRARRAVATSLRGAASRSAAPSPHAPAPRHPAAPVGAAAMMRMXTXXVGAPPVSLXTINPKVLKCEYAVRGEIVTHAQNLQQELQKNPESLPFDEILYCNIGNPQSLGQQ

SEQ ID NO: 41546 - protein, 297 aa, Sorghum bicolor
  unsure (1)..(297): unsure at all Xaa locations
  Clone ID: SORBI-28MAY03-C46618_1.pep
MLSLQQQHGGAVAGGGGGDARNHAPQPAVLGAGVDWLAFGARADLEEPARNAPSPALFLLPPAPLDDRAAQPEPKPKPGQLAGAVDEERHLALAHQNYRSGKYREALEHGNVVYEKNARRTDNLLLLGAIYYQIRNYDMCIAKHEXEALAIDPQFAECYGNMANAWKEKGDIDLAIRYYLTAIQLRPNFCDAWSNLASAYTRKGRLNEAAQCCRQALAINPRLVDAHSNLGNLMKAQGFIQEAYSCYIEALRIDPHFAIAWSNLAGLFMEAGDLDKALMYYKEAVKLKPSFADAYLN

SEQ ID NO: 41547 - protein, 265 aa, Sorghum bicolor
  Clone ID: SORBI-28MAY03-C46755_1.pep
MEAAEAVTVGVGGSIGAPSAPGGVLLLFLLALSTLIIIIRWRWNNNRNSRLPPSPMALPLVGHLHLIRSPPHRSLDRIVKRYGPLVYLRLGPSTHCVVAGTADAARDLLKHEASIPERPITVVAHHLAYGDAGFAFAPYGAHWRFMKRLCMSELLGPRTVDQLRPVREAELAAVLGAARQASASGERIDVSRYLISMSNNAIMRMVASALPGHMTEAARDCAKHVAELVGAFNIEDYVGICRGWDLQGITRRTREVRDKFDALME

SEQ ID NO: 41548 - protein, 260 aa, Sorghum bicolor
  Clone ID: SORBI-28MAY03-C4656_1.pep
MAEVSTAAAPEGVLHRRIEFHPARRPHASVAVGGGGFRMETLNPDAAGKAGAGAAVGSSEGEATRSEKADAGGIDPELSVARIYLGRIGAALGCRRCACGLFSVLLCLAFAGPCAAARLGGPHSSPCRAPGFCAAGALRYLVVTPRVSSGRIVAPFRIVKNLRCISRTFRNSRQEDAHELMGTWLESMHKCCLPSGVPSESQSAYDKSLVHKIFGGRLRSQVKCTRCSHCSNKFDPFLDLSLDIAKATTLVLALGNFTWE

SEQ ID NO: 41549 - protein, 260 aa, Sorghum bicolor
  Clone ID: SORBI-28MAY03-C46858_1.pep
HITGSHLYELEQHLDRFLRSALMAKILLPFDRSTIRSILIQTVSASNCTQGSLRYWLSVGPGDFQLSSSGCANPALYAVVIDRPPVQVPSCCKVVTSSIPIKSPQFAVMKSVNYLPNALTKVEGEENGAFTGIWLDDEGFVAEGSNMNVGFVTKSKELLMPCFDKILSGCTARRVLTLAEHLVAHGKLSGVISRNVSVQEGKMADEMMLIGSGILVKPVVQWDDQIIGSGQEGPIAQALYDLILEDMRSGPPSVRIPVPY

SEQ ID NO: 41550 - protein, 271 aa, Sorghum bicolor
  Clone ID: SORBI-28MAY03-C6488_1.pep
EESELRCRFFFFLLFFFGTATGGRRFLGRGDAEGISLGWLRSGGCFAFASMERDFLGVIDRAAGKGGGDVVVVEDSRTELAEAAQWQFPAKSGSGAPAFMSFRTARGEEGSEEFSISGFRPAGDALDGIKKQTSLPAVISQHQQQQRQFGLSSSQVTAQQYPAAAHGGQRLQGMDYSAAALHYLPGGSRLVQPLSVRHPAPFNQANLMVRSQSFHNGTGVPSRNQQPFTMSNGFGGSTVGVYGARNPRNQTSTQLTIFYNGSVNVFDNVPV

SEQ ID NO: 41551 - protein, 322 aa, Sorghum bicolor
  unsure (1)..(322): unsure at all Xaa locations
  Clone ID: SORBI-28MAY03-C45392_1.pep
MKELRLYENSEKALLSSSSANGTAILRVLQALSSLVTTLKERKDPEQPAEKEHSDAVSQISEINTALDALWFELSNCISKIESSSEYASNLSPASASAATLTTGVAPPLPAGTQNILPYIESFFVTCEKLRPGQPDAVQEASTSDMEDASTSSGGQRSSAQASLDEKQNAFVKFSEKHRRLLNAFIRQNPGLLEKSFSLMLKIPRLIDFDNKRAYFRSKIKHQYDHHHHSPVRISVRRAYILEDSYNQLRMRSPQELKGRLTVHFQAEEGIDAGGLTREWYQSLSRVIFDKGALLFTTVGNDLTFQPNPNSVYXTEHLSYFK

SEQ ID NO: 41552 - protein, 186 aa, Sorghum bicolor
  Clone ID: SORBI-28MAY03-C454_1.pep
MAEVIDLTGDGGVLKTVVRKAKDDAIAPSESLPLVDVHYEGTLAETGEVFDTTHEDNSIFSFEIGQGAVIKAWDIALRTMKVGEVAKITCKSEYAYGAAGSPPEIPPNATLIFEVELLACRPRKGSSVGSASDEKARLEELKKQRELAAATKEEEKKKREEAKAAAAARVQAKLDAKKGKGKGKGK

SEQ ID NO: 41553 - protein, 139 aa, Sorghum bicolor
  Clone ID: SORBI-28MAY03-C45477_1.pep
RSAAKPGAYVQPIMIRKKKDCRLTSIVIGEVLLVPGEEGAPPGTRHSRFGNGIWRADHGAILPSKVQDFCGPLPTFSFCVGLVFPGGFQTFAQGQEGWLVSRPWGVFVGCGGNHGHGLVQALEFINLKTCRCQLCCQIE

SEQ ID NO: 41554 - protein, 238 aa, Sorghum bicolor
  Clone ID: SORBI-28MAY03-C45533_1.pep
ARGYHQAVAFGDMVVAVRTRSSQTVSDYTCNGRHVLTMTRNLERPIIGSVLQSMWGVSPTHLSWSPEHNATVVDYTWSTGHTPFGPFSETKSLSFVQKDAARRNVLLTTLNYTITSTIDILESMAAHGGEKILLRKKRHVEFNQRWNLLTYKLEKVISAMSRLDYDKALYFLRSSDHDLYEIHSLVYQASQELEASLVCFKDPPFPWVSVSMSGVFVFGFFYVYSKRDKLFRSKRKQF

SEQ ID NO: 41555 - protein, 140 aa, Sorghum bicolor
  Clone ID: SORBI-28MAY03-C45676_1.pep
GCFHMTCWCGHEFCYSCGADYASGVQTCQCVFWDDEAVEASSAERSTQAASEIWAWDTFDCMPTAVEGYSEQERAQLALIQRFLAGGFSLGDNHNPNPCQSPPRCADSYIVDTMKDLHQLPWLERFVSVISDTYNDDYIQ

SEQ ID NO: 41556 - protein, 268 aa, Sorghum bicolor
  Clone ID: SORBI-28MAY03-C47289_1.pep
ARGRLSDFVSEALDEDVVPIIHVASTCDLQDLLNQCIHRVAVSTLDSRYLEKELPDDIYCRIKEIRRSTFHDESSESAMHEADHDKRVRNILKALDSDDVDLVGLLLKESTVTLDDAFAIHYAAAYCEPKVFAELLKLDSANVNRKSNSGYTPLHIACMRREPDIILSLVERGASVLERTLDGRDALTICKRLTREKDCNRKLEKYEEKSKAYLCIDILEQELKRKSFILDPISIEESIATPLLVDNFHMRLINLVNRVAFARIFFPS

SEQ ID NO: 41557 - protein, 137 aa, Sorghum bicolor
  Clone ID: SORBI-28MAY03-C47414_1.pep
TRVDSFYWDGTNPSSSSSTGSRGSNSMGFEPQSTSSILENSVFPWTNIGQEKDTRAHLVEELKWPDLLHGTFAETTTAMQNQSQTLYDDVIKAESQFSMEGICASWFQNQQTQQQLQAAPNMYDKDLQRMQLSFENI

SEQ ID NO: 41558 - protein, 173 aa, Sorghum bicolor
  Clone ID: SORBI-28MAY03-C4745_1.pep
PRHPTPPSPLRHSPRPWLHQRTPSSSSASSSPAATTARSVTQPTTPRRRSCSTRPGESESEAEAAGQATLVGGEEVGTGARAAAMARSGGGRGGRPAGWPRRAPPRRRQWRRPPRRGRVAPLSWTGAAPRRPSCRAATASPSSSTPGRTSVCDGLAAAAAAAAEAACGRHCFD

SEQ ID NO: 41559 - protein, 150 aa, Sorghum bicolor
  Clone ID: SORBI-28MAY03-C47544_1.pep
MDKLLQFGRKAWFVVRVMSGQEERRIRSYRLQLQKRLEMAQARKEELRKQPEQVILSEVRQVVQQMQALNQHLDEAEAAIDEYFKPIDKNAKIISDMQLEKEEKQMKEMAKVMQEQIKMQREITMTRAEAASIESNDTKVGEKVAEIPPK

SEQ ID NO: 41560 - protein, 104 aa, Sorghum bicolor
  Clone ID: SORBI-28MAY03-C47570_1.pep
HRSDVYSFGVVMLELLTGRKPYDSSRPRAEQHLVRWADSQFHDMESLSKMVDPSIQGECSMIPLSRFADIISGCIRPEPELRPAMSQIVQDLARIVGASGEVSE

SEQ ID NO: 41561 - protein, 142 aa, Sorghum bicolor
  Clone ID: SORBI-28MAY03-C46117_1.pep
AIVYRNMAILGVDGFSSLPKNCLTLCYIFFAAAIVVNLIRDLVPKKVAGFIPLPMAMAIPFYLGSYFAIDMFIGTVILFAWQMINRAKADAFGPAVASGLICGDGIWTLPQSILALAKVKPPICMKFLSRSVNAQVDGFLGN

SEQ ID NO: 41562 - protein, 147 aa, Sorghum bicolor
  Clone ID: SORBI-28MAY03-C46206_1.pep
SAGNQGMLSPYRSSSFPVPQYALQRDNVFPERPDEPECQYYMKTGDCKFGAVCKFHHPRVRSLPPPDCVLSPMGLPIRPGEELCKFYSRYGICKFGANCKFDHPTMAAPMGVYAYGFSASGSPASASTNVPMARRLLGSPSASGYTS

SEQ ID NO: 41563 - protein, 67 aa, Sorghum bicolor
  Clone ID: SORBI-28MAY03-C46293_1.pep
AVDRAHRIGQTRPVTVSRLTIKDTVEDRILALQEKKREMVASAFGEDKSGSRQTRLTVEDLNYLFMV

SEQ ID NO: 41564 - protein, 273 aa, Sorghum bicolor
  unsure (1)..(273): unsure at all Xaa locations
  Clone ID: SORBI-28MAY03-C46400_1.pep
ARGDGMPPPPPRWKGACQPPVRCNNKLIGAASFVVDNTPADDVGHGTHTTGTAAGRFVEGVSAFGLGGGGTAAGTAPGAHLAVYKVCDAQGCFESDLLAGMDAAVKDGVDVLSVSLGGVSTPLDKDPIAIGAFAAVSKGVLVVCAGGNSGPLPSTLSNEAPWILTVAAGSVDRSFRASVRLGDGEMFQGESLTQDKHFSSKVYPLYYSDGINFCDYFNVDITXMVVLCDTETPVPPMSSIEAVREAGGAGVVFVNEPDFGYTIVLEKYYNLPM

SEQ ID NO: 41565 - protein, 170 aa, Sorghum bicolor
  Clone ID: SORBI-28MAY03-C46411_1.pep
MSKGPVPFVNIGKRAKDLLYKDYNFDQKFSLSTSSSSGLNLTATGVKINEDFIGVIRTQHKSGRTTVDVIIDSDSKVSTTVTVDEALTGLKTSFAFKVPDHKSGKLDLQYAHNRFSLNSTIGLTSTPLVELAATVGTSELTIGAEVGFDSTSAAVTKYNSGIGYNKSDFS

SEQ ID NO: 41566 - protein, 311 aa, Sorghum bicolor
  Clone ID: SORBI-28MAY03-C47930_1.pep
MTRSASGERKRRLIRSLDYQCVRRFRLRRLLSFLWRYSYHEAFEALSKETTVYFRVSHLQHMVRQGLWTDAVRYVLRFVPAIDLTDGGNFLTIFITLLSSIARYKPTVPSTFPLYDPYARHELDWQGRVRPGGVKVAEIIRSVCCKEAWGRINWALVRLKAAEIVGDLFTELPEFDDMRRLPPCPVIVRPANVLPLRASSRGHSRFHKKLGRIPPDVLARYFVPKETSQPGLPLEPFTMIRMAEILDECLQAGKCLVINDRHRVESSSTEGTKDPMVTEAAVPRSNLKRPRATEQEVDTRKIQIIGGACSK

SEQ ID NO: 41567 - protein, 157 aa, Sorghum bicolor
  Clone ID: SORBI-28MAY03-C47988_1.pep
KKSFKINNGMRNRRARIYVNGFPISDRAVRKAEKLAGSICPGNYWYDYHAGFWGVMGRPCLGMIPPYIPEFNFPMPKNCAGGNTGVFVNGRELHQKDLDLLVTRGLSDSPGRSYVVENSGKVSDEVSGEELYGLGKLAPTVEKMGRGFGMRVPRFIQ

SEQ ID NO: 41568 - protein, 304 aa, Sorghum bicolor
  unsure (1)..(304): unsure at all Xaa locations
  Clone ID: SORBI-28MAY03-C47996_1.pep
MEIQARQLLVAILGIVIAIAFADAVQGATATPVVVGLAKCSDCARRNMNAEAAFKGLQVAVKCKNSKGEYESTAVGQVDKSGAFSVPLAADAVGEDGELKSECFAQLHSASSAPCPGQEPSKIVAAPPGGHDGNEKTFVALGGKVHRSSPECASAFLCHHFFHSIMHHHHVGTHTPVVLPHAPDHGHGGHSLPPVPKPPAVDVPEHKPAPVTVPEHKPPSTPVDTPSTPTAPSTTPVYSPPTPTPIYHPPAQRDAVTGPXLFKKLLPFLKMLLPFFPPDAMETQHYECLVSVFLAFAGYAVSSE

SEQ ID NO: 41569 - protein, 84 aa, Sorghum bicolor
  Clone ID: SORBI-28MAY03-C48014_1.pep
KGSNRINVFSECAKTESFLPFGSGSRECVGQKFVVLAISMLIASLLRSYEVHPHPSLSKEMDTAVDSSHLHMPNPKIILTKRRI

SEQ ID NO: 41570 - protein, 89 aa, Sorghum bicolor
  Clone ID: SORBI-28MAY03-C48028_1.pep
NFHTCHSVLDLTNPEPCSSTICNPCCAYSQESYGLRCSLVATMSDRLSSSVDLRLWSPWTPQAPKRQEHRNERRKGSQDKLDAELRSPG

SEQ ID NO: 41571 - protein, 81 aa, Sorghum bicolor
  Clone ID: SORBI-28MAY03-C46905_1.pep
SVKTDILPPRKNSSTLIAEWASKSSTLIIQSTKTVTQAVQTVLLFLQVPPKRICGKCKPISKRSFHYMFHEYRRDNLWKMS

SEQ ID NO: 41572 - protein, 276 aa, Sorghum bicolor
  Clone ID: SORBI-28MAY03-C4662_1.pep
MSASPLMAMLLLASTLAPRVPVTRGSGSGTSAAHPAYADATAYGLAAASALEAGLEEYGGGRIVDITHAYRPELPFPGRDGLGAVTGLTESMANAPGNNVSELRMVVHSGTHVDAPGHMVQEHFVAGLGVDKLDLDVLNGPALLIDVPRDTNITAQAMESLNITQGIRRVLFRTLNTDRKLMWTKEIDTSFVGFTEDGAQWLVDNTDIKLVGIDYLSVAAFDHLISAHLVFLNRRDIIPIEGLKLDHVKTGVYMLHCLPLRLIGCDGSPIRCILIK

SEQ ID NO: 41573 - protein, 123 aa, Sorghum bicolor
  Clone ID: LIB3481-047-Q6-K1-B8.pep
CPNTHLLYVAQAMESLNITQGIRRVLFRTLNTDRKLMWTKEIDTSFVGFTEDGAQWLVDNTDIKLVGIDYLSVAAFDHLISAHLVFLNRRDIIPIEGLKLDHVKTGVYMLHCLPLRLIGCDGS

SEQ ID NO: 41574 - protein, 201 aa, Sorghum bicolor
  Clone ID: SORBI-28MAY03-C47045_1.pep
HEDHMAMRARGTGTYFPDPNLRKERPPTGRGERGRNHSHQNNYQKFHHHARPDMPVDMIPFDELRHESPLQIYAPSANDHGIPSPMNIPIPSPSSQSPRDPLNVPMHSPSSQVRKDNFHGNGFMLSQDSKLEFGTLGALPREVASKDHASRPSSASNNQGSGPVTVSPMSVVKNTGMGSNGMRNVQAYRLKDSGDFPPLSS

SEQ ID NO: 41575 - protein, 184 aa, Sorghum bicolor
  Clone ID: SORBI-28MAY03-C47145_1.pep
MWWRAVRARRRVAGARPASTAAAGAEKSCRAVVVPRFGGPEVLEIRQGVPVPDLKPREVLVRARAVSINPLDLRMRSGYGRSIFEPLLPLIIGRDISGEVAATGTSASSFSIGQEVFGSLHPTALRGTYADYAILSLDELTLKPSTLSHVEASAIPFAALTAWRALHGTARISEGQRVLVIGGG

SEQ ID NO: 41576 - protein, 271 aa, Sorghum bicolor
  Clone ID: SORBI-28MAY03-C47151_1.pep
ARGSPAAPFPSRPAPAPGSAQPHSSAPLSPDGAGSASGLEEKLAGLSTGGDAQNPPPAGEGGQEPQLSKNANKREEKRKKLGEERRLKEEEKKNKAAAAAASGKPQKASAADDDDMDPTQYYENRLKTLDSLKATGVNPYPHKFPVGISVAEYIEKFNTLSNGEKLTDVTECLAGRIMNKRTSSSKLFFYDLYGGGMKVQVMADARTSELDEAEFSKYHSGVKRGDIVGIAGYPGKSNRGELSVFPKKFVVLSPCLHMMPRQKGEGSAVPV

SEQ ID NO: 41577 - protein, 138 aa, Sorghum bicolor
  Clone ID: SORBI-28MAY03-C48823_1.pep
SREELHKLLQPFSASELYQDLQHFPRVDVKVKLRNEQERSKPPTLNIRLQLKNSRRSASRAFAPRFPKAKQEAWWLVLGNATSSELYGLKRISFADRVVNTRMELPQMFDAQETKLILVSDCYLGFDLEYYLEHLTKG

SEQ ID NO: 41578 - protein, 72 aa, Sorghum bicolor
  Clone ID: SORBI-28MAY03-C48811_1.pep
PSTSHGTCSKSATSKSLGGKSKSGKNRASSTSSKSGGSSRGGDDSNIWTCDQCTYANPRSARACQACDRQHR

SEQ ID NO: 41579 - protein, 365 aa, Sorghum bicolor
  Clone ID: SORBI-28MAY03-C4887_1.pep
PKLSTSSTWAGDKWFIYPSYDYAHCLVDSLENITHSLCSLEFGIRRPSYYWLLAALGQYQPYVWEYSRLNITNNVMSKRKLNQLVTDKWVDGWDDPRLLTLAGLRRRGISAAAINSFIRGMGITRSDNSLIRIERLEYHIREELNNVCPRALVVLHPLKVVITNLDYGMVINLDAKMWPNAPDSDGSAHYKVPFSRIIYIEKSDFRLKDSKDFYGLAPGKSVLLRHAFPIKCMEVIYGDNADSIVEARGVYDASKATKPKGVLHWVAEPSPGVEPLKVEVRLFEKLFLSENPAELDDWLGDLNPQSKEVIKGAYAVPSLASAVLGDKFQFERLGYFAVDSDSTPEELVFNRTVTLKDSYGKAGPK

SEQ ID NO: 41580 - protein, 114 aa, Sorghum bicolor
  Clone ID: SORBI-28MAY03-C48962_1.pep
PYLVDLGSPQFVGVPPDPQWSIDTEMHLKSVVHLDRSQEVVNIVGSNGQTSPRDKRSGTRNRVMSSAFVPLFHLSIELPNDEDAEGTVQVLQALIEKGKARRWDKNILHRSNIS

SEQ ID NO: 41581 - protein, 175 aa, Sorghum bicolor
  Clone ID: SORBI-28MAY03-C48989_1.pep
GIYLDCRVLVEYDIRIKRGQTRQEDLPVIDGAATFSELTYIRGAITNRISGDSGGSMDIARALFRNSVEATVEVWVSNLGRCVSGLDLFITGFVGRIPEEIKIFRGSIGDLCVVKRFVVAVRLNSVLFLLFKVPAFGTDPICRFAYRAVAHGCISGYRELNSCTVDVKVTWSNLY

SEQ ID NO: 41582 - protein, 141 aa, Sorghum bicolor
  Clone ID: SORBI-28MAY03-C6400_1.pep
MQDPRDDDFSAPKLHKKKVVYRPLPSGQLKGEPELLRREFPQSSGMVQKPPKRSLKVEPHTSPSDRGTPDSLTESGPTDEYRALRRKYLMLEEENFALDKELSMEEEEMKALEDEKLALLDQLVVLEGLVEPSQLQSQRRP

SEQ ID NO: 41583 - protein, 111 aa, Sorghum bicolor
  Clone ID: SORBI-28MAY03-C64012_1.pep
SLLNQPKQQLAASFTTEPNQQLHPPISLNLQSSTLYVSPIQSRLSSKQSFRLPFICGQSEVASPPGAAVTRSSALASRRGSAGPGTVLAPAAGTVGCHSVIGRGPPVQVQF

SEQ ID NO: 41584 - protein, 242 aa, Sorghum bicolor
  Clone ID: SORBI-28MAY03-C6409_1.pep
PTASLLLPAPPFVSVSDVRRLQLPPRGRHRPRLCWRGVEWGSVQTRMVSSSFFGSRTRRRNVICASLFGVGAPEALVIGVVALLVFGPKGLAEVARNLGKTLRAFQPTIREIQDVSREFRSTLEREIGIDEISQSTNYKPTTMNNNQQPAADPNVKPEPAPYTSEELMKVTEEQIAASAAAAWNPPEPATSQQQEAGAATPSEGAATSGGSDGPAAPAPPALAVSDSDPSQANQPEKVDTQR

SEQ ID NO: 41585 - protein, 125 aa, Sorghum bicolor
  Clone ID: SORBI-28MAY03-C64122_1.pep
KGGKTLDSSIPLSKQEDLIVWMRTAALPTFRKLYGRIYVDLKENDTITVQLENNYNTYSFSGKKKLVLSTATWIGGKNDFLGLAYLTVGGICFFLAFAFTLLYLIKPRKMGDNSYLSWNRATLGR

SEQ ID NO: 41586 - protein, 105 aa, Sorghum bicolor
  Clone ID: SORBI-28MAY03-C64138_1.pep
GTWLSRSGGFPTYGLPQPLLSHLRAALGCDIDESTTEADIKENDKVVLETILSIFNPMLEALPEQDDSHREGASWDVKLSLDYKDLQRKIISSIVTSCTSALENF

SEQ ID NO: 41587 - protein, 377 aa, Sorghum bicolor
  Clone ID: SORBI-28MAY03-C49433_1.pep
HEETVEGWNASAPPLYLWSHPHWTKKHMQVAEERGHTCMGNIACHVEDSNLLDDLPMRKQSEATNKRNSRSGKHEACNDRKANRLDGGPAKKQARSEEEKETLGKIEHHVKEANIPDNLPVKIAETSRKVISHSGKDRENGRYNSRRYDNRSRKRTPDHIESLPPEKQVEVAYEETKVIIPSKKITHNEQRGACRENRSSCVEETKSAQYNYEKIAAGMPNMSSREGGDSDMSISPPVSSNARSKSICYSPSKPIEHFDTTAHPDKYIDSVLNQDRAHPDKYIDSVLNRATHQDSYLALNRKYDPMFTDIDDISRMKGSSIEEVTKPYTTAPTSDPYSLRSRDGSFYRHPSSEDLNINTDVPMQGYSARYGQIGGDS

SEQ ID NO: 41588 - protein, 145 aa, Sorghum bicolor
  Clone ID: SORBI-28MAY03-C4944_1.pep
NQAGVLLACGATLYWADGKTANFNCSFLTNLAFDVTLYGTNGTLHVTDLVIPYEENSAEFSVASKSNFVKPTIGWDPLPRKHVVTTDLPQEALMVQEFTRLVQNIRDSGGRPERKWPAITRKTQVVLDAVKASIDKGSEPIEVAS

SEQ ID NO: 41589 - protein, 208 aa, Sorghum bicolor
  Clone ID: SORBI-28MAY03-C49489_1.pep
MLRAALFRSAPGLRRSPAMAAAAAPFSTAAAAAAWLSNGPASTPPRVRLLIGGEFVESRADEHVDVTNPATQEVVSRIPLTTADEFRAAVDAARTAFPGWRNTPVTTRQRVMFKFQELIRANMDKLAENITTEQGKTLKDAWGDVFRGLEVVEHACGMGTLQMGEYVSNVSNGIDTFSIREPLGVCAGICPFNFPAMIPLWMFPIAVT

SEQ ID NO: 41590 - protein, 403 aa, Sorghum bicolor
  unsure (1)..(403): unsure at all Xaa locations
  Clone ID: SORBI-28MAY03-C4951_1.pep
TTLDAPKKLLSSEALQRLEPCKLTLGSPSDRLNALVEAVLVKPCTGFCISHEVAVFLRNYFFRHDGTITSFITAXLACCKHFSMEPLSFLCIGMLEEDSEEFWRDKFESLPQTIRKYAFDLPSSKNANNSNNSCNMVEGLSRLLKLQKDWSSVLLCLYEAGRHDKMQLLDIFCEAANPDLQTENAPDNYLCASKVTCENLLGVKSGSAKGFIAQVMNTIRYLPTEILLHVLEVWSIHLKGMSEINDRVKELQSTTIGADSVRTKRRSTANTGNGTVLLNDKVAALLQDVIRKYLVPVECLPFHEIICFKNVDILQSALIGNPRRMIQLDLLKSQSHLKCSCCSRSGAAVSGSLHDTSIMCNLAQEYGXVINLHEWTXLEGIIKSTXSKGKXKSYSSPSKKKSK

SEQ ID NO: 41591 - protein, 215 aa, Sorghum bicolor
  Clone ID: SORBI-28MAY03-C4806_1.pep
ARGQQQQPPPQQQLQQQQQQQRRDGSHLLNGSANGISGNNPLMRQNQSTANVMATKMYEERLKVPSQRDSLEEASLKQRYGENAGQLLDSNEASLLKAASSAQSSGQILHGTVGGLSGTLQQVQARSPQLPGPAQGIKTEINPILTPRAAGPEGSFIGVQGSNQAGNNLTLKGWPLTGLEQLRSGILQQKSFIQNQQQLHQQIQMLTPQQQQQLM

SEQ ID NO: 41592 - protein, 179 aa, Sorghum bicolor
  Clone ID: SORBI-28MAY03-C48150_1.pep
FSSANSLDDLISSDVLGWLLFYLNNGDYAVLECTLKILRHLSEVSEEYNRMMGRAGYLSALSSLLGAKSCRVREMAAQVLSSLLMLHPNRVIFIQDGDNLNRLLQLLDPAEGKLMAKDLILSAIMSLAETHSGRKKIVTSENFCCLKELADTGDFDAKKIVRKLSTNRLQTIFSKIWSV

SEQ ID NO: 41593 - protein, 280 aa, Sorghum bicolor
  Clone ID: SORBI-28MAY03-C4837_1.pep
MYKSRLQELCQKRRWAPPVYEPTREGPAHTPLFRATVVVNGESFSSPDEGERSVKEACNLAAMAAFENLSALPAEAPAPAPAPAPPPPETQLRYKNQLQEYAQKRGKLLPSYRPIHGGSLRAPLFKSEVTIDGQTFESPEYCRTMKEAETAAAKVALMFLPQEAGPTQQLPLPSVSYKNLLQEFVQKEGFPLPTYDTTLDVSNYSAAFISTVEIQGATFRGEPGNTKKQAEMNAAKIAFQHFKDRVKDSACSTGHGGPPVQQGTKNLPAGQNIKGLEPGF

SEQ ID NO: 41594 - protein, 154 aa, Sorghum bicolor
  Clone ID: SORBI-28MAY03-C48529_1.pep
MKLSAAVLCALVAVQAAALLLATVPSAQAKELEVGYYGKKCKGVENVVKWHVIKAIKANRRTGAALVRLLFHDCFVRGCDGSVLLDASSDNPHPEKEAPVNIGLAAFDVLEEIKAAVEKRCPGVVSCSDILIYAARDAASALSNGHVHFAVPAG

SEQ ID NO: 41595 - protein, 190 aa, Sorghum bicolor
  Clone ID: SORBI-28MAY03-C48565_1.pep
MAASCVSKERTGVPVVALSLGKPMPRVGFGTASATLGQAEGRAGVTEAVLSALSAGYRHFDTASAYNSEAAVGDAVIHAAAVRDDLYITTKLAITDAHPGRVLPALHKSLRNLQMEYVDLYLIHFPVSMRPPVVEGGLAVVKEDLVEMDMKGVWEEMEECHRRGLARAIGVSNFSCKKLEYLLSFANIPP

SEQ ID NO: 41596 - protein, 397 aa, Sorghum bicolor
  unsure (1)..(397): unsure at all Xaa locations
  Clone ID: SORBI-28MAY03-C4867_1.pep
LVLDRERPTKRRYRYTGYANAAFDQDRSCSHLAKMIIQHDYPLHIVQQPAFSIFIESLQPRFKIVDVDTMEGEVYAVYQKEKENLLQSFSTMPGRISLTIGLWTTSQTLGYVSLAGQFIDSEWKVHRRMLNFMMVSSPHSENALSEAISLSLSDWNMKDKLFTITLDNDCSSHDIYSANLRDHLSNKNNLMLKGQLFVVRCYAHILNAVAQDVIASIHGVVYSIRESIKFIKASSAREEKFAEIALQLEIPSTKTLCLDVTTQWNTTYLMLLAALDYKQTFTTLETCDDNYNEAPSAEDWKKVEAACNYLKLLYDSAHSIMAAANPTANIFFHEAWKLQLELANGTGHEDPAFSSIAXDMHERFDKYWKDCSLVLAIAVVMDPRFKMKLVEFSYSXI

SEQ ID NO: 41597 - protein, 211 aa, Sorghum bicolor
  unsure (1)..(211): unsure at all Xaa locations
  Clone ID: SORBI-28MAY03-C50067_1.pep
PPPRRPPPPASHPGAGGPRAHEEAGRLRAPACPVPPPPAQAPARSTRHSPPPPGPXPSLSGSADPRPPPAAAPPSAPSPSTRRPGVVAAAPARARSRAGRAPXPRPRSAPEFVPRPPPARLSRRPHAAPPSCVPWSAPRARPSRPPLPLPAAWAHPSSPRSPPSPSAAPAAARRCRRPSSASPAWRWSRACRPGCSGAAGLELNKDGSDCL

SEQ ID NO: 41598 - protein, 326 aa, Sorghum bicolor
  Clone ID: SORBI-28MAY03-C49815_1.pep
MAAAAIGVVALFLAAASFGANANTDSNDVNALNVFYTTMNSPPQLTNWVSQNGDPCGQSWLGVTCSGSRVTAINLSGMRLNGTLGYNMNQLTALVQLDASNNNLGGSDIPYNLPPNLQSLNLEGNNFSTRVPYSISQMVALRNLNLGHNQLSNINDMFSQLTNLTTLDLSYNTFSGNIPQSFNSLTSLKTLYLQNNKFSGTIDVLTNLPLTDLNVENNQFTGWVPDKLKGINNLQTSGNSFNNGPAPPPPPSSLSPLSPPSTDTPPPSRRPAVPSSAGKDTPAKDGGKHSKLGGGAVAGIVICLLVVGAIVAFLVIKRKSWRLSRG

SEQ ID NO: 41599 - protein, 298 aa, Sorghum bicolor
  Clone ID: SORBI-28MAY03-C4979_1.pep
LMKRIARQLEEASVSDLLIPTVDGDTTVYDIDLILSIVEEFVRQDSKNAQRHNGGEVNDHVSAPSASMITVAKIVDGYLAEVAKDPNIPVYKFFSLAETVSANSRPVHDGLYRAIDMYLKEHPGLGKSDKKRLCALMDCKKLSPDACAHAVQNERLPLRIVVQVLYHEQTRASAAATIRADSIGIGSYESSRSGATTNTEDEWDGVMAVEDLSLSKTTKLDKCHTASTIVEKNHGGNKGANGRVKGGATSKKALGKIMSSKGQTGERSSSDSSDSAILPSQEHPKRTPARSTTKSAAA

SEQ ID NO: 41600 - protein, 355 aa, Sorghum bicolor
  Clone ID: SORBI-28MAY03-C50197_1.pep
MWALNNAKAGGPCLTPRHPAPPSLASPSTAAAAAGRRFLRRSPVWAPLVAVRASGGTRKARPGGGEASSGEEADSKASSSGHDDASTPTGDTSAGLNQPHDETKTNKPINVSSSNYWRDVRANLVRREQELLVDPSTPTESKPSSGDPLQLPQKWAHAITMPEAGCVLVATEALDDDSIFERTVIFILRLGSRGTFDGPFGVILNRPLYTKIKHVNPTFQDQATPFGDSPLFFGGPVDMSMFLVRTDDSSRLKGFEEVVPGICYGFRTDLEKAAVLMKSGAIRTQDLRFYVGHAAWDYEQLLGEIRAGYWAVASCSTELISDALTGDPSCLWTEILQLMGGQYSELSEKPKQDSS

SEQ ID NO: 41601 - protein, 315 aa, Sorghum bicolor
  unsure (1)..(315): unsure at all Xaa locations
  Clone ID: SORBI-28MAY03-C49171_1.pep
HEELLWEAMNTTDDSTGLIRGFMLISRQTAAPSSLYTVSCRDENXXKSMAKYCVEDLPNLLKAENLDNVAALLSRLIESLPADAESLIKWVVEVRRKEEGGPSLSKEEKERLFLKENVLQQVRDTRLFAIVHDQQNANKPCCNCSSLCEEDSLTRIAAVVCCQGAAMLSGNLVPRDAFCCKETCLKCVQANGDGLKTVISGSVVSEGSEQGVDMLLPMSSPSASSCNSNLRNNVIKYPSPVDVLTVLLRALHPNTWLGIKDEKLKAEFQTLISTDSLPDDLKREILHLRRQLYYLKACKEEECEDAEPPSPKQQS

SEQ ID NO: 41602 - protein, 299 aa, Sorghum bicolor
  Clone ID: SORBI-28MAY03-C49205_1.pep
MERVALLRTSGRRLLHRCRRGRSVVVPTAAASSLARRTSSFSLPARGYSALPRGGARFLAAAAPLHCSGRYWPAAAPQLARRLSAPAVSTSPSPVPYDTDDVHEYAAKLGFEKVSEQTIDECKSTAVLYKHKKTGAEVMSVSNDDENKVFGIVFRTPPKNSTGIPHILEHSVLCGSRKYPLKEPFVELLKGSLHTFLNAFTYPDRTCYPVASTNTKDFYNLVDVYLDAVFFPKCVDDFQTFQQEGWHYELDNPEEEITYKGVVFNEMKGVYSQPDNIMGRVSQQALSPDNTYGVDSGGD

SEQ ID NO: 41603 - protein, 115 aa, Sorghum bicolor
  Clone ID: SORBI-28MAY03-C494_1.pep
LLEIISGRRPAQSVESVGWQTIFEWATPLVQSHRYLDLLDPHIQELPDTGVIQKVVDLVYSCTQHVPSVRPRMSHVVHQLQQLELKSAASEQQLRSGTSTSATSPMLPLEVRTPR

SEQ ID NO: 41604 - protein, 256 aa, Sorghum bicolor
  unsure (1)..(256): unsure at all Xaa locations
  Clone ID: SORBI-28MAY03-C49401_1.pep
MAAAEENSSLFLIFILTMIALPLVPYTILRLCRAASEKAKTIHCRCSGCHRSGKYRKSIYKRISNFSTCSNLTIVLLWIVMIFLVYYIKHVSREVQVFEPFSILGLESGASESEIKKSYRRLSIQYHPDKNPDPEAHKYFVEYISKAYQALTDPISRENYEKYGHPDGRQGMQMGIALPKFLLNIDGASGGIMLLGIVGFCILLPLMIAVIYLSRSXKYTGNYVMHQTLSTYYYFMKPSLAPSKVMDVFIKAAEYM

SEQ ID NO: 41605 - protein, 117 aa, Sorghum bicolor
  Clone ID: SORBI-28MAY03-C4941_1.pep
WLASSETSSSLRKWPAFAAEGSRASSSPKQRTKNRMNGSLPPVCDCCFALLAAAAAATNYRAGRRPAVRAVGRRLLMVLDEREGALVLPLHNAISALFSAAASKALPRRAHRGRYIA

SEQ ID NO: 41606 - protein, 334 aa, Sorghum bicolor
  Clone ID: SORBI-28MAY03-C49410_1.pep
MESEMAEESPAAAAARARPLEAVAEEGQEVAEQNPVAPVGSTLTMERVAAAKKFIENHYRSQMKNIQERKERRFRLERQLASSQVPKEQQINLMKDLERKETEYIRLKRHKICVDDFELLTIIGRGAFGEVRLCREKTSGNIYAMKKLKKSDMVVRGQVEHVRAERNLLAEVASHCIVKLYYSFQDTEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLRESMDIDSSLSDTANGRRWRSQHEQLQHWQMNRRKLAFSTVGTPDYIAPE

SEQ ID NO: 41607 - protein, 194 aa, Sorghum bicolor
  Clone ID: SORBI-28MAY03-C50741_1.pep
HEVFLDDDIVVQRDLSPLWAINLEGKVNGAVETCTGEDSWVMSKRFRTYFNFSHPVIARSLDPDECAWAYGMNIFDLAAWRKTNIRDTYHFWLKENLKSGLTLWKFGTLPPALIAFRGHVHGIDPSWHLLGLGYQDKTDIESVRRAAVIHYNGQCKPWLDIAFKNLQPFWTKHVNYSNDFVRNCHILEPQHVKE

SEQ ID NO: 41608 - protein, 205 aa, Sorghum bicolor
  Clone ID: SORBI-28MAY03-C50751_1.pep
MASAAADAVSAVPPSVVSAAEETLAAAESVGDHLSHLLAAAAADPDAVAELPPLLRARAFLAVAQAATSLLAVRLRCSGIDPDEHPIRKESERLSLWQEKLNQFEAWDKAPLRPTTTINTQAAARFIGHSLSHLTSDQKRSMQEISRGEKRSWSGQKRKPEPLPEKKSVRAAAEEFLAKAAQELIGHSDSRVKGPVIVIPDEDED

SEQ ID NO: 41609 - protein, 113 aa, Sorghum bicolor
  Clone ID: SORBI-28MAY03-C50907_1.pep
HQGAAIELGNELVARSVDLVYGGGSIGLMGLVSQAVYDGGRHVIGVIPKTLMTPEISGETVGEVRPVADMHQRKAEMARQSDAFIALPGGYGTLEELLEVITWAQLGIHHKPV

SEQ ID NO: 41610 - protein, 165 aa, Sorghum bicolor
  Clone ID: SORBI-28MAY03-C5086_1.pep
MASAAAAALLLLLLLSPSAAQPGFISLDCGGARDHTDAIGIQWTSDATFVSGGGQTAQLQVQTAQQQLTTVRYFPADNRKYCYTMNVRNRTRYLVRATFLYGNFDNSNVYPKFDISIGASTWSTIVVDDATTPVVEEAIILAAAPTLSVCLSNASTGQPFISTLE

SEQ ID NO: 41611 - protein, 86 aa, Sorghum bicolor
  Clone ID: LIB3476-003-Q6-K1-C3.pep
MASAAAAALLLLLLLSPSAAQPGFISLDCGGARDHTDAIGIQWTSDATFVSGGGQTAQLQVQTAQQQLTTVRYFPADNRKYCYTYD

SEQ ID NO: 41612 - protein, 355 aa, Sorghum bicolor
  unsure (1)..(355): unsure at all Xaa locations
  Clone ID: SORBI-28MAY03-C5103_1.pep
LEQEEYVEDGIDWAKVDFEDNQDCLSLFEKKPLGLLSLLDEESTFPNATDLTFANKLKQHLDSNSCFRGERGKAFAVRHYAGEVAYDTSGFLEKNRDLLHMDSIQLLAKCKTSLPKMFASKMLVQSDNSMSVPYRSSAADSQKLSVAMKFKGQLFQLMQRLESTTPHFIRCIKPNNLQLPAIYEQGLVLQQLKCCGVLEVVRISRSGYPTRMTHQKFARRYGFLLLEDVASQDPLSVSVAILHQFNILPEMYQVGXTKLFFRTGQIGKLEDTRNRTLHGILRVQSCFRGHQARHHARERIRGVGGXESFIXGENARQIYSSLSRKHRAAVILQRNVRCWLARRYFIKLRKASXII

SEQ ID NO: 41613 - protein, 114 aa, Sorghum bicolor
  Clone ID: SORBI-28MAY03-C49550_1.pep
RLVSNLHFVGQVTVTAIENHAQQVAAIADELTSFGISQSEGAGRTRTREATIGRGKGAPAPGGGGGSASGTPARIRGRPAPTANDVAEMGTRRRAGLERPRHAPRRGPAAALHP

SEQ ID NO: 41614 - protein, 161 aa, Sorghum bicolor
  Clone ID: SORBI-28MAY03-C49589_1.pep
SKWTKKSWEKAVIFVDNSGADIILGILPFARELLRRGTKVILAANDMPSINDVTYPELVEIINELKDADGKLSGVDASGLLVANSGNDLPVIDLSSVSPELAFMANDADLVVLEGMGRAIETNLYAQMKCDSIKIGMVKHPEVAQFLGGRLYDCVFKFNEA

SEQ ID NO: 41615 - protein, 171 aa, Sorghum bicolor
  Clone ID: SORBI-28MAY03-C49564_1.pep
RFGGAVPGTAICADKVEEPRDESPLSCVSTTGSSTTLSATQQSVSEPNSEPSETSIEASPRQCHGEKSQDVTDGEADSSETPPKDEVIKPVISINLQPEQSVVQQDIVDMYMKSMQQFTESLAKMKLPLDVENSSPSNEDSYSSTIEKTSPSPSSAAAKGSRVFYGSRAFF

SEQ ID NO: 41616 - protein, 92 aa, Sorghum bicolor
  unsure (1)..(92): unsure at all Xaa locations
  Clone ID: SORBI-28MAY03-C49599_1.pep
TWALWTGLGPSVARNAIINAAEVAGYEQFAQMFLKPPGFADYVFTRLLAGLSAVFPAVCRVAPGDVVMFXTLGHATYCGTLSCCARIFLIDV

SEQ ID NO: 41617 - protein, 81 aa, Sorghum bicolor
  Clone ID: SORBI-28MAY03-C49675_1.pep
LLLIFVTLQLRSCHLVTLLYNRDLLVAMIFQVLITSALIEGKLLVIFFIGVCSISMKASCSLSYSSVHTCMLPKTCMLVGR

SEQ ID NO: 41618 - protein, 105 aa, Sorghum bicolor
  Clone ID: SORBI-28MAY03-C49726_1.pep
FTKFAHPQSGGFRGFNGSGLGLAICKRFVSLMGGHIWIDSEGTGRGCTATFVIKLGVCDNTNTYQQQLIPLVWPSSADSDLSAPKVLPDGRGSATSLKSRYQRSV

SEQ ID NO: 41619 - protein, 217 aa, Sorghum bicolor
  Clone ID: SORBI-28MAY03-C51521_1.pep
GRRREQTGQHVPPYYGLRPVPLIEAAVFVADAPQEPPRARTRLESLCSLRHGQLHPLVFSSPPIPPSSPIPISELWVLPFVSAHHPGRLLHRNPSPLLSAISLHCSVALDLRLEILPCPAARGAAKDNMVLVRRSLTMSRPRSCHDADDRGWNPLHVAARKGDLKEVRRLLDDGMDVNAPAWGPKCPGATPLHLAAQGGHVKIMDELLERGANIDAR

SEQ ID NO: 41620 - protein, 142 aa, Sorghum bicolor
  Clone ID: SORBI-28MAY03-C51536_1.pep
MEYERIHQKAQPGALSPTKLRMKIMGAHNRVRVITSNSSSRTSPAKNIEASQAQNRLLVCDVLEEVSDSTSDGTKHPSAVNKTEAVEKDSAVDSNKVQNISKSSVPQPATGSSSMIHPVGPLGDTVPFGPLPLSPRAPVPFR

SEQ ID NO: 41621 - protein, 350 aa, Sorghum bicolor
  unsure (1)..(350): unsure at all Xaa locations
  Clone ID: SORBI-28MAY03-C51529_1.pep
HEGGVGSGKRRRGRSAPRRPVQPPATWIEAVGTLAETLRFTYSETLGKWPIGDLAFGIKYLMRRQGSSRVASVYAGSECIELKGPEIMEELIVLRRLIDLCFLFSKKPFPVFRELAGFSQEDVLIEEPKAGILKPAHTILRDECTKSFLVLIRGTHSMKDTLTAATGAVVPFHLSLLDEGGVSKLVLGYAHCGMVAAARWIARGVTPCLREAVRQCPEYQIKIVGHXLGGGTAALLTYILREHKEFSSTTCVAFAPASCMTWELAESGKHFVTTIVNGADLVPTVSTASIDDLRSEVTASSWLNDLRDQIQQTRFLNVVYRSATALGTRLQSFSGARERVAGAGAFLRPV

SEQ ID NO: 41622 - protein, 108 aa, Sorghum bicolor
  Clone ID: SORBI-28MAY03-C51571_1.pep
MGSLGEVDHGKEMFHGHGHSDPVVDELNRLQNLLREKERELGHAYSEIKGLKVTEALKDKAIAELSKELKKQDEKMRSLEKQLEQKNLEVKRLNNERKEALSAQFAAE

SEQ ID NO: 41623 - protein, 296 aa, Sorghum bicolor
  unsure (1)..(296): unsure at all Xaa locations
  Clone ID: SORBI-28MAY03-C51596_1.pep
MQNHAYSRLGISGAGAAVPSPPSSPRRAWGRRASAKGGWSARASAGAGWGWGAARRGTRAVLAALLRRQAVFLFAPLLYVAAMLLYMGSISLDSVPRIISRPAPGSVYRSPQLYARLRADMDADNATDALATVWRHAYRGGVWRPCISNNTNGLPESNGYIYIEANGGLNQQRTSICNAVAVAGFLNATLVIPNFHYHSIWRDPSKFSDIYDEDYFIQRLKNDVRVVDKVPEFIMERFGHNLSNAFNFKIKAWSPIQFYEDIVLPKLIEERLIRISPFANRLSFDAPPAVXRLRCL

SEQ ID NO: 41624 - protein, 151 aa, Sorghum bicolor
  Clone ID: SORBI-28MAY03-C50370_1.pep
IRTSNVKEEAPVTVANQKFNEAPIPNEELTIGVVQEQRKDVKPRSYPAAKPELCDTTITEESSPISTLKLAHTESAPAEWDHLNIVQQRADALESLLELCVKLLEQERLDELAGVLRPFGEGAVSSRETAIWLTKSLMTPPKFGESPTKLL

SEQ ID NO: 41625 - protein, 170 aa, Sorghum bicolor
  Clone ID: SORBI-28MAY03-C50490_1.pep
CDSLPATGTSGTIDDFMAMQTNFGSFTSLVRAVEDVPLSRIMQDQCDLQLGFGGSKQQIYPSFEQQLRMASAGAPPYGGMGRHDSIPVPEPTLMLGYAPQLGNCPPPFQLGWGPSYSKMVGMLQSVCVWCNSPFQHFGTVAEQQADSLGYICPSCKGKFSGHLGINGPSI

SEQ ID NO: 41626 - protein, 322 aa, Sorghum bicolor
  Clone ID: SORBI-28MAY03-C50500_1.pep
HEDKTDWGLELGWIYGSITEDILTGFKMHCRGWRSVYCMPKRAAFKGSAPINLSDRLNQVLRWALRAVEIFFSRHSPLLYGYKNGNLKWLERFAYINTTIYPFTSLPLLAYCTLPAVCLLTGKFIMPSISTFASLFFIALFMSIFATGILEMRWSGVSIEEWWRNEQFWVIGGVSAHLFAVVQGLLKVLAGIDTNFTVTSKATGDEDDEFAELYAFKWTTLLIPPTTLLIINIIGVVAGISDAINNGYQSWGPLFGKLFFALWVIVHLYPFLKGLMGRQNRTPTIVVIWSVLLASIFSLLWVRIDPFIVRTIGPGRQAVASC

SEQ ID NO: 41627 - protein, 272 aa, Sorghum bicolor
  Clone ID: SORBI-28MAY03-C5057_1.pep
MGRYSPAYSPPRRGYGGRGRSPPPRRGYGGGGGGGRGDHGSVSLLVRNIPLRCRPEELRVPFERFGPVRDVYLPRDYHTGEPRGVGFVEFADAYDASEAQYRMNREMFAGREITVVLAADSRKRPGDLRRRTGPRGYSGHERRRPYRHGRSRSRSYSRSRSPRPRGRGRSQSYSPAPKRRDDYSASPPRSKEENPRSSKQPKENDRDKKRRSYTPDDRNDRRGAEIGHDERKKCPAGEEDEKPHRGRRRSPRPASMSPPGSRSRSASPAISS

SEQ ID NO: 41628 - protein, 95 aa, Sorghum bicolor
  Clone ID: SORBI-28MAY03-C50648_1.pep
DEANAKSSEDSVAVEKPQQEEDNVATEKPQQEEDNGVKALEEDVSPEKSANGKPLEEEDPVHEKLADADTVVEPSSQDDTATEKPSATTDTAETA

SEQ ID NO: 41629 - protein, 287 aa, Sorghum bicolor
  Clone ID: SORBI-28MAY03-C5067_1.pep
MDWDLKMPVSWDLPDLEHDAAMPQPPPIAATAAAASPAAASGIAAAATAAPPHAAATRGAPSRAECSVDLKLGGLGEFGAVADGTKEPAAAATATAAPSAPSASPMKRPRSGPGGAAGAQCPSCAVDGCKADLSKCRDYHRRHKVCEAHSKTPVVVVAGREMRFCQQCSRFHLLAEFDEAKRSCRKRLDGHNRRRRKPQPDAMNSGSFMTSQQGLFSSAGTRFSSFPAPRPEPSWSGVIKSEDSSYYTPHPHPVLSNRPHFAGGSTSSAYSRGGRRFPFLQDFSAGA

SEQ ID NO: 41630 - protein, 338 aa, Sorghum bicolor
  Clone ID: SORBI-28MAY03-C52267_1.pep
MQDSTKLELRRQAELKKSLRSGFASIPQPRNEYQIVMPPITEDEAEEAEEKIEEDMSDRLARERAEEQARQEALLRKRSKVLQMSLPRPPAASVEIIRQSLIRSGESRSRSTFVPPTSLEQADELINEELLRLLEHDNAKYPLDEKTQKEKKKGSKRQQNGGPLVPEIEDFDEDELKEASSMGAGEIQYLRVAMGHENESFEDFVKAHDACQEDLMFFPTNNSYGLASVAGNADKISALQNEFETVKKRMDDEAKKASRLEQKIKLLTQGYQVRAGKLWSQVQDTFKQMDTAATELECFQELQKQEHLAASYRILNLTEEVNKQKALERTLQSRYGEL

SEQ ID NO: 41631 - protein, 262 aa, Sorghum bicolor
  Clone ID: SORBI-28MAY03-C5237_1.pep
MRLFSGVLDSSSAFASAVLGSVSDRLGFSRVFFGRASPSSMPALACEAAASSSAAAGADPCAGAQKPWLFVGLGNPGRMYKGTRHNVGFEMIDAIAEAEGISVSSKQFKAIVGKGLIGDVPVMLAKPQTFMNASGESVGQLVSYFKIPLNQLVVIYDDLDLPFAKLRLLPKGGHGGHNGMRSIIDHLKQSRNFARLRIGIGRPPEEQGAISFVLQSFTVQEKEELEVVFQRGLQAVRIMVQEGFNKSAQFVNTPPPAEMLNR

SEQ ID NO: 41632 - protein, 196 aa, Sorghum bicolor
  Clone ID: SORBI-28MAY03-C5236_1.pep
MDLSAVQAALSDKSYSALAPLCDELLLQVAAKGAITDEWPYSVHLLAHLYINDLNSARFFWKSLPQEVKDTRPELAAVWRIGQCLWNRDYAGVNTAAQGFEWGPDLADFITAFLESYRQRIFKLLTSAYSTISVADVAHFMGMSEEDVTNYAVQNSWSLDAATGMLTVKKPKAQTNQKLDSSKLQRLTECVFHLEH

SEQ ID NO: 41633 - protein, 190 aa, Sorghum bicolor
  unsure (1)..(190): unsure at all Xaa locations
  Clone ID: SORBI-28MAY03-C52561_1.pep
MTKDEEFKLVKIQNHVLKVNIHCDGCRHKVKKLLQKIEGVYSVAIDVDNHKVSVTGDVDSETLIRKLTRGGKHAELWSQQKGGGGGNQGHKGNNGQQKHQQHQQHQQHNQQQQQQQQQKQGANPGKDAHNKNNNNGGQKEQGKQGGVGSLMQGXLKAFKNQHSNKNQLPELSSEDDDLYDDEXDDEFDDD

SEQ ID NO: 41634 - protein, 253 aa, Sorghum bicolor
  Clone ID: SORBI-28MAY03-C52661_1.pep
TRLPSPSGLRANLRAPFGPASGRGGFAGRPGGRGSVPGPAAAVYPAPARPAVVVLPAPPRHAQAPVPRRSRTRPLRGGLRGALSRAVARGARPWPALSSASGAHPLRLALPGVVPPTANEEDDKFDCENMQWNSSDLASDDAQSPKPQRSRSRQHRGFHRKSLSRSMSCDSHSKTSVSSSSRAHTKVDLSKLELTALWRYWRHFNLDACPNPSREQLIDAVQRHFTAQQLDELQVIVGFVQAAKRLKTTMKVA

SEQ ID NO: 41635 - protein, 360 aa, Sorghum bicolor
  unsure (1)..(360): unsure at all Xaa locations
  Clone ID: SORBI-28MAY03-C5092_1.pep
TREKVKLPKDKKVLATRANKEDSTANEITLADPNQVAVLFSEWCQMCNHVSASDAAYSRFVSQLQQDGLLKGDDISERFFRILTELAVTHSLVSEQIVAPGGSSQQSPQQPHISYFSVDSYAKLVVMVLKYSSLEITPNKASILSKILSVTVRTIQKDAEEKKASFNPRPYFRLFINWLYDLTTTDGHHDGSNFQILTAFANAFHMLQPLRVPAWGFAWLELVSHRSFMPKLLMCNSQKGWPFLQRLLVALFKFXDPYGLRDAELPEAVDLLYKGTMRVLLVLLHDFPEFLCDYHFSFCDVIPSSCIQMRNVILSAFPRKDMENTERGGVDQRMEVAVGEPSRNPEPKETRILTRHSFKE

SEQ ID NO: 41636 - protein, 204 aa, Sorghum bicolor
  Clone ID: SORBI-28MAY03-C51148_1.pep
MTVLHSPVGVRSIVTSMVAFFILASSIVFLLDRGQEEQVQMAIEHGRQEVQVKLEAGLQEPAIRGTTDEGDASNEECNWSRGRWVYDNVSRPLYNGLKCTFIFPEVACDKYGRKDVMYQHWRWQPHGCDLPRFDAIKLLEKRLAPSSASVADAGNSKRWGPPGCVAEASRPDDRLKTRIFNGSLISFKALEYNATIDFYWSPLL

SEQ ID NO: 41637 - protein, 219 aa, Sorghum bicolor
  Clone ID: SORBI-28MAY03-C51176_1.pep
MSEFLDLETQDGIRMTWNVIPGTKQDATNCVVPVSATYTPLEPNPSIPVLPYAPLRCRMCRSILNPFSVVDFVAKIWVCPFCFQRNHFPQHYNSISENNLPAELFPQYTTVEYASTSETGPVAPPVFLFVVDTCMIEEEIGYLKSALAQAIELLPDQSLVGFITFGTYVQVHELGFGLLPKSYVFKGTKEVTKEQILDQMSFFAGKTKPTSGVIACARD

SEQ ID NO: 41638 - protein, 135 aa, Sorghum bicolor
  Clone ID: SORBI-28MAY03-C51261_1.pep
LPPTAPLDLQGNAKEVDVQKTGGVREITNPPSIIDIKSSLLQQIRDKTEQLKLNNGHERSKKAVGGDIKSLDEREELLQQIRSKTFNLRRTNASKTDGSSQSTANSNVVAILEKANAIRQAVASDGGDDDTWSDI

SEQ ID NO: 41639 - protein, 158 aa, Sorghum bicolor
  Clone ID: SORBI-28MAY03-C51317_1.pep
FLAGDSAGANIVHDMLMRAASARGPRIEGAVLLHPWFGGSAPIEGEPPGPAAGTAGLWTYACPGAVGGADDPRMNPLAPGAPALEKLGCARMLVCAGTLDALYRRDRAYYEAVAASAWPGDVAWLESEGEDHDFFLGKPECENAKQLMDRVVAFIAGA

SEQ ID NO: 41640 - protein, 389 aa, Sorghum bicolor
  unsure (1)..(389): unsure at all Xaa locations
  Clone ID: SORBI-28MAY03-C5377_1.pep
MATPPPPLRRAAALLLVVLAGVLASTARADLVISKADRRVDLTSHIVRILASLKVENVGPDPVSQVLLSFPNIQAKNLAAIRAFGSEGKVKGQSTILPIEVVQPSGAPPDLTFFSALLPKPLEKGKTLYLDVLTVFTHSLQPFPEEITQAEAQLVVYQDSAHYLSPYPVKAQTLAIRLPGGRXVESYTRPPLPILVDSELKYGPFHDLPPFSYLPVIVHFENNNPFAVAKEVIREIEISHWGNVQITEHYNIAHGGARLKGEFSRIDYQSRPYVRGVSSFRHLIAKLPPRAHSIYYRDEIGNISTSHVWSDSMKTQLEIEPRFPLFGGWQTTFTVGYGLPLEDFVFYSDGKRFLNITFGSPLEEVLIEKLGVKVVLPEGSKDIEVSAPF

SEQ ID NO: 41641 - protein, 175 aa, Sorghum bicolor
  Clone ID: SORBI-28MAY03-C54560_1.pep
MAVLLLLVAVLGVVLASSLLLRWNELRYSRRRGLPPGTMGWPLFGETTEFLKQGPSFMKQRRLRYGSLFRTHILGCPTVVCMEPELNRRTLASDGAGFVPGYPQSMLDILGPNNIAAVHGPLHRAMRGAMLALTRPHMIRAALLPKIDAFMRAHLHGWAGRRVYIQEMTKEMALL

SEQ ID NO: 41642 - protein, 250 aa, Sorghum bicolor
  Clone ID: SORBI-28MAY03-C54576_1.pep
MTLAAGLGYALIALGPAFSLFAGVVARKPFLVLTLLSSTLFWLISLIVLSGIWRGFLPIKSEAWWAYAILILTSVALQEGTRLVFWRLYKKMEEMLDAFADRISKPRLSLTDKMLISLAGGLGHGVAHAVFFCLSLLTPAFGRATFYIETCSKMPFFLASALIALGFLVIHTFSMIIAFNAYDERKKSDQVFVPVIHLAAAVMTLVNLAPGGCLIGTPLLLVMAALTLQHCWRVACQRLTEHRHQQHNSN

SEQ ID NO: 41643 - protein, 384 aa, Sorghum bicolor
  unsure (1)..(384): unsure at all Xaa locations
  Clone ID: SORBI-28MAY03-C54735_1.pep
TRPIPSSPRAPRPPPRLPPLPPPAAPPALPAPPRAGPRPPRPPRRRRPGPPPSPTPRTRPPPAPAPPALPLHGGFPPRPGPPGAAAAHPRLPRRRRPIHRTPRAALRGVGGGHARALPLHPPCLPARWQGSEGRAPPLPSSRGVGPASALLSVVGGWSLGFRHLLPRPSPCLRLTGVRGDGLSGPPALLSNGFEFSEVVRGEISADNSGRSFLIRISESKVFYYWCAEKSKERARELLTKMKNLLXGRPTLSDLTGISNSRLDAFATHLHAYLLASSIGDVKSLGSLNDFLSTSRSHGQYLQLQSAVSKTSRFRASATSAIKSSSAYQASLSPRSGTFKDGVPRASCARVVGRDKLKRRAEWSGSLTAPLDTNPLTINRDSTSE

SEQ ID NO: 41644 - protein, 197 aa, Sorghum bicolor
  Clone ID: SORBI-28MAY03-C5446_1.pep
VNGETKTVMARGTHGACDYLLKPVRLEELRNIWQHVVRRKFSNCERANIDGYEECTRPSNADFDHVHSQITGGTPDQSGRSSKKRKEYHSEEEDEGEESNGQENDDPSAPKKPRVVWSVELHRKFVAAVNQLGIDKAVPKRILELMNVERLTRENVASHLQKYRLYLKRLSAVASQQASIVAAFGGNDPFMRMGASL

SEQ ID NO: 41645 - protein, 110 aa, Sorghum bicolor
  unsure (1)..(110): unsure at all Xaa locations
  Clone ID: LIB3476-006-Q6-K1-C7.pep
XASAVASQQASIVAAFGGNDPFMRMGAFEGLQGYQSFASSAALPSFTPQGLLNRNSPTSFALQGMSASRPIQIASNSTISHSISDPNKYHLSLPGTSSRQGNLAQXLTTS

SEQ ID NO: 41646 - protein, 481 aa, Sorghum bicolor
  Clone ID: SORBI-28MAY03-C51796_1.pep
MEEFVNQQKTLEADASNSPLNQSHSHIFPVPSDNHDIERECPGSTPRSDTKELVVDNSVLTSAAPEILTTTSAASDSCKMESVNQQKTLEADASNAPLNHHPHSHSVPVSSDNQDIQRECPSPTPKSDSKEPLVDAPGLTSVAPEMLATTSASDTCKMEEFVNQQKALEADATNASLNQPPHIFNVSSDNQDIEHECPSPTPRSDCKEPLMDNSVFTSAAPEILATSASGTCKMEEFVNQQRPIKADASNASLNQPPHCHIFTVSSNNQDIECECPSPTPRSDRHEALVENLVLTSAVPENLLRSSAVACASDTCKMEILNKKRTFEADASLNQPPHSSIFASSSGDNQDNVCEHPSPSPRPEGEQPLMDNSGLTSTVPQNLTSSASASKMCKMEEILNEKRILEANPSDGSITQSPQSKVFLVPSPDILEREFSSKAPRPEFKEPAVDSSGLTSAAPENLMTKQHVHSPDAFVPPKSCAP

SEQ ID NO: 41647 - protein, 161 aa, Sorghum bicolor
  Clone ID: SORBI-28MAY03-C51826_1.pep
TRRSRLAELKTHARGFPVCFPRLNSPPSRPLRLASTLLHCRRSALTSTSPPSPPPCNTSTTVSRLYRCWGCGRQHLPPHSAPCIRSASLPPFYSAIHPHRCPLFLDADQRRSDPRGVHARHGTVVDISVHLHQARLPSSGPQSSLPFLLSKSSLPASHCLI

SEQ ID NO: 41648 - protein, 149 aa, Sorghum bicolor
  Clone ID: SORBI-28MAY03-C51861_1.pep
MPARARWRLLALPLALFLVAGSAHGLVKPEAAATPKPPVPKAISDLRDAIVKGLGFQAEGLKVSGFDVRDALVGHAVAYEFDIEVGRKVLPVRLLEDVSRWDFVDLPIFRSQADADDTALAEIRRGGRGSVVEPTLPPFQLAGPMELWI

SEQ ID NO: 41649 - protein, 83 aa, Sorghum bicolor
  Clone ID: SORBI-28MAY03-C52097_1.pep
MGPLFLRVGASRPRCCPFRCPPFVLLPPWVCPSPSSDPSCMRGLRGGGVRTPAPPHSARGVYREEIQRMYERGGFALATTRRS

SEQ ID NO: 41650 - protein, 206 aa, Sorghum bicolor
  unsure (1)..(206): unsure at all Xaa locations
  Clone ID: SORBI-28MAY03-C52134_1.pep
LSLDEDVLNSALEVHFKAGSMHWVVDKVPDQSLLNTANWKFIIPRLYWNYPNDDMLLNISMASSPVIRITSEXIEATINADMVIDVVDGKEIVPVACISVIVSTSGVVDASGNKVYGRVGLDNFSLALKWSRIGNFHMSLIQGVIRVFLNTVCMPYLNSRLGNGFILPVVHGFTLQDVYVLTSAEQLTLCSDVTFNASSLASLSLL

SEQ ID NO: 41651 - protein, 78 aa, Sorghum bicolor
  Clone ID: SORBI-28MAY03-C55354_1.pep
NRFRWLTRVSLDPYTENTDSTEKHAAALGDTAAQTTTMLLYFPCGLIRGALTNLGIPCSVSADMSNLPACSFVVRIKT

SEQ ID NO: 41652 - protein, 308 aa, Sorghum bicolor
  unsure (1)..(308): unsure at all Xaa locations
  Clone ID: SORBI-28MAY03-C5550_1.pep
PSHMEDPMDYTPAPAETLDHDVTIEEIQEYFTNYIVNESLGIIANAHVVYADKEDLKAKSRPCLELAKLFSIAVDFPKTGVPALIPPELHVKEYPDFMEKLDKATYESKGVIGKLYREIKKHTPHIRHFTREVASXSYDTDLIVDGYEDYITEAIEFKEEYDFRLGNLMDHYGIKSEAEIISGCFLKMAKNFTKSSDADAIRMAVRSLRKEARSWFNEMSTSEDDQDATEAKASAWYHVTYDPQYWGNYNEGYDRPHLISFPWCVYDKLVIIKQRRNFFTQMDPNLVSPMNNMRLHEHCQQVCSCTYP

SEQ ID NO: 41653 - protein, 117 aa, Sorghum bicolor
  Clone ID: SORBI-28MAY03-C557_1.pep
LREYPKLRLTQGRMVFEVRPTIKWDKGKALGFLLESLGFADCSNVLPVYIGDDRTDEDAFKVLRRRGQGHGVGILVSKHPKETSASYSLQEPAEVMEFLLRLVEWKQLSRARLIRLQ

SEQ ID NO: 41654 - protein, 167 aa, Sorghum bicolor
  Clone ID: SORBI-28MAY03-C55599_1.pep
MISPRMPTNLLPARTISPVSNGCAATASPSSPSVAARPRRPSSGLQSVTGRGKFPLAAITLDDYLPMRSTEVKNRTSTDDITSLRLITAVKTPYLPDGRFDLEAYDSLINMQIEGGAEGVIVGGTTGEGHLMSWDEHIMLIGHTVNCFGSRIKVIGNTGSNSTREAV

SEQ ID NO: 41655 - protein, 181 aa, Sorghum bicolor
  Clone ID: SORBI-28MAY03-C55717_1.pep
FHLSDVFVSQSLTLSVDPSPSPGKPPAPMWISSHVGPPLSPSSPSLSADPSPSPGKPPAPMSGLHCRRPLSLSPFLGRGSSFTPGSGPPPQLESVVTPLQPATASPSRLTRTWPLPLLCIQAMAPPLHLELALSCVTSSVSTDQGRPCRVPSASAAQARDEELHLCRGTSIAAPSMQGHRS

SEQ ID NO: 41656 - protein, 248 aa, Sorghum bicolor
  Clone ID: SORBI-28MAY03-C5271_1.pep
MLATTAASLRPPLRRFPSVSSPLGTSHGGASLLPWRRRRSLACRADLQQDAPFAAAIGACVLASLVLPPPRPRGEAVEEVEEEGEFGFGATDTRMAVMGIISFLPYFNWLSWIFAWLDSGRRRYLVYAAVYLAPYLRTNLSLSPDESWLPIASIFGCILHIQLEAGIRSGDIESFKFIESARKLIFPSAAKEKYGDHGNKRGSIGTGDRQNRRIPTAHESRERLRNSDIFKRKLDDSNDEKQKKSDWN

SEQ ID NO: 41657 - protein, 148 aa, Sorghum bicolor
  Clone ID: SORBI-28MAY03-C52849_1.pep
ICIEGQPLGVIQPVPYRTDNGTIRVLLRSFETIGRVCMADSVDEGVTWSYVHETDLPNPNSGIDGVKMKDGRVLLAYNTFSRGTLKIAVSSNDGDSWDEVMTLEDTKGMEFSYPAVIQSLDELIHITYTYNRTQIKHVVLQPSAMVKL

SEQ ID NO: 41658 - protein, 95 aa, Sorghum bicolor
  Clone ID: SORBI-28MAY03-C53371_1.pep
DVFSYGVILWELCTMRQPWEGMNPMQVVGAVGFQQRRLDIPGGVDPAVAEIIKRCWQTDPRMRPSFSEIMGTLRPLLKNTLANQPNRKRAQQTDD

SEQ ID NO: 41659 - protein, 99 aa, Sorghum bicolor
  Clone ID: SORBI-28MAY03-C53468_1.pep
FSHELVHSIFISTMLLTTIPMTSILPMTLKPSTHAYHASFHYSYHSTRTDCSNLAEYVIIALYKPQNNNLMKFVHTCTSRYGSVNISIFRTFLSCCRFQ

SEQ ID NO: 41660 - protein, 329 aa, Sorghum bicolor
  Clone ID: SORBI-28MAY03-C5375_1.pep
ALRRRHLQMDETQDASRRADLKAGAIMMASNIRANTGKRVGTVPGVEIGDIFYFRMELCVLGLHAPSMGGIDYMTTKFGNDEESVAICIVSAGGYENEDDDTDVLVYSGQGGNSRNTEERHDQKLERGNLALERSLHRKNVIRVVRGFKDPFCLTGKIYIYDGLYKIHESWKEKTRSGVNCFKYKLLREPGQRDGAALWKMTQRWIDNPATRGRVLLADLSSKAEALPVCVVNDVDHEKGPGEFTYTNQVKYSRPLSSMKKLQGCGCQSVCLPGDASCACGQHNGGDLPYSSLGLLSCRKPIIYECGESCNCSINGRNKVTQKGSRLHF

SEQ ID NO: 41661 - protein, 391 aa, Sorghum bicolor
  unsure (1)..(391): unsure at all Xaa locations
  Clone ID: SORBI-28MAY03-C5376_1.pep
MDSDYGVPRELSEVQKKRALYQPELPPCLQGTTVRVEYGDAAIAADPAGAHVISHVFPHTYGQPLAHFLRKTAVVPDAKVISEHLAVRVGIVFCGRQSPGGHNVVWGLYEAIKAHNQNSKLIGFLGGSDGLLAQRTLEITDEVLASYKNQGGYDMLGRTKDQIRTTEQVNGAMASCQALKLDALVIIGGVTSNTDAAQLAETFAEAKCATKVVGVPVTLNGDLKNQFVETTVGFDTICKVNAQLISNMCTDALSAEKYYYFIRLMGRKASHVALECALQSHPNMVILGEEVAASKLTIFDITKQICDAVQARAEKDKNHGVILIPEGLVESIPELYALLQEIHGLHGQGVSVENISSQLSPWASALXEFLPXFIRKQLLLHPESDDSAQLS

SEQ ID NO: 41662 - protein, 120 aa, Sorghum bicolor
  Clone ID: SORBI-28MAY03-C64208_1.pep
HGKVTPTTVPGAVVPAEQWIQDERELKRQRRKQSNRESARRSRLRKQAECEELAQRADVLKQENASLRDEVNRIRKEYEELLSKNNSLKEKLEGKQHKTDEAGLNNKLQHSGDDSQKKGN

SEQ ID NO: 41663 - protein, 129 aa, Sorghum bicolor
  Clone ID: SORBI-28MAY03-C5625_1.pep
ADPVGSILDGSRSGLRGSGSGWPTPAAPRRGLPWPNYESCLPCIHLILFFEPTSGLSKTHSILLEELKGICHMVNQNLKLRRQCLQAKKLYELAIRLEFGFLEVATYLICLLLKDGIDALVYWSCTGPS

SEQ ID NO: 41664 - protein, 249 aa, Sorghum bicolor
  Clone ID: SORBI-28MAY03-C56498_1.pep
MSADAAEAAMAAASLCDDLEPATARTRIRDVLAAGTARAGDRVVVGGSRRTGREQGKGSFAFLELSDGSCAATLQVIVDAAVHPLARLTATGTSVLVEGDIKEPPEGTKQNVELKVSRVLEVGEVDAAVYPLPKGKVKLTLEKLRDVVHLRSRTNTIGAVARIRHQLAYASHTFFDENGFLYVHTPIITTSDCEGAGEMFQVTTLFSQAEKTEKELRENPAPSDSEIEAAKFLVKERGDVVAQLKAAKA

SEQ ID NO: 41665 - protein, 249 aa, Sorghum bicolor
  Clone ID: SORBI-28MAY03-C56867_1.pep
MADSPTVDAVLHNAVIVTIDGALRVLRDGAVAVAGDRIAAVGPSADVLAAFPCAVQTLDLGGRIVLPGLVNTHVHTSQQLARGIADDVDLMTWLHGRIWPYESHMTEEDSYASTLLCGIELIRSGVTCFAEAGGQFVSEMARAVELLGLRACLTKSTMDCGDGLPPNWSCCSTDDCIQSQKELYEKHHNTADGRIRIWFGLRQIMNATDRLLLETRDVAQKLNTGIHMHIAEIPYENQLIVRTKGIDHG

SEQ ID NO: 41666 - protein, 164 aa, Sorghum bicolor
  Clone ID: SORBI-28MAY03-C56955_1.pep
MASAAVVDAGDAPEPTVRNLLDQDSLKWVFVGGKGGVGKTTCSSILSVLLAGVRQSVLVISTDPAHNLSDAFQQRFTKFPTLVRGFTNLYAMEIDPKVENDDLSNEGMEGFLSELTNAIPGVDEAMSFAEMLKLVQTMDYSVVVFDTAPTGHTLRLLQFPATLE

SEQ ID NO: 41667 - protein, 133 aa, Sorghum bicolor
  Clone ID: SORBI-28MAY03-C742_1.pep
MTLSLSTSFLPTPAAATARATTARTLRSVVPSQGMRCSMRKKGLHPEIYEDAKVYCNGELVLVTGGTKPEYTVDVWSGNHPYYVGDTSALVVMDSQIEKFRKKWGHVKEYWPEDQWREMHPDGDPEFEPEGDN

SEQ ID NO: 41668 - protein, 157 aa, Sorghum bicolor
  Clone ID: SORBI-28MAY03-C74306_1.pep
MDEHMGRRTVGGLLFTKGGSILLFREDGSRPKSKNCCSRHGCSGQHSADKAKGKEVHRAAAPNESTPATPGRSQIFRKPNRKPPHESSASGSISRDAGGSCSETGNRSRDTPGPGRDLLARLKERVNTSRKRSLNRENSPQSPSGFSAGSPSNSRSV

SEQ ID NO: 41669 - protein, 162 aa, Sorghum bicolor
  Clone ID: SORBI-28MAY03-C74240_1.pep
MSPAATKDDTRAAAATPVRELGAADSSSAASAGPGASDGLTDTELNGASVGASSGASVGDGVGASVGDGVGASVGDGVGATLGAGAGDTGAGAGAATGGAVGGRIGAARNGVGAVAGGNVAGGSAAGDMARGGAATGAGVVGAGAATATVGDETGGSVAGGV

SEQ ID NO: 41670 - protein, 191 aa, Sorghum bicolor
  Clone ID: SORBI-28MAY03-C74337_1.pep
GAEAACVGDAATVVVGGCAEACGAAAAVVGAATEACGAETAVVGGATEACGAAAAVVGAATEACGAETAVVGGATEACGAETAFVGGARKARGAEALTTGGALDADGEEAGDCAAQETMRSESSSGSRAIAIRPLPPPELVLLLVAGRLPLVFSVDRRRSFRSSLLLRCCPALCAVFPDLSSVECSRGGGK

SEQ ID NO: 41671 - protein, 129 aa, Sorghum bicolor
  Clone ID: SORBI-28MAY03-C7437_1.pep
MEEVTEGVNNLAITEPHKKNRIQVSNTKKPLFFYVNLAKRYMQQHEEVELSALGMAIATVVTVAEILKNNGLAVEKKIMTSTVDVKDDTRARPIQKAKIEIVLGKTDKFDELMAAADAEREAAEAEEQS

SEQ ID NO: 41672 - protein, 202 aa, Sorghum bicolor
  Clone ID: SORBI-28MAY03-C74462_1.pep
MAGFCTPAATAAAHATPTPLASSRKHIVMCLSPKPGGGGGSKRVRLASTGAAPQVRALAPATAAEEAAGPSPAPLNVDYLAAEFAGHGVSFEPVGSSCAVKMALRNGSVAHVLLPSGLVTSYKPAMWHGTVTEVLHTNVAEGPGGRAVIRGGVSVDLRCAGGDGGVWSPSASGAWSLRDVRGNPTTSIEIELASAAPGSAAA

SEQ ID NO: 41673 - protein, 242 aa, Sorghum bicolor
  Clone ID: SORBI-28MAY03-C5767_1.pep
VEMLGYCVDGNYRILAYEFATMGSLHDVLHGRKGVQGAQPGPVLDWMQRVKIAIEAAKGIEYLHEKVQPSIIHRDIRSSNVLLFEDFKAKIADFNLLNQAPDMAARLHSTRVLGTFGYHAPEYAMTGQLTQKSDVYSFGVVLLELLTGRKPVDHTMPRGQQSLVTWATPRLSEDKVKQCVDPRLKGEYPPKGVAKLAAVAALCVQYEAEFRPNMSIVVKALSPLLQQRPAPATAEPAPQPVS

SEQ ID NO: 41674 - protein, 287 aa, Sorghum bicolor
  Clone ID: SORBI-28MAY03-C57767_1.pep
MAHIHFRLISTLSTANLDICLTKAERGVELGPSVRDDLIVPVQRFQGSRLASGAVPVPYQQNGSHRNNKERNSRAPKVARVSTSGSSISAAIVEAENDLEAQERENKEELEAMLKDALREKSDIFNSDNPDEDKVKLGEPGWRERYYEEKFGARTPEQIEEIRRDVVLKYTEGLCWVMHYYYEGVCSWQWFYPYHYAPFASDLSGLGQLNIKFELGTPFKPFDQLMGVFPAASAHALPLQYRQLMTDPHSPIIDFYPIDFEVDMNGKRYSWQGIAKLPFIDEARLLA

SEQ ID NO: 41675 - protein, 357 aa, Sorghum bicolor
  unsure (1)..(357): unsure at all Xaa locations
  Clone ID: SORBI-28MAY03-C576_1.pep
MHSSQLRGSHSAVKETGWLPFHVVARDENGHIIGVVPLYLKXHSRGEFVFDQSWAEAYYNYGLEYYPKLQSCVPFTPVTGQRILLRNTSYRDQVFDALVPGLMSLTTKMNVSSLHITFPSEGEFSKLKNSGLLQRIGLQYHWRNRNYKSFDEFLMDLKQPKRKNIRQERKKIPAQNLQMKRLRGDEIKSSHWDAFYKFYRNTTDNHWGRPYLTRDFFHLLGEKMGENVMLIVAEKDDKLVAGALNLIGGDTLFGRLWGCLPDAYFPNLHFEACYYQAIEAAIELNLSNVEAGAQGEHKIQRGYLPVTTYSCHYFSNPGFAAAIGNFLTHETAHVKRAIKVLHDSGSYKEDILKEFAA

SEQ ID NO: 41676 - protein, 80 aa, Sorghum bicolor
  Clone ID: LIB3478-010-P1-K1-A6.pep
LVKGLMSLTTKMNVSSLHITFPSEGEFSKLKNSGLLQRIGLQYHWRNRNYKSFDEFLMDLKQPKRKNIRQERKKVYLLLA

SEQ ID NO: 41677 - protein, 392 aa, Sorghum bicolor
  unsure (1)..(392): unsure at all Xaa locations
  Clone ID: SORBI-28MAY03-C57803_1.pep
HEASPLMYAQNAIAVNEFLGHSWQKVVDSTQSNDTLRVEILKARGIFVDPNWYWIGVGALLGYIMLFNVLFVLFLDWLGPLGQGQAVVSEEELREKHVNRTGENVELLPLGTASQNSPSDGRGEIAGAETRKRGMVLPFMPLSITFDNVKYSVDMPQEMKDKGITEDRLLLLKGVSGAFRPGVLTALMGVSGAGKTTLMDVLAGRKTGGYIEGDISISGYPKKQETFARIAGYCEQNDIHSPHVTVYESLLYSAWLRLPHEVDSEARKMFVEEVMELVELTPLRGALVGLPGVNGLSTEQRKRLTIAVELVANPSIIFMDEPTSGLDARAAAIVMRTVRNTVDTGRTVACTIHQPSIDIFEAXDELFLMKRGGEEIYVGPLGRNSCHLIDYF

SEQ ID NO: 41678 - protein, 219 aa, Sorghum bicolor
  Clone ID: SORBI-28MAY03-C55771_1.pep
QDASRALELNPDQAKAYKVRGTARRYLGEYELAIKDLYQGNQIDFDEETDKLARSIKDRVDHLVSRRREKERNAQEAERRRKLAEYERRKKAAEERRKAEEEAQHTPGAPGGMPEMPGMGGMGGLPPELVQQLFSDPEVQAALEDPEIAPKLTEILQNPSAALKYLSDPKLAPLFRKFAPMFAGAGAQGPQGHAQGQPHQHHAGCSHSHSGGAEEFDLD

SEQ ID NO: 41679 - protein, 111 aa, Sorghum bicolor
  Clone ID: SORBI-28MAY03-C55992_1.pep
STDSNEHGLSDYEVSGEGLREAIKGGDVKGVKKLLTQGVDCNYCDKQGFTLLHLAALFNQTEIALILMDHGANVESKNGQGETPLDCAPTMLQYKMRQRMEELAASRRPLE

SEQ ID NO: 41680 - protein, 219 aa, Sorghum bicolor
  Clone ID: SORBI-28MAY03-C56053_1.pep
HEGGALLGSGSFGMVYEAITDEGVFFAVKEVSLFEGIHAKLCIFQLEQKYHLQDNHVSTYTRQILNGLTYLHERNIVHRDIKCANILVHANGSVKLADFGLAKELSKFSAAKSCKGTVYWMAPEVVNPKKTYGPAADIWSLGCTVLEMLTRQVPYPDMEWTQALFRIGKGEAPSIPSALSKDARDFISQCVKSNPEDRPSASELLKHPFLINRSMRSPI

SEQ ID NO: 41681 - protein, 110 aa, Sorghum bicolor
  Clone ID: SORBI-28MAY03-C56209_1.pep
TDGIMPAISRGLQGKALSDCSLLANLLHPKDMRSPQPTMPMEAAMRGCGKPLCTLEPRPPKSHRRAEAEPPESGTPHSIRRPRPLGRQRRAQKVARTKPGRQSIWRQGHV

SEQ ID NO: 41682 - protein, 92 aa, Sorghum bicolor
  Clone ID: SORBI-28MAY03-C56222_1.pep
MHDTDDEDLTGSRHKRRKGNRRRKRHRYDSDEDKLDELLELGSADGKNGVESQRGSWRLSTDGFSASWDIADIPDHLSTYYSTVWVKRACFR

SEQ ID NO: 41683 - protein, 107 aa, Sorghum bicolor
  Clone ID: SORBI-28MAY03-C56378_1.pep
LGANFHQMWCSDILDSAFEIFYTEESRGFKSLVAYAIGITITQCSCFSLIPSLFVVAFTFFLATHRLHLNPSSMSTWEDVSLTQKPLKDGQLRSFFKPRECIVSGTN

SEQ ID NO: 41684 - protein, 234 aa, Sorghum bicolor
  Clone ID: SORBI-28MAY03-C58520_1.pep
MNPYFVGILVPVAVSLLLRKRRKAERKRGVPVEVGGEPGYAVRARRFEQPVETHWEGVSTLAELFEQSCKEYVNMPLLGTRKLISRETEAAPGGRSFEKLHLGEYEWKCYAECFKSVCSFSSGLIRVGHEKNERVAIFAETRAEWQIALQACFRQNITVVTIYASLGEEALCHSLNETEVTTVVCGQKELKKLIDISGQLDTVKHVVYINEEGISAEVSLAQNCTSWKVESFEE

SEQ ID NO: 41685 - protein, 212 aa, Sorghum bicolor
  Clone ID: SORBI-28MAY03-C582_2.pep
MLPEDMGILCHGDQGERTVAELLFSKPYEIELCLLHNPPPAGSSMEWKVKKVQIPPDTKISTYSWMTDAVFPIGTCLCWVDNYQGMLAIDVLTDSNSNPDHQQCLRCIPLPKKALKSQRLYKDAGEPDPLRSVCVTDTGIIKLVCILTECPTFTIKAWTLDDIHEGRWTMDLSNTMGAEEFFRLLGTGHSCLPQVQPSFPLVSLVDPDVICF

SEQ ID NO: 41686 - protein, 142 aa, Sorghum bicolor
  unsure (1)..(142): unsure at all Xaa locations
  Clone ID: SORBI-28MAY03-C582_1.pep
VRXRVGGRVGGAGEFFCLLGTGHSCLPQVQPSFPLVSLVDPDVICFLLEDEDRGLFWMIDVNMKNKKLLSSALYISEEEEEDGYPPKRGRRNNFFGHCFIRSKFSSYLSENAITSRDLSEKVQKTKEDRVMQQKSRLEAQLE

SEQ ID NO: 41687 - protein, 260 aa, Sorghum bicolor
  Clone ID: SORBI-28MAY03-C5856_1.pep
MEAPPGPEPMELDAPPPAAAEAAAAVPPAGSDKKKEGEGGDAVTGHIISTTIGGKNGEPKRTISYMAERVVGTGSFGIVFQAKCLETGETFAIKKVLQDRRYKNRELQLMRAMEHPNVICLKHCFFSTTSRDELFLNLVMEFVPETLYRVLKHYSNANQRMPLIYVKLYMYQLFRGLAYIHNVPGVCHRDVKPQNVLVDPLTHQVKLCDFGSAKVLVPGEPNISYICSRYYRAPELIFGTTEYTTLIDIWSAGSVLSDAL

SEQ ID NO: 41688 - protein, 469 aa, Sorghum bicolor
  Clone ID: SORBI-28MAY03-C5853_1.pep
EPTPGNYYFEERYDLVRFIKTVQKAGLFVHLRIGPYICGEWNFGGFPVWLKYVPGISFRTDNEPFKTAMQGFTEKIVGMMKSEKLFASQGGPIILSQIENEYGPEGKELGAAGQAYINWAAKMAIGLGTGVPWVMCKEEDAPDPVINACNGFYCDAFSPNKPYKPTMWTEAWSGWFTEFGGTIRQRPVEDLAFAVARWVQKGGSFINYYMYHGGTNFGRTAGGPFITTSYDYDAPIDEYGLVREPKHSHLKELHRAVKLCEQALVSVDPAITTLGTMQEAHVFRSPSGCAAFLANYNSNSYAKVVFNNEQYSLPPWSISILPDCKNVVFNSATVGVQTSQMQMWGDGASSMMWERYDEEVDSLAAAPLLTTTGLLEQLNVTRDSSDYLWYITSVDISPSENFLQGGGKPLSLSVLSAGHALHVFVNGELQGSAYGTREDRRIKYNGNANLRAGTNKIALLSVACGLPNV

SEQ ID NO: 41689 - protein, 315 aa, Sorghum bicolor
  unsure (1)..(315): unsure at all Xaa locations
  Clone ID: SORBI-28MAY03-C5897_1.pep
MMADDPPRRPPSALARKSAPAQPWSHVETMHLIDAYEERWTALRRGQLKAHQWGEVRPRSSPAAPPHRGXAQRTTGTQCRHKLEKLRKRYRNEGARPVTSLWPYFRRMDRLERGPLAAYPAAAGSPPAPGGDEEDEEEEEEEEEEEDAQEEEEEEEELVPRNNHTRSINGIIREFGTGLAPRHPQLQLHAPPSSITPSTAPPRKRVAYEAFQAKAAAAAKAKDDDDEAVEMAYGGGSSGRGAGAQLSAVLRDFGEGVMRLERRRMEVQWEIERGWQEADARHARMLQDAQRQLRDTVAAACALPPKKARRDHGDS

SEQ ID NO: 41690 - protein, 377 aa, Sorghum bicolor
  Clone ID: SORBI-28MAY03-C58990_1.pep
ARGFLRKKLHRIKVGFFLHSPFPSSEIYRTLPVRDEILKSLLNADLIGFQTFDYARHFLSCCSRLLGLNYESKRGHMRVEYFGRTVSLKILAAGVHVGRLESMLKLPATINKVQEIESRYSGKLVILGVDDMDIFKGISLKLLGLELLLERTPKLRGKVVLVQIVNPARSIGKDVEEAKYEAVSVAQRINDKYGSANYKPVVLIDYSIPFYEKIAFYAASDCCIVNAVRDGMNLIPYEYTVCRQGNEDIDKLRGVNKSSSHTSTLIVSEFVGCSPSLSGAFRVNPWSMEDVADALYNATDLTQYEKNLRHEKHYRYVRSHDVAYWAHSFDQDLERACREQYSQRCWTTGFGLNFRIIALSPGFRRLSLEHLTSSYKK

SEQ ID NO: 41691 - protein, 170 aa, Sorghum bicolor
  Clone ID: SORBI-28MAY03-C57093_1.pep
ARGRVEGVYPVRPPLPAAIGGYEGVGQVHAVGPAVTAPLSPGDWVIPSPPSFGTWQTYIVKDENVWHKVRSDVPMEYAATITVNPSTAFRMLQDFVKLNPGDSIVQNGATSIVGQCVIQLAKVHGIHTINIIRDRPGSEEAKNKLKQLGADEVFTESQLDMKKCQSLLGA

SEQ ID NO: 41692 - protein, 127 aa, Sorghum bicolor
  Clone ID: SORBI-28MAY03-C57001_1.pep
NTNTRTCTSRALRYISLSYGVANRLKKEQEDVREKGEELSVKLRRVVAGVQIPAHQHAPAFLACPGGMVAEPAPQWSTPPPPNLQPARFPTHRGGGFGQSELLHLGKMKSRGGRWMRQREGVPVLAV

SEQ ID NO: 41693 - protein, 218 aa, Sorghum bicolor
  Clone ID: SORBI-28MAY03-C57096_1.pep
MPSTAVGWRRPGPIVLLGSPCRVVGKAGVTLQILVAGARPTFLRLLPRTPADYRPDIIHQALLAIFDSPLTKAARLLALDGCTQKGVLFEIKPHVRMPRTFKRFCGLMSQLLQKLSITAVGKREKLLNVVKNPVTRYLPVGARKIGLSFSAEKSVNLFDYVAKSSDDEPLVFVVGAMAHGKIDKEYTDDYIQICNYPLSAACCLNRICSALEQKWNIQ

SEQ ID NO: 41694 - protein, 167 aa, Sorghum bicolor
  Clone ID: SORBI-28MAY03-C57218_1.pep
VLREAPGVVMPVVWSPLALVGALLTLSNNVMQLAESAKAKRYRKNCHLLQDRVRLIANHLRELQQGTSESDPSPATQDTMKCLEDVLRRAQELVQSCQRKKRAFDFLRAHKKTGEFAFVGKRISNIMESFHMANRSLIQGLYSDRIFMVLLKTLLQDHDGIRVLQNN

SEQ ID NO: 41695 - protein, 292 aa, Sorghum bicolor
  Clone ID: SORBI-28MAY03-C57283_1.pep
HEGCFCSFPADVKPRPFDRSDVYQQMQVQQHREGFRTAAVAVDGIPPDYLLNKGWTVVAMAKPKYHELADDARGVDSGLRDRMPDLDSLGGDPPPPSAVVVVGRWYVPFLFVKVDGDRRLRDQVRKSMFYKMTMEQSWEQIYSRENTADLHGARAAEIAVTATVRRFTALLGGGTTVVQAGEPQANDDGAMWFRPAAARTTGGGVALDMVLWERMRWEVERGGRRWVAATGNGGNEERIQRTERRDDDSSIGHWTKFGCYLLVERFVLRRMDGTVALTCEFRHTDKIRARWV

SEQ ID NO: 41696 - protein, 177 aa, Sorghum bicolor
  Clone ID: SORBI-28MAY03-C5754_1.pep
MSAAHLLRHSRKLRSLQNAVGCENFSLVRHFSSGSGSVIAKENGVGKRTRGTRFSQHNQPAKELETFSLGVNGSCTWRRASNSLTPSAASRLNGSFSCGQVVSARPFSSSADLPPHQEIGMPSLSPTMTEGNIAKWLKKEGDKVSPGEVLCEVETDKATVEMECMEEGYLAKIVQGD

SEQ ID NO: 41697 - protein, 159 aa, Sorghum bicolor
  Clone ID: SORBI-28MAY03-C5940_1.pep
MFGRTKTEPPIYYMPTKPIIDDPAIVEQNKEVAFEEWKSMRRAELTQFQKQVEEQYLSNVERQLEKIQNARNARKANGPANMQEMDKELDTHRAEHGPKTRRVPEEGGNDDDEDAEDMAAEDELMDEVLGINDGINEDPSKPSEEATTEGGGPAPEEAQ

SEQ ID NO: 41698 - protein, 384 aa, Sorghum bicolor
  Clone ID: SORBI-28MAY03-C59492_1.pep
HEGFQGEQGEEGRIRLSACCKHYTAYDMEKWEGFSRYTFNAKVNAQDLEDTYQPPFKTCIQEARASCLMCAYNQVNGVPMCANQDLLQKTRDEWGFQGYITSDCDAVAIIHENQTYTKSDEDSIAIVLKAGMDINCGSFLVRHTKSAVEKGKVQEQDIDRALFNLFSVQLRLGIFDKPNNNQWSTQLGPNNVCTKEHRELAAEAVRQGAVLLKNDHSFLPLKRSEVRHVAIIGPSANDVYAMGGDYTGVACNPTTFLKGIQAYATQTTFAAGCKDVSCNSTELFGEAIAAAKRADIVVVVAGLNLTEEREDFDRVSLLLPGKQMSLIHAVASVAKKPLVLVLLGGGPVDVSFAKQDPRIASILWLGYPGEVGGQVLPGILFGEY

SEQ ID NO: 41699 - protein, 221 aa, Sorghum bicolor
  unsure (1)..(221): unsure at all Xaa locations
  Clone ID: SORBI-28MAY03-C5956_1.pep
MSADDLRSELDELRRLEGLAKHPRVQTLLANEIRNVEAKLAKATEPSPEPLAAASAPAPAPAPAARPVLNYVTLGSFSWDQDNEKIKIYVSLEGVEQEKVETTFKPTSVDVKFHDVKGKNYRCAIPKLNKEIVPEKCKVVVKPTKVIITLFKASKGNWLDLHFKEDKFKPSMDKEXDPMSGIMDLMKNMYEEGDEDMKRTIAKAWSDARSGKTTDSLSGLR

SEQ ID NO: 41700 - protein, 324 aa, Sorghum bicolor
  Clone ID: SORBI-28MAY03-C59595_1.pep
EKVVKDLRRNESEEDFRCSQTAPVRAIKHSTVLKQAAESYTHRIYKLFEAEFLDGCGATSCHETSSGGNLLRFGITMQGRGSKVWDVVLDTSTMEISCGCRKFERMGLLCSHALKVFTLQNVDTIPEKYVLKRWTKDARRSMYTLAQDDSTQQECTEAELAYRNRAMQYAYNLIIKSQELEESRKIFWDSLEAGEKALEVFFEMRNMRTQAAKDANKNEKKKKKTSKGPNPKKAKQAPGVSSTEHEVIVQTNEHQFQSSQDAQGNATIGRPYYYQVPQTFPNAPIQPNQMYMHPNMHTVPLCTPQDLSAFAIRPNSTFGGAKNI

SEQ ID NO: 41701 - protein, 231 aa, Sorghum bicolor
  unsure (1)..(231): unsure at all Xaa locations
  Clone ID: SORBI-28MAY03-C5977_1.pep
MRARRMRLAAVARTTRMAAEEMRRASASAAVAATAEAAPAPAQAGSRWARVWPSALRWIPTSTDRIIAAEKRLLSIVKTGYVQEQVNIGSAPPGSKVRWFRSASDEPRFINTVTFDGKENAPTLVMVHGYGASQGFFFRNFDALASRFRVIAIDQLGWGGSSRPDFTCKSTEETEAWFIDSFEEWRKAKNLSNFILLGHSFGGYVAARXALIDPLHRQHLSWPDFTCKSSE

SEQ ID NO: 41702 - protein, 192 aa, Sorghum bicolor
  unsure (1)..(192): unsure at all Xaa locations
  Clone ID: SORBI-28MAY03-C5781_1.pep
QLSAQNTVILFEALHTVAAHCLQINRGSGLRSXLQELGSMTQMQDPPLLRLENESYQLCLSILQNIFLDISPDHGSTEVVESHLIGLCKEVLEVYLSTAKPSQLSSGTQPLGHWLIPVGSSKRRELAARAPLVVSTLQAISGLGDSAFEKNLGQFFPLLSGLISCEHGSSEVQVALSDMFSTWVGPLVLQSC

SEQ ID NO: 41703 - protein, 225 aa, Sorghum bicolor
  Clone ID: SORBI-28MAY03-C57897_1.pep
MELLDARHRHTPDSARGPDAASDMGLPLAGAAYQPYVSELLSFSIERLHKEPELLRVDAERVRRQMQEVAVENYGAFIAASEALSFVRAQLESFDGHLEAMIEEIPNLTSGCTEFVESAQQILEERKLNQTLLANHTTLLDLLEIPQLMDTCIRNGNYDEALDLEAFVSKISKLHPDLPVVQGLAAEVKKTVQSLISQLLQKLRSNIQLPECLRIVAHLRRIGVF

SEQ ID NO: 41704 - protein, 338 aa, Sorghum bicolor
  Clone ID: SORBI-28MAY03-C58_1.pep
RITNPPQTVKGTRLIAAAASAVAPPPPRRVVAPLRSLSTRRPGILALTVTCCSPSPPPPVVAAEAPAPAPPQEAKPKPKPRRYPKQYPGESVGVAEEMRFVAMRLRNPKRTTIKDKAGTENADAGASEDEDEEEEEEEQEEEDGGGGVKEEHEKEEEGELEAGEWMPSMEGFVRYLVDSKLVFGTIERVVAESTDVAYVYFRKSGLERSASISKDLEWFRKQGIAIPEPSTSGSTYAAYLTELAESNAPAFLSHYYNIYFAHITGGVAIGNKICKKILEGRELEFYKWDTDAELLLKDAREKLNELSKHWTRKDRNLCLKEAAKCFQYLGKMVRLIIL

SEQ ID NO: 41705 - protein, 225 aa, Sorghum bicolor
  Clone ID: SORBI-28MAY03-C58244_1.pep
MGIAEVALHTMPGARATHSPASILSLRAVARRRNKNTDSVPNTRALQGLLRIPRLRSVRRLCQRIDDIARVTEGNGTWVKEAMNNAGQVLGDISVPGQAVGGNGSLNGSVAKPPPQRRKSSSVEDEAWELLQESMVYYCGSPVGTIAANDPNDSDPVNYDQVFIRDFIPSGIAFLLKGEYEIVRNFILHTLQLQSWEKTMDCHSPGQGLMPASFKVRTIPLDGDE

SEQ ID NO: 41706 - protein, 389 aa, Sorghum bicolor
  Clone ID: SORBI-28MAY03-C58442_1.pep
ARGARDLETGKIVALKKVRFDNFEPESVRFMAREIQILRRLDHLNVMKLEGLITSRLSCSLYLVFEYMEHDLAGLCSSPDIKFTEAQLKCYMNQLLSGLEHCHSRRVVHRDIKGANLLVNNEGVLKIADFGLANFFDPSKNHPLTSRVVTLWYRPPELLLGSTHYDAAVDLWSVGCVFAEMYRGKPILQGRTEVEQLHKIFKLCGPPADDYWKKSKLPHATIFKPHHPYPSTLGEVFKVVPENALSLLETLLSVEPYKRGTASGALSSEFFRTKPYACEPSSLPKYAPNKEMDAKLREDALRRKASSRGHGTEASKKSSRLSRAAREPIAVPKQIISSTEESKTNVNATKDGTIQDRTKLNGDARLFADIQPVSAAQVKESARHVKNES

SEQ ID NO: 41707 - protein, 215 aa, Sorghum bicolor
  Clone ID: SORBI-28MAY03-C5823_1.pep
MVAVAAEVPIRGADAVPAAEREAVRAAAAEAAAKGGEGESGTQPLRHLPRLLRRLLVLPPTAPPPPPRFPPPPRPPVPLRLRRLSGDAPVFVSPAIDYYARHHQLPPPPLQQQQPMHVLQFVGGVGGGGMGGGGGRDSSSDGSVNGQPNRRRRNGFIQGRRRMMGGRPRRSDREDSVRRTVYVSDIDQHVTEQKLAEVFSTCGQVVDCRICDDPN

SEQ ID NO: 41708 - protein, 115 aa, Sorghum bicolor
  Clone ID: LIB3476-011-P1-K1-C2.pep
WPRPLKSPTPQSPTTDGPRQSHQTSSPSHRAIELLHGLTNPSTGASAGGRAHRAFFSFFRTPAVNGQPNRRRRNGFIQGRRRMMGGRPRRSDREDSVRRTVYVSDIDQHVTEQKG

SEQ ID NO: 41709 - protein, 179 aa, Sorghum bicolor
  Clone ID: SORBI-28MAY03-C56319_1.pep
DGKVRFAEGSVVAADIILYCTGYRYHFPFLDLDGLTVDDNRVGPLYKHVFPPKYAPNLSFVGLAYKTIVFQTLEQESKWVAAVLSGRATLPSEEDMMAAVREHYQLMEEAGRPKRHTHTLSPQWAEHMNWLAGQVGEPPLEPWKREMFDRVLGSILTLDEAYRDRWEQEEDRDSGTGAH

SEQ ID NO: 41710 - protein, 197 aa, Sorghum bicolor
  unsure (1)..(197): unsure at all Xaa locations
  Clone ID: SORBI-28MAY03-C60878_1.pep
LLFKAAGLASRRGARAAAGAAAGGRRWRRTRRGPRRPSRSCPWRRASXRARPPARPSAPRPRQRPLPAAQGGGRGACARGARRGAACRRGRTRRPARQRTPSRRGWRSARRVGLELGPRAPGTTARWGARRRRGSGAPMEEPGRGPWTTARLRRSGCGGGGGGALGEGAGARRGRGGAGAGRGRGRRRRPLCCAARG

SEQ ID NO: 41711 - protein, 147 aa, Sorghum bicolor
  unsure (1)..(147): unsure at all Xaa locations
  Clone ID: SORBI-28MAY03-C61351_1.pep
KGXDTSVXEDQIRSALEEHFRSCGDITRISIPKDYDTGASKGMAYMDFKDPDSLNKAYEMNGTYLGDYSLYVDEAKPRPDNNRDGGFSGGRGSRGRSDRGRGDRGRGRGFGGRGGRGDRGRGGRGTPFRQTAGTPSAGKKTTFGDDD

SEQ ID NO: 41712 - protein, 119 aa, Sorghum bicolor
  Clone ID: SORBI-28MAY03-C61383_1.pep
NSTGNKPDLIVLSTGSELEIAAKAADELRKEGKTIRVVSFVSWELFEEQSDEYKESVLPEAVTARISIEAGSTLGWQKYIGAQGKAIGIDKFGASAPAGKIYKEYGITVEGVIAAAKSF

SEQ ID NO: 41713 - protein, 119 aa, Sorghum bicolor
  Clone ID: SORBI-28MAY03-C61683_1.pep
ACKKHNHYYKVYINVVIYSIFVWLNYLVFHMLMLPNYFHSEFSLMLMFNVLHSPKWEVLLRRPFSMKISPKASPTGQKMLGGVIEWQQQVSVTIHLLVREFKCQIRHRENQQWNKELQG

SEQ ID NO: 41714 - protein, 318 aa, Sorghum bicolor
  Clone ID: SORBI-28MAY03-C5902_1.pep
MESLASQARPAAVLWLAGFFQAARLHRVVSFCASSRALSIRIAQCFLLNGLIFLGSLLTLKSVVIPTLLWILPDQCNQTGGHLCEHTAAISIYSFLRSGLVEIFYVLWFYPLYVFSFILSTIWYNDIAKHALDVVKSKRLVLTRALDDHNTTETEEQPEGFDRVALGIGEQVYSILLLTIFFVEVSVIGYIPYFGKAMNFLLLSLMYAYYCFEYKWNFFAVSLHERLDFCESNWAFFAGFGAPCVLPIFFFSPLTSYGFLAILYPLFVMTAAGTQAEQVIDGLRPAHEGKLQRIPVFFVAKRLTTKVLQLFPLAQKEQ

SEQ ID NO: 41715 - protein, 312 aa, Sorghum bicolor
  Clone ID: SORBI-28MAY03-C59107_1.pep
HEERVMQELSQIGLMPEMWGGDTPMIQISALTGDNVDELLETARLVAELQELKANPHRNAKGTVIEACLDKAKGPLATLVVQNGTLNKADIIVCGEAYGKIRALYDDRGKLVDKAGPSNAVQVIGLNNVPLAGDEFEVVDNLDVARERANERAEALRLERISAKAGEGKVTLSSIAASVSSAKQTGIDTHELNVILKVDFQGTIEAIRQAIQALPQENVSLRFLLQAPGDVSVSDVDLAVASEGIIFGFNVRAPGSVKNYAKKRSVEIRLYKVIYDLIDDLRNAMEGLLEPAEEEVPIGSAKVRAVFSSGSG

SEQ ID NO: 41716 - protein, 253 aa, Sorghum bicolor
  Clone ID: SORBI-28MAY03-C592_1.pep
MAVVTSTASLCPAAAGGLSASSSSPFTRKPSSTRRLQAASTACHCRPARVVEGLDRRDALLGIVLSAAVAPLLAPAGALADEPTTESQEGFTTYEDEANKFSIQVPQGWLVGAGEASGIRSVTAFYPEQAAADSNVSVAITGIGPDFTSLKSFGDVDSFAEGLVNGLDRSWQRPPGLAAELIDSRAANGLYYLEYTLQNPGERRRHIVSAIGMAFNGWYNRLYTVTGQYIDDDDDSEKYRPQIEKAVRSFRLT

SEQ ID NO: 41717 - protein, 405 aa, Sorghum bicolor
  Clone ID: SORBI-28MAY03-C5932_1.pep
IFAHILIWHLQGEYVDESEKDAEALKGSAFQSLLPAVKDKIIESFTPEARDMFEREFDFFDKVTSISGVLFPLPKDERRAGIRRELEKISIPGDDLYLPTATNKLVRGIQLDSGIPLQSAAKVPIMITFNVVARGGDPNDVKPQACIFKVGDDCRQDVLALQVIALLRDVFQAVGLNLYLFPYGVLPTGPGRGIIEVVPDTRSRNQMGETTDGGLLEIFQQDYGPVGSPSFETAREMFMISSAGYAVASLLLQPKDRHNGNLLFDSHGRLVHIDFGFILEISPGGNMGFESAHFKLSHEMTQLLDPSGTMKSDTWNQFLRLCVKGYLAARRHMNGILSTVNLMIDSGLPCFSRGDPINNLRKRFHPEMNEREAANFMIRTCADAYNKWTTAGYDLIQYLQQGIEK

SEQ ID NO: 41718 - protein, 166 aa, Sorghum bicolor
  Clone ID: SORBI-28MAY03-C59327_1.pep
MAGRAPATARDKTSFAATCSLLSQYLKEKKDGGLQRLGGLAMAPAAGAGAGGFRPPTTMNLLSALDAPAEEPTSDAAKATVEEPKDHHKSTAGNPREAAGDEAQQLTIFYGGKVVVFDKFPSTKVKDLLQIMNPGGDRVDRAGATATVPTQSLPTPSHNSLSDLPI

SEQ ID NO: 41719 - protein, 89 aa, Sorghum bicolor
  Clone ID: SORBI-28MAY03-C62437_1.pep
PHPTSSDASYYYPNNMPAAPLGPGLPVGMGFPPAYGAQPVMYNTQPGASPQGYMHPAGPQYGQQMMMGGQTRPVYYYAPEMQQYRGRNF

SEQ ID NO: 41720 - protein, 105 aa, Sorghum bicolor
  Clone ID: SORBI-28MAY03-C62473_1.pep
TSVASTTGQQRCNIFLPSPCLHFCCFPSLFWLMGLPMTRASQLQSNILKYMCRLALIMKMQRYCPEEWWIQEQQKHPTSIHSYIYEMTTMEAESTPHVPCARSWG

SEQ ID NO: 41721 - protein, 224 aa, Sorghum bicolor
  Clone ID: SORBI-28MAY03-C6265_1.pep
TGKKLPWTSSKRPDHRRLLAMATLAALLLLVAASNAAALSAKAVEYHSFVATPLSPHAYTAAPSADADEDLFGGSLAVADEGAAAASAVHFRVVHRDAFAANATAAELLRHRLQRDKRRAARISKAAAGGGAGAANGTRSRGGAVAAPVVSGLAQGSGEYFTKIGVGTPSTPALMVLDTGSDVVWLQCAPCRRCYDQSGPVFDPRRSSSYGAVDCAAPLCRRLD

SEQ ID NO: 41722 - protein, 149 aa, Sorghum bicolor
  Clone ID: SORBI-28MAY03-C62688_1.pep
DLVAEMPLKICYPALENQEWKIITGSDPKNTPWSYHNGGSWPTLLWQLTVACIKMNRPELAAKAIEVAERRIATDKWPEYYDTKRARFIGKQARLYQTWSIAGFLVAKLLIEKPDAARILWNDEDAEILNALSTNRKRGKKVLKKTYIV

SEQ ID NO: 41723 - protein, 181 aa, Sorghum bicolor
  Clone ID: SORBI-28MAY03-C62780_1.pep
EGILSSLSAVLSTIIGVHYGHVLVHMKSHTDRLRQWVTMGICLLVLGIILHFSHAIPLNKQLYTFSYICVTAGAAGVVFSVLYFLVDIVSLRYVFAPLQWIGMNAMLVYVMAAEGIFEGFLNGWYYEGTNNTLVYWVRKHVFVKVWHSTRVGILLYVLFAQILFWSLVSGVLHRAGLYWKL

SEQ ID NO: 41724 - protein, 416 aa, Sorghum bicolor
  Clone ID: SORBI-28MAY03-C6029_1.pep
ARGPAAVRDPLLSNTKETVRGQGTTLYREGSRPTGIWLVSIGVVKWTSQRLSRRHCLDPILSHGSTLGLYEVLIGKPYICDMTTDSVAHCFFIETEKIEELRHSDPSIEVFLWQESALVLARLLLPRIFEKMGMHEMRVLIAERSTMNIYIKGEDLEVEENCIGILLEGFLKTDNLTLITPPAVLLPSDADLGLESSDYCHTAPRYQVEARARIIFLEEAEAHLHRSASRLLLPQGQGGGHEPTRSMSKEHSGLLSWPESFRRSRGNLGLAAEMLPGGLSSRALQLSMYGSMVILSSGQGHSHRRQGRHRVQATTTDQKQSSSYPRMPSISKERPLLSVQSEGSNMKRVAALPLRDDAAEVEAPAAQQRRRRRKAMHLQEDNSSDDSAGEEVIVRVDSPSMLSFRQSAAAPPPQDQ

SEQ ID NO: 41725 - protein, 345 aa, Sorghum bicolor
  Clone ID: SORBI-28MAY03-C60358_1.pep
HEDFSLSPSSGSSRPARRPPPPPPPAPRRRPPLPVAGAPPPDPSAALPVPRRSSGSPAVVRARPRARAAPRLRVTAATARLPPPPAARPPRSRGHRFPASRPLPPGRRLRLLHRLGLTARRGVSAGPAGREPPGGPLGGLPGCAVRLPYFGRPGVPRGAGTAAAGGLVLGRLPGRLRRLGDPHTHFPAVHIAGTKGKGSTAAFLSNIMRAQGYNVGCYSSPHLLTIRERISVGNDGGPVPVGLLSDLFDEAKEAIDEAIESENGSLTHFEVFTALSFLLFSQENVDIAIIEAGLGGARDATNVIRSTELAASVITTVGREHLAALGGSLQSIAIAKSGIIKQGRP

SEQ ID NO: 41726 - protein, 134 aa, Sorghum bicolor
  Clone ID: SORBI-28MAY03-C60_2.pep
MAAKMFALFALLALCASATSATHIPGHLPLVMPLGTMNPCTQYCMMQQRFARLLAWPIPMLQQLSLQPAYQTPMTMPNMMPPMTMMPSMMSLPQCHCDAISQIMQQQQLPFMFNPTAMAIPPMFLQQPFVSSAF

SEQ ID NO: 41727 - protein, 147 aa, Sorghum bicolor
  Clone ID: SORBI-28MAY03-C60_1.pep
MAAKMFALFALLALCASATSATHIPGHLPLVMPLGTMNPCTQYCMMQQRFARLLAWPIPMLQQLLALPLQPAYQTPMMMPNMMPPMMMRPTMMPPMTMMPSMMSLPQCHCDAISQIMQQQQLPFMFNPTAMAIPPMFLQQPFVSSAF

SEQ ID NO: 41728 - protein, 294 aa, Sorghum bicolor
  Clone ID: SORBI-28MAY03-C60383_1.pep
MSNATAKLDFDLNEGIPGDDGHQSEPTISPVVCSSAIHLTGHLPFTSPITSGLQPAPITVAAPAKGPFVPPENLLRAKPEIGWKGSAATSAFRPAEPRKILEMPTATRDIPVSHAAGKQSRPTLGFDLNVADDQALEEDIPQSSAQTTCSESGNTRSRDGSSRSAGIELDLNRVDEVADNGQFVPNASHRVEVPLLSTRSLPGVFSNAGTNSSRDFDLNSGPGLDDVGTEPAPKPSKNTSSIQFLQQLPVRMNSAAISNISPWLAAASPCGPVAIQSFLPSREQPYPIEAAPGA

SEQ ID NO: 41729 - protein, 242 aa, Sorghum bicolor
  Clone ID: SORBI-28MAY03-C60611_1.pep
HEVHNYFRIGGVAADLPYGWMDKCLDFCDYFLQGVVEYQQLITRNPIFLERVEGVGFISGEEAVNWGLSGPMLRASGIQWDLRKIDPYESYNQFDWKVQWQKEGDSLARYLVRVGEMRESIKIIQQAVEKIPGGPYENLEARRFKKAKNPEWNDFEYRFLGKKPSPNFELSKQELYVRVEAPKGELGIYLVGDDSLFPWRWKIRPPGFINLQILPQLVKKMKLADIMTILGSIDIIMGEVDR

SEQ ID NO: 41730 - protein, 146 aa, Sorghum bicolor
  Clone ID: SORBI-28MAY03-C6052_1.pep
MEFPHHHHHHGHRRDDDEDDRRGPPPPAYGGYGQPPPPDPYGRAPVDPDPYGRPPPQSAYGGGGGYGNVVHVGHEPGDGRPHYGGGGLVRPRDTPAPRGRGRGAAPVRQQTYRIYCKAGDDQYSLAGRDGKVCLVRTERNDDTQHW

SEQ ID NO: 41731 - protein, 100 aa, Sorghum bicolor
  Clone ID: SORBI-28MAY03-C6352_1.pep
VGTRRAEEVVDPDMELKPAIRALKRALLVALRCVDPDAEKRPTMGQVVRMLEAEDVPSREDRRSRRGHSNNADSESKASSSEFEISSDRRELGPSSRFQP

SEQ ID NO: 41732 - protein, 82 aa, Sorghum bicolor
  Clone ID: SORBI-28MAY03-C6363_1.pep
MALSSRRMAAAPFLVLVLLLVATELGTTPVAEARHCLSQSHRFKGLCMSSTNCANVCQTENFPGGECKAEGATRKCFCKKIC

SEQ ID NO: 41733 - protein, 188 aa, Sorghum bicolor
  Clone ID: SORBI-28MAY03-C6359_1.pep
MVEDRSPKPIHCKAAVCRAAGEPLTVEEIVVDPPKAYEIRIRVICTSLCHTDVTFWKAKVAPVFPRILGHEAYGVVESVGEHVEGFAAGDTVVPTFLGQCSQCGSCTSEHSNMCDSVPFVIGPGMRRDGTTRFRDAQGSPLHDLLAVSSFAEYTVVDVNQVVKLDPAVPPKLACLLSCGAGTGVGAAW

SEQ ID NO: 41734 - protein, 148 aa, Sorghum bicolor
  Clone ID: SORBI-28MAY03-C63749_1.pep
SLPKRKMPNDQVEIVHGWCSARRSFRLRERIIYRRLLSLLLYYYLLVTKLGIILVVILIGHEHIRKVSRSAVRWRDCLLLEMNMLAAVSLVRDRRHMLQRMARCCLARYVEERCVVHVPVHFIVLSLSWILPLVEGLYVQWKMFIWSI

SEQ ID NO: 41735 - protein, 97 aa, Sorghum bicolor
  Clone ID: SORBI-28MAY03-C63835_1.pep
DVESLLNSYKQLVLRYVALAQGMGVSPETTLARSGQTSDLVVSEDPDNLNSVVNDNEKKVDDVISENHHSEAVDTEASEQMTQKTAVDSSDDLKVSA

SEQ ID NO: 41736 - protein, 163 aa, Sorghum bicolor
  Clone ID: SORBI-28MAY03-C61908_1.pep
FTNIAHSVSRGLSEQDVEVLRGIAGCGEDIGRDEFDRLWYWLYPVAVSLSRENIKKLWDCTTPRWIEGLITIEEAENALRSSRELLKEPGTFVLRFPTTRSWPHPDAGCLVVTYIGSDNSIHHRLLSLDSSDASAENLQDLLLQEPELSQLGRVDRLPTAIRR

SEQ ID NO: 41737 - protein, 220 aa, Sorghum bicolor
  unsure (1)..(220): unsure at all Xaa locations
  Clone ID: SORBI-28MAY03-C61978_1.pep
VQHDEKSQRGGHVGVGDGDGDRRETKTRPPRPGPAPPAPPSSRAVSVQARRRVSLRFPTARVHPPRVLGTLVVVVPPRPPPPRLPPPGPATRRDRDQPARTPPNCNSSHTPAGSWAPHSTASLPVKPRRRRTHAGSAGAGPXGAGVNAGAARPRAQPAGPGAAPAAPGWARPPPSLAPSAPAPSPRAPRPAGPAGGPPRPPPPRPRPPRRRAPPATSEGL

SEQ ID NO: 41738 - protein, 144 aa, Sorghum bicolor
  Clone ID: SORBI-28MAY03-C62033_1.pep
CLELYKVIAGEHPIEDYRNTFANLALPLFSMAEPVPAKVMKHQDLSWTVWDRWTIKGNLTVAELLQWFSDKGLSAYSMSCGTSLLYNSMFARHKDRLQKKVVDVAREVAKVEVPEYRKHIDVVVACEDDDGNDIDIPLVSVYFR

SEQ ID NO: 41739 - protein, 336 aa, Sorghum bicolor
  Clone ID: SORBI-28MAY03-C62_1.pep
EFGTRSLPCLQQQWSLPRFAAAATSRRAIGVCYGVIGSGLPSKSDVVQLYKSNGITSMRFYFADKDLLTALRGSGISLALDVGNDKVGELASDSAAAASWVRDNVQAYYPDVDIRYVVVGNEVPGAASVLQAMQNVHAALASAGLAGNVRVSTAVKMDAIENSSPPSSGVFKDPAAMSPIVQFLAGNGAPLLANVYPYFAYEYSDGIDLNYALFQPSSTTVTDPANGLVYTNLFDAMVDAVRAALDKAGGGGGVDVVVSESGWPSADGKGATVDNARTYNQNLINHAGKGTPRKPGSMEVYVFAMFNENQKDSDPTEKKFGLFNPDKTPVYPINFA

SEQ ID NO: 41740 - protein, 186 aa, Sorghum bicolor
  Clone ID: SORBI-28MAY03-C62167_1.pep
RLPNYINNRCVLRNLLQVPVIKEDSLKDRMEDQRKGNYVITSEELEDIMEEAMHIMWEFIKADRVEATTTTSVLKGLSSTHVELQDPMDHDLMAHIHSTLQKKEKRLKDLLRTGNCIVKKFKKPKEDRSNQNLFFSQVDMKLVARVLRMPRITSEQLQWCKAKLDKIILVDHRKIHREASFLLFPC

SEQ ID NO: 41741 - protein, 123 aa, Sorghum bicolor
  Clone ID: SORBI-28MAY03-C62393_1.pep
RAPPGFTRFCNPSRCRGSPGLCPGPTEGSCSTLLPRCRATTSVRLPTYVGVAPVGSPAFQLSPSLYVVELKKSHGDPALYRQLCERICSDLGVLKMDQIFGTRSTADDLACLARRSATPLVAL

SEQ ID NO: 41742 - protein, 390 aa, Sorghum bicolor
  Clone ID: SORBI-28MAY03-C6435_1.pep
HEEKEKAEAHMFTALKVARDSDFKEQIGRHMHFDLVDFDKVNSFRAPKNAPGNDVKEELSKEFGIPVESQRFWVWAKRQNFTYRPSRPLTFLEETSAIGYLKDAIVAKLPNSEVRLFLEVHLGQENQGIASGKTKEDILIFFKLYDPEKEDLRYVGNFFVKASGKPSDIVERLNEIAGFPSDEDIELYEEVKFEPAVMCVPIESNISFRSSQIDNGDIICYQKRCLPDSMDRYRYPSVPSFFEYIHNRQVVYFRLLDKPKEEGFSLELSKRSTYDDVVEKVARQLRLDDPSKIRLTQHNLSSQQPKPHHIKYRSLNYLSDMLHNHNQMCNILYYDVLDIPLPELESTRSLKITFENATNHEMSFHTMRLPKSNTLLDLIEDLKSKVELSC

SEQ ID NO: 41743 - protein, 128 aa, Sorghum bicolor
  unsure (1)..(128): unsure at all Xaa locations
  Clone ID: SORBI-28MAY03-C6461_1.pep
DEGAENELXFQEWTQQVQEMLNTKKFGGIAFRDKDFKTAIDYYSKLVAMMSTPSATVFARRSFSYLMNGQAELALRDAMQAQVCMPEWPTAFYLQALALSKLGMETDAQDMLNDGATFEAKKQNGWRS

SEQ ID NO: 41744 - protein, 165 aa, Sorghum bicolor
  Clone ID: SORBI-28MAY03-C647_1.pep
ARGDICVSRAFGDIRFKTRKNEMLVKGVKEGRWTDKFISRIKFKDDLIISSPDVSLVELGPDVEFVLLATDGLWDYIKSSEAVAFVRDQLRQHGDVQLACEALGQKALDQRSKDNISIVIADLGRTNWKALPDERPNMFLELSQAVATVGVVSIGIWFSSFLGLQ

SEQ ID NO: 41745 - protein, 160 aa, Sorghum bicolor
  Clone ID: SORBI-28MAY03-C64771_1.pep
GANNDKHAVERPLKRSKKRRVSFRDQVGGELIQVVGISDGADVGTEPGPVGVKEGSLVGKYESLVQVTVIPKGKEQASPKEYTSTSTSGVTDKLQEVLKKVKSTTKPGIYDDLYGDSVPAKVGSSWAYKSDDLSDKAQPVEEKTHSMNSADDSDDLFGDS

SEQ ID NO: 41746 - protein, 121 aa, Sorghum bicolor
  Clone ID: SORBI-28MAY03-C62993_1.pep
GYATTDASGAAFCRSAALILMALLLLRHALSISDNEGNDDDASTMFSLFLLRAAGFLLPCYIMAWIFSILHRRRQRQEEAALAAAEVAFILQSARGRALQFAIAPDSPATPQHEPAPQQQQ

SEQ ID NO: 41747 - protein, 109 aa, Sorghum bicolor
  Clone ID: SORBI-28MAY03-C63228_1.pep
WSTQKIYLFLIRAARLSVWLHGVDLFCGFEPLTSYSENDGFQIPSGNTFCLSSHVLICVIPIDAVSTSDWLSKLSFIMLSFARSVLHLQYEQGHTRCIEQLMVQLDRFN

SEQ ID NO: 41748 - protein, 155 aa, Sorghum bicolor
  Clone ID: SORBI-28MAY03-C63300_1.pep
LGASPARARPAAPAIVPPHSVAGSGEYTLVYQDPLGDSILVGVPIGRKVDLGAYDSYERLSLGVKELFHGFLEAQKDLSSAGSTQPGATEKIFSQLLDGSGEYTLVYQDNEGDRMLVGDVPWNVFVSTAKRLRVLRSSELSHGLIAVAPRRGPDC

SEQ ID NO: 41749 - protein, 108 aa, Sorghum bicolor
  Clone ID: SORBI-28MAY03-C63389_1.pep
GLAPLCPSLLGSSVERSSVFGVCILVCPDHEKSASGLVWCSVGVWGGLVPPACVAPMGPRTLMCTRFAFCLSSKLQGSRTLLLCGCRELGCVIPRWCRCLPVAFCCIA

SEQ ID NO: 41750 - protein, 165 aa, Sorghum bicolor
  Clone ID: SORBI-28MAY03-C63514_1.pep
RKNKYTEAHARSRASTATERHQKPKPSNTQTISPPHKDPGSLDAKAELLYVDTRPTVRTPATSLERYAFFLSPVQLYIYLLLTCIYMHRKKNEHPVFFFSLVKNLSKSNHQSDPELQQIQTLPTAMYTDQVWGKKRILLMHRGSLRQKVQWMSWITQESVSIGNG

SEQ ID NO: 41751 - protein, 239 aa, Sorghum bicolor
  unsure (1)..(239): unsure at all Xaa locations
  Clone ID: SORBI-28MAY03-C66399_1.pep
WILSYNNGNGEEQHTQHFPQLELLPSFSSSHAPPSPPLHYRGRGAMERFYYVAVVTSVLLVLLHHFLTRRGKKQQRLPPGPRFAFPILGHLPLLKKPLQTSLADLVSRHGPVVHLRFGGRHAVVIGSAALAKECFSGELDVAIANRPHFPSAREASFDYSVLTVVNYGALWRTMRRVATVHLLSAHRVNIMSDTVIARELRAMVRRLARASASXPGAAARVELKRRLFDLSHSVLMEIM

SEQ ID NO: 41752 - protein, 348 aa, Sorghum bicolor
  Clone ID: SORBI-28MAY03-C6645_1.pep
MRTPRSLLPLLLLLLSAAALLTVADSQERKNYVVHLEPRDDAGGDSAGSLEEWHRSFLPEATLDSAADDGPRIIHSYSHVLTGFAARLTDAEAEALRSKEGCLRLYPEEFLPLATTHSPGFLGLHMGKDGFWSRSGFGRGVVIGLLDTGILPSHPSFNDARPPPPPKKWKGTCQFRSIAGGGCSNKVIGARAFGSAAINNTAPPVDDAGHGTHTASTAAGNFVQNADVRGNAHGTASGMAPHAHLAIYKVCTRSRCSIMDIVAGLDAAVKDGVDVLSFSISATDGAQFNYDLIAIATFKAMEHGIFVSAAAGNDGPTAGSITNGAPWMLTVAAGTMDRAIRTTVRLGN

SEQ ID NO: 41753 - protein, 115 aa, Sorghum bicolor
  Clone ID: SORBI-28MAY03-C66809_1.pep
ARGQEGASEDDINNLSKFKFRTMSDADKLAAGIAAPVGGVMTECGTNPPVEHILSAEDAECCICLCPYEDGVELRELPCNHHFHCSCIDKWLHINATCPLCKFNIVKSNLDREEV

SEQ ID NO: 41754 - protein, 240 aa, Sorghum bicolor
  Clone ID: SORBI-28MAY03-C6703_1.pep
HEGVLGFAAARCNGVYIHATFHSWPEDKIVGRPPLIRKTAAPSESGGIRRRRRRLRGIPAAQRRRHLPRGHRQRRLGIRAGQAGPTMTPSRRPAAEAARHPPRHPRAARASPRRSAFPSPHRLSFPAPVRASAPGSSPSRCLLASSPSWAPPSSSSTDSLLHQPFPNQTEHSSYSLRQPPTAMTPPRRQGHFYDKYYSHDTDPDIRPPPPRCEENHQVCQPRFPSCCAEAEWSTNPNLRR

SEQ ID NO: 41755 - protein, 242 aa, Sorghum bicolor
  unsure (1)..(242): unsure at all Xaa locations
  Clone ID: SORBI-28MAY03-C924_1.pep
MASGNPYAAELAAAKKAVTLAARLCKTVQQDIVHSGVQAKADKSPVTVADYGSQILVSLALKMDVASGPFSLVAEEDSEELRKEGAEEILEEITDLVNETIVDDGSYNISFTKEGILSAIDDGKSEGGPSGRHWVLDPIDGTKGFLRGDQYAIALALLDEGKVVLGVLACPNLPLSSVNNLNGNSSGDQVGALFSATIGCGTEVESLYGSPPQKISVCSIDDPVNASFFESLXSAHSMHDLT

SEQ ID NO: 41756 - protein, 165 aa, Sorghum bicolor
  Clone ID: SORBI-28MAY03-C92888_1.pep
FKINYYPRCPQPELAVGVETHTDVSALSFILHNGVPGLQVLHGGRWVTARDEPGTIIVHVGDALEILSNGRYTSVLHRGLVNREAVRISWVVFAEPPPDAVVLRPLPELVTPDHPARFTPRTFKQHLDSKLFKKKQQEQQKADKDGNNNGDHHHDEPPPPQTQTN

SEQ ID NO: 41757 - protein, 160 aa, Sorghum bicolor
  Clone ID: SORBI-28MAY03-C9308_1.pep
MSGGSGTFLEIQPSELAFPFEIMRQSSCSMQLTNKTDHYVAFKVKTTNPKQYCVRPNIGVVLPGSTCDVTVTMQAQKASPSDMQCKDKFLVQSVVAENGATAQEINAAMFNKEPGKVVDEFKLRVVYVPTTTPNPIPEESELGASAPSYSQENGISHSTM

SEQ ID NO: 41758 - protein, 175 aa, Sorghum bicolor
  Clone ID: SORBI-28MAY03-C9328_1.pep
MGALSRPEEVLALVKLRVAAGQIKRQIPPEEHWAFGYSMLQKVSRSFALVIQQLPPQLRNAVCIFYLVLRALDTVEDDTSIPTEVKVPILQEFYRHIYNRDWHFSCGTNHYRVLMDNFHHVSTAFLELGQGYQKAIEEITRRMGAGMAKFICKEVETVDDYDEYCHYVAGLSGYG

SEQ ID NO: 41759 - protein, 78 aa, Sorghum bicolor
  Clone ID: SORBI-28MAY03-C9359_1.pep
MDSEPSSQNPTDMTAFVQNLLGQMQTRFESMSENIVSKIDEMGTKIDELEQSINNLKAEMGTEMPAKKPDEPKPADSA

SEQ ID NO: 41760 - protein, 136 aa, Sorghum bicolor
  Clone ID: SORBI-28MAY03-C12481_1.pep
EEELRQYDGSDPEKPLLMAIKGQIYDVSQSRMFYGPGGAYSLFAGKDASRALAKMSFEPLDLNGDISGLTPMELGSLNDWEYKFTSKYVKVGTIRRTVPAEEVYGSISPEIREEVTVPVVEAELEPEPEPHDGDAP

SEQ ID NO: 41761 - protein, 141 aa, Sorghum bicolor
  Clone ID: SORBI-28MAY03-C67539_1.pep
NRHDPANPAVFSIYLVRPDGSGLRRVYVAGPEGSAEADKERINHVCFSPDSQWLLFTANLGSVVAEPISGPNQFQPYGDLYVCRLDGSGLRRLTCNAYENGTPAWGPASAGLGLESLAIGPPAGEDALGQFDEPLWLTCDV

SEQ ID NO: 41762 - protein, 179 aa, Sorghum bicolor
  Clone ID: SORBI-28MAY03-C67810_1.pep
MGKRDFERLRHVAFFDAMATELPDEYASQEVNHLTLAYFAVGGLSLLRELDRINKDEIAKWILSFQVHPEANDDIGVGLFYGFCGSRSTQFPLPNTKDPCCDVSHLASTYSALAILKIIGYDLANIDCKALLLSLKKLQQPDGSFMPTHIGAETDLRFVYCAAAICSMLDDWTGMDKLK

SEQ ID NO: 41763 - protein, 221 aa, Sorghum bicolor
  Clone ID: SORBI-28MAY03-C6784_1.pep
MAILYALVARGTVVLAEHSAAATNAGAIARQVLERLPDGGADSHVSYTQDRYVFHAKRTDGITALCMADDSAGRRIPFAFLEDIHGRFVKTYGRAALTALAYAMNDEFSRVLSQQMDYYSNDPNADRINRMRGEINQVRSVMIDNIDKVLERGDRLELLVDKTANMQGNTVRFKRQARRFRNTTWWRNVKLTAALILLLLVIIYVVLVFMCHGFTLPTCIR

SEQ ID NO: 41764 - protein, 176 aa, Sorghum bicolor
  Clone ID: SORBI-28MAY03-C67863_1.pep
TGLGIAPRSLGDIIGVVKAYTTRVGSGPFPTELLGKTGDLLRASGVEFGTTTGRPRRCGWLDIVALKYCCQINGFSSLNLTKLDVLTGLKEIKLGTSYYTDDGNTVQSFPADLDLLEQIKVKYEALPGWEEDISSIRDYSDLPETARRYVERIEELVGIPVHYIGVGPGRDALIYK

SEQ ID NO: 41765 - protein, 134 aa, Sorghum bicolor
  Clone ID: SORBI-28MAY03-C67892_1.pep
KSDVYSFGVVLLEMLSGRRALDKNRPNGEHNLVEWARPYLRSKRRIFRILDPRLGGQYSLARAQKAAALALQCLSVESRHRPSMDEVVTALEQLQDTKEGGNHHLQKRPSSRSMDNNGVKAAVKGKPAPSVKPV

SEQ ID NO: 41766 - protein, 175 aa, Sorghum bicolor
  Clone ID: SORBI-28MAY03-C65004_1.pep
SIVRLEKILHLLAGSAKLPGGMDKMKAMQSLSCAGTTKSSANIVEEFSKLDNLKELELYYYATETPGNEKQIMFPVDGLKTVKQLCIRCTSPSVTFEPRVLPKVEALELRFEKGRADESSGVSGLGHLSSLKHLVLEFEQHDVGAMATVDAVRKAAEGLLLDRQYITIKVDGKKY

SEQ ID NO: 41767 - protein, 147 aa, Sorghum bicolor
  Clone ID: SORBI-28MAY03-C65076_1.pep
KDYAEAHAKLSDLGSKFDPPEGFSLDDDMSTAPADEKTEEDISFAVAPSPVAPEPEPAAEPTPEPVAAAITTATADDNNGAAPQPEPFVAAKYSYGKRELSESMKQKIRAEYEGFGGSPDKPMQSNYFLNIMILIAGLAFLTSLVGN

SEQ ID NO: 41768 - protein, 172 aa, Sorghum bicolor
  Clone ID: SORBI-28MAY03-C65213_1.pep
AGKKELYTYQTLDFWEQIKTPGMSLRCSGLYLSQFRRTSPHLLASGDGKRTATIVGDVYIHPSAKVHPTSKIGPNVSISANARVGAGARLINCIILDDVEIMENAVVMHSIVGWKSSIGKWSRVQGEGDHNAKLGITILGEAVDVEDEVVVVNSIVLPNKTLNVSVQEEIIL

SEQ ID NO: 41769 - protein, 85 aa, Sorghum bicolor
  Clone ID: SORBI-28MAY03-C65318_1.pep
GRFQGQATDVDIARKEIRNVKIEMVKLLARHIGKPIEEIARDIRRPKYFSPSEAVDYGIIDKVIYNEKIQEDGGVVSELKRSNLI

SEQ ID NO: 41770 - protein, 118 aa, Sorghum bicolor
  Clone ID: SORBI-28MAY03-C65781_1.pep
YLATGTKGCLHARHCAPPLPVVSPSTFTVYDGKAGSDIIVSETVDYPLKALVFTSTNLKTLVSVLSEISFSLHDNATAYSLLISNNGTKVFLFPQVKSFKPFIPFIDNIIQQPWYGNT

SEQ ID NO: 41771 - protein, 179 aa, Sorghum bicolor
  Clone ID: SORBI-28MAY03-C6511_1.pep
GHCRCSSAVVEDEKKPEDAPQFEVEKDKDGAENEEEEKEPEDKEMTLEEYEKVLEEKRKALLALKAEERKVEIDKELQSMQQLSVKKDADEVFIKLGSDKDLEKKENAEREERAKKSLSINEFLKPAEGERYYNPSSRGRGRGRGRGERGGFRGGYNGSYRGPAAAPAIEDQAQFPALA

SEQ ID NO: 41772 - protein, 63 aa, Sorghum bicolor
  unsure (1)..(63): unsure at all Xaa locations
  Clone ID: LIB3476-021-P1-K1-B8.pep
VLQSMQQLSVKKDADEVFIKLGSDKDLKKKENAEREERAKKSLSINEFLKPAEGERYYNXSSR

SEQ ID NO: 41773 - protein, 208 aa, Sorghum bicolor
  Clone ID: SORBI-28MAY03-C6531_1.pep
MALALATTPLTHLAVAPLPISGSQSSLLLLPRRASHAPVSLSLPLRSRLIAAVATKEEPELGGGGSGGDDGAGGSGGGGGSDPKEGGQEGEGEEEKMEQGLSLSQKLTLAYAALVGAGGVMGYMKSGSQKSLAAGGISALVLYFVHTQLPVRPVFASSIGLGIAAALLSVMGSRFKKSGKIFPAGVVSLVSLVMVGGYFHGILRSSHA

SEQ ID NO: 41774 - protein, 232 aa, Sorghum bicolor
  Clone ID: SORBI-28MAY03-C6838_1.pep
RPAGKKKKKKKKKKKTRDLPIVSHLRPQAHRPRSCTDAGDDHGGEMTVFHFLNCAFLTFGPHVVYYSATPLSEYDTIGTSVKAAAVYLGTALVKLVCLATLLKVPENDSFDPYQELMKVFIGFIDVAGLYFALTQLTHRNISQNHKFQAVGLGWAFADSVLHRLAPLWIGARGLEFTWEYISQGLEPNANLVMTLSLAALGSLMWLRKEKPRTLIPIIYACALLLATMPSIT

SEQ ID NO: 41775 - protein, 238 aa, Sorghum bicolor
  Clone ID: SORBI-28MAY03-C6863_1.pep
MVAGSMKHLVEVEPAKEAAGGAPSAGPTYRCAAGDNAASPPAVPGLDCCWDIFRMSVEKYPDNKMLGRREIVDGKAGSYTWLTYKQVYDTVLKVGAAIRSCGVGKGGRCGIYGANSPEWVISMQACNAHGIYCVPLYDTLGAGAVEFVLCHAEVQIAFVEEKKVGEMLKTFPNATKYLKTIVSFGKVDPVHKEKVEQNGLSIYSWEEFLQLGGEEKFELPPKEKDDICTIMYTSGTTG

SEQ ID NO: 41776 - protein, 79 aa, Sorghum bicolor
  Clone ID: SORBI-28MAY03-C6830_1.pep
VVRCQEVFCEAKVFCLSTMANSNDQQVRRPCMCHAGYFGCAWAAAYLDCEATYADSIALQDMCASCGVPDCLFPAGMLM

SEQ ID NO: 41777 - protein, 68 aa, Sorghum bicolor
  Clone ID: LIB3476-025-P1-K1-A5.pep
VVRCQEVFCEAKVFCLSTMANSNDQQVRRPCMCHAGYFGCAWAAAYLDCESTYADSIALQDMCASCGV

SEQ ID NO: 41778 - protein, 208 aa, Sorghum bicolor
  Clone ID: SORBI-28MAY03-C68650_1.pep
MAKCYSDWPPIPPLHPSRRTPPQSHASPCTIRRQPATFVLHCSRSCAPPLLEPKNLRADEFEAVPTTPVSALPDAVPKLGISNKFIRGLCGDPQTEQLAFEGYRRALLQPEFRLEKKTANALTLQLLREKQWGSLELLVEDFRAYGVLPEKRTCARLVACCIRARRFGLADAVLEVVEVKKGAPATMAFGAAMQAYNKLHMYSSTVLL

SEQ ID NO: 41779 - protein, 163 aa, Sorghum bicolor
  Clone ID: SORBI-28MAY03-C68737_1.pep
EETIVPEIDPEAIKFKEMPEAQKKAALENDMPVGPMPLPRAEGHISYGGALRPGEGDAIAQYVQQGKRIPRRGEVGLSAEEIQKFEDLGYVMSGSRHQRMNAIRIRKENQVYSAEDKRALAMFNYEEKSKREHKVMADLQRLVQRTIGHDVGPSHDPFATTDG

SEQ ID NO: 41780 - protein, 123 aa, Sorghum bicolor
  Clone ID: SORBI-28MAY03-C67077_1.pep
MSASGGETTTTTTLLGSVVVGDAQQAPFPWKLVLLCAALAWCAVRALEWAWWRPRRLARVLRSQGLRGTAYRSLAGDAPLTEQLNREATSRPLPLGCHDVAPRAMPLFHQTMKEHGKTSITWF

SEQ ID NO: 41781 - protein, 154 aa, Sorghum bicolor
  Clone ID: SORBI-28MAY03-C67102_1.pep
GAHTVGRGHCSSFSDRLPPNADDDTMDPAFRRKLAAKCASDPSGNVVTQVLDVRTPDAFDNKYYFDLIAKQGLFKSDQGLINHPDTMRTATRFALNQAAFFEQFARSFVKMSQMDVLTGTAGEIRLNCSVPNIVVSSSAHTAAGDGDEGRAADE

SEQ ID NO: 41782 - protein, 173 aa, Sorghum bicolor
  Clone ID: SORBI-28MAY03-C67402_1.pep
TAAQMAEVAEGLYSSGKPFLWVVRASETSKIPDKFADKANERGLVATWSAQLEVLAHPAVGCFVTHCGWNSTTEGLSAGVPMVAMPQWSDQPVNAKYIEDVWRVGVRVRPDKDGVVRKEEVERCVREVMDGDRSMEYQQNAAEWKEKARKAMSAGGSSDNNIKEFLGKLGLKV

SEQ ID NO: 41783 - protein, 247 aa, Sorghum bicolor
  Clone ID: SORBI-28MAY03-C67_1.pep
MAPQFAAAGFLTGLLALATFASCNTEGDILYKQRLAWEDPNNVLQSWNSTLANPCTWFHVTCNNNNSVIRVDLGNAGISGPLLPDLAEIQNLQYIELYGNGLNGSIPETLGNLTNLISLDLWDNLLTGEIPTTLGSVSTLRYLRLYQNNLTGPIPSSFGNLTSLLELKLQENSLSGAIPASLGNIKALQFLRLNDNMLTGTVPSEVLSLVISGNLTELNTARNNLDGTGTSSGLRVTAIIQDALKTA

SEQ ID NO: 41784 - protein, 101 aa, Sorghum bicolor
  Clone ID: SORBI-28MAY03-C67439_1.pep
MVIATQGMGCSHTATLRSASVVSSLLIALSVPFFGLVMALVGSLLTMLVTYILPCACFLAILRRKVSWHQVAACSFIIMVGVCCACVGTYSSLSKIIQNYT

SEQ ID NO: 41785 - protein, 179 aa, Sorghum bicolor
  Clone ID: SORBI-28MAY03-C69154_1.pep
GGCVKEEARLQTATMIKQARTMADGKKLGDALDKLVEAQNALGDVPVADPYDDPLLDALRKELQELQKLMKSPAVYEQQGRPYAMSSETSHDRQRFAARGDMEKNRLFATPRMDKYLEQAKKFDEDPAAPLPPADVDEKEEVAANPLAPLAGPITFYIQAAVQALQAIEKLINNGAKAV

SEQ ID NO: 41786 - protein, 168 aa, Sorghum bicolor
  Clone ID: SORBI-28MAY03-C69809_1.pep
MSMSMSSSPADLSRVLPRVLIVSRRTVRKNKFVDFVGEYHLDLIVGYGAVPVIVPRVAGVHALLDSFEPIHGVLLCEGEDIDPSLYDSSSDADAVSLSPEQLEAVRRLHPSDAAIDHEKDSIELRLARRCLERNIPYLGICRGSQVLNVACGGSLYQDVEHELAVGPG

SEQ ID NO: 41787 - protein, 186 aa, Sorghum bicolor
  Clone ID: SORBI-28MAY03-C6995_1.pep
ELINDSVPPKDPEEGGENCEGNADSESLSDIDDAEVDWYLHNEEEKQYKKIIWEEMNKEYLEEQAAKEALAAELAARGIVVEEGKKKKRRRNEDTKSSTPAETPAEATYNMLKRKGLGSKINEGAVGELYKTKDEVGSASKEEEMDFDALFGPDNADGETVDDGYNGGYNDDGVEAYNGIDDDFDF

SEQ ID NO: 41788 - protein, 114 aa, Sorghum bicolor
  Clone ID: SORBI-28MAY03-C69967_1.pep
GFLPQQLQGSHRWRCCQEPWLVGPAPPPPPAAHSVARLNNSKGAAVGDAVKTLGLLGLFTRGLPLRILMVGTLTGAQWVIYDSFKVMIGLPTTGGAPAPTTVPLEGLGELKASA

SEQ ID NO: 41789 - protein, 180 aa, Sorghum bicolor
  Clone ID: SORBI-28MAY03-C6999_1.pep
FFKNSVLTKTYHMIDEDEPILEKAIGTDIEWYPGKCLTQKVLKRKPRKGSKNTKPITKTEDCESFFNFFSPPQVPDDDEEIDEDTAEQLQNQMEQDYDIGSTIRDKIIPHAVSWFTGEAAQDEDFEVMDGEDDDDEDGDDDEEDEDDEDEDDDDYDTKKTKGTAGGEGQQGERPAECKQQ

SEQ ID NO: 41790 - protein, 228 aa, Sorghum bicolor
  Clone ID: SORBI-28MAY03-C67938_1.pep
MEEEQSPRLGREPATEPSPSLEWPEPECKNDDGVKDPEDPESTGGGGDGNGISSLEQPLLKRSTTLTASHLAIVGAKVSHIESLDYEIIENDLFKHDWRSRSNVEVLQYIFLKWAMAFLVGLLTGVIASLINLAIENISGLKMQHMVNLVREKRYWAGFLYFAGVNFALTFVSAVLCVVFAPTAAGPGIPEIKAYLNGVDTPNMFGAPQLIVKIIGSIGAVSSGMDLG

SEQ ID NO: 41791 - protein, 129 aa, Sorghum bicolor
  Clone ID: SORBI-28MAY03-C67966_1.pep
GPPHPTAGAGLYAPPPFSDLAACRAAPPSGPRPRARPAAPSGSARAPPPPAPAPACGGGERPEVQSQPKIAEWERTFAGAGAGPGINPAGSMLGLGGHHQLGPAAVGVGQLPAGDPLLQDILTYWGKPY

SEQ ID NO: 41792 - protein, 194 aa, Sorghum bicolor
  unsure (1)..(194): unsure at all Xaa locations
  Clone ID: SORBI-28MAY03-C6813_1.pep
MAMAAAEGKSRRFALACGVLSQYVKAEQQMAAAAAPAARAPATTLSLMPGADVGAEQEPTPAAAARGEEMAGPASTAAPLTIFYGGRVVXFEDFPAEKAAEVMRLAAGGAERVAVPAPAPAPAPAPRDDLPIARKASLQRFLAKRKDRLVERAPYTRPSPSPAEEAEKTKQPAASSWLGLGGSTTDAERLTIAL

SEQ ID NO: 41793 - protein, 186 aa, Sorghum bicolor
  Clone ID: SORBI-28MAY03-C68158_1.pep
MGNSDAASPASAAAARDAKKKRGNRSAAKLKQSKRETRRGQFLSKGQGNDGNDAKVATSPTGAGSNAGSPILASPHPPLPRRRVDSRSRGSDPEDREEAGAAGLEVDGSGLDSPGSDKSQGGDCHQRKGFSGNGGGRSLSSGSSVWSSSRSVSDAEEDTGGPEDESEVFDDWEMAADALYIDDSSC

SEQ ID NO: 41794 - protein, 169 aa, Sorghum bicolor
  Clone ID: SORBI-28MAY03-C68227_1.pep
MARSARARRHVARQLKSTHPIPSYRWKAKAMKKSNRKQASPALQKMDWEDANCSVCMEYPHNAVLILCSSHDKGCRPYMCGTSYRHSNCLDQFKKAYTKGALLQEVPANSIGTNLDSAQLTAEKTESMDLACPLCRGKVKGWTVVEPARSYLNGKRRTCMQDGCSFVGT

SEQ ID NO: 41795 - protein, 70 aa, Sorghum bicolor
  Clone ID: SORBI-28MAY03-C6826_1.pep
FSKWKFAFISMNRPDYLQDSDVISTRFQRREVYGAWEQYLGMEHTDTAPKRAYTVNQNRHSYEKPVKIYN

SEQ ID NO: 41796 - protein, 394 aa, Sorghum bicolor
  Clone ID: SORBI-28MAY03-C7066_1.pep
TRIRSNHQLFPYAASDEKQTQLSEDKIPSQDQAGKEGNRIETQGVEKHLKNASQLSHNGGSDSLVVCCEDVLFLLSLASLIQGSSKHLQKTKLTKPCCWSAVFKNMDGKICGLILAYQTGIIEVRSVPDLAIVAESSLMSLLRWSYKTGMDKSASSSNGQITLVNGSEFAIISLMASENDFRIPESLPCLHDKVLAAAAEAAISFSTDQRRKQNPAAGIIGGFIKGMKGKAEENAKMRESLTMETPSQQLESIFLKEPFAELSIPDLDDPIEELSIDDIEIDDEVPIAPAPAASSTSQWNKRTAVEEERAKLFEGSSNVDKPRMRTPQEILTKYKFGGDAAAAAAHAKDKLMQRQEKLERISQQTAELQHGAENFASLAQELAKTMENKKWWKL

SEQ ID NO: 41797 - protein, 129 aa, Sorghum bicolor
  Clone ID: SORBI-28MAY03-C7077_1.pep
MALQWMILACVVAVEAAVAALVTLPVPRAVRGQIVALTSLFLQPLSTVIPFAAFQLLDIYWKKEHRLMCTAEICTAEERIRFEKSMFKAQRNVILCVSACLLYWCIYRIVKFNKDIKALEETEKRLKEE

SEQ ID NO: 41798 - protein, 168 aa, Sorghum bicolor
  Clone ID: SORBI-28MAY03-C71089_1.pep
MAAIEDDQAAGSAVPAVALSSGKPMPRIGLGTASFPLGNAGDRPVVREAVLRALDAGYRHFDTSAVYGTERAIGDAVAEAVSAGTLASRDDVYITSKLWIADAHPGHVLPALRKTLQNLQMEYVDLYLIHFPVSMRLPEAEGGAGAGPVLAKENLVEMDMKGVWEEME

SEQ ID NO: 41799 - protein, 176 aa, Sorghum bicolor
  Clone ID: SORBI-28MAY03-C70907_1.pep
MAHRPDAAAPLLAKPDADATPPPPPKRNKYPFFCAVLASMTSVLMGYNVAVTSGAQIFMAEDLGVSDAQIEVLSGVINIYSLVGALLAGWTSDRLGRRLTIVLANAFFLVGPLAMALARGYALLMVGRFVAGVGVGYALVIAPVYAAEIAPPSSRGLLTSLPEIFINTGVMLSYVS

SEQ ID NO: 41800 - protein, 136 aa, Sorghum bicolor
  Clone ID: SORBI-28MAY03-C71136_1.pep
LHVLGGSIQSIGVMIGGAIIWYKPEWKIIDLICTLIFSVIVLFTTIRMLRNILEVLMESTPREIDATRLQRGLCEMEGVVAVHELHIWAITVGKVLLACHVTIAREADADQILDKVIGYIKTEYNISHVTIQVERE

SEQ ID NO: 41801 - protein, 276 aa, Sorghum bicolor
  Clone ID: SORBI-28MAY03-C68895_1.pep
MGNAAFRSLPTKNNRRMRQIKNEIESILLGLISKRMQAMKEGESAKDDLLGLLLESNMRETGENGQSSQGMTIEDVMEECKLFYFAGMETTSVLLTWTMILLSMHPEWQDRAREEVLALFGKNQPGYDGLSRLKTVTMILYEVLRLYPPAIAFSRKTYKEMVIGDVTYPAGVIVELPVMFIHHDADIWGSDVHEFRPERFAEGIAKASKDRLAFFPFGWGPRICIGQNFALLEAKMALSMILQRFQFELAPTYTHAPRQVIMLRPMHGAQIKLRAI

SEQ ID NO: 41802 - protein, 86 aa, Sorghum bicolor
  Clone ID: SORBI-28MAY03-C69017_1.pep
EVRESDLRTGVETIAKGLADASGDLRKLKSSMLTPENTDLIKQSIFTLIFTLKNIESISSDISGFTGDETTRRNIKLLIKSLSRLL

SEQ ID NO: 41803 - protein, 174 aa, Sorghum bicolor
  Clone ID: SORBI-28MAY03-C6909_1.pep
MAAARGINQLLKRTLHNQSAGSSLLSSLRGKHEESSAGLRALALLGVGASGLLSFATIASADEAEHGLAAPDYPWPHAGIMSSYDHASIRRGHQVYTQVCASCHSMSLISYRDLVGVAYTEEETKAMAAEIEVVDGPNDEGEMFTRPGKLSDRFPQPYANEQAARFANGGAYPP

SEQ ID NO: 41804 - protein, 179 aa, Sorghum bicolor
  Clone ID: SORBI-28MAY03-C69103_1.pep
MAVVDKWTGLGSALASFLFLWSMVQRHVPVTLSHRVATWANKLASYLNPYLEITISEYGAERFRRSDLFLAAEAYLSDACALRARKLKAEIGRDSSNLQVSVGDNDEVTDDFQGATVWWYVAKKVPRSNVINLYGNQDEPRFYRVVFHRRHRDLVVAKYLPHVLREGRAVTVRNRQRRL

SEQ ID NO: 41805 - protein, 190 aa, Sorghum bicolor
  Clone ID: SORBI-28MAY03-C6970_1.pep
MKRLVSTALATRGLLRSRGAPSTTAVMSRPAFQQFMNYSSPQGGDPNASTNSTAARIAADPDTHQDFEPKSRSSDMSLNDIVAQDIKENPVLIYMKGFPESPMCGFSALAVKVLQQYGVPICGRDILGDLKLKESVKAHTNWPTFPQIFIKGEFVGGSDIILSMHQKGELKDLLGDIAQRAEQKADAHDS

SEQ ID NO: 41806 - protein, 251 aa, Sorghum bicolor
  Clone ID: SORBI-28MAY03-C71890_1.pep
APSLTLPRPSAPPPTPPVASPSARTLIPPRHHGAAPSPSTSGDSSLRLLRAHPRHGRRSRGVSVSTPAARSRPFVFSPRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETDADITVAALPM

SEQ ID NO: 41807 - protein, 175 aa, Sorghum bicolor
  Clone ID: SORBI-28MAY03-C7248_1.pep
RDEIKGGRQLEAFSIQLIVLATWKQAIHLCNTFVASPARESPSQDIPLLATSKLADDACMQIEKQFLSEVEYAEELASTVGQIADGTEIPDAIEIIFQSALLIGRRGGVDEMFGKAADAMTGYMRAVSMLRFLLIEAPSLALNPPLILTRSDRHRLRTYIEALNTRLCQMQSQRH

SEQ ID NO: 41808 - protein, 72 aa, Sorghum bicolor
  Clone ID: SORBI-28MAY03-C72502_1.pep
VCPCGLLVAPQERQQRSVTDLCWTLGVLFRVLLGKLHIIVGLHGSCLGKCFATPFSPIGHSRKGVNSHVYLG

SEQ ID NO: 41809 - protein, 147 aa, Sorghum bicolor
  Clone ID: SORBI-28MAY03-C72551_1.pep
NRVVKVADFGVARVKDQSGVMTAETGTYRWMAPEVIEHKPYDHKADVFSFAIVLWELLTGKIPYEYLTPLQAAIGVVQKGIRPMIPKDTHPKLIELLQKCWHRDPAERPDFSEILEILQKLSKEVKTDPEGRHKTKSGFLAALKRSH

SEQ ID NO: 41810 - protein, 147 aa, Sorghum bicolor
  Clone ID: SORBI-28MAY03-C72566_1.pep
CLQVTMILYEVLRLYPPVVQLDRQTYTEVELGGVTYPPGVLLSLPIVFIHHDKDVWGEDADEFRPERFKDGISKASKDSPAFFPFGWGPRICVGQSFALVEAKMALSSILQHFSFGLSQSYTHAPFPVSTLQPEHGAHIMLKKLSSV

SEQ ID NO: 41811 - protein, 164 aa, Sorghum bicolor
  Clone ID: SORBI-28MAY03-C70095_1.pep
MVQLLLALALAILLVGVPVADAATAKYTFTVGSMQINQLCSSTSIIAVNGQLPGPSIEVNEGDDVVVKVVNNSPYNITIHWHGVLQLMTPWADGPSMVTQCPIQPSSSYTYRFSVPGQEGTLWWHAHSSFLRATVYGAFIIRPRRGNAYPFPAPDKEVPIVLGQ

SEQ ID NO: 41812 - protein, 220 aa, Sorghum bicolor
  Clone ID: SORBI-28MAY03-C7_1.pep
MADEIDTRPASAGSRGRPAHATEDDDREEGEIADDTPAPALPVTHPLEHSWTFWFDNPQGKNKQAAWGSSIRPIHTFSTVEDFWGLYNNIHHPSKLVIGADFHCFKNKIEPKWEDPICANGGKWTISCGRGKSDTLWLHTLLAMIGEQFDYGDEICGAVVSVRGKQERIAIWTKNAANEAAQISIGKQWKEFLDYKDSIGFIVHDDAKKADKGPRNRYTV

SEQ ID NO: 41813 - protein, 378 aa, Sorghum bicolor
  Clone ID: SORBI-28MAY03-C7015_1.pep
LQNYLLWSRTISYTNHTVLPEALEKWSQIVMRKLLPRHMEIIEEADKRFRELVISKHKEMEGKIDSMKVLDSSNPQKPVVRMANLCVVSSHTVNGVAELHSNILKQELFADYVSIWPTKFQNKTNGITPRRARRFCNPELSEIVTKWLKSDQWTSNLDLLTGLRKFADDEKLHAEWAAAKLSCKKRLAKHVLDVTGVTIDPTSLFDIQIKRIHEYKRQLLNILGAVYRYKKLKEMSAEEKQKVTPRTVMIGGKAFATYTNAKRIVKLVNDVGAVVNNDPEVNKYLKVVFIPNYNVSVAEVLIPGSELSQHISTAGMEASGTSNMKFSLNGCVIIGTLDGANVEIREEVGEDNFFLFGAKADQIAGWRRQRKWLLNQTT

SEQ ID NO: 41814 - protein, 168 aa, Sorghum bicolor
  Clone ID: SORBI-28MAY03-C70446_1.pep
ARGSTSGGEDGAFCSQPEPPPAFPPAATAAVAAVCQQLAAPAAPAPPPPSKVGGVAGRRTILPVPPPRPAGQRARKKMRLPEIQQMVRSLSVENDALRKEMKALQRACAALSQENGKLETRLDQSTSRNKVISVENKGKKPQAEHQHTAEQEAPNGFVLPDLNLPADV

SEQ ID NO: 41815 - protein, 179 aa, Sorghum bicolor
  Clone ID: SORBI-28MAY03-C70255_1.pep
LPAAAPAGAAAGRAGAWVGESSAASLTKFEDVFELFCQGRYPGGPYWRNAMEFWRESQRRPDEVLFLRYEGHAGRPGLGNLKKAGGGRGARVLRGGGGGGRCRRRGAVRGPLRLGVPEGRGRARLGLHGAAVLGWGLVRDWAGYMTVDMAARLDKIVEEATRGAGLSWGGAPPRRLRLA

SEQ ID NO: 41816 - protein, 404 aa, Sorghum bicolor
  Clone ID: SORBI-28MAY03-C7050_1.pep
IYRRPQMIYVVKRLRIFRKELKDRHENYSESILASHHSWRKNNKQEMIMPTYNSKMQIRKSLGSFRRNLSNSKIQSEPSNVRIFTQEELKEVTHNYSYRLSGGTSGQVYKGTLEDNAVVAVRIFSEVLEGFEEAFINGGMILSQIFHRNIIKLLGYCSDCPAFVYEYAAKGSLSDVLDGHEHFPLDLRTKIAVKIAEALEYLHSSGAGIIRHGYVVPSKILLDDNFMPKLTGFSWARKFIKESNIIASDAITSHQLPSSGFYNDPIHDHCASLKVRTDVYQFGVLLLTLISRKNFVFYADHDDLISQFRTACLTDGSGRAFFDDDIAAHSEDIFLLEEIGRLSLKCICEEIDQRPTMKEVAELLRIITRSWKKCSSERTTLVSKTVSTSHIARAEGTKSNRPLD

SEQ ID NO: 41817 - protein, 195 aa, Sorghum bicolor
  Clone ID: SORBI-28MAY03-C73565_1.pep
MAPMSVPATLAPPAPPKASPTARSSARRAPAADAASVAASSVAGSAALLTLTPAAPAAALSKEDVAGSLIKVVDTVDDVIGVGGKAAEQVAAVLKALGEAVQPAFPVLKSASDEALKLAAPVVSGASKQATEALQGAGVDPAPVLSVAKTAAEQSTKVIDAAKPVASATVETITTLGPEGYVVTAGAALLAYLLV

SEQ ID NO: 41818 - protein, 211 aa, Sorghum bicolor
  Clone ID: SORBI-28MAY03-C73727_1.pep
MAAKLCTLLLAAVVVLSLLVSPIACSRKLSKTKPKTKPAARVIHKPAAAPAVKASHKPATPAKSHTNHTTLYGSGGWLSGAGATYYGAPNGDGGEGGACGYQTAVGKQPFDSMIAAGSAPLYRGGEGCGACYEVKCTSNAACSGQPVTIVITDLSPGGLFPGEVAHFDMSGTAMGAMAKPGRGMADKVRAGGVVRVQYRRVPCKYPGVNVA

SEQ ID NO: 41819 - protein, 138 aa, Sorghum bicolor
  Clone ID: SORBI-28MAY03-C74024_1.pep
SPGSSMDDDGDQYWGLEVGADLSYCRFRHIVFLVCLDLVRPVEEGWGSATNFLFDGVQIHSFISSSLVCLDVHTVSVDIMDQDYILAYWRVESSWSRLTILGHLTRRLLRLENARHLEADELTVGPLFGSLSTAMELF

SEQ ID NO: 41820 - protein, 184 aa, Sorghum bicolor
  Clone ID: SORBI-28MAY03-C74143_1.pep
MSSLAAARADNFYYPPEWSPKKGGLNKFHGQHALRERARKLDQGILIIRFEMPFNIWCGGCNSMIAKGVRFNAEKKQVGNYYSTKIWSFTMKSPCCKHEIVIQTDPKNTEYVIISGAQKKTEDFDVEDAETLLLPADEDRDKLADPMYRLEHQEEDLRKKKEAEPVLVRLQRLSDSRHSDDYAL

SEQ ID NO: 41821 - protein, 183 aa, Sorghum bicolor
  Clone ID: SORBI-28MAY03-C71360_1.pep
MTSGAGGAAAGIGGTRVPTWRERENNRRRERRRRPPAPCDNNEVLKALCREAGWVVEDDGTTYRKGCKPPPGMMSPCSSSQLLSAPSSSFPSPVPSYHASPASSSFPSPTRLAPCSPSPPPPPLPPAPSAAPAAPAASSLLGGVEGNSLIPWLKNLSSSSSFASSSKFPQLHHLYFNGGSISA

SEQ ID NO: 41822 - protein, 257 aa, Sorghum bicolor
  unsure (1)..(257): unsure at all Xaa locations
  Clone ID: SORBI-28MAY03-C7154_1.pep
RGGASRFGAGLEVLPVPASAWALLAGSAQRPPLLVLPFRPGLXENMSINLDHPNLSGETTVQNAVTEVAAMVGENVKLRRGFMLSTTAHGVVSSYMHTCPQPGMGRIAGLVTLEAEDSITLLDAVKSVGSSIAMQIVATKPLFLSKELVSASALENEREILRTQAESSGKSQMAMDKMVEGRLRKYFEEVVLMEQKYVLNDNTNVKTVLNDLSKEVGSKVTIGNFIRMEVGEGIERYNIFVPSHVISIDKWVFVCDV

SEQ ID NO: 41823 - protein, 133 aa, Sorghum bicolor
  Clone ID: SORBI-28MAY03-C71622_1.pep
RRKQKGVAQQEHDCIPDEHYVQTLFSIKGLEDELERRTLTYTSWNQSSNPKDKMTWHPMVFEYGTSSPEHINAIKRIDHVNYQMEQRTEWCQCNGTLVPCFLFARKFSYSAAMHLLEQGAIGTPKSAQLMINF

SEQ ID NO: 41824 - protein, 308 aa, Sorghum bicolor
  Clone ID: SORBI-28MAY03-C71804_1.pep
RQDVKLLGPCQPLPPGLRRGARRRRRTSPWPSPCPSPCPSPSSSSAALSSARSRSTTRRRSPRRGGPTRTRPSRTTSRTRTAPWRAPRCCGSTRRGTGPPTPSASSAPTTRRRPAPSSSSPSPPAVAAATVPCPPPGRAARRRPGPPTPAGWAPVFDVLRLFPDDCAFPTVCGAYGVCTDMQCSCPDAANFRAVDFRRPNRGCVPTAPVACGGPPARLVSLPGLAYFNDPATSLKALERVSDAACRKACLDECRCAAAQFVYGADAGDGFCYLQSEVLSMETSRPEVVHYNSTMHLKVRATRRPSAGF

SEQ ID NO: 41825 - protein, 266 aa, Sorghum bicolor
  Clone ID: SORBI-28MAY03-C71676_1.pep
GFFLVLLLLLLPFSPSLSPLSSPSCPPPRGGRSTLPHPQPPLPAAFLPPSLLPSRPPPAPTTKPRFRRLRSSRATGAGQMAEQGGAAPGEAVGSDTTAPAPAPALAADAAGQRSLPTPFLTKTYQLVDDPAVDDVISWNDDGSTFVVWRPAEFARDLLPKYFKHNNFSSFVRQLNTYGFRKMVPDRWEFANDFFRRGEKRLLCDIHRRKVALAPATPVAGLATAAAAAASGAVTVAAAPIPMALPVTRPASPALSTDEQVLSSNSG

SEQ ID NO: 41826 - protein, 196 aa, Sorghum bicolor
  Clone ID: SORBI-28MAY03-C74463_1.pep
MASPPLQLAAAPLLLLLLLLLVVVPGTGSSRVFSVADYGAAGDGSHYDTAAIQATVDACAAAGGGRVLLPAPGDYLTATVHLRSRVVLDVPPGARLLGGTRQADYPPESRRWYVVLAENTTGAGVTGGGEINGQGGAFVVTPSEVKNVMVSWNATGDCLGDECRPRLVGFIDSKDVKIHDITLNKPAYWCLHLVRC

SEQ ID NO: 41827 - protein, 203 aa, Sorghum bicolor
  Clone ID: SORBI-28MAY03-C74814_1.pep
LKKMLEGLARHLFGAVEMRWVDTYFPFTNPSFELEIYFQDDWLEVLGCGVTEQEILKRNGRSDHVAWAFGLGLERLAMVLFDIPDIRLFWSNDKRFTSQFSEGKLGVKFKPFSKFPPCYKDMSFWINDAFTENNLCEVVRGIAGDLVEEVKLIDNFTNKKGMTSHCYRIAYRSMERSLTDEEINNLQLNVREAVKDKLKVELR

SEQ ID NO: 41828 - protein, 198 aa, Sorghum bicolor
  Clone ID: SORBI-28MAY03-C74932_1.pep
RGLMVADVRWTAQDIWQFLFPFAGRRRRAGRRLHRELGRGPCRLGCLQDHHSVVPHACADHGFQLGRVRGAHRPSGGADLTSGLARTEAGVGARAGLPLRRSVPDRRLRRRPALPGRGEYYQPACRERTARNLFSHPVVGMKTVRIFSDRIRDRIRLEGFRSVRIRVRIFNIRYRIRIRIFKSYIYDVDIQSYLIRHG

SEQ ID NO: 41829 - protein, 497 aa, Sorghum bicolor
  unsure (1)..(497): unsure at all Xaa locations
  Clone ID: SORBI-28MAY03-C7503_1.pep
MAGAAAAAAVDVEDLLVRVKTGAEDELAAVAREVEALARGGRLGEEDDEDGLLVPALLARLAAAGTADARVSVMAALRRLAGCVAGESKERLASIEALSSIVRSLSRDVDERREAIAVLLDLSDIPQVRQRIGRIKGCIVMLVTLRNARESGTEDDAEKLLSILSSNPQNVLLMAEAGYFRPLIQYLKQGSDMNKVLMATAISKMFLSEHMKSSLGEDGAIEPLVDMFKYGNLEAKHSALGALRNLSSSLQNAELLINSGITGPLLQLLFSVTSARGTLREPASAILAAIAQSERILLHKDVAPQILSLLNLSSPVIQLHLLRALNSISGHANAKRARSKIRQNGGVQLLLPFLTEKNVDIKIAALHLMFHLSKDSSQELAEQFRETHLDILVKIISSPTSRDEKAAAVGILSNLPVTDKKVTEILMRSNLLPILITLFEANIATSVTPQRMXVLEGIAGXFIRFTVTWDRKLQSSQLDXGGPCLVKLLSRRQWTPV

SEQ ID NO: 41830 - protein, 219 aa, Sorghum bicolor
  Clone ID: SORBI-28MAY03-C75209_1.pep
MPLSSLSLLRHHPPRPLPPTSNRQPPPPHPRLLLPPFTGRRAFVCQPLAAATDDMAAAAAAASPPTLLEHMGQAGTAADLTVLVSHIQSACKRIAALVASPGNAELSRSKAGRGTVAAGRDAPKPLDELSNDIILSSLQSSGKVAVLASEENDLPIWISNDGPYVVVTDPLDGSRNIEVSIPTGTIFGIYNRLVELDHLPLEERAQLNSLQSGTRLVAA

SEQ ID NO: 41831 - protein, 183 aa, Sorghum bicolor
  Clone ID: SORBI-28MAY03-C72643_1.pep
MAVDSPPPPAQPRRQSEAGAGGRRTDKHGRRLEVYNEVLARLRSSAAAATVSPAFEDALWAHFHRLPARYALDVNAERADDVVTHQRLLQEARDPERRPALSVRVVQVSRIIDGDTADSCDTDMETVASNNHVVASQMAHPPPAFGSSSNLEALGLETNEGDVRSTNDTDHSVLLQMVQMFGK

SEQ ID NO: 41832 - protein, 312 aa, Sorghum bicolor
  Clone ID: SORBI-28MAY03-C72856_1.pep
MQETTLSPFAASHKDSLTQEDGLMQHADLSPLIANHRDSLIKETELPPSTASHKDSLIEETDLTQTISSYVNNLKLQFKEGTQICDIDMLPQDVDLIELPDQRKIIGRDVGAEAVIEMEEGKLDQSSSLNLSDIDLVGSTEVAAIHNNPVLVQPSTAGSSSESNNKQQEDLEIFTGANASPTDDLCQLPLDNKDVQVIDIECGTPVDVGGFDLSKSKNEMVCSSMDSIMDNGNGIHTDVLPGIQDGYSLAFSDFLGSDIPCYPPMQSDLHAGIGVNDSEGITVMDDPIYGSLTDIGFMDVWGQPTQDYDKFF

SEQ ID NO: 41833 - protein, 160 aa, Sorghum bicolor
  Clone ID: SORBI-28MAY03-C73122_1.pep
MESLEALVAHIQGLSGSPEEVAHLHSLLKQADGDSLRAHAAALLPFLAHLSPETHSLGYLYLLEACATSGSNLSDFGGGDFLVTIAGFLTACSADQIRLAPDKFLNVCRVLKDQVMQLNMPIRGIAPLRAAVRKIQSSPEQLTPLHADYLLLCLLAKQYK

SEQ ID NO: 41834 - protein, 153 aa, Sorghum bicolor
  Clone ID: SORBI-28MAY03-C73336_1.pep
GEHSDVKSEQGQKHEIDGQDINDFNPRDAELGTKVSEDITDSKSSTPVQTESVVQQNGPDSAKVTAQTVIRNPFESSFSGPSITSGPLTPSGHIPYSGNISLRSESSTTSTRSFAFPVLQNEWNSSPVKMAKADRRRLKEDRGWGYRILCCKF

SEQ ID NO: 41835 - protein, 169 aa, Sorghum bicolor
  Clone ID: SORBI-28MAY03-C73140_1.pep
MQRDTSSSDVSASHAGRVRRRRHPTEATTDGNRANGQPLLVNDQNKYKSMLIRTYSTLWMIGGFAFIVYMGHLYIWAMVVVIQIYMAKELFNLLRKSSEEKQLPGFRLLNWHFFFTAMLYTYGRFLSRQLVNTVTSGHLLYKVVSGLIKYQMFICYFLYIAGFVWVILT

SEQ ID NO: 41836 - protein, 175 aa, Sorghum bicolor
  Clone ID: SORBI-28MAY03-C73416_1.pep
YLRILYVQIMKIDDERPYQSHIFHDLSSNGSPKLDCEAERQGDLKFLADKMVEQTNQSELSFVKAEHLNGGKIGQTRIEDYSYDKDVVEASLPDTVLSSDHGVHFVKDVCIDAGVLPAQATSSETPPHQKGPMPFDSLASSAISSWGGSVRGLRAPAPVPLSLRRRLPRSLLSQF

SEQ ID NO: 41837 - protein, 238 aa, Sorghum bicolor
  Clone ID: SORBI-28MAY03-C76457_1.pep
MPAIPTAPAPSPSSFLLARRHSLHVSYPSPSSNHQRLPPRLLRLPARPQAAPMSAVARAPASPVAPPAHPTYDLKAVIALALAEDAGDRGDVSCLATIPSDVEAEATFIAKADGVIAGISLADMIFNQVDPSLKVEWFESDGNYVHKGLQFGKVYGCARSIIVAERVVLNFMQRMSGIATLTKAMSDAARPACILETRKTAPGLRLVDKWAVLIGGGKNHRLGLFDMVMIKDNHISVA

SEQ ID NO: 41838 - protein, 113 aa, Sorghum bicolor
  Clone ID: SORBI-28MAY03-C76840_1.pep
MAGDITCGSLLQKLQFIWDEVGESEEDRDKVLYQLDQECLDVYKRKVDQATNSRDLLIQALDDSKIELARLLSALGEKAIARTPEKTTGTIKQQLAAIAPTLEQLTKQKKKKK

SEQ ID NO: 41839 - protein, 308 aa, Sorghum bicolor
  Clone ID: SORBI-28MAY03-C7723_1.pep
HEVGEDVESILYKLLTVADFNVQAAQQGMVYIDEVDKITKKAESLNISRDLSGEGVQQALLKMLEGTIVNVPEKGARKHPRGDNIQIDTKDILFICGGAFVDLEKTISERRQDSSIGFGAPVRANMRAGGISSAQVTSSLLESVESGDLIAYGLIPEFIGRFPILVSLAALNEDQLVQVLTEPKNALGKQFKKLFSMNNVKLHFTDGALRIIAKKAMSKNTGARGLRTILETILMDSMYEIPDARSGEKRIDAVVVDEDAVGSVDQPGCGAKILYGDGALDQYLSQIKVSGDGVASEMDGETERAIGM

SEQ ID NO: 41840 - protein, 319 aa, Sorghum bicolor
  Clone ID: SORBI-28MAY03-C7729_1.pep
SLMSSTLLEDLEKEDCTPPSRSFMDYPGRPETCQRRVPALNYDAESETLSRAGSMLSEIITTRDGLKGNSSVAGDTEFVAGIGEFVAELKEMAQVQYQKQHGDQGDNGELAEGTIRSVGLDPIMDALQSPSRWPLEFEKKQQEIIDLWHGCNVSLVHRTYFFLLFKGDPADAIYMEVELRRLSFLKNTTYSNGSMGRNVVVAGSPSTSLVSSAKKLQREREMLCRQMQKRLTIQERESLYTKWGVSLSSKRRRLQVARRLWTETKNLEHVRESASLVARLIGLLEPGKALREMFGLSFAPQQFTRRSHSSWRYGRSSLD

SEQ ID NO: 41841 - protein, 215 aa, Sorghum bicolor
  Clone ID: SORBI-28MAY03-C77446_1.pep
MAAAAVASSSTPRPLRLAQRGALAPHHVSAPPPRSRRPRLAVCASAGVETETTSGSGRFYFNFTGFPFPLGPFLNRRTIRTEAVKGSIWLFEQEQALGFSSVSTNTRMTVIKLKSGGLWVHAPIAPTKECIQLLKELDAPVEHIVLPTFAYEHKIFVGPFSRKFPKAQIWVAPRQWSWPINLPLEFFGIFRAKPLKDEDDATPWAVEIEQKVLSS

SEQ ID NO: 41842 - protein, 190 aa, Sorghum bicolor
  Clone ID: SORBI-28MAY03-C1215_1.pep
MAAPTTSRRGPGGARNMDDENLTFETSPGVEVVSSFDQMGIKDDLLRGIYGYGFEKPSAIQQRAVLPIINGRDVIAQAQSGTGKTSMISLTVCQIVDTAVREVQALILSPTRELASQTERVMLAIGDHLNVQVHACIGGKSIGEDIRRLENGVHVVSGTPGRVCDMIKRRTLRTRAIKLLVLDEADEMLS

SEQ ID NO: 41843 - protein, 150 aa, Sorghum bicolor
  Clone ID: SORBI-28MAY03-C1235_1.pep
VGRSFGVTDFVNPSQLDNRSVIEVIVEMTGGGVDYSFECIGVPSVMTDAFRCTKMGKGKTIVLGLGRDSDQVCLPSLELLFGRCVMGTLFGGMKPKTDIPILAKKCMDKELQLDALVTHELGLQEINTAFDLLLQGKSLRCIIWMDKDNK

SEQ ID NO: 41844 - protein, 137 aa, Sorghum bicolor
  Clone ID: SORBI-28MAY03-C12404_1.pep
MNQSISKRHRPVAPEVGGGSMIPDEVLLFEILVRLPVKSLVRFKSVCKAWCATIASAHFVRLHLELARARSSSSMVIVPRKEQPRPTKLASVCVHIFSFQPARQSNVAKLIMKSKPRPGGIPHFTIPLHCDGLILIP

SEQ ID NO: 41845 - protein, 194 aa, Sorghum bicolor
  Clone ID: SORBI-28MAY03-C1246_1.pep
MSTRAAGSVLLRHLGPRVFGSVSSSPAAAPPRPLLALAGGGEWRGAAVWVRLLSTSAAEAKEEAAASKGNAGSTAAAKAEAVEAAKEGDGKKDKVVSSYWGVAPSKLMSKDGVEWRWSCFRPWEAYKPDTSIDLTRHHEPKVLLDKIAYWTVKLLRVPTDIFFQRRYGCRAMMLETVAAVPGMVGGMLLHLRSL

SEQ ID NO: 41846 - protein, 492 aa, Sorghum bicolor
  Clone ID: SORBI-28MAY03-C12466_1.pep
KLQMLWMSGMNLTGGIPDNLSSLTELTLLALSDNKLDGKIPGWIWKLQKLQILYLYANSFTGAIGPEITAVSLQEIDLSTNWLSGSIPESIGKLSNLWLLYLYFNNLTGRIPSSVGRLPNLVDIRLFSNSLSGHLPPELGKYSPLGNFEVSNNLLSGELPDTLCFNKNLYDIVVFNNNFSGPVPAVLGDCVTVNNIMVYNNNFTGEFPEKVWSAFPNLTTVKIQSARGPGSLPCLIASAIPRLVWANSRCAAAVPSSAPGLLACAPGNNLFSGPLPENMSGLANLSELKLAGNRISGSIPPCIRSLEHLNYLNFSSNQISGPLPAEIGSLPVLTILDLSNNELTGEIPQELNNLRLSFLNLSSNQLTGELPQSLQSPAFEDSFLGNHGLCAAASPNINIPACRYRRHSQMSTGLVILFSVLAGAVLIGAVIGCFIVRRKKQQGRDVTSWKMMPFRTLDFSECDVLTNLRDEDVIGSGGSGKVYRVHLPGRGR

SEQ ID NO: 41847 - protein, 229 aa, Sorghum bicolor
  Clone ID: SORBI-28MAY03-C78289_1.pep
MALARQRPRPRPRLLLFFSAALVFFLLFAAHQAAAAQVGDACSSSSSSGGGCGSGLHCSACGGSSGGDSSICTRASPVDPATHGTGLPFNNYSWLTTHNSFALAGAESATGNPLITETNQEDNVTAQLKNGVRGLMLDTYDFDNDVWLCHSFQGKCYNFTAFQPAINVFKEIQTFLDANPSEVVTIFLEDYTATGSLPKVFNASGLMKYWFPVSKMPKSGGNWPLLKDM

SEQ ID NO: 41848 - protein, 262 aa, Sorghum bicolor
  Clone ID: SORBI-28MAY03-C7849_1.pep
HEARILEAEKNSALSSDLTARGLASEGRSPPRIGIVGHMTRIANKLLQLANTNIMVQSHLQQNSDWIEWHASTLTKRNALENVYQWACGRPTSLQDRGRDSDDEDFRDRDYDVAALASNLSQAFKYGIYSNEDIDEAQASLEPHPEDVYFDDESAEVVISSLRLGDEQESGSLFTNSNWFAFDEDKPLNDGLVSSEASPSPNSEMSALKEDDENDEVILGEEVMDDTKGSEPPLPVPNKDANEESGHTGLANGTIDTLEDDI

SEQ ID NO: 41849 - protein, 324 aa, Sorghum bicolor
  unsure (1)..(324): unsure at all Xaa locations
  Clone ID: SORBI-28MAY03-C78500_1.pep
MPTSAAASATAAWATLSSVNPRRSSSALRLPPSLRRSLPSRLSSSSPSRSPLVPVSAMASPAAAASGETASRKKLIIFDAEEDLAASLAKYTAELSAKFAAERGAFTVVLSGGSLVKALRKLAEPPYLEAVDWSKWHVXWVDERVVPKDHADSNYKLASDEFLSKVPIPADQVYAINDALSSEGAAEDYETRLKQLVKDGVIETSTVSGFPKFDLMLMGMGPDGHIASLFPGHPVVNENQKWVTFVKDSPKPPPERITFTFPVINSSAHIALVVTGAGKAGAVHKALSGGQKTSDLLPVEMVSLQDGELIWFTDKPAVSMLSSI

SEQ ID NO: 41850 - protein, 138 aa, Sorghum bicolor
  Clone ID: SORBI-28MAY03-C78504_1.pep
EDGGRRSRNRSRSRSLGELLHCAETPPFLTPRTSPSPLHTASMDNSYNPLFESPAASPGPGAAPAVSPPPKFQFLRDAEEKLYRRALAEEEAMRARRSPRSPAATAEEDGGYITIVVAKNNRAIPMPSPPACAAAGGH

SEQ ID NO: 41851 - protein, 278 aa, Sorghum bicolor
  Clone ID: SORBI-28MAY03-C78550_1.pep
MDPCPFVRVLVGNLALRMPVAPPAAGAGAGVHPSTSPCYCKIRLGKMPVQSVPAPLVVSDGGEQTPASGALAAAFHLSKADLEWFNGKPSLFSSRGEASLKVSVYAGRKGSTCGVSSGRLLGKATIPLDLKGAEAKPAVLHSGWISIGKRAGKGNPAATELSLTVRAEPDPRFVFEFDGEPECSPQVLQVGSAMKQPMFTCKFGCRSNSDLRRPGMQPERDAGASAKERKGWSVTVHDLKGSPVAMASMVTPFVPSPGTDRVSRSNPGAWLILRPAGD

SEQ ID NO: 41852 - protein, 154 aa, Sorghum bicolor
  Clone ID: SORBI-28MAY03-C75254_1.pep
SFANTNVVSGQGSAQAINQTTDALTTVTGGAASASAQQQVHQSFPLYIFLGGDGSGTSSQRLMRRVEIGFDETRSKGGGGGGGGAATSTLRNAQAAAAEVTLRDDPVVGASWRMHQTYAYGASDGGCYLRNVSSVGYDVLFDHHDASCAGTLGR

SEQ ID NO: 41853 - protein, 336 aa, Sorghum bicolor
  Clone ID: SORBI-28MAY03-C75338_1.pep
MPTASSAHRSLLLCLCVALLSNSAAALPSPRDLRFSVEDIAAVEAALPRHSRRTSSKTTFFEVDRPLRPPRGSSGPCSTLLLSHSFAFTLTKPPVTATYSPPPCLASGASSVSLAVLEWRAECRGAQYDRTFGVWLGGAELLRGSTAEPRPGGVVWSVSKDVTRYAALLAAGDATLAVYLGNLIDDTYNGVYHANLTLHLYFRSGARSSPPSAAADAVVPVSRSLPLNDGLWFVVQNATDVQSARVTVPRNAYRAVLEVYVSSHDADEFWYMNTPEQNGPFREVTVLLDGDVVGAVWPFPVIYTGGINPLIWRPITSIGSFNMPTYDIELTPFLGK

SEQ ID NO: 41854 - protein, 297 aa, Sorghum bicolor
  Clone ID: SORBI-28MAY03-C7541_1.pep
TRLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICRLFDLDTEKVIRFVENRPFNDQRYFLDDQKLKRLGWAERTPWEEGLKKTIEWYTTNPDYWGDVTGALLPHPRMLMTPGVERHNWTEEIKSLTSSPAEASTTAPATSTKRATDAPQKPLFKFLIYGRTGWIGGLLGKICEKQGIPYEYGKGRLEERSQLLEDIRNVKPTHVFNAAGVTGRPNVDWCETHKQDTIRTKC

SEQ ID NO: 41855 - protein, 117 aa, Sorghum bicolor
  Clone ID: SORBI-28MAY03-C75974_1.pep
MSMPEAGQAAERDEQQQAQVIKALMQGICAVRYRKADNTPCPIAQGLYLGSVGAAFNKEALKSLNITHILIVARSLDPVFPAEFNYKKIEVLDSPDTDLLKHSDECFSFIDEAISSG

SEQ ID NO: 41856 - protein, 128 aa, Sorghum bicolor
  Clone ID: SORBI-28MAY03-C75790_1.pep
REDRLHRLQKGVAARRDRDQKKLESILLAEKEAIFGSKPSPKRTSSLSRKTNGYRPNGNTNGLKTPTPRRSSLGSATPELLTPRSYSGHNRYFGDLSRLSTSHLNFGDDSLSTFTSISGSEPESPSIG

SEQ ID NO: 41857 - protein, 214 aa, Sorghum bicolor
  Clone ID: SORBI-28MAY03-C7603_1.pep
MGHPYAPAELDLPGFVPLKLSQAEILVSYLGASLFVLLAVWLVSGRCGRLSKTDRLLMCWWAFTGLTHIMIEGPFVFTPDFFKKENPNFFDEVWKEYSKGDSRYLARDAATVTVEGITAVLEGPASLLAVYAIGSRKPFSHILQFAVCLGQLYGCLVYFITAYLDGFNFWVGPFYFWAYFIGANSFWIWIPMLIAIRSWKEICAAFQAEKVKTN

SEQ ID NO: 41858 - protein, 131 aa, Sorghum bicolor
  Clone ID: SORBI-28MAY03-C80410_1.pep
CLKGWLASAEALLVRVPIVRLTPPPTSWEIAASGYPEKGDVARAYELTKNALYMYAPNSGWVPEPSMIETMPKYPRAVWAPKAGGALRPPLIVAVPMYPGIAGAVSGARAREERKGEGAREALREDLIAWP

SEQ ID NO: 41859 - protein, 173 aa, Sorghum bicolor
  Clone ID: SORBI-28MAY03-C80492_1.pep
MDVAGDGGGGRRPNFPLQLLEKKEEQPCSSSAAVGTSAGGNGNGSGAGGEMQVRKAAPKRSSTKDRHTKVEGRGRRIRMPALCAARVFQLTRELGHKTDGETIEWLLQQAEPAVIAATGTGTIPANFTSLNISLRSSGSSFSAPGHLRAALPSPAAAARFGRADAWDRVVGLG

SEQ ID NO: 41860 - protein, 97 aa, Sorghum bicolor
  Clone ID: SORBI-28MAY03-C80812_1.pep
YSRSDITALAKDKVYTHVRLDEMTIHQALQLGQDANTPFGFFNGQRCQMCLRSDPLLKVMERLANPGVRRVFIVEAGSKRVEGIISLSDIFKFLLSL

SEQ ID NO: 41861 - protein, 288 aa, Sorghum bicolor
  Clone ID: SORBI-28MAY03-C8105_1.pep
ARGGRQLFSDGDESERNRYRRHQSLDVSPANSNLSEPTKIVVLKPGLSNSHDSRIARSSLSSAEDSEDESMMTVDETVCSRRLAARGTWQMRMRLKDKQDEESMLSREYPDFYIGDDSFGKSEVEIAKEMSGETSEELEFGTPTSGRSWDFLSRSGSPYSASCSSQASHRREPSVVREGKKKILERWSMVSSTVSGEEEMEGRRSTGTLGDMLTIPKVKDQEEIGAETLGSPALELEPEESFSCLPRSRSLPLSLSYGVAESNGLASGTQEAEKERIRKSSSFRGKSF

SEQ ID NO: 41862 - protein, 116 aa, Sorghum bicolor
  Clone ID: SORBI-28MAY03-C81449_1.pep
ATTAPVSPERSPASSSVTESSSMTEQEQEQGNTGSSAGGFPIKEESFTSSASDAEEFQFDDTFWSETLSMPLESFDVPMEPYDALGASSVGADGDLDYWLGVFMESGDVHQELPQI

SEQ ID NO: 41863 - protein, 188 aa, Sorghum bicolor
  Clone ID: SORBI-28MAY03-C77549_1.pep
ARGSTGTRIRQSPDAFVDDLIFHLRDQLTRLHTLDARKFVVANVGPLGCIPYQKTINRVGEDECVKLPNQLAAQYNARLRELIVELNGNLPGARFCLANVYDLVMELITNYPNYGFETASVACCGNGGSYDGLVPCGPTTSLCDDRDKHVFWDPYHPSEAANVLLAKYIVDGDTKYISPINLRKLYSL

SEQ ID NO: 41864 - protein, 163 aa, Sorghum bicolor
  Clone ID: SORBI-28MAY03-C77651_1.pep
SQVCQTSQLDESKASVGGMMSFSGAPAGGFHNEANPDDSFMSLMLKAQRAGETDGSGFLHDAVAHHSDESARFMAYHMAEFGRYGNNNVSLTLGLQHAENSLSVPPNTQPGFPGVRDQDIYNATAPLNVASTSSEYDSASQIDQQQQQRQRFEPSPLMHDFVA

SEQ ID NO: 41865 - protein, 276 aa, Sorghum bicolor
  Clone ID: SORBI-28MAY03-C77744_1.pep
TRPNSYQGDDNRMKNMQSEASQAIRNSKYLKAAQELLDEIVSVWKSVKQKTDKGPAEAGKADGKETDGGTKSDGVSSDPQESGANAAAELSTAEKQELQNRMAKLMAMLDEVDRKYKHYYHQMQLVMSSFDMVAGSGAAKPYTAVALQTISRHFRCLKDAINDQISVIRKKLGEDDTTSGKEGKLTRLRYIDQQIRQQRAFQQYGMLQQNAWRPQRGLPENSVSILRAWLFEHFLHPYPKDSEKIMLSRQTGLTRSQISNWFINARVRLWKPMIED

SEQ ID NO: 41866 - protein, 140 aa, Sorghum bicolor
  Clone ID: SORBI-28MAY03-C7791_1.pep
LSPSIETLDNIRNFDRVQEVPHEGPMCDLVWSDPDDRCGWGISPRGAGYTFGQDISEQFNHTNSLRLIARAHQLVMEGFNWAHEQKVVTIFSAPNYCYRCGNMASILEVDDCREHTFIQFEPAPRRGEPDVTRRTPDYFL

SEQ ID NO: 41867 - protein, 114 aa, Sorghum bicolor
  Clone ID: SORBI-28MAY03-C77941_1.pep
KVRGFTFDISSGAMESLELDSFGLSIVPSSLVSTYCLFVEDVLDIVSDTIVVHEDAVSRVQRLTQGILGTQNIHGPGGEIDEYSRIGGGEEEESKRPGKVRWPRTPQGSEAPGG

SEQ ID NO: 41868 - protein, 307 aa, Sorghum bicolor
  Clone ID: SORBI-28MAY03-C82253_1.pep
MQRALLLRPLVGSPLVPAGPLAQPAVRRRCRFHGGVRVRSSTGEDGSEPGGGSGGGGAAASWLSSAVGEKVDELLRREENRALLEGVEDAERRVERARAALADIERQEAAARFARDEVRRLEKRRDEIAESQRELLQAREMIDEAQRSLSSSLEEGSFGDMSSGDVDQDSERIESVKAAAISSIVGVLASLPISFYEVEDLPQLFLRSSIVFICCALFGVTFRYAVRRDLDNIQLKTGAPAAFAFVRGLALLESGRTLELSTDTLISVTLDGAVSVVENIFIFLPAAVALDYCFKMRFLSPFPRRKQ

SEQ ID NO: 41869 - protein, 114 aa, Sorghum bicolor
  Clone ID: SORBI-28MAY03-C82312_1.pep
IVQICHGNDEFGESFVEVKVSEADLSRNPVRLTEIESLDGDCIFMSPSSSKSFRCHYGGGGGEGDLIYIFLGPSRLVYNMKDGTMAPFAADIPEDKLREADGKPMNPVWLFPYE

SEQ ID NO: 41870 - protein, 164 aa, Sorghum bicolor
  Clone ID: SORBI-28MAY03-C8237_1.pep
ARGGTSKWLRSFDQRVRESIDYAICLNSVGSWSSDLWMHVSKPPENPYIKQIFEEFSDVSKEMGVSVGIKHKKINVSNPRVAWEHEQFSRFRVTALTLSEMSTPPEFLESTGGLHDTRESTDVESVTRTVRLVSESLARHIYGLKGRNIDVFAENSSLAVILTI

SEQ ID NO: 41871 - protein, 206 aa, Sorghum bicolor
  Clone ID: SORBI-28MAY03-C82675_1.pep
MSTSRRRTLLKVIVLGDSGVGKTSLMNQYVHKKFSQQYKATIGADFVTKEVLIEDRLVTLQIWDTAGQERFQSLGVAFYRGADCCVLVYDVNSNRSFDTLNTWHDEFLNQASPSDPKTFPFILLGNKIDVDGGKSRVVSDKKAMEWCASKGNIPYFETSAKEDYNVDNAFLTVAKLALEHERDQDIYFQSVTDPVPETEQRSGCAC

SEQ ID NO: 41872 - protein, 284 aa, Sorghum bicolor
  Clone ID: SORBI-28MAY03-C8274_1.pep
MLAASARRLSAAASSSSSSMRASQLAAARNPQRWMHDRNKKAMELVAKGWSALQEVDRVIDYADRNDKRLIPLLRGAKENFELALEIDNDNTHARYWLGKMHFKYHVPGACKAVGAALLVEAANMGDPDAQYELGCRLRIENDYVQSDQQAFHYIEQAVDQLHPGALYLLGAVYLTGDCVKRDIASALWCFHRASEKGHAGAAVAYGSLLLKGAEIPEVITRFNSGKSPSTGKMRKRPLQQDPIKLAKEQFQIAAEAGCDLGLRWLKRLEDYETQEEKLKQIQH

SEQ ID NO: 41873 - protein, 265 aa, Sorghum bicolor
  Clone ID: SORBI-28MAY03-C7893_1.pep
MADAYWRYAAADPRQQQQQQPQPPSAGGGIGHPGMGGGAPQMAPAVGQQQQQPMKRPRPADFSDVPGAPDMTGYYPRDEERAGYRPARDTEALNASYERFLRTGQIQSFGGGPAGEPIRPAVGGNAGYPVDDRSMMAARGMDSRNIGFGGGMPEPPLPPDASNTLYIEGIPTGCTRREVSHIFRPFVGFREVRLVNKEPKHPGGDPIVLCFVDFAEPTQSAIAMEALQGYKFDEHDRNSPNLRLQFARFTGPRGNSGPGGGRGRR

SEQ ID NO: 41874 - protein, 370 aa, Sorghum bicolor
  Clone ID: SORBI-28MAY03-C790_1.pep
GFKMSKSVGNVVDPEKIIVGGKNQREEPGYGADVLRLWVSSVDYSTDVLIGPQILRQMSDMYRKLRGTMRFLLSNLHDWKPDNSVPYNDLPKIDKYALFQLETVMASMKDSYESYQFYKVYQMLQRFATVGLSNFYLDVAKDRLYVGGRVSFTRKSCVLVLMAHLLYLVRAISPIMPHLAEDVWQNLPFQYTLQDGSPANFVFDLKWPEKNEEWLSAPKDDVDFLGVILELRSEVNKILENARTGKLIGSSLDAKVYLHTESSDTVLKLKELSSASNDADALHRLFITSQVDVLPILNEEITSSVPYTGKFSNPHTGDIWIGVTRADGAKCERCWNYTQDVGSFHDHPTLCGRCYGVIDLQPQPAAAAVS

SEQ ID NO: 41875 - protein, 216 aa, Sorghum bicolor
  Clone ID: SORBI-28MAY03-C7923_1.pep
MGVEENGSSPSPADAAAAVTVTGARTVAPAKNRCTLATFDLPYITFYYNQKLLLYRTTAAPDFLPFPDAVARMTAALADALRVFYPLAGRIVVQREEDDDGGGGAGPGALAVEGDDGAEVFEAEALGVAVDDLAGGDCTDEAEKVMQQLVPYTGVMNLEGLRRPLLAVQFTKLKDGLAVGCAFNHAVLDGTSTWHFMSSWAELCRGAPLSLQPIHD

SEQ ID NO: 41876 - protein, 233 aa, Sorghum bicolor
  Clone ID: SORBI-28MAY03-C79243_1.pep
RRRRCSSPVALPPHPSRSPHGMGTPRPPPRCPPHIRLCLARAPLLPAPLCFVAARGGPSRIPPRLLPISASVGAPSSWTYDCTHTLVVHYYCTTALHYFLHLPNYILHFLRKCGAQQVFGLSSWKLVLHNLVDVLLGFHFLLCAPTLVLYLKHKLLYIARGGPCRSARDGEAALPGAVPAGALAGVRGGGGGRRALVRGSWAAAAALPCRPERGGHGPSRWDVQYWRLLPQRP

SEQ ID NO: 41877 - protein, 147 aa, Sorghum bicolor
  Clone ID: SORBI-28MAY03-C80403_1.pep
SNRTRRPQGTKHSEYPDCHGAMGRAYPDMQHYWNNAEMKSIRMKHVNFVKISTGNGRSRGKRPDELIEFYLVIKIRDWLQQLPLQTTALLPIVSGQDDDYRFHLPARVIDSGEPAERDGEVLQTRCMPPSATQSLHRVCRTAVNTKP

SEQ ID NO: 41878 - protein, 184 aa, Sorghum bicolor
  Clone ID: SORBI-28MAY03-C84572_1.pep
MEGLSIDPKWLIDPKLLFVGPRIGEGAHAKVYEGKYKNQSVAIKIVHKGDTPEEMTKREGRFLREVTMLSSVQHKNLVKFIGACLEPVMVVVTELLVGGSLRKYLVSLRPRSLETHVAVGFALDIARAMECLHAHGIIHRDLKPENLLLTADQRTVKLVDLGLAREETLTEMMTAETGTYRWMA

SEQ ID NO: 41879 - protein, 148 aa, Sorghum bicolor
  Clone ID: SORBI-28MAY03-C8464_1.pep
MASKRIQKELMDLQKDPPTSCSAGPAGEDLFHWQATIMGPSDSPYAGGVFFVNIHFPPDYPFKPPKVNFQTKVYHPNINSNGSICLDILKEQWSPALTISKVLLSISSLLTDPNPDDPLVPEIAHMYKNQRQRYEETARAWTQKYAMG

SEQ ID NO: 41880 - protein, 188 aa, Sorghum bicolor
  Clone ID: SORBI-28MAY03-C8465_1.pep
MAPLVPMSQPWVEKYRPRQVKDVAHQEEVIRVLTNTLQTADLPHMLFYGPPGTGKTTTALAIAYQLYGPELYKSRVLELNASDDRGINVVRTKIKDFAAVAVGTARKAGYPCPPYKIIILDEADSMTEDAQNALRRTMETYSKVTRFFFICNYISRIIEPLASRCAKFRFKPLSEEVMSSRIMHICNE

SEQ ID NO: 41881 - protein, 180 aa, Sorghum bicolor
  Clone ID: SORBI-28MAY03-C84898_1.pep
MAAVAESLSVSVSGSSFLDLRAAAPFLVAAVAFYFLVEQLSYHRKKGPLPGPSLVVPFLGSVAHMIRDPTGFWDAQAARAKRSGVGLAADFLVGRFVVFIRDTELSHRVFANVRPDAFHLIGHPFGKKLFGDHNLIYMFGEDHKDLRRRIAPNFTPRALSTYAALQQRVILAHLRRWLDR

SEQ ID NO: 41882 - protein, 344 aa, Sorghum bicolor
  unsure (1)..(344): unsure at all Xaa locations
  Clone ID: SORBI-28MAY03-C8501_1.pep
ARGPLVIVCNKTDLQPLEGLSEDDMKLVMEMNAEAMKTITQAGGPNGAGVLLTMSTLTDDGVMAVKNAACERLLEQRVDVKMKSKKMMDCVNRFHVAVPKPRDNKERPVCIPQAVLEARANAAAKEKKKLEKDIENENGGAGVYSASLKKHYILANDEWKEDILPEILDGHNVADFLDPDILVRCEELEREEGLRLEEQAAEDAFQIDGHELTQEQKEILAQIRKKKALLIQEHRMKKRTAESRPIVPRKFDKDRKFTTDRMGRQLSSMGVDPSAAMNRARSKSRGRKRERSLSRAAADGDSMEIDGQQSNKKLRRTSRSRSRSRGSXEVIPGEGFKDSEQKKK

SEQ ID NO: 41883 - protein, 113 aa, Sorghum bicolor
  Clone ID: SORBI-28MAY03-C8148_1.pep
MAAAAAGGGLSGDVPIFHAENLVSNVKSINYSRTFLSIISGVVAGIWGFTGLMGFVFYFLVMMVASLMLLVKAKVSVHTYFDSWNRIIIEGVLGGLMSFVLFWTFAYDIVHIF

SEQ ID NO: 41884 - protein, 197 aa, Sorghum bicolor
  unsure (1)..(197): unsure at all Xaa locations
  Clone ID: SORBI-28MAY03-C81710_1.pep
MAFQHRRRRPWRLLAVPVAAAALLLLSQLTAAATAGGGPGDVAVYWGRHKDEGTLREACNTSAYTTVIISFLSAFGHGTYTLDLSGHPVAAVGDDIDYCKSMGKLVLLSIGGQGGEYWLPSAQSATDVADYLWYAFLAGNSXRSGSGAAVARPFGGAQVDGIDFFIDQGAAEHYDVLARRLYGYNRYYRGGGITLTA

SEQ ID NO: 41885 - protein, 139 aa, Sorghum bicolor
  Clone ID: SORBI-28MAY03-C818_1.pep
VVATSEVSISLTLDPSKLWSRELIQQELDHVVEELEKFSVVHLLQRRSIISLIGNVQRSSLVLEKARNVLRRNGVNVQMISQGASKVNISLVVNDSEAKQCVQALHSAFFENGFLSEVEGADVPQNGSSLNSNGAIYAN

SEQ ID NO: 41886 - protein, 125 aa, Sorghum bicolor
  Clone ID: SORBI-28MAY03-C81927_1.pep
VTDELLKQTFSPYGELPRGKIPVGKRCGFVQYSNRASAEEAIRMLNGSQLGGQSIRLSWGRSPANKQPQQEQNQWSGGGYYGYPQGYDPYGYARPPQDPAMYAYTPYPGYGNYQQQPPQQPPPQQ

SEQ ID NO: 41887 - protein, 350 aa, Sorghum bicolor
  Clone ID: SORBI-28MAY03-C8194_1.pep
TRRSLRSLGANQVHPKNWYPIPLIFCRPWGKLPENVPCHPKLRVFANCMKKKGRGMFIFVSIIDGDYHELAEDAKTACHQLDAYIDYKRCEGVAEIIVAPTMSDGFRSIVQTMGLGNLKPNIVVMRYPEIWRRENLTQIPSTFVSIINDCIIANKAVVIVKGLDEWPNEYQRQYGTIDLYWIVRDGGLMLLLSQLLLTKESFESCKIQVFCISEEDTDAEELKADVKKFLYDLRMQAEVIVVTMKSWESHMESSSSGAQQDNSHEAYTSAQQRIRTYLDEMKETAQRERQPLMENGRQVVVNEQKVDKLLYTMFKLNSTILRYSRMAAVVLVSLPTPPLNHPSYFYMEYM

SEQ ID NO: 41888 - protein, 162 aa, Sorghum bicolor
  Clone ID: SORBI-28MAY03-C82211_1.pep
PSIVFIDEIDAVGTKRYDAHSGGEREIQRTMLELLNQLDGFDSRGDVKVILATNRIESLDPALLRPGRIDRKIEFPLPDIKTRRRIFQIHTAKMTLADDVNLEEFVMTKDEFSGADIKAICTEAGLLALRERRMKVTHADFKKAKEKVMYKKKEGVPDGLYM

SEQ ID NO: 41889 - protein, 202 aa, Sorghum bicolor
  Clone ID: SORBI-28MAY03-C8700_1.pep
MYADAGFGFAAAYSPALASSQPQPPPPFDYAFSSAPVPALTMPAMDHDAFAAASAHLGSLVQPSMVSEYDLGGEGDLFKAPEAIIEEPLLSLDPVAAAFSMMTGNESAMDQTIKDAGIGTIPNDPLLSEVLYECEKELMEKSAIEETISELMDVKIPMLQVEEIPSQAEQVLIQTQLPAMEKEKQSIPECSLQKSVSSGCLN

SEQ ID NO: 41890 - protein, 218 aa, Sorghum bicolor
  Clone ID: SORBI-28MAY03-C8723_1.pep
IQMCEQAAEAQKSKGSLGRRGRTSSDPSGNSRDSISVDAILSKNLSTSVLSAESSSKVYLINCLSAIQEPLMGQEVATSYVNNLRSMIEAHICALVDKEVDSILRKCGLSNKMPYIKEYGSKADAKPLADIIETSPQMLLECLKAFYGIVTGTEGSLPEFEQLQVPRLRSDACYGLARALAESYELIYSAVMDPNNSYPDPRSLVKHSPEQIRTILEI

SEQ ID NO: 41891 - protein, 378 aa, Sorghum bicolor
  Clone ID: SORBI-28MAY03-C8765_1.pep
MARGLRGVRDDLSELGRHLLDIACFLHPLLNPAHTDSPPPTPTGPGPRHRRARRSPSPHPPSSPSLLAGILSDLAEIGGSFRGGFSGAAAAAPSSPPPPAAVESQQAAASPPSPAAAADQIAVDVVGAARALAARPEAWIDFPVLALDEDSVISDIQRDHMESIEKLVPDLASLRGRLCPSYMDEDIFWKIYFRLLESNIIEHSSEEDTQSVPNSVHHNNEIESDSPPHVCEIESVKSNQEGYQSHEGRALPKTRSERSIDQWVFAKSKSEESMDQWSEIPSDVESFREGKRYLSSEELSDVDSANVVVMDKYMDSLLSDRRHLPYASSSVRQDSVRRKPASSTDYSHRPPQPTPPASLSKKESWDVIEDSEFDILDS

SEQ ID NO: 41892 - protein, 178 aa, Sorghum bicolor
  Clone ID: SORBI-28MAY03-C87747_1.pep
MLPLLPLFAVSLFPGLWSPSSRPARMTTMRPAILLTICTLSALLLVARGLEKPSVAPVVAVGVAAASDLIRSGGHRYLDVRTEEEFRNGHVEDSLNVPYLFFTSQGREKNPRFVAQVAADFDKEDNIVVGCKSGVRSELACADLMAAGFRNVKNFERGYTAWVGIGLAGTKSQGQDEL

SEQ ID NO: 41893 - protein, 225 aa, Sorghum bicolor
  unsure (1)..(225): unsure at all Xaa locations
  Clone ID: SORBI-28MAY03-C881_1.pep
MEIGQYPVSSCSKEHQKIYQEWFALADADGDGRITGPDAIKFFGMSKLSRPDLKQVWAISDTRRQGYLGFPEFVTAMQLVSLAQAGNEITQDSLKRDDLISLNPPVMEGLDALLAKSKHLVKRVDPEMDGYPQEQSTLTNKWFSSKSSKKIPLTAVTSVIDGLKKLYIEKLKPLEVTYKFNDFVSPLLTSSDFDAKPMVMLLGQYSTGKTTFIKHLLGGGYPXXH

SEQ ID NO: 41894 - protein, 187 aa, Sorghum bicolor
  Clone ID: SORBI-28MAY03-C8391_1.pep
MATIQHKPAPTAPSTTTGGGLRAMDLYEKLEKVGEGTYGKVYKAREKATGRIVALKKTRLPEDDEGVPPTALREVSLLRMLSQDPHVVRLLDLKQGVNKEGQTILYLVFEYMDTDLKKFIRGYRANHEKIPAQTVKILMYQLCKGVAFVHGRGVLHRDLKPHNLLMDRKTMALKIADLGLSRAITVP

SEQ ID NO: 41895 - protein, 270 aa, Sorghum bicolor
  Clone ID: SORBI-28MAY03-C8412_1.pep
MFRNQYDTDVTTWSPQGRLFQVEYAMEAVKQGSACVGLCSRTHAVLAAVNKPASELSSYQRKVFRVAEHAGVALAGLTADGRVLSRFLRNECINHSFVYEAPLPISRLALKLADKAQVCTQRSWKRPYGVGLLVAGLDESGAHLYYNCPSGNYFEYQAFAIGSRSQAAKTFLERRFQGYKDYTPEQLIKDALSAIKETLQGEKLSSSNCTVAIVGRKDDGTIEPFEMIGAARIQELIDSMEVAEEAPVEASSSMQEEERGSEDAAAPMDI

SEQ ID NO: 41896 - protein, 134 aa, Sorghum bicolor
  Clone ID: SORBI-28MAY03-C8439_1.pep
MAPSLLAAVSASPFLLAGSGSSRRPLGAAPIRRAGLRVAALKYDPAKVAPQNDRVLVRIQQIPEKSAGGVLLPKSAVKFERYLMGEILSVGADVSEVEAGKKVLFSDIDAYEVDLGTDEKHCFCRESDLLALVE

SEQ ID NO: 41897 - protein, 140 aa, Sorghum bicolor
  Clone ID: SORBI-28MAY03-C84477_1.pep
IRHSDDHLHMHYVLEPPTPKTEMPGGGVAHSLQPPQQPKKRSPCSRLTRGHGERAKRHNLCRILPCGAPKACETVEAPTVSSFVRVSPVLRSAPHKASHHSTSVAMAGVGRQRRQKALAGSTRRHRGRGQEAPIEPLCRR

SEQ ID NO: 41898 - protein, 240 aa, Sorghum bicolor
  unsure (1)..(240): unsure at all Xaa locations
  Clone ID: SORBI-28MAY03-C832_1.pep
MGKDGTKYAVVDAFTAEPFKGNPAAVCLLEDASKAADERWMQSVAAEFNLSETAFLLRDDSSAAGAVPRFQLRWFTPATEVDLCGHATLASAHFLFTSVFAEHEALIEFSTKSGILTAKRVPAPESTGVSGEGKLFIELDFPVIDLVDCHPSELPSIPETLNGASIISVHKSTGDLIVVELSSGKEVADITPNIHXIKMCSGSGIIVTGPAAAGSGYDFFTRFFCPXFGIDEDPVCGSAH

SEQ ID NO: 41899 - protein, 147 aa, Sorghum bicolor
  Clone ID: SORBI-28MAY03-C90081_1.pep
MGGQWVEEGMPPSNLQCFLDCTTPTVETHILPKTNGRSPTDAWHHAEMDSVEYFNLADLWEQYYEWSAYGAGATVQLPGGDRVVQYYVPYLSGMQLYTNKALTASRSFGEDNGMDLWSDDEDNEKMSRSWSSTSDESLFNCDVLWSN

SEQ ID NO: 41900 - protein, 152 aa, Sorghum bicolor
  Clone ID: SORBI-28MAY03-C9132_1.pep
SLGVEENCDSAALATEICDAASHMTDLAVPQSDEDLHQDQHLEDHPEMEETILMVEPKCEEGDGSSFVLPPSPPELMLEEQDDPGLVALGTESCTGQQSLEVGEAEDQENPSTAEHGVMIVKHTGEENNNCNGVYSSCPPSSAIVDPIQIEQ

SEQ ID NO: 41901 - protein, 176 aa, Sorghum bicolor
  Clone ID: SORBI-28MAY03-C9077_1.pep
MNMEQQIKHSHLPIRGLSLHVAQAGKGELGTVVFLHGFPEIWYSWRHQMLAVAAAGYRAVAPDWRGYGLSDQPPEAEAASYDDLVEDLLAILDALSIPKAFLVAKDFGAMPAYDFALRHPSRTCGVMCLGIPFLHGGSSFTSLPEGFYILRWRGVLVPVGYIYNHLCQIEQSDRKQ

SEQ ID NO: 41902 - protein, 88 aa, Sorghum bicolor
  unsure (1)..(88): unsure at all Xaa locations
  Clone ID: LIB3478-024-P1-K1-F2.pep
AGEAAMAHQEIEHTQLPVRGINLHVAQVGKGDLXTVVFLHGFPEIWYSWRHQMLAVAAAXYLAVAPDWRGYWLSDQPSVNEEDSWVWD

SEQ ID NO: 41903 - protein, 224 aa, Sorghum bicolor
  Clone ID: SORBI-28MAY03-C91574_1.pep
MSASVGRTRVGRYERGRSRGEGTFAKGTCARNVETGENVAIKILDKEKVLKHKMIAQIKREISTMKLIRHPNVIRMYEVMASKTKIYIVMELVTGGELFDKIASRGRLKEDDARKYFQQLINAVDYCHSRGVYHRDLKPENLLLDASGTLKVSDFGLTALSQHVREAGLPHSTCGTPICVAPEVINNKGYDGAKADLWSCGVILFVLMAGYLPFEDSNLMSLYK

SEQ ID NO: 41904 - protein, 298 aa, Sorghum bicolor
  Clone ID: SORBI-28MAY03-C92242_1.pep
METLLSPSTLFTPSLRGSRRPSLTASVSSRSTVVVSCALRRPQAAGAAVAATTSSSNGDGGIDVVGRSWMSFLHHGLAAAALSLAISLAPAPAPAVASEFDVLNDGPPVDSYVVDDAGVLSRVTKSDVKRLARDLEARKNIRLNFITVRKLTSKADAFEYADQVLEKWYPTIEEGNNKGIVVLVTSQKEGAVTGGPAFIQAVGDQILDATVSENLPVLATDEKYNEAIFSTARRLAAAIEGLPDTGGPSFKENKRESNFKTKEETEEKRGQFTLVVGGLLVIAFVVPMAQYYAYISKK

SEQ ID NO: 41905 - protein, 239 aa, Sorghum bicolor
  Clone ID: SORBI-28MAY03-C85451_1.pep
MTTRSNGDGHGHGGAGSWYPQRRPHYGYGGGSASFRGCCCCLFLLLTFLALLALAVALVVVLVVKPRKPQFDLNQVSVQYLLVASPTSPAASSPAGVPPAAPGAAYLSLNITLLFTAENPNKVGIRYGATAFDVMYHGVPLGVAAVPGFEQPAHSTRLLQTRVIVDRFNVLQTDAQDLIRDAAINDRVELRITGDVGAKILVLGFSSPKVQVSVDCAIAISPRSQSLKYKQCGVDGLSV

SEQ ID NO: 41906 - protein, 261 aa, Sorghum bicolor
  Clone ID: SORBI-28MAY03-C8549_1.pep
MWSFASNAIAGSLKKKGQPSKCSISNPDCSDDEVSSCTSREEGLDCPICWESFNLVENVPYVLWCGHTMCKNCILGLHWAVVKFPSLPIQLPLFISCPWCNLLSFRLVYKGNLRFPRKNYFLLWMVESMNGERAKFHSSNHEEHHSSWHSSAGTNSSHQHRRNATVRSESSSARETSVVGNIFHTDNISASLQKLMVCFMQLTAKFPLVIIFLLIVLYAVPASAAVLVLYALVTFLFALPSFLILYFAYPSLDWLVREIFA

SEQ ID NO: 41907 - protein, 120 aa, Sorghum bicolor
  unsure (1)..(120): unsure at all Xaa locations
  Clone ID: SORBI-28MAY03-C85906_1.pep
PPPSPPPSPPPPPKPPPAPPPRPPPPPAPPPKPPPFPPPNPTPSPPPCPRPPPSPTPPPPPPPYPPPPPSPQPPPHXSASPRTAPRRPPQEPPRRPAPETPCSTHPSAPSPCRAKQEFTS

SEQ ID NO: 41908 - protein, 155 aa, Sorghum bicolor
  Clone ID: SORBI-28MAY03-C8601_1.pep
AEKNRKLNDLLDALDFNQVVIFVKSVSRAAELNKLLCECNFPSICIHSGMTQEERLTRYKNFKEGHKRILVATDLVGRGIDIERVNIVVNYDMPDSADTYLHRVGRAGRFGTKGLAITFVSSASDSDVLNQVQERFEVDIKELPEQIDTSTYMPS

SEQ ID NO: 41909 - protein, 203 aa, Sorghum bicolor
  unsure (1)..(203): unsure at all Xaa locations
  Clone ID: SORBI-28MAY03-C86378_1.pep
MAKGTDQEKVQDVKQASAGKGAAGDVPAAGEEQQQLVIKAPVHCDGCGRKLRRSLQRIEGVGEVTVDSRTNTVVVRGGRAVVENATEVVQVVERRTGEKAVLVSPSPEKLPPPPPSAAAKGGETNKKGDANTKDMGEDELLQVNMEMVTVLKMNLHCDACSEEIKRRILKVTGVEEAVPHLKSSQVMVXRGKVEPATLVGFIH

SEQ ID NO: 41910 - protein, 285 aa, Sorghum bicolor
  Clone ID: SORBI-28MAY03-C8696_1.pep
MPQEQGVEEPPPQAEGEAQPAADVPMSEAAAAEDEEEEPVMGEGEGGANGADAAVGSVKASVKPEAEGAEEGDREELNGGPTAPGVGEAVKLENGDGSVTVGGSADEAGAGDGGDDKGLVGQNQPAVNQLVLAPAEEDPALTKISNNSFMFDYTTGGDDSGTEEEQAAFMKELERFHREKMLEFKPPKFYGEGLNCLKLWRQVTGLGGYDQVTSCKLWRQVGESFKPPKTCTTVSWTFRNFYEKALLEYEKHKIETGEFQVASSALPDRIGSESQVGGSNVSGSG

SEQ ID NO: 41911 - protein, 302 aa, Sorghum bicolor
  Clone ID: SORBI-28MAY03-C9378_1.pep
MGREKCSSSRDNKKPDEVKYESDDDMLLQRKDRRKVEFAFLRSLRMMLPVYAPGAVCFLACHIAREAILPNDIYRWAMEGNVPYVAAFTEVDRFLGSSFQDCPLDARQLFRPVRVIGAWQLEAAAGSIAQKVGLRLPSVNFYAIAHRCLKDLLLPIDRILPHACRIYEWAMPAELWLSSNPARVPTRVCVMAILIVALRLLYNINGQGIWEKICEEGRNTSESHHDTNSSTFRKLEASNSEEFGTRELLCAIAAAYDKIIRHMVNLDFIALSTHYVYLVVYMVVRGMLILTVGSLYSTCYIH

SEQ ID NO: 41912 - protein, 221 aa, Sorghum bicolor
  Clone ID: SORBI-28MAY03-C94024_1.pep
DLVIDELDKPNSIMSESIALNLLFLLLFASHETTSMGLTVILKFLTDNPKSLQELTEEHEKIMERRVDPDSDITWEEYKSMKFTSHVIHESLRLANIAPVVFRQANQDVHIKGYTIPEGSKIMICPSAAHLNSKVYEDPLAFNPWRWKDTPEPVGGSKDFMAFGGGLRLCVGAEFAKLQMAMFLHYLVTNYRWKALSKGTMMLYPGLRFPDGFHIQLHKKT

SEQ ID NO: 41913 - protein, 257 aa, Sorghum bicolor
  Clone ID: SORBI-28MAY03-C9381_1.pep
ARGKNPEQRRVPVSIDVPDPDFHDFDKDRTEKTFDSDQVWATYDSEDGMPRLYVMVQKVLSVRPFRIRMSFLNSKSNIELAPINWVASGFQKTCGDFRVGRYQVSETVNIFSHKVNWTKGPRGIIRIVPQKGDTWALYRNWSPDWNELTPDDVIYKYEIVEVIDDFTEEQGLTVIPLLKVAGFKAVFHRHMDPKEVRRIPKEELFRFSHRVPSRLLTGEEGNNAPKGCHELDPAATPVDLLKVITELKEDTMTQTAK

SEQ ID NO: 41914 - protein, 209 aa, Sorghum bicolor
  Clone ID: SORBI-28MAY03-C94782_1.pep
MPPLPAAAMATATLPLRLLPSKTLTLSTLASARRSLSVAAARPRRWRLRAAAEEAPEAVEVEFVEAEEEPAVPEPVEAQLAAAGAGKDADIFAVVMIGSRQYIVMPGRYIYTQRLKGANVNDQIILNKVLLVSTREKAYIGMPVVTNAAVHAVVEEQGRDDKVIVFKYKKKKKYQRKLGHRQPNTRLRITGISGYEEYPADPILDPAAA

SEQ ID NO: 41915 - protein, 143 aa, Sorghum bicolor
  Clone ID: SORBI-28MAY03-C94931_1.pep
CHDDPLQYVRKAKKVVDRKKSSLEVVFTHLAAEVILKIFGLKAARATFHRMISQTTISFSGMIGPVEQVEFCGHPVVFIAPGGYGPPEALTVNFQSYVNTMMVNLAVDEAQFPDSHELLDDFVESLRLIRAAASSLGKNQRND

SEQ ID NO: 41916 - protein, 259 aa, Sorghum bicolor
  Clone ID: SORBI-28MAY03-C9414_1.pep
MSWDDDDDEDGALEALVEQLEEDLENDDLSVDDDDDGISEEDMARFEKELAEAIEGVSGVDESAGDSLMSSGDYGIDEQIDRSERPELKTWQLRRLARALKIGRRKTSIKNLAGELGLDRGLVIEMLRNPPPKLLLMSDSLPDEAPSKSEVKEIEPPSSTTDDEVDTTEIKPELELPVHVMSAEWSARKRLKKVQLETLERVYLRSKRPTNAMISSIVQVTNLPRKTIVKWFEDRREQDGVPDHRVAFKRSLSEIGSIS

SEQ ID NO: 41917 - protein, 117 aa, Sorghum bicolor
  unsure (1)..(117): unsure at all Xaa locations
  Clone ID: LIB3478-001-P1-K1-E10.pep
CSIYSCNECNCDNSNLEENVVAAEDVMDDDDDEDGALEALFKQLEEDLENDDLSVDDDDDGISEEDMARFEKELAEAIEGVSGVDESAGDSLMSSGDYGIDEQIDRSERXELKTWQL

SEQ ID NO: 41918 - protein, 176 aa, Sorghum bicolor
  Clone ID: SORBI-28MAY03-C88228_1.pep
MEVLFGSNNHGGDKAADLASLIIAQAALEVPRLARGFAMILHNEIFTSGDQNLINRILSKSKNETDPENKDDGESDDDNDDDDGDDEDAENQEEDDGGDEGSDDNGNEEEDDDDDDDDDPEANGEGGSDDDDDGGEDEEEDDDDDDGDGDNDEDDEEEEEEEDDDDVPQPPTKKRK

SEQ ID NO: 41919 - protein, 221 aa, Sorghum bicolor
  unsure (1)..(221): unsure at all Xaa locations
  Clone ID: SORBI-28MAY03-C8795_2.pep
TRALYGFDPPRSKEHGGCCSCCFPQRRKIKASAAAPEETRALRMADFDEDEMNMSSFPKKFGNSNFLINSIPIAEFQGRPLADHPGVKNGRPPGALTVPRDLLDASTVAEAISVISCWYEDKTEWGHRVGWIYGSVTEDVVTGYRMHNRGWKSVYCVTKRDAFRGTAPINLTDRLHQVLRWATGSVEIFFSRNNALLASRRMKFLQRIXLPNVGIYPFTSI

SEQ ID NO: 41920 - protein, 278 aa, Sorghum bicolor
  Clone ID: SORBI-28MAY03-C8795_1.pep
QTESSFLILWVVVHDRLHQVLRWATGSVEIFFSRNNALLASRRMKFLQRIAYLNVGIYPFTSIFLIVYCFLPALSLFSGQFIVKTLNVAFLTYLLVITLTLCLLAVLEIKWSGISLEEWWRNEQFWLIGGTSAHLAAVLQGLLKVVAGIEISFTLTSKSGGDDVDDEFADLYIVKWTSLMIPPIVIMMVNLIGIAVGFSRTIYSEIPQWSKLLGGVFFSFWVLAHLYPFAKGLMGRRGRTPTIVFVWAGLLSITISLLWVAINPPSGNQQIGGSFTFP

SEQ ID NO: 41921 - protein, 350 aa, Sorghum bicolor
  unsure (1)..(350): unsure at all Xaa locations
  Clone ID: SORBI-28MAY03-C8852_1.pep
TGIMATMVSRYPQEDWAQEGGDPCLPASWSWVHGGSDASPRIFSITLSGKNITGSIPVELTKLSGLVELRLDGNSFSGQIPDFSECHNLQYIHLENNQLTGELPSSLGDLPNLKELYVQNNKLSGQVPKALFKRSIILNFSGNSGLHIVTNGISHTIIVICGVIGAIVLLGIAIGCYFITCRRKKKSHEDTVVIAAPAKKLGSYFSEVATESAHRFSLSEIEDATDKFERRIGSGGFGIVYYGKLADGREIAVKLLTNDSYQGIREFLNEVTLLSKIHHRHLVTFLGYSQQDGKNILVYEFMHNGTLKEHLRGTDNVKITSWLERLENAEDSAKGIEYXHTGCSRHHHRD

SEQ ID NO: 41922 - protein, 230 aa, Sorghum bicolor
  Clone ID: SORBI-28MAY03-C8927_1.pep
QGNPDEVAAALCRYSAPEEVDTLPSTCGACGTECVTRFFATKIPYFREVIVMATTCDMCGYRNSELKPGGEIPAKGKKITLRVQNARDLTRDVIKSDSASVKVPELELELSSGTLGGMVTTVEGLIVKICEALERIHGFQLGDSTLEWKKKKWEDFKERLSKLLSLQEPWTLIIDDGLAASFVAPATDSLEDDSQLTMEEYQRSWEQNEELGLNDMDTSSADAAYNTTST

SEQ ID NO: 41923 - protein, 194 aa, Sorghum bicolor
  unsure (1)..(194): unsure at all Xaa locations
  Clone ID: SORBI-28MAY03-C89588_1.pep
PPSNLSAFRHHRRRHGLLSPPPLXLLPLRLLLLIPLLAAAKPVLEDGYTVTTFANFNPLPASGPHPYAILPRPRAGDLLLLDSAGSALYTLSLSSSPGEPRRLAGGKRRSGFDDGDAAFDRPRSVAVDAADNVYVADQRHGAVRKVAPSGYTTTVAGGLSSGPGHRDGLAQNATFSADFELVYVPKICALLVAD

SEQ ID NO: 41924 - protein, 500 aa, Sorghum bicolor
  Clone ID: SORBI-28MAY03-C90_1.pep
MTATPAMIGLSAGKRLLATSFGNTDLAPPDAHPSLQFAPAAPKLTVVAHRASASSSSSSSSPAGHARAHAIRALRNHSAPALAPPLPLPLPPPPAADPAPELDSEFEFELESSLEAIVLLQRSMLEKQWQLPFEDEDEDDERLTKAAVVVARSGVSARQRRMSGRRRGPGRKSVTVSPELMQSRNRIYLRGTVSKDLLTHKQVIQLSRKIKDGIWLQHQRSKLKEKLGNEPSYKQLAQSLHISPPELRARMRESFLAREMLTMSNIRLVISIAQKYDNLGVELADLIQGGLIGLLRGIEKFDASRGFRISTYVYWWIRQGVSRALADNSKAFRLPTYLHERLIAIRGAKYALEDQGIAPTVENIAESLNISEKKVHNATEAVNKVLSLDQQAFPSLNGLPGDTLHSYIEDQNVANDPWHGFEERYLKEEVNNLINSNLNERERDIIRLYHGIGKQCHTWEDISRQFGLSRERVRQVGLVAMEKLKHAARRKHLDALLEEY

SEQ ID NO: 41925 - protein, 117 aa, Sorghum bicolor
  Clone ID: SORBI-28MAY03-C968_1.pep
MVTFHLLELILDTAGLFQTHPSQTCFLSSIDLHTQYSYQVMLPEAVAIVVAPTDPTRSYGIFRLTDPGGMDVLRECDESGFHTHRETTNGSPIYETCSKVHFNPNLRFEIVDLRSGQ

SEQ ID NO: 41926 - protein, 175 aa, Sorghum bicolor
  Clone ID: SORBI-28MAY03-C9695_1.pep
ISLRVEKNSKSPRKRSNSPSRSVPDLQEIVQGEKQAVIDGIFHCPSPRGCRRPLPSCRFVPYWQPLPCWPYRSDDGRSSRAPSGVEHRHQPSLVWVGGSREGGSRGHQRRTACATPYRGRQQQGPQPWPSEWCRWRRGPSVWAPAAEDLGGPPWPARASAPPARAPSPYGPRALG

SEQ ID NO: 41927 - protein, 186 aa, Sorghum bicolor
  Clone ID: SORBI-28MAY03-C9677_1.pep
TALLADFGIASFYQHPSSTPASSTASSVGVFLTIGYISPEYAGGGRHAATSDDVYGFGIILLEMMTGRRPTDPMFKDGVSIINFVEGHFPHEIFQVLDAHLTEEYKNFAEAKKISENAVHQCLVSVIQVAFSCTKPIPSDRMNMKEIATRMHTIQSSYVSMGKQSNIVRPLGVELPEMLYNGTDHT

SEQ ID NO: 41928 - protein, 121 aa, Sorghum bicolor
  unsure (1)..(121): unsure at all Xaa locations
  Clone ID: LIB3478-051-P1-K1-G9.pep
HRFSARQDLLSQSLPCCVLRHGGEYAGGGRHAATSDDVYGFGIILLEMMTGRRPTDPMFKDGVSIINFVEGHFPHEIFQVLDAHLTEEYKNXAEAKKISENAVHQCLVSVIQVAFSLTKPI

SEQ ID NO: 41929 - protein, 288 aa, Sorghum bicolor
  Clone ID: SORBI-28MAY03-C9760_1.pep
MAAPMPSSTPPPAAANPSHNPRRKRKPRPKTALPSALNPNWAQLQSKLPHRPAATHLGKRKHDDDPPAPAEPSPPPAVQDIKLDPTSDDTSLTKAVAIDCEMVGVGSDGSKSALGRVTLVNSFGNVVYDEYVRTVERIVDYRTRISGVRPKHMNKAKEFWAVQKEVAELIKGRVLVGHALHNDLKVLLLSQPKKDIRDTSEYEVFRRERKRRSLKDLAAEVLGAKIQQNEHCPIEDARAAMFIYNKHKKAWEKNMKEQFRFKKKLKKRGKKKTTESNGNDPNVPTVLL

SEQ ID NO: 41930 - protein, 216 aa, Sorghum bicolor
  Clone ID: SORBI-28MAY03-C10110_1.pep
GKQVDGLSLSMEEIIHECKLFFFAGHENTALLLTWSVYLLSIYPEWQERLRKEVLREFGREAPNPNALNKLKEMTMVLFETLRLYSPALFMQRKTLADMTVGSTKLPKGIAIVIPIPIMHRDKEAWGDDADEFNPMRFENGITRAAKVPHGLLAFSMGPRNCIGQNFSMLEAKSTLALMLQKFSFALSPDYVHAPVDLFTLKPKFGLPVILRPLKI

SEQ ID NO: 41931 - protein, 98 aa, Sorghum bicolor
  Clone ID: SORBI-28MAY03-C19225_1.pep
CPVAHSARSLFDAPDARGGYYIRPVDKSVRSHMNVPFTLAKGPDFEKQFIAEAAKEGMVQLKGHRSVGGVRASIYNAMPLAGVEKLVAFMKDFQARNP

SEQ ID NO: 41932 - protein, 225 aa, Sorghum bicolor
  Clone ID: SORBI-28MAY03-C19317_1.pep
MPPVKWLMHWHPSPGATINSQILSEACGCAESLGGSKDGKWKTSIFFYRAMTRDGSGGPAGQQHPDLPRELLGVALHERPGLYFSIVRAQRLVLQADAAFPQVMEKLQSYRIRVALNFEGFQYQLGDFCLRIGKCVPNNSEALRGIMMEVEYYPLSSIEKSKAVMEDFFDIWQETIGKKSLPGQFIHVDSNFSDYGLSDQYSFQHTAVQYATCLQQLMAAVTVRA

SEQ ID NO: 41933 - protein, 228 aa, Sorghum bicolor
  Clone ID: SORBI-28MAY03-C1942_1.pep
MFDYITSNGVDPPTPPPESPKNGVDHSPPAATGLPEHSPVTAHGLPSGPDSHVNGTDHLPLATRDLPRIQETPMNGVNLDGSDNTEDNDYTHREPVFHYPSNRKKIPIHFSAAKKKKKNKSETALLMQAHLYRITELAQKAQDTFEKFSSQADSAPWPSIQDVMTLVRECGARCGSNEHFIATELFVSREQREMFLTMETAEERFQWLRRKYIVKYLSGTTGTSLGTR

SEQ ID NO: 41934 - protein, 308 aa, Sorghum bicolor
  unsure (1)..(308): unsure at all Xaa locations
  Clone ID: SORBI-28MAY03-C19229_1.pep
MDPPRAVAVLLLVLLPVLAPVASGVPFVVLHGIGDECGNDGLASFTEMLGEWSGSKGYCIEIGRGAWDSWLMPLQEQANTVCKKVKKLXXLIEGDNIVGLSQGNLIGRAVIEYCDGGPLVKNSISIGGPHAGTASVPLCGSGFVCILIDDLIKSEIYSDYVQAHLAPSGYLKIPTDMEDYLKGCRFLPKLNNEIPSARNTTYKERFSSLENLVLIMFEDDAVLIPRETAWFGYYPDGAFSPVLPPQETKLYTEDWIGLRTLDEAGRVKFVSVPGGHLRISRSDMKKYIVPYLTPEASSKQSVHRMLSL

SEQ ID NO: 41935 - protein, 219 aa, Sorghum bicolor
  unsure (1)..(219): unsure at all Xaa locations
  Clone ID: LIB5051-004-A1-XP1-D6.pep
MDPPRAVAVLLLVLLPVLAPVASGVPFVVLHGIGDECGNDGLASFTEMLGEWSGSKGYCIEIGRGAWDSWLMPLQEQVKKMKELSEGYNIVGLSQGNLIGRAVIEYCDGGPLVKNFISIGGPHAGTASVPLCGSGFVCILIDDLIXSEIYSDYVQAHLAPSGYLKIPTDMEDYLXGCRFLPKLXHEIPSGRNTTYKERISSLEXNLVLIMFEDDAVLIP

SEQ ID NO: 41936 - protein, 129 aa, Sorghum bicolor
  Clone ID: SORBI-28MAY03-C19672_1.pep
IHRCSHPSLQPNCTRTNPRYSSCNHTKPGISSSGLSILNMPCYFVRVERRGPASVRCESQKSGFFWKTRGSTLLLSLACFRNTCRHVSLSVRVPDMYTKVYYIKAMTNDGLELRVNNTDVHIIFTAKLH

SEQ ID NO: 41937 - protein, 77 aa, Sorghum bicolor
  Clone ID: SORBI-28MAY03-C19571_1.pep
QLIGGLSRSVVYLCMKLKVVSQSRFCWFKLNVLGSLVALHSDIHVCKPGESPICPTLRWEANGRRRRRSRAALRERD

SEQ ID NO: 41938 - protein, 208 aa, Sorghum bicolor
  Clone ID: SORBI-28MAY03-C9897_1.pep
KRDTSAMPLNVSSAGSVNDSLKQSYTVGTPELQSTATSRVKWQRAEVNHALMEEIQEINQQLIDTELHVSEDDAESFTASEGGEGTVIRCTFTAVAVSPSLKSMFASAQMSPILPLRLLVPASYPKCSPVLLDKFPDEQCRNSDDLSTKAKSKFSVLLRGLAEPMSLREIARTWDACARKVIAEYAQQTGGGSFSSSYGCWESCVGAS

SEQ ID NO: 41939 - protein, 281 aa, Sorghum bicolor
  Clone ID: SORBI-28MAY03-C9900_1.pep
LLPQCWPITNSKSSNLSLKSCSRRQKKSYVSCASAAVQGQTQTPLTGSQQAYEHSSSKPKKVMVIGGDGYCGSATALHLSNKGYEVAIVDNLVRRLFDHQLGLDSLDAWASIQNRVRRWKSLTGKTIQLFIGDICDFEFLSEAFKSFEPDAAVHFGEQRSAPYSMIDRSRAVYTQHNNVIGTLNVLFAIKEYSDECHLVKLGTMGEYGTPNIDIEEGFITITHNGRTDTLPYPKQASSFYHLSKVHDSHNIAFTCKAWGIRATDLNQGVVYGVRTDETALH

SEQ ID NO: 41940 - protein, 312 aa, Sorghum bicolor
  Clone ID: SORBI-28MAY03-C9966_1.pep
RDGLFNFKPSVRPVPLEVHIQGYPGKFYWPRMNSMNKPAYAAICTHSPNKPVLIFVSSRRQTRLTALDIIQLAASDEKPRQFLSIADNSLDMVLSQVSDSNLRHTLQFGIGLHHAGLNDRDRTLVEELFSNNKIQVLVCTSTLAWGVNLPAHLVIIKGTEYYDGKTKRYIDYDITDILQMMGRAGRPQYDQHGKAVILVHEPKKSFYKKFLYEPFPVESNLREHLHDHINAEIVSGTISNKEEAIIYLTWTYLYRRLVVNPAYYGLEDTETNTLNSYLSRLVETTFEDLEDSGCNKVDDHSCKVLILGKIAS

SEQ ID NO: 41941 - protein, 118 aa, Sorghum bicolor
  Clone ID: SORBI-28MAY03-C10090_1.pep
VPETLASCSSADEFMQKLPTFDEDWARQRSDAEAADEVLRYVGVVDTVNKKGQVELRRYKRDHPFAQLSGSDNIIAFTTSRYKEQPLIVRGPGAGAEVTAGGVFCDLLRLASYLGAPS

SEQ ID NO: 41942 - protein, 248 aa, Sorghum bicolor
  Clone ID: SORBI-28MAY03-C100980_1.pep
HEAEVLEPLVRKIRDEKYGWKYGCGAKGCTKLFHAPEFVHKHLRLKHPDLVLESTSKVREDLYFQNYMNDPNAPGGTPVMQQSAPDRGRRRPSMDNRLKFDRGSNREHDRSERDGGRYGRGDQSPSRDGPDDQMFDGFRGRSSNGPFVAEFPPPPILMPVPGAGPLGPFVPAPPEIAMHMLREQGPPPPFEPNGPPHGNTGMLGPMMGGPAPIIAMPPNFRHDPRRLRSYNDLDAPDEEVTVLDYRSL

SEQ ID NO: 41943 - protein, 112 aa, Sorghum bicolor
  Clone ID: SORBI-28MAY03-C9479_1.pep
RGEGGCNNGWGGGEHWLLQLLLSVALPVLGFAGLGLAATQGLLAGRIPGLSEPDENGWRTYRRPGVWSGGHGLGGSPSVPFASTFLQRLALVNMIRGHEGLYYGERISEHHF

SEQ ID NO: 41944 - protein, 82 aa, Sorghum bicolor
  Clone ID: LIB3478-010-P1-K1-D11.pep
LYGCTLTIYDVHCPLCPPDDLDDATIEKIGNPEKVISAFGPEVIGENVEGKVLSSATAEYSGRTYYQFELEPPHVFITATAA

SEQ ID NO: 41945 - protein, 170 aa, Sorghum bicolor
  Clone ID: SORBI-28MAY03-C95006_1.pep
MYRSAGVAMAWNVFRFCTALRGLGSIMILLVLAIVGVTYYAVVLCNYGPALLTGGGTTLAAFAVLLLFHFLLAMLLWSYFSVVFTDPGSVPPNWNLDFDVERGETAPLATSEFSSQMNSQQSVALGNTANPRVRYCRKCNQLKPPRCHHCSVCGRCVGALNYKYFLLFLF

SEQ ID NO: 41946 - protein, 94 aa, Sorghum bicolor
  Clone ID: SORBI-28MAY03-C9498_1.pep
TPNREQSSWRPSFATLVSFLPIHISIFSSVAKIQGHSHKLKELPFRIALKHLLKGRGHRGLFFYNFPEPCLSQASLATALLNAAHVTLANGIYS

SEQ ID NO: 41947 - protein, 126 aa, Sorghum bicolor
  Clone ID: LIB3478-002-P1-K1-G11.pep
LPIHISIFSSVAKIQGHSHKLKELPFRIALKHLLKGRGHRGLFFYNFPEPCLSQASLATALLNACKNNTYMSHLQMASTARPPADSAISVCCGIEIWKNYRLDNLPVCFLLVPCKLGTWIINNYEA

SEQ ID NO: 41948 - protein, 227 aa, Sorghum bicolor
  Clone ID: SORBI-28MAY03-C95608_1.pep
MAALLHHQAAAPTAKPPHPWALHSTTSSLSPLSRRRRCASTIRSAATDSSFGTGGDAAPSKKTTRKEKQQERRRQQDLQDRQQQLLMMEEKTSLAKRDGGTGSSSSGGGEVDGDDDELPQPVFDRILRRIAFTVGLPMATGVALLNVYDALKRGQGVVVPSWVPLLTILVAFGTSALGIAYGTLSASWDPDREGSLLGIDEARANWPVLWQEEIQKEKEKKAKQMKK

SEQ ID NO: 41949 - protein, 216 aa, Sorghum bicolor
  Clone ID: SORBI-28MAY03-C9564_1.pep
MASAVSLLLLSPPRHLHRDVASRLLSTPHRRVLLAAPTSATPRRLLAAPPPRASNNNDDSGAVEAPDRLVAADAYLYPFLDGAHHGRFLLAQFPFFNALLRPLGPAARLFHSSPLTPFLLFLTLYFAVVRNQQAFSRFVRFNAMQAVVLDVLLIFPDLLAQSFAPSGGVGFEVFQSMESTVFLFLLVSLVYGSGACLLGKTPRLPIVADAAERQVM

SEQ ID NO: 41950 - protein, 89 aa, Sorghum bicolor
  Clone ID: SORBI-28MAY03-C95975_1.pep
GSRGSNCASIRHCPLMSCTRCSTSPSCDEDVHIISQMVVLRNIHITLTALTMKAKAKKEICRFTRSYMKSTFQFTTVFICTMGQITKLK

SEQ ID NO: 41951 - protein, 232 aa, Sorghum bicolor
  Clone ID: SORBI-28MAY03-C10414_1.pep
MDDAGRAPPPAPAAVTVSATAAPAPPPPSATAAADKSSLDPEALYEEGMWQQMAMNSGATMQPGSYPERPGEPDCTYYLRTGLCRFGMSCRFNHPPDRNLAIASARMKGEYPERVGQPECQYYLKTGTCKFGPTCKFHHPREKAGIAGRVQLNTLGYPLRPNEKECAYYLKTGQCKYANTCKFHHPELFNVVPSSRGSPIYTSVHSSASAGPQSYTGTMPSWAFPRASFIPS

SEQ ID NO: 41952 - protein, 83 aa, Sorghum bicolor
  Clone ID: SORBI-28MAY03-C1033_1.pep
TCFPYDLTKYYIAFWTLLKVHEPVFTQGSTTTKRKTKSLAHSDQALESLYLTSHYSPNRHSGLLLMRLKSTFGPNRSLMLSIP

SEQ ID NO: 41953 - protein, 72 aa, Sorghum bicolor
  Clone ID: SORBI-28MAY03-C104290_1.pep
TLVLRSSWKWSNYRARRRKGNAIFPKAYITRSQKSRNWRYPPKKHNHFISRLSLQPVDDLIIVHPSLSIVKV

SEQ ID NO: 41954 - protein, 169 aa, Sorghum bicolor
  Clone ID: SORBI-28MAY03-C10462_1.pep
MENAVVLREWFDRVDAGRTGNITAAQLQGALAVGNLNFPISVVQQMIRMYDFDRNGTMSFEEFLALNKFLQKVQSVFSTLERGRGFLSLEEVYEALIKLGFSLDSPAFYTVCESFDKSKKGMIQLDEFISLCIFVQSARNLFNSFDTSKQGRVTLDFNQFVYCTANCRI

SEQ ID NO: 41955 - protein, 97 aa, Sorghum bicolor
  Clone ID: SORBI-28MAY03-C9779_1.pep
MQCEAENNHVLVVVRAQMMHPEPTMKRAGGPTNAVDRLSALPDELLHVILSFLPAPLVVQTSLLSRRWRRLWRSTPLIKIHEQEFVISSKIRTNTLE

SEQ ID NO: 41956 - protein, 281 aa, Sorghum bicolor
  Clone ID: SORBI-28MAY03-C97969_1.pep
MGESRGSIAFFATYRPPMPLDIFSVPNPPSSIRDEVHLTDGVSYNYNCRPIPKDALKSLLKRPKLVAEGGATDADVDSGRVSGLLFVSERDGGLETLRVALRFDDSGGKQTCKVFSLADVFGAADFTGARLEDSGCIGGGYKMGSRSVDHSLIYVSTKEPVEERRSPWTVVYKTNLRTGKTERLTPKGQFDLSPAVSPSGKKVAMATFRPEGWEGEIEDLQTDIFVMNVERPPMRKRLIKNGGWPSWASDDVIFFHRKVGDTWGVFRHDTRTNETVRVTPE

SEQ ID NO: 41957 - protein, 196 aa, Sorghum bicolor
  Clone ID: SORBI-28MAY03-C9833_1.pep
GDPNIPHVATVPGDPPVLPARAGLLCDTHSQRPDRPIGEARRRLLVDPGHEAAAGEGGGQGAAGDDMAEVVVVGGAGAPGPVVEQVGGNYGGARADRIDNHDGRWIRRPPPPSYEESRSRSSNLAALPPKLLGQFARTVCSPAGIGRRRFGDRTAAQASVAGSRRNGRFLREAANLVLASRFLPFCFLFLVGFFFP

SEQ ID NO: 41958 - protein, 187 aa, Sorghum bicolor
  Clone ID: SORBI-28MAY03-C9851_1.pep
RHIPLVLEPRYVPPALDHHHGPTVPELRHVPAAYYRTLAPSGDSYYRPVENLVPERYATVADITTRDPIIRDHTALPGEASARADRLDDLYRTRGAHVEDLYRPGEIAARADRVGITTRADRVEELYRSDRLVNRAVDPPHSAYLTAGYETNPAYAETSIRPVSARVSGPGAPVSSHYSFTGGPVYR

SEQ ID NO: 41959 - protein, 242 aa, Sorghum bicolor
  Clone ID: SORBI-28MAY03-C98564_1.pep
ARGSCASAALSVLTRDDSRMHAEGIDAMGHATHLNYGPSSSISSETVKNAAICGLSAAATKSKLFADQEEREIQRLSATIINHQLKRLELKLKQFAEVETMLLKESERLEVMRQQMVTQRVRLLSTRFTSTGGTIPGGSSSMVANPMNQATGLRPLMMPGTVSQSSVPAMYANNMQGHPQMALLQQRQQMLSFGPRLPLSAINPGSSSSAPNMMFNPGMPNSAAPNHHPLLRSPSGNNSNVG

SEQ ID NO: 41960 - protein, 155 aa, Sorghum bicolor
  Clone ID: SORBI-28MAY03-C98761_1.pep
AGLVIQRRRSTTIQPIVTAHAHWRQQLAELRRLLDENQCPEAKDLLEDLIVQARENWRRPDWRGNLAAAQFGGLFSFLGTQPVSVGNFVRNRLPDGAYEQAFQLRTYGRLWSLYPLIAACDIRYNRFSVDTARAFHQFLTNNPMERAFWVNIVIE

SEQ ID NO: 41961 - protein, 150 aa, Sorghum bicolor
  Clone ID: SORBI-28MAY03-C10667_1.pep
MQQRRVQSWWPHGQAPSARRQPCLSARRQPCAATHHQHGGVGPFPSSGQRQLLCLGRVILKQTQILFMDQATASVDSQTDATIQKITRQEFSSCTIISIAHRIPTVMVWDRVLVLDAGLVKEFDSPSRLIEQPSLFGAMVQEYANRSSSL

SEQ ID NO: 41962 - protein, 80 aa, Sorghum bicolor
  Clone ID: LIB3478-017-P1-K1-A7.pep
MQQRRVQSWWPHGQAPSARRQPCLSAGRQPCAATHHQHGGVGPFPSSGLVKEFDSPSRLIEQPSLFSAMIQEYANRSSSL

SEQ ID NO: 41963 - protein, 156 aa, Sorghum bicolor
  Clone ID: SORBI-28MAY03-C110326_1.pep
ARGTISLSLSYQIHPQINWHNTGEVGRYMAPSRRRNNSSLFESSTIITANLIMASSSFLLSRIAPRVATASPPPPPTTRMVATSRASAATSTRSVEPMAGCKTILMKPVDGQDGKVDQRAEMFIRSFRERTLSETAHFETANAGARPQPQARRCPR

SEQ ID NO: 41964 - protein, 238 aa, Sorghum bicolor
  Clone ID: SORBI-28MAY03-C108420_1.pep
HEAEAKAKKLKSRKHRRRGDSSSDSDSDYDSDIDRKHRKRKDRRRNKKHEHSDSDARRRKRRSRRSTDSSDESNSEYESRSEEERPRKKRSHRRRHHRHSSRSDSEDYSSDEEEQRSAKDHSQSRRRHHRSSDDDSDKDKVKSRHGKRLRSSDEDARSDSNSHKHLRSQSLEESSDDRDAAESEKMRNGKRSHKNGHHHHHHRHHRHHHERHRNSAEPNDKRQVLKDGQRAIGSDSAN

SEQ ID NO: 41965 - protein, 172 aa, Sorghum bicolor
  unsure (1)..(172): unsure at all Xaa locations
  Clone ID: SORBI-28MAY03-C110388_1.pep
MQANKSFPLSLACLLCLDACLPARLASRHASRRLSLSSRASAGGLLLPPLLPLGRRVRQAAARHHGRRRATPPPRRVRAREEVDEPXARQRPRSRSRRPPRPHRRRRRSGRQASRRRRSPSSSGTRGTAPSPRPAATPPRRRRRPAALSRGGTGRARRPRAGTRAYPGPSCS

SEQ ID NO: 41966 - protein, 170 aa, Sorghum bicolor
  Clone ID: SORBI-28MAY03-C10182_1.pep
SDRLGEDFSEHYKDFTERLIGTEETVRAASKRLTQGMADFSKAISSAKTEGEKTKIKGDQQTSTRTMRSYNNILSMAQLLHLKSPLFIGDKKITLSWMEQPKKPEATTARGKRSQPATNGNGPANKKGRGGMQNQLVNRAFEGLSRGGRGSGRGQVRGGRGRGRGWGGYR

SEQ ID NO: 41967 - protein, 103 aa, Sorghum bicolor
  Clone ID: SORBI-28MAY03-C10218_1.pep
MATELTAAQLRAYDGTDPSKPIYVSIRGKVYDVTSGRGFYGPGGSYAVFAGREASRALGKMSKDEADVSGDLSGLTDKELGVLADWETKFQAKYPVVARLADA

SEQ ID NO: 41968 - protein, 100 aa, Sorghum bicolor
  Clone ID: SORBI-28MAY03-C10244_1.pep
HVPYVVPLRPVAVAAVVRLLEHDGSSLLGASSYGLAVATISSALLDGLLAREELLLGGLEHCQCHVSPACPGQVTLAYSKQSYLSQQVLQITTKKRHDYE

SEQ ID NO: 41969 - protein, 229 aa, Sorghum bicolor
  Clone ID: SORBI-28MAY03-C10270_1.pep
METMKSLLKPKPTPQQQLREWQRRLRNEGRNIDRQIRDVQREEKKVEKAIREAAKRNDMGSAKALAKEVVQSRKAVNRLYENKAQLNSISMHLGEIVATARTVGHLSKSTEVMKLVNNLMKAPDVAATMQEFSKEMTKAGVMEEMVNDALDSTLDNEDIEEEIEEEVDKVLTAIAGETASELPDAVRKEKEKMRQPSTSVPAERTAIAEAVDDDDELDQIRERLAKVRS

SEQ ID NO: 41970 - protein, 80 aa, Sorghum bicolor
  Clone ID: SORBI-28MAY03-C103488_1.pep
FQQHELAWHMGWESYKDICGFLIFFLFSSLFRLIWVTSLNHQREDSSQGAGRGKKILLFQQNGVGFFANHDSPLRDYKNG

SEQ ID NO: 41971 - protein, 215 aa, Sorghum bicolor
  Clone ID: SORBI-28MAY03-C11171_1.pep
MDSSSSSSSLSQQPEFDYLFKLLLIGDSGVGKSSLLLRFTADSFEDLSPTIGVDFKVKMVSIGGKKLKLAIWDTAGQERFRTLTSSYYRGAQGIIMVYDVTRRETFTNLSDIWAKEIDLYSTNQDCIKMLVGNKVDKESERCVTKKEGIEFAREYGCLFLECSAKTKVNVEQCFEELVLKILDTPSLLGDASSGAKKNIFKQKPPEADAAASSCC

SEQ ID NO: 41972 - protein, 371 aa, Sorghum bicolor
  Clone ID: SORBI-28MAY03-C1122_1.pep
MEDLSDLGGRGHLGAATSRRPAPPSLPSSSSSKVSVQVYTVPSSSAAGGGGEAAARAQGGVAPLIHASSSVGGHGGRVADLLDPIKAKIVSHPRYHRLLAAFLDCHKVGCPPEAAEEIAAAAREREAWQRAAVGDAHNTRPDPELDQFMESYSELLVAWKEELTRPLREAKEFLTTVELQLNFITNTGPPMGALISSAAEDNTGLDMSDDDQEEGSGGMEAEAALGIDPCSDDKELKKQLLRKYSGCLGNLRKELCKKRKKGKLPKEARQKLLSWWELHYRWPYPSEMEKIALAESTGLEQKQINNWFINQRKRHWKPSEEMQFAVMDGFHPGAPPNAAAFYVDARLVGATPAMFYARPEHGAHHGLWHNN

SEQ ID NO: 41973 - protein, 279 aa, Sorghum bicolor
  Clone ID: SORBI-28MAY03-C1126_1.pep
MVHQGEELPQAWWFDSHNLARPSPWLNSTLSELDDKTKQMLKLIDQDADSFAQRAEMYYKKRPVLVDMLGDLYRTHRSLAEQYDLLKHSSGTRHTVFGLSSCTQSRSQASSTNGKSTPRSSCSASMYDSESEVDDPEQEDEEEQAAEPTRAGTIKTEPSSQQQEREQAEQQMRAEIESLKAQNAALQKAAEENAAALRAELAGKDEEKREVIRQLASSMDVMRQENLTLREHIARGSSSKHSSSAPRAAAFDLRKVARSLFSPRLFTAHCRHTGPIVAL

SEQ ID NO: 41974 - protein, 145 aa, Sorghum bicolor
  Clone ID: SORBI-28MAY03-C112761_1.pep
MAAAALREQLNALLSSMFSSGLVDDQFQQLQMLQEDGGTPGFVAEVVTLFCDDADRIISELAALLEQPIVDFDKVDAYVHQLKGSSASVGAQKVKFTCMQFRQLCQDKNRDGCIMALAVVRNEFYDLRNKFQTMLQLEQQIQAQQ

SEQ ID NO: 41975 - protein, 209 aa, Sorghum bicolor
  Clone ID: SORBI-28MAY03-C106170_1.pep
TRPKTTNQPKAFLAACRGGGATRAAKIGSDSPAADGVGDAARKRPSGGDGPTPAPADKRRRPEHPSSSSAGSRDRHQAHHHQPHGRRPPSSSAEEKVRASHILIKHEGSRRKASWRDPEGVAISATTRDDAADLVRALRDQIVSGDRKFEDIAAENSDCSSAKRGGDLGSFGRGKMQKAFEKAAFALKVGEISDVVDTESGVHIIKRTG

SEQ ID NO: 41976 - protein, 174 aa, Sorghum bicolor
  Clone ID: SORBI-28MAY03-C1056_1.pep
MSPSADAAGPASFASAPPLAPLIAAQLNYLLSHSKLPIRVGQIWSGCRNGSPADRFTLAIPFCLDYVHWDFVYNALSPKVAPDVVFGPEDERFQPLVDYAVAGNGDKSCLARWDCRAPEGLLALVQELRELYIEYQKKRVHMVDDARVAFELSTVLSKEGIEVCMVPSADRPDE

SEQ ID NO: 41977 - protein, 245 aa, Sorghum bicolor
  Clone ID: SORBI-28MAY03-C10431_1.pep
TGAARGPRPPPPAAAPRAAVLPHALRQPHPAPHLPVRSPRAAVPPPPPPGALLLSGAPLGVPGRGIPRPDEPPEAVRVVRPRAPPMQAPAQPPSPPGVLPAKRQVVAPRSLATALPAPGPPAPHRRTWRRAWWRQISNRMHTSGLVSCHTINMIEFEPEYHVNFGNPDIDEKPPNVIGGDASECEALHSCFQNQEGFVIHLMARAPRMLVRLVMYREPDVVTAKQQEEELQRVYCSGNGSKIPES

SEQ ID NO: 41978 - protein, 66 aa, Sorghum bicolor
  Clone ID: LIB3478-014-P1-K1-C5.pep
IWASHLLSKQRAPFKSPLRINKVVTATEYKRPFYLYCSETMRVNLSMNWHFLSKPQPGLFCNEQKF

SEQ ID NO: 41979 - protein, 106 aa, Sorghum bicolor
  Clone ID: SORBI-28MAY03-C10696_1.pep
MVIMAGMLPGVECARRRRLRQGAEAAGGGTRRSSFCLYAAGHGGAGGLGGGGNSGKQQRSGVMEMIHGWTLDSNAREAKERLDQKLRSKREAAIKRHHSTGSIKLS

SEQ ID NO: 41980 - protein, 190 aa, Sorghum bicolor
  Clone ID: SORBI-28MAY03-C1074_1.pep
PVSELWRILLLLTSWDEPMKSMVFCFLFSYIIIRGWVVYFIVTVLLFSATFMFLTRLTTQGKQMSEVKVVSPPPLNTMEQLLAVQNAISKIEELVQDANIVLLKIRALLLAFPSQATDKAILALVLMALCLAIVPTRVLLLLVFVEVSTNHSPLRKATTERCTRRLREWWFSIPAAPVVVEKEKEDKKTR

SEQ ID NO: 41981 - protein, 96 aa, Sorghum bicolor
  Clone ID: SORBI-28MAY03-C10769_1.pep
ALTLRCISTHLQGLKFEHSGKTLPSKHQVDELAQSYNTTKLLTVFISFLILYMLKLHHASPGFIGSDINHPVEQQLGQCHSGPHRRQCAAQYRRQG

SEQ ID NO: 41982 - protein, 118 aa, Sorghum bicolor
  Clone ID: SORBI-28MAY03-C11467_1.pep
VARMVELHGAHLVSHERPDEVNNALMDLIKATKSAMKPEEWSAQPENISETGALISARPITVTMQTDEGANAAVAIYNLLGKLQLSFLYLIGVIVMGFEHMRNIVKVMKPVRVAAVES

SEQ ID NO: 41983 - protein, 142 aa, Sorghum bicolor
  Clone ID: SORBI-28MAY03-C114935_1.pep
MLKFLSKVVVEYCPLDPRKAAAVELLAQCNGRKAKDSNPACSVELRRLPSPPLSTDPKSQPTLPPPRVLVTYLNGAEEAIMAAEGATAQGIRDQILARGRLIDTEQMFRDGGEKWPVVIPEEELGMSFPGIKPKKAEDKPQA

SEQ ID NO: 41984 - protein, 168 aa, Sorghum bicolor
  Clone ID: SORBI-28MAY03-C115151_1.pep
MVVAAPPSSCSISISIGSRSELGSLFAAFDADADGRISASELRECMRATLGAEAAVSAEEAEALVAEADADGDGLLDAAEFAGLVARLQQDAGEEDRHRGLRQAFGMYSETENNVEAGCITPASLRRMLARLGEHQDVDECRAMICRFDLDGDGVLSFDEFKIMMNAA

SEQ ID NO: 41985 - protein, 322 aa, Sorghum bicolor
  Clone ID: SORBI-28MAY03-C11534_1.pep
MMPRRQPGVAPPPPQAAPGAPPHWGGIPPPMAPQHQYGPPPPTQQAPPPPQMWGQAPPPPTQAAYGQAPPPPQAAYGQAPPPPQAAYGQPPPQPQAAYYGAPPAPAPAAMAAAPTGPSEVRTLRVGDLQYWMDENYVYGCFASTGEVQNVKLIRDKHTGQLQGYGFIEFISRAAAERVLQTYNGTMMPNVELPFRLNWASAGEKRDDTPDYTIFVGDLAADVTDYVLQETFRAHYPSVKGAKVVTDKLTMRSKGYGFVKFGDPNEQARAMTEMNGMLCSSRPMRIGPAANKKATGVQEKVYRAALDQSVNDRCVSCVLHDLC

SEQ ID NO: 41986 - protein, 120 aa, Sorghum bicolor
  Clone ID: SORBI-28MAY03-C115674_1.pep
GEVTLEQLSAYDGKDPAKQILIAIRGQVYDVSRGRLFYGPQGPYSLFAGRDATRALALMSFDPNDLTGDLDGLSPDELEVLQDWEEKFKERYPRVGHLACQDAASSGQNTAGLHHEEGDA

SEQ ID NO: 41987 - protein, 292 aa, Sorghum bicolor
  Clone ID: SORBI-28MAY03-C11043_1.pep
MKTSSLVVVALAAVVLFAAHDASLAGASSSSSPRVIIVGAGMSGISAGKQLWESGVRDLLILEATERVGGRMHNHNFGGINVEIGANWVEGLGGDNLNPIWPIVNDTLKLRTFYSDFDSVVGCVYKENGGGLYDEEYVQKKMDRAYEVQELGANLTKKMRPNGQDDISLLAMQRLFNHQPNGPATPVDMALDYFIYDYEFAEPPRVTSLQNTQPTPTNADFGEDNYFVADQRGFESIIHAIGSSYLSTDANGKLSDRRILLNKVVRQIAYNKEGVVVKTEDGSSYSADYVVV

SEQ ID NO: 41988 - protein, 133 aa, Sorghum bicolor
  Clone ID: SORBI-28MAY03-C111122_1.pep
NETPMMAGYLDRRVERRKLVGTSGDSLEGLSVGEGNSLGGLGARSTVDGEVILRGRRSVGNIVEAELQAGDGADVNLGAVELDNLNLEAAGDGIGNLGRRAGSKKLRGIGSLVSGEGTVDDTLSRLSHNNPRA

SEQ ID NO: 41989 - protein, 262 aa, Sorghum bicolor
  Clone ID: SORBI-28MAY03-C11117_1.pep
MPAVSAAACCAAAAPANEVAEDLFGFLRVLSDGTVLRSPAGPVFCPTTFPGSHPSVQWKEAVYDKAKNLRVRMYKPTTTAFAAVGKKLPVLVHFHGGGFCLGSCTWANVHEFCPPPAAGAAAAARAAAVRAPPARRRPAPCAARPPSPPAPRRRSGGAAAASRPAAAAAACTSRGPRAGGGGGEAGKKLPVLVHFHGGGFCLGSCTWANVHAYCLRLSAEAGAVVLSAGYRLAPEHRLPTAVDDGVGFLRWLRAQSTMDAAA

SEQ ID NO: 41990 - protein, 124 aa, Sorghum bicolor
  Clone ID: SORBI-28MAY03-C111228_1.pep
HEGARTPLLLPPIRVPPFVVCSPRHDGHEPSLPPFLFSLTSATSMSSMSPEWERWRWLPTSHTPPSALSSSLRPPCIRREEQQRRPLFLAATSMHPERRATTATFGKVGGVLIWISTFSSFSSL

SEQ ID NO: 41991 - protein, 164 aa, Sorghum bicolor
  unsure (1)..(164): unsure at all Xaa locations
  Clone ID: SORBI-28MAY03-C11129_1.pep
QNSSLTSCLKNFSSTETLNAEDKFFCDKCCSLQEAQKRMKIKKPPNILVIHLKRFKYIEQLQRYKKXLSYRVVFPLELKLLNTVDNSDLEYSLFAVVVHVGSGPNHGHYISLVKSHNHWLFFDDENVEMTDESMVQAFFGSPQEFSGNTDNGYILFYESLAERS

SEQ ID NO: 41992 - protein, 117 aa, Sorghum bicolor
  Clone ID: SORBI-28MAY03-C11157_1.pep
MNAPDRYERFVVPEGTKKVSYERDTKIVNAASFTIEREDHTIGNIVRMQLHRDPNVLFAGYKLPHPLQYKIIVRIHTTSQSSPTQAYSQAVNDLDKELEYLKQAFEDEKNRFEMARL

SEQ ID NO: 41993 - protein, 147 aa, Sorghum bicolor
  Clone ID: SORBI-28MAY03-C1116_1.pep
LRVPQAEGHGSNTLVVMGGQEDIESLQVHVESAGHTLKKGTAGKLTADSNIQQTQRDIHPGLIGTTVGSIRATRGDMRITMREMIDSLIGSLRIMKGTMIGLMTCMVAGMTIGMMTGRLIGLSQESRVRTGFCFLPSFCCMCSSQLA

SEQ ID NO: 41994 - protein, 260 aa, Sorghum bicolor
  Clone ID: SORBI-28MAY03-C117941_1.pep
MTSLVDHPGRETVGFSFSEATAAGPKQHGFYPYTDNGGSTLGITGSDFAILAGDTRSTSGYNINSRMVPKVFKIGGDEETGEGAKIMLSVVGFAADGTALKERLDAMVKMYKYKHGKPMSVAACAQRLSTILYEKRFFPYYVHAILAGLDEEGKGALYSYDPVGSYEREQCRAAGAASSLIMPFLDNQVNFKNQYIPGSGEGHALVAKKPEPLPLETVKGLVRDAFTSAVERHIEVGDNLQMLIITKDGIQETFHPLKKD

SEQ ID NO: 41995 - protein, 98 aa, Sorghum bicolor
  Clone ID: SORBI-28MAY03-C11825_1.pep
GLEVTWSSVVKIGQSLYREAPGSDPFRPDQKTPVKNFFLSGSYTKQDYIDSMEGATLSGRRTAAYICGAGEELLALRKKLVIDDSEKALGNVQVLQTS

SEQ ID NO: 41996 - protein, 222 aa, Sorghum bicolor
  Clone ID: SORBI-28MAY03-C118495_1.pep
MATSEDADHQVTVVDFWANGFGMRARIALRELGVAFRYVEEDLRVRERSELVRRMNPVHRSVPILIHGGRPVCGSVNILQYVDEVWGPTLFPRDPLQRAHARFWADFVDQKVFSTQTRFLKSKGDEKEAAKGELLEQLKRLEEVLGDKTFFAGDEFGFLDAVLIPFSSMFHGYEQHGGFDLDVECPSLMSWVRRCKERKSVKGVLPDEDKMYELHKKWYGIE

SEQ ID NO: 41997 - protein, 405 aa, Sorghum bicolor
  Clone ID: SORBI-28MAY03-C11882_1.pep
MASRILSRQNLRKLASFTLQNISQRQLISPYPPALRSTIAPPGKFLSPLYLSGHSLAVRWATYGSVNLVLSDDGKPKFQIEEVEPSTKRRYLTKKRLKVQRKKEKKKRKEANKNDPRRIRPKGKKIKQKFPTPEARLKYKIEKAKLKEVRLVEKLKKYEVAKAQGPMAKPDDLSGEERFYLKKVSQKKSNYVPVGRRGVFGGVILNMHLHWKKHETVKVICKPCKPGQIQEYANEIARLSGGIPVNIIGDDTIVFYRGKNYVQPEVMSPIDTLSKKKALEKSKYEQSLETVRRFIAISEKELELYYRHVALYGNPQSQKADLVCGDDRETSLLKMGGLDQGKDQEPHLATNHFSDHHVSDVSESDEEDSSGSEYDVNDDETESITSISEDSIVSDHGDLANWGEA

SEQ ID NO: 41998 - protein, 347 aa, Sorghum bicolor
  Clone ID: SORBI-28MAY03-C12042_1.pep
MAASPPRRRLPAARLLLVLPVLPRQVAWPVMNTLHSAVDLLPSFVAAVAPGAPAPAAWSGACFAENEAAIELTPGDRNGTGVGGAVLRLKTASAHSWTCMDLYVFATPYRITWDYYFAAQEHTLEIKSWEEQAELEYVKEHGISVFLMPSGMLGTLLSLIDVLPLFSNTAWGQHSNLAFLKKHMGASFEKRSQPWVANIRKEDIQSGDFLALSKIRGRWGGFETLEKWVTGAFAGHTSVCLKDEKGDLWVAESGYENEKGEEIIAIVPWDEWWAMALKDESNPQIALLPLHPDVRARFNESAAWEYAQSMVGQPYGYHNMIFSWIDTIGDNYPPPLDANLVMAVMSM

SEQ ID NO: 41999 - protein, 227 aa, Sorghum bicolor
  Clone ID: SORBI-28MAY03-C11321_1.pep
MAAAAPEKRPPRSLFELASDFFDSSVLLRAHPSTAPSAVEPSEPSRSPPPPTTQQQQQQLSEASGSRWTCNTCAAEFESLQEQREHFKSDLHRLNVKLSIAGKTIIKEEDLDKADSDSLFDDLEISSVSGSEDEQENGPASERLLSVKGKEEFRKKLYFRRASGDTISIYRCMLLKEHEEPLIDCKSGQMENASCVPEEEMINRVKHLTCEPRDASHLRIVILTSGG

SEQ ID NO: 42000 - protein, 109 aa, Sorghum bicolor
  Clone ID: SORBI-28MAY03-C11382_1.pep
LLHYAIKLITKAQAISIYLLFMQRITSDTSNRSSDHHEIIYSQLKRGQIGLVLSLTCLDHQTKCLCEAEETTVSFKCHFGHKLPRTELKVPQLKRAKCSHPDYSKAEVP

SEQ ID NO: 42001 - protein, 167 aa, Sorghum bicolor
  Clone ID: SORBI-28MAY03-C11401_1.pep
KEFEMWLGFDQNPLYALLHESIYCEGSSSKWSAEKIHGEYGSLFDPIKATEEGRAVYFTGEMVFPCLFDEIPALRDLKEAAHLLAEKEDWPPLYDVSVLNNNKVPVAAAVYYEDMYVNFNIAKETASQIRGIRLWVTNEYMHSGIRDGGSHVFEHLMGLLNGKKPLF

SEQ ID NO: 42002 - protein, 214 aa, Sorghum bicolor
  Clone ID: SORBI-28MAY03-C114194_1.pep
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKVLVGNKADMDESKRAVPTSKGQALADEYGIKFFETSAKTNLNVEQVFFSIARDIKQRLSETDSKPEDRTIKIKAEGEADAAAAQKSACCGS

SEQ ID NO: 42003 - protein, 131 aa, Sorghum bicolor
  Clone ID: SORBI-28MAY03-C114578_1.pep
QEIRKIPADGVVNYVGGDMFKSIPPAQMVTLKMVLHHWSDEDCVKILANCKKAIPSKEDGGKVVIADIILDPASGPVMFETHLLMDVCMMLMKGGRQRDLNDWRDLILKAGFSDYKLLKNFGARGVLEIYP

SEQ ID NO: 42004 - protein, 201 aa, Sorghum bicolor
  Clone ID: SORBI-28MAY03-C127678_1.pep
MATPRFAKATAVLSCLVALATLASCNTEVDILYEQRQTWKDPNDVLVSWDPTLVNPCTWLHITCNNDNSVIRVDLGNAGLSGYLVPDLGGLKNLQYLNLYGNNLTGSIPESLGNLTRLEGLELQKNALSGAIPSSLGNIKTLQFLKLNANILTGTVPLEVLSLVIAGNLTELNIANNDLAGTVRSSGLRVTAIIQDKLKTA

SEQ ID NO: 42005 - protein, 289 aa, Sorghum bicolor
  unsure (1)..(289): unsure at all Xaa locations
  Clone ID: SORBI-28MAY03-C12781_1.pep
TRGLDSHPPGGLLNILKSTPQAASNGSSSHAIHIDVDNNTRTEKRLTWTKKEDLRLVAAWVNNSNDPVQANYKKNDQYWKGVADVFNSTTPKDRVRTAKQIKDHFGRIKKRVACFCGNWKEANAMWASGESDEDVMNRALESYAEDHKKDGPFMFRHCWEVLSKEPKWDAYLERLEDLEPGKRKFVEDDEEQHFSLDDDERPIGGKKAKEQKKKKXQQHCIIDLEDELNNFLDAQKAANEGRAEMLETQRRVSSEKLESRRLAHLAAKEHKEAVMLETYRSLLMQNFLK

SEQ ID NO: 42006 - protein, 89 aa, Sorghum bicolor
  Clone ID: SORBI-28MAY03-C1280_1.pep
CLANANVRPRRQGGSTRHVIEKNSMAPIRRPSVEFSKAALGIYSKADVGNPDGGKPAQEDLMNPRAHKRKVPNGLSNGTYYANGNGVHA

SEQ ID NO: 42007 - protein, 277 aa, Sorghum bicolor
  Clone ID: SORBI-28MAY03-C1296_1.pep
RSTTRGDADIQTAVAAKEALEGHSIYEGGYCKLHLTFSRHTELNVKVNNERGRDYTKGNVTPSSDRPSILGPQPIPNVGAAIPPAPGSVATNSVMQPGDPSVAVPSNPSSEPLLQAPVVSSGGPAQYPNQAILQAPPGVAPQFPGYGALQFAQGSAQAQMVQPSGQGSQQMSSHVNYQLPPGAAQFMQYLGNGSHPLPNAPGPQTMPYPALGGQQLPPGPQMMQAPGFGGLPFSQGPGQPMPQFPMYGTQQFPPGMEPQMMQGGQQFTFAPRGPYGR

SEQ ID NO: 42008 - protein, 227 aa, Sorghum bicolor
  Clone ID: SORBI-28MAY03-C12950_1.pep
HEAEADADDGQKGKDGDDVKEKRWKVLVWSTAVYLTTLGMLVALLMGLNMSWSAITAALVLLALDFTDAQACLEKVSYSLLIFFCGMFITVDGFNRTGIPNALWELVEPHSRIDSAKGTALLAVVILVLSNVASNVPTVLLLGSRVAASAAAISPESQKKAWLILAWVSTVAGNLTLLGSAANLIVCEQARRAQFFGYNLTFWSHLRFGLPSTIIVTAIGLLIVVSY

SEQ ID NO: 42009 - protein, 252 aa, Sorghum bicolor
  Clone ID: SORBI-28MAY03-C11571_1.pep
EPLRYYHNITSNTLTVLEAMAAHNVNTLIYSSTCATYGEPDTMPIVETTPQNPINPYGKAKKMAEDIILDFTKSKKQSNMAVMILRYFNVIGSDPEGRLGEAPRPELREHGRISGACFDAALGIIPGLKVRGTDYPTADGTCIRDYIDVTDLVDAHVKALGKAEPGKVGIYNVGTGQGRSVNEFVKACMKATGASIKVEYLARRPGDYAEVYSDPSKIYKDLNWTAQYTDLGQSLAQAWKWQKAHPNGYGSA

SEQ ID NO: 42010 - protein, 252 aa, Sorghum bicolor
  Clone ID: SORBI-28MAY03-C117121_1.pep
LSPSGLPVREIPGSYGVPFFSPLRDRLDYFYFQGAEEYFRSRIAKHGGATVLRVNMPPGPFLSGDSRVVAVLDARSFRVLLDDSRVDKDGTLDGTFMPSLALFGGHRPLAFLDGADPRHAALKRVMIRLAAARMHHVAPAFGVAFAATFDAVEAELASCAGAASEFNKHNMRHMLDFTCAALFGGKPPSKAIGDGAAAKAYKWLAFQLHPLASKAIRPWLLEELLLHTFRLPPFLVRRDYAELTAYFADVAG

SEQ ID NO: 42011 - protein, 145 aa, Sorghum bicolor
  Clone ID: SORBI-28MAY03-C11746_1.pep
MATATLLSSSFAMPAAAAARRATSSSSSATSLGFATSQLAGLSLSAGAATPTAVALLPKRQQLQPIVARRVCPFTDKKTNRANKVSFSNHKTKKQQFVNLQYKKLWWEAGKRFVKLRLSTKALKTIEKHGLDAVARKAGIDLNKK

SEQ ID NO: 42012 - protein, 170 aa, Sorghum bicolor
  Clone ID: SORBI-28MAY03-C1169_1.pep
MAVDPRQVVAGFLTLSMFVMLGNMIKHDHFSSPVTEELALEATGVESNTVKLDNNAEMNSVDMAGVEDLMDAIEDVKPCWTKPSQKNQPSNGFVTFSLTMGPEYHISQITDAVVVARYLGATLVLPDIRGNELGNKRKFQDMYNVDKFVRSLDGVVEVIEEIPDEVSAKN

SEQ ID NO: 42013 - protein, 200 aa, Sorghum bicolor
  unsure (1)..(200): unsure at all Xaa locations
  Clone ID: SORBI-28MAY03-C11777_1.pep
IIRQREAKRGSPKTEAQDKALNLLRXDLHKAIDSENYALAAGLRDDIAKLEAESLAVSAKALAYQNVKYAFRLGQKVRHNIHGYRGVICGMDPVCCESKSWMETANVEKLSKGPNQPFYQVLVDVYVDPELLVAYVAEENLSAAEESEKGRFDHPYIEFLFYGEDTAGDFIPIKQLREKYDQPRYEASGDESDNDDNTNS

SEQ ID NO: 42014 - protein, 181 aa, Sorghum bicolor
  Clone ID: SORBI-28MAY03-C13469_1.pep
HNLRQLQFIIKNSSKLRRRLMDKELDPAVLLTMSADELKAGLTSAEKTSEPEESRKLQMTDKRCERCSEKKVVISNIIHAGHGDRYQLECTSCGCTCFSSRDAITTLTEDAPTTAGNVGTAPLATAKFEVVEKQLTSPRDQSGKPASDALRKSTAAYMPTMERQKSFVKPKDEPSPAPKQG

SEQ ID NO: 42015 - protein, 193 aa, Sorghum bicolor
  Clone ID: SORBI-28MAY03-C13531_1.pep
MATTDLGFEETELRLGLPGGGGEVVGEGRSSVVSSGKRGFAETIDLKLKLEPATPAAVLKAAEADEHQDGVAAAAAAKEDAGCVAAAEEAAVGGKMKRSPSQSSVVTAAAVQADPAEKPRAPKAQVVGWPPVRSFRKNIMSVQSDKGAGGSKDADKSSPAAAAGGGAAFVKVSLDGAPYLRKVDLKMYKSYQE

SEQ ID NO: 42016 - protein, 250 aa, Sorghum bicolor
  Clone ID: SORBI-28MAY03-C13613_1.pep
MGTKMKKGILKPFRYISNMMDGKEPEMQIGFPTDVKHVAHIGWDGPGSNNNNSNNNAGGAPSWMKDYHSAPLDSSSFRSESGGTAAANPWASQEIVMDGGNSIGDTSFRDTKSEAGGADVGGGDSPPTPGSRRARRHRSRGSATSSMDVSTGAEGGAEERKKEKGKKGTRKNRKKDKSAGDDAASATCQDLPAVPKKSNRRKNKGSSDGGAAAKDSATAAPERGRRRPHQGVWQDHSHRPQAPFQSVQRA

SEQ ID NO: 42017 - protein, 171 aa, Sorghum bicolor
  Clone ID: SORBI-28MAY03-C13497_1.pep
GTDADASVSGGGSGGADAAVSGGVSGGAKVSGGVKGDAGGSGKAYTGTDGDASVSGGGSGGADAAVSGGVSGGAKVSGGVKGDAGGSDKAYTGTDGDASVSGGGSGGAKADIGGTVGGGVSGGAKIGGGVKGDAGGSGDAAASTSAEAKAGGSKSSGGGSDFGYGASSKEL

SEQ ID NO: 42018 - protein, 83 aa, Sorghum bicolor
  Clone ID: LIB3480-022-P1-K1-B9.pep
HHAYPLTPPLTLAPPKTPPLTVASAPPDPPPETLASALVPALPHASPLTPPPILAPPETPPPTVPPISALAPPDPPPETPPPA

SEQ ID NO: 42019 - protein, 141 aa, Sorghum bicolor
  Clone ID: SORBI-28MAY03-C13539_1.pep
MDGGGGGDLRSAIKKWNVIYPVYLNSKKTVAEGRRIAAAKACPDPTCVEIADCCSHLKIPHAIELDKAYPRDFFQVGRVRVQLKKDDGSPVNPAIKTKKQLMIQIAELVPKHHGRTKKQEAATSSSAGGSSKNSKGGKKKK

SEQ ID NO: 42020 - protein, 88 aa, Sorghum bicolor
  Clone ID: SORBI-28MAY03-C26796_1.pep
MRRFKRVTEVGVENRFNSPASWLDPKLPMEPAAGESQSTGGRFFIADEMGMAQLAQLEEYLETGSPGQEQDHNKAQNGHIQNLVRRLL

SEQ ID NO: 42021 - protein, 201 aa, Sorghum bicolor
  Clone ID: SORBI-28MAY03-C26834_1.pep
MLAWKEKVADRLARLLADSPVSPSPAQAAVAPPQAKSFPAEPFIPPKTSSLSSYVFSLLPTSNLGHEQNSPCSETLRPLPPESLPKKWRGSNLTWKDPPLELSEESGSESERDERNGNFGSDQVLQSYRSINNSNGNEETSTSDCAGTLRYLTEKSMFVSPKLFAFFQSSLPETLKGCHWVLLYSTWKHGISLRTLLRRSE

SEQ ID NO: 42022 - protein, 132 aa, Sorghum bicolor
  Clone ID: SORBI-28MAY03-C26817_1.pep
CQVMLRVGDLDRAINFYEKAFGMELLRKRDNPEYKYTIAMMGYGPEDKNAVLELTYNYGVKEYDKGNAYAQIAISTDDVYKTAEAIRVNGGRITREPGPLPGINTKITACTDPDGWKTVFVDNIDFLKELEE

SEQ ID NO: 42023 - protein, 290 aa, Sorghum bicolor
  Clone ID: SORBI-28MAY03-C26890_1.pep
HEAPDEPVYGLLVDLWGKAGNVDKALGWYQAMLQDGLQPNVPTCNSLLSAFLKMNRFQDAYIVLQNMLAQGLVPSVQTYTLLLSCCTEAQAQMGLCGQLMAITGHPAHMFLLYLPDAEPGGQNVRDHTGYFLDMMHSEDRESKRGLMDAVIDFLHKSGLKEEAGLIWEVAAQKNVYPDSVREKSSSYWLINLHLMSEGTAVTALSRTLAWFHRQILTLGTGPERIDIVTGWGRRSRVTGSSLVRQSVQKLLNLFEFPFFTTRGNTGCFVGCGEPLNKWLHNPYVERMHLL

SEQ ID NO: 42024 - protein, 189 aa, Sorghum bicolor
  Clone ID: SORBI-28MAY03-C26932_1.pep
VKGSCTRLDPEYFRRQQLTEKSDVYSFGVVLFEVLCARPALSPSLPKEQVSLADWALHSQKKGILGQIIDPYLQGKISPQCFMKFAETAEKCVADHSIDRPSMADVLWNLEFALQLQESAEDSSSVTDGTSSNTSPLTILRLHSDEPTTDTTTTTSTSMSMTGRSLASVDSDGLTPSSVFSQLMHPGGR

SEQ ID NO: 42025 - protein, 278 aa, Sorghum bicolor
  unsure (1)..(278): unsure at all Xaa locations
  Clone ID: SORBI-28MAY03-C26964_1.pep
PGRGRGHFNDYQNQGKLFMAHSCARGKDLAGMVVTAAHSGKRFYVDSICDNMNAENSFPRKEGYLGPLEYSSFADYYKQKYGVELIXKKQPLIRARGVSYCKNLLSPRFEHSEAGNGEFSENLDKTYYVYLPPELCLVHPLPGSLVRGAQRLPSIMRRVESMLLAIQLKDIIGYPVPANKILEALTAASCQETFCYERAELLGDAYLKWVVSRFLFLKYPQKHEGQLTRMRQHMVSNMILYQYALDKNLQSYILADRFAPSRWAAPGVLPVFDEETRD

SEQ ID NO: 42026 - protein, 334 aa, Sorghum bicolor
  Clone ID: SORBI-28MAY03-C14026_1.pep
MMGGFLSRVLLLAFGYAYPAYECYKTVELNKPEIEQLIFWCQYWILVALLTVLERFGDFTISWLPFYSEAKLMFFVYLWYPKTKGTTYVYGTFFKPYISQHENEIDRNLLELRARATDMVVIYFQKAASVGQNTFFDVLKYVAAQSPSQKSRQRPQQESQQPQQQQPQVQVQVQLQQPQPQKQAAPVMRRAASIAARQAAMAQQSQETKPVPSSPKIKRQTSGKSGSVASTKPAAAASTPKPAGSPKKGEVKPAADPVQTPATSANSPKSEPNAPPLPEAEGVDKMAIDEVSGDAAEGAEELDPALEETPMEETIRVTRAKLRRRTATEDPAGN

SEQ ID NO: 42027 - protein, 113 aa, Sorghum bicolor
  Clone ID: SORBI-28MAY03-C14150_1.pep
FLTHCGWNSILESVWAGVPMLCFPLLTDQITNRRLVAREWRAGVSIGDRGAVRADEVRARIEGLMGGEDGVMLREQVKKLRGTLEAAVAPGGSSRRSFDEFVDELKRRCGGSH

SEQ ID NO: 42028 - protein, 173 aa, Sorghum bicolor
  Clone ID: SORBI-28MAY03-C14220_1.pep
YEGNDCGICRVGGKEKFFHCVKCGSCYSVELRDNHRCVENSMRQNCPICYEYLFDSLQGTRVLNCGHTMHLTCFGGKVVARRYTCPICSKTALDMTRHWGVLDQEIEATIMPVIYPYLIWVLYNDCNKIAVINSHAVALASTHCSSPNTRSTSRPADSSGSSSPSTDSSDNNM

SEQ ID NO: 42029 - protein, 194 aa, Sorghum bicolor
  Clone ID: SORBI-28MAY03-C1462_1.pep
RNSHATLRYKNIKRRAQKAEVGGGMTGPAWRSTLWSIVGTVKWYGIGVALIYAVTLSIFPGYITEDVHSEALKDWYPILLISAYNVFDLVGKALPAVYLLQNGNVSVAGSFARLLFYPLFYGCLHGPSFFRTEIPVTVLTCLLGLTNGYLTSVLMILAPKAVPIHHSETAGIVIVLFLVVGLVIGSFVSWFWVI

SEQ ID NO: 42030 - protein, 97 aa, Sorghum bicolor
  Clone ID: SORBI-28MAY03-C12960_1.pep
FLPETSSMPLRIYYNNLHSSRLISRHTLNVTSVSRTETFIKKSFTNTRVYLQGAGTLISRCTLLKRTLLYLFTLQTCIEIFVNKLQEFSFTPWVHVH

SEQ ID NO: 42031 - protein, 283 aa, Sorghum bicolor
  Clone ID: SORBI-28MAY03-C13148_1.pep
CKWGCGYPYFAVVLNFSQYWALYCLVEWYTATKDELAHIKPLAKFLSFKSIVFLTWWQGVIIAIMYSLGLVRSPLAQSLELKTSIQDFIICIEMGVASVVHLYVFPAKPYELLGKQYSPTNISVLGDYAASDPVDPDEIKDISRPTKVRLPQLEPDEIVATNTGAPVRDLVIGSRVYVVKDFKFTVNQAVRPVEKRFDKMKKNIKFRQSRDDNWVSASTPERTIRGIDDPLISGSASDSGIVGKGKRHRRDSSSAAAVDSWEGTEQAPDSFVIRGRRWEIKKS

SEQ ID NO: 42032 - protein, 302 aa, Sorghum bicolor
  Clone ID: SORBI-28MAY03-C1327_1.pep
MRKLVSSRLAALSSPEVASAAAAAGGAALALRGWWEEVNDSPAWQDGAFFSLSAAYALVSAVALIQLIRIQLRVPEIGWTTQKVFHLMNFIANGVRSIIFGFHAYVFLLQRKVYTLVLLDLPGLLFFSTYTLLVLFWAEIYHQAKHLPTDKLRTIYIAVNSVIYVIQVCIWVYLGINDNPLVELVSKVFISAVSFIALLGFLIYGGRLFVMLRHFPIESKGRRKKLIEVGTVTAICFTCFLIRCIVVAFSSFDPDLSLEVLDHPVLDFFYYMLTEILPSALVLFVLRKLPPKRVSGQYNSIR

SEQ ID NO: 42033 - protein, 149 aa, Sorghum bicolor
  Clone ID: SORBI-28MAY03-C13325_1.pep
RRRFDKRIYIPLPDLKARQHMFKVHLGDTPHSLTESDFESLARRTDGFSGSDIAVCVKDVLFEPVRKTQDAMFFFKADGDMWMPCGPKQPGAVQTTMQELASKGLAAKILPPPISRTDFEKVLSRQRPTVSKKDLEVHERFTKEFGEEG

SEQ ID NO: 42034 - protein, 178 aa, Sorghum bicolor
  Clone ID: SORBI-28MAY03-C13413_1.pep
YCVGLLAAGYCMFSSSVIFVLTGGTGVYVFTLDPMYGEFVLTQEKLQIPKAGKIYAFNEGNYALWDDKLKKYMDSLKEPGDSGKPYSARYIGSLVGDFHRTLLYGGIYGYPRDKKSKNGKLRLLYECAPMSFIVEQAGGKGFDGHQRILDITPTEVHQRVPLYIGSVEEVEKVEKFLA

SEQ ID NO: 42035 - protein, 78 aa, Sorghum bicolor
  unsure (1)..(78): unsure at all Xaa locations
  Clone ID: SORBI-28MAY03-C15051_1.pep
GGSYPPYIALDPSFYSRSSGQTSSSVPSRETSANRGSKSPPRNDMGNEELDQRQNKPRRXLRDELQPVKHLVRWTASE

SEQ ID NO: 42036 - protein, 175 aa, Sorghum bicolor
  Clone ID: SORBI-28MAY03-C15207_1.pep
FTQFLLDSEDDSDAFEPPAFCKFGSMKASSRNPLSKLDECDEEDEDETEDDEDDDILTSALPQKIPSISKLSSSMKGLGFIGKSKLYRRGVPKGKVTGRTNYSGKASEHQSGSRSANELLPPSASFVKLSDMSPKEWSAFLEKFQELLPGAFHTRKHTAGVGQRPMPRLGTSCQF

SEQ ID NO: 42037 - protein, 130 aa, Sorghum bicolor
  Clone ID: SORBI-28MAY03-C15276_1.pep
MTSYRELSKKAQKANNIWWRLSGLLGDRNRQVMYILLQALFTVATMALTVPIFLSYRMHVVFLILKVCASTWNGGSFILEVMPRQVVQKQQKKKLDMKPIEQGSSTQSAPGDDGTLGNHHHHTSEEQIQE

SEQ ID NO: 42038 - protein, 300 aa, Sorghum bicolor
  Clone ID: SORBI-28MAY03-C15283_1.pep
TRVLQTITELEENIQEGLSVAKKKERKILSHAKVVGTACDVCKPEDVKKLVNFAINELGSVDIWINNAGTNKGFRPLVTFSDDDITQIVSTNLVGSLLCTREAMNVMQYQEKGGHIFNMDGAGSGGSSTPLTAVYGSTKCGLARGQGSLLKESRRSKVGVHTASPGMVLTDLLLSGSSIRNKQMFNLICELPETVARTLVPRMRVVKGSGKAINYLTPPRILLALVTAWVRRGRWFDDEGRAVYAAEADRIRNWAESRARFSFTDAMEMYTENTWVSVFSLSVVCAFIILSSSGGPLPGT

SEQ ID NO: 42039 - protein, 153 aa, Sorghum bicolor
  Clone ID: SORBI-28MAY03-C13624_1.pep
KEWEIRSSAVSRLVYCINSFREAALSNDQKFEHIDVSEKQTRINECSEAETWLIEKKQQQDALPKHANPVLLAADLKKKAETLDRFCKPIMTKPKPAPKPQTPPPVETQAPEPQTPEQQQSNGESAASEGAAEEPPAEQMDTDKPEGATDPSA

SEQ ID NO: 42040 - protein, 115 aa, Sorghum bicolor
  Clone ID: SORBI-28MAY03-C13847_1.pep
ANIANSAHKILGRLYAFDVHCNSFFPAFVILYVASDFLSPLLVAHGFFPALLSNLLFVVAISYYHYLNFLGYDVLPFLDRTTFFLYPIGLVIILSPLMILIGFNPTRYFLSLYFG

SEQ ID NO: 42041 - protein, 235 aa, Sorghum bicolor
  Clone ID: SORBI-28MAY03-C13873_1.pep
RVASIVGRNNGGVIAGLVSCGIVMGSMSNSNNLMQDLKTGYLTLTSPHAVFISQAIGTALGCIINPIMFWIFYKVQNGNADIFDAPYARVYRGIAMLSAGQNGLPMHCLWLCKIFFTLALVLSMFREMATCKQWRVAQYIPSTICMAIAIVMPARIPIDMFVGSLLLYLWRCANPSKAPAYSMAVASGMVCGDGLGMLLTSAMALTQVHAPICIKFLSRTDNVKMDAFLATLPMT

SEQ ID NO: 42042 - protein, 337 aa, Sorghum bicolor
  unsure (1)..(337): unsure at all Xaa locations
  Clone ID: SORBI-28MAY03-C13680_1.pep
MKLEEARRLEEARHAEEAALALAEMEKAKCRAAMEAAEAAQRLADLEAQRRRNAEVRARREADEKVRALDAISNHDFRYRKYHIDEIEMATERFSDELKIGEGGYGPVYRASLDHTPVAIKVLRPDAHQGRKQFQQEVEVLSCIRHPNMVLLLGACPEYGCLVYEYMEHGSLEDRLFRRGGTPTIPWPQRFRIAAEIATALLFLHQTKPEPLVHRDLKPANILLDRNYVSKISDVGLARLVPPSVADSVTQYRLTATAGTFCYIDPEYQQTGKLGVKSDIYSLGVLLLQVVTARPPMGLTHHVXKAIDAGTFAQMLDITVKDWPVEEALGYAKLALK

SEQ ID NO: 42043 - protein, 139 aa, Sorghum bicolor
  unsure (1)..(139): unsure at all Xaa locations
  Clone ID: LIB3480-011-P1-K1-F2.pep
LVLGRSRSRTSGCLVYEYMGNGSLDDCLFHRGGGGQVLPWQHRFRIAAEIATGLLFLHQAKPEPLVHRDLKPGNILLDRNYVSKISDVGLARLVPPSVADNVTQCHMTSAAGTFCYIDPEYQQTGMLGGKXDVYSLGVT

SEQ ID NO: 42044 - protein, 158 aa, Sorghum bicolor
  Clone ID: SORBI-28MAY03-C13876_1.pep
MSNSKKIVVKLDLHDNKDKQKALKAVSVLVGIDAISVDMAAHKMTVIGTVDPVQVVSKLRSKSWAAHLDSIGPAKEPEKKEEKKEEKKEEKKDGDGKKEEGDGKKDGGDGKKEEGGEGKKEEAGDGKKDGGEGKKEDGDGKKEEDGKKEEGKKEDEKE

SEQ ID NO: 42045 - protein, 103 aa, Sorghum bicolor
  Clone ID: SORBI-28MAY03-C13746_1.pep
KLLVLRALSLLPRRLDGKPSKDKDVQASSPAKRQANATNGVQPSTATTSQGSSSRKTTGKLVFGSGSGGSRTEKAPEKEAKEEPKKEDPKFTAFTGKKYSLKG

SEQ ID NO: 42046 - protein, 144 aa, Sorghum bicolor
  Clone ID: LIB3480-006-P1-K1-C6.pep
RTSHCGVLEFIAEEGMIYMPYWMMQNLLLQEGDMVFIKNANLPKGTYVKLQPHTTDFLDISNPKAILEKTLRNFSCLTTGDSIMVAYNNKKYYIDIVETKPSNAISIIETDCEVDFAPPLDYKEPEPVKPAVPASTEPTTEAPA

SEQ ID NO: 42047 - protein, 69 aa, Sorghum bicolor
  Clone ID: SORBI-28MAY03-C15974_1.pep
MADEEVTDPKALLEERSKAKCVSQWYEYQKCVKRIENDETGHKHCTGQYFDYWKCVDKNVAEKLFEMLK

SEQ ID NO: 42048 - protein, 139 aa, Sorghum bicolor
  Clone ID: SORBI-28MAY03-C15993_1.pep
MANSASGLAVNDECKVKFRELKARRSFRFIVFRIDDKDMEIKVDRLGEPNQGYGDFTDSLPADECRYAIYDLDFTTVENCQKSKIFFFSWSPDTARTRSKMLYASSKDRFRRELDGIQCEIQATDPSEMSLDIVRSRTN

SEQ ID NO: 42049 - protein, 121 aa, Sorghum bicolor
  Clone ID: SORBI-28MAY03-C16079_1.pep
HEEGGGGGGGGMPGLGCTRGGANGGGGGGGMHSGAEMLQAAAAAGNPMAQQQYMALMQQQQQQQQMMMQHGHGGAGYPAAMGYGYGRPPMHYPMGYPMAPHSHADNYNIFSDENPNSCSVM

SEQ ID NO: 42050 - protein, 117 aa, Sorghum bicolor
  Clone ID: SORBI-28MAY03-C16344_1.pep
MAQGLNGGNGAPPLVAVVKNELYAADYATKEVRKYDKENNAWITFGLLPGRYTSVHGWGIAFRSCGKMLIVIGAISVGGGGVIEICSWVPNNEPPDWKIIGPPRSGSFVYNCAVMSC

SEQ ID NO: 42051 - protein, 113 aa, Sorghum bicolor
  Clone ID: SORBI-28MAY03-C1609_1.pep
SLVRFVLMLVVNCASFLKNTFSVTTITVFNILMNEAVTQDVRAAANGIAVTLMSISKAVAPAVAGIIFSWAQRRQTASFLPGDHLVFFILNIFTLTGLIFTFRPFFVRGSAKH

SEQ ID NO: 42052 - protein, 62 aa, Sorghum bicolor
  Clone ID: SORBI-28MAY03-C14595_1.pep
MAKIKPKALLAQSKVKKAPSQISVATIVTYMILGILVVSSVYAAYKYWIGKGPVEAVGIEGN

SEQ ID NO: 42053 - protein, 138 aa, Sorghum bicolor
  Clone ID: LIB5048-011-R1-XP1-G6.pep
YNNKTQLHSWGLIPLDAHCLHWSFAYPVFVGSINRGYNQDAEDHVGNDSSHADLARSLLHFALCQQGLWLNLCHPTLLVVARRRRRAVEGTDESVGTWPRAAATVAKLSPRERARWRGLNRRRESRGQYWRKSWDFPR

SEQ ID NO: 42054 - protein, 257 aa, Sorghum bicolor
  Clone ID: SORBI-28MAY03-C14668_1.pep
HEGDWDWFINLSASDYPLVTQDDLLHVLSELPRQLNFIEHTSDIGWKEYQRAKPVIIDPGLYSLQKSDVFWITEKRSVPTAFKLFTGSAWMMLTHQFIEYCIWGWGTRPRTVLMYYANFLSSPEGYFHTVICNVPEFRNTTVNHDLHFISWDNPPKQHPHYLTLADYDGMVNSNAPFARKFGREDPVLDKIDQELLGRQPDGFVPGGWTDVLNTTEKGKPFTVERVQDLRPGPGVDRLKKLVTGLLTQEGFDDKHCL

SEQ ID NO: 42055 - protein, 194 aa, Sorghum bicolor
  Clone ID: SORBI-28MAY03-C14719_1.pep
SHSMSASEQSARDWFLNGASGVDMMLNGGLGHGLRNMSLDSVSSARSFGHANHQQSFVSNPIELAANGWGGTWSSGSTSSSRSVASSLGAFRGWNSSESSSAMPHSDWRTNGPAPYDYTSVDWSVDTTLLNPAAKSERLSDTWSTMFMGGRSTRTPGNLSAAGIAGLHDSNHPMDPAPSPRPYEWPTFCRGGSS

SEQ ID NO: 42056 - protein, 332 aa, Sorghum bicolor
  unsure (1)..(332): unsure at all Xaa locations
  Clone ID: SORBI-28MAY03-C14946_1.pep
MSTLKKSDKKAALDFAAWSFNVTTSVGIIMVNKALMATXRVGFATTLTGLHFVTTTLMTIVFRWLGLSQPSHLPLADLVKFVTFSNLSIVGMNVSLMWNSVGFYQIAKLCMIPASCLLEVVFDHVHYSRDTKLSIMVVLIGVAVCTVTDVSVNARGLIAAVIAVWSTALQQYYVHFLQRKYSLNSFNLLGHTAPAQAGSLLLVGPFVDYLLTGKRVDHFSFSSLALFFLALSCFIAIGVNLSQFICIGRFSAVSFQVLGHMKTVLVCPLGFFSLARXGPDLQVVLGMVLAVLGMIWYGNASAKPGGKERRSILPVRSASLKGSSEEKAGAEK

SEQ ID NO: 42057 - protein, 253 aa, Sorghum bicolor
  Clone ID: SORBI-28MAY03-C15009_1.pep
MVVIELEPEEPTRPSSPAAEEQAAAAAAGEAARPSSSAAPEEVAAAAAAGGEASRAAEEDEEAFEDALTDEQLREKARSQANDAKAEGNKLFGAGQYEEALSQYEMALQIAAELESSEDIRAACHSNRAVCFLKLGKHDETIKECTKALELNPTYLKALLRRAEAHEKLEHYDEAIADMKKVIEMDPSNQQATRSLFRLEPLAAEKREKMKEEMIGKLKDLGNSVRTRGRTRGDNFKAVKDPNTGSYSIQFQK

SEQ ID NO: 42058 - protein, 151 aa, Sorghum bicolor
  Clone ID: SORBI-28MAY03-C15019_1.pep
PSMDKIEKTPGEASGRRNPSGSVNPSDNYAQRPRETVSMSLKEIMHSTDRSGERTVERPRTSSRTGSASRRAVASSSRPASSVEPSEQYNRTSRLFSSNSGSRPSSTQRVNPSPGESRATSLSRAAVARGSRDEPLHRSLELLSLGGGKRK

SEQ ID NO: 42059 - protein, 89 aa, Sorghum bicolor
  Clone ID: SORBI-28MAY03-C17075_1.pep
MAQPAFLSSLRSRLRSAPPPPHHRLQPSRGYHAELGAREKALLEEDVALKRFKSYKNSVKQVSKIGNALTFAVVLACSYELAVFTINRK

SEQ ID NO: 42060 - protein, 121 aa, Sorghum bicolor
  Clone ID: SORBI-28MAY03-C17228_1.pep
MDPAKLAAFLAVAVVVCAVAAAPATADYYSGGGGGGGAPAPESCQTQITYFTNCLARSEIRGQCCSVVESRKCLCQLKREVALPCSLHRHHGRKCSKDEQAPPSVKLAELQRLPCFKTLKC

SEQ ID NO: 42061 - protein, 111 aa, Sorghum bicolor
  Clone ID: SORBI-28MAY03-C17288_1.pep
MGFRGKLKLSRKEQHGVSMKFRVRDPRPAQTIQDGLRFVKNMKHGLAGQPDKYDEVVATMRQFMSGSICTADVVERVKVLLEGHPDLLRHFNEFLPWGYIRAHGPLGRLSV

SEQ ID NO: 42062 - protein, 149 aa, Sorghum bicolor
  Clone ID: SORBI-28MAY03-C17291_1.pep
MGQVESQATPPAEEPSPAAVEPSPPSPAPPPSSLEALAAEAMSFDEDGTEESIDVKVQKALDCPCVADLKNGPCGGQFVDAFSCFLRSTEEEKGSDCVKPFIALQDCIKANPEAFSKEILEEEENDEEADKSNLKVRAPSWSRESKPKV

SEQ ID NO: 42063 - protein, 140 aa, Sorghum bicolor
  Clone ID: SORBI-28MAY03-C17194_1.pep
GGALPVPACISLPPGGAAGPQIPRPPLLLLPARTRSRHQEISPSTPILLPSRAMAAQTVVLKVGMSCQGCVGAVKRVLGKMEGVESFDVDIKEQKVTVKGNVTPDAVLQTVSKTGKKTEFWEAEPVTTESAAAPADATTA

SEQ ID NO: 42064 - protein, 159 aa, Sorghum bicolor
  Clone ID: SORBI-28MAY03-C15351_1.pep
MAIAARALRRLPLHLSPSISRSFCAVSPAAAPAPAAASAKVADRIVRVLAIDPDGARREVVGLTGQTLLRALANAGLIEPASHRLEEIDACSAECEVHIAQEWLDKLPPPSYEERYVLTRASRNRELNKHARLGCQVVLAPELQGMVVAVPEPKPWDIP

SEQ ID NO: 42065 - protein, 151 aa, Sorghum bicolor
  Clone ID: SORBI-28MAY03-C15365_1.pep
IDGASLIGSAGEWDQPLTMRIPGNYGAVYITLSRFNSAVEATVEVLISEVQCSFNLSLTCLTSQLSKEIRLFHGAIAGSRGLQRSVVAIPWNSSINLNFKVGALSSSSNQHYCSFMAKVHGHDTQEIKTLFALISVKVTWSMLPIALDCLY

SEQ ID NO: 42066 - protein, 254 aa, Sorghum bicolor
  Clone ID: SORBI-28MAY03-C15870_1.pep
RHEDWSKENESQYRKKITSLSKVSHKNFMNLLGYCEEEHPFTRVMVFEYAPNGTLFEHLHVREAEKLDWMARLRISMGIAYCLEHMHQLKTPLVLRNFDSTTVYLTDDFAAKVSDLEFWNDAKGYNSTNNELAFSLDLENIVHKYGMVLLEILTGRVPCSEDDGPLENWASRYFEGEMRLEELIDSSIGFFPEDTARALCEVVRSCIDRDPKKRPQMQEVAARMREITALGPDGATPKVSPLWWAELEIMSSES

SEQ ID NO: 42067 - protein, 155 aa, Sorghum bicolor
  Clone ID: SORBI-28MAY03-C15815_1.pep
RFASKQISPQVSGGNFEVGQVTYKFNFMKSRGPRRMQCNIQCPVSQGTMSDPSKEKTPSSSSLDLKNKAPRWHDHLQCWCLNFHGRVTVASVKNFQLVATAGSGGPWGVGDEETVILQFGKIEDDAFTMDYRQPLSAFQAFAICLTSFGTKLACE

SEQ ID NO: 42068 - protein, 172 aa, Sorghum bicolor
  Clone ID: SORBI-28MAY03-C15930_1.pep
KPGQEQSLSASAGFPTFSSYGDPPVYGTPSLEVPGLIKISCDGGPPCDPDARDWLAGDPEVTDRVARWVQEAMPGHVDASGGPVIRQSCMCSMTPDFDFVMDFLGGELGRDVVVGVGFSGHGFKMGPAVGKILAEMAIDGDSPTAAEADLDLGFFRIGRFDGNPVGNANKDQ

SEQ ID NO: 42069 - protein, 297 aa, Sorghum bicolor
  Clone ID: SORBI-28MAY03-C15964_1.pep
MKSSLRKLRGFALQRHEQRVDRDRGGRGHSTAAAATAADELLAAAQDMADMRSCYDNLLSVAAAIANSAYEFSEALQEMGTCLLKRVTPNKDGINDKVLLLLGKSQFELRKLVDSYRVHVLNTITTPSLSLLNELQTVEEMKRQCDEKRELYEFMLNAQKEKGRSKNAKGDNGASEQLKQAQEDYQEEATLFLFRLKSLKQGQFRSLFTQAARHHAAQLNLFRKGVKSLEAVEPHVRLAAEQQHIDHQFSALEEEDYLVEDENDDDYNDSHDGELSFDYGENKEAEESGNVSRNHTE

SEQ ID NO: 42070 - protein, 182 aa, Sorghum bicolor
  Clone ID: SORBI-28MAY03-C17709_1.pep
VPRSCRPSAGRLCRLYRLVSASASASAAPRPHHLPFAVNPSPAPLAPSSSASSPPGFAAPYRLFSSASGSSMVVVGSADSFNSILSKVQDEKLPAVFYYTAVWCGPCRAIAPLVSKLSSQYPKIPVYKVDIELEGLGNKLHGLNICSVPTFHFYHKGQKIDEIVGADGKKLQAGMESLHKQQ

SEQ ID NO: 42071 - protein, 266 aa, Sorghum bicolor
  Clone ID: SORBI-28MAY03-C17882_1.pep
MGPEEAEAVLETIWDLHDKVSDAIHALSRAHFLRAVRRRASAADKPAAGLVYVKGGGLGLGARGGDEVAALAALAEEARSLHAIRAALEDLEDQFECFLAVQSQQQAERDFALARLEQSRIMLAIRLKEHHGKNHEVIDEASNFVRNVYQDVWPSLSTTKPEKCADSSSNTAKGPPGFVRMVSSSLAVAGSSFNLKSLGGALGNSAALALGIVSVLQLRWLASGAHSSGAGNYSYRKISEKNSSSRLGISPSGSRTARLDVSLARG

SEQ ID NO: 42072 - protein, 221 aa, Sorghum bicolor
  Clone ID: SORBI-28MAY03-C17890_1.pep
MAFASSLLPVPASRVCASPAPELAAFSTAKKSVSLAAASRRRGPRHGVRAEVNESGSALAVDALSQVKHVLLPVLDRNPYLSEGTRQAAATTASLAKKYGADITVVVIDDKPKESVPDHDTQMSSIRWHLSEGGFSEFKLMERLGEGQKPTAIIGEVADEWNLDLVVLSMEAIHSKHVDGNLLAEFIPLYLFYRSRSDMGMELICICHVFLSQMVCFSLKM

SEQ ID NO: 42073 - protein, 244 aa, Sorghum bicolor
  Clone ID: SORBI-28MAY03-C17960_1.pep
PAGLGSSIINARPPYRRSPTPPQDPPKVPKAAAARQPAMAAQSFLLAATATATTAALFAAPYSSARPFHSAHFVAGPGGAAAARALVVADASKKAVAVLKGTSEVEGVVTLTQDDDGPTTVNVRITGLTPGLHGFHLHEFGDTTNGCISTGPHFNPNNLTHGAPEDEVRHAGDLGNIVANAEGVAEATIVDTQIPLSGPNSVVGRAFVVHELEDDLGKGGHELSLSTGNAGGRLACGVVGLTPL

SEQ ID NO: 42074 - protein, 158 aa, Sorghum bicolor
  Clone ID: SORBI-28MAY03-C17968_1.pep
MAMNPPSSIVASMAAPVPAKFTKFTFRTLYIRRTDPGSKEMSQAGRPSDQLGRRNISDCPIYDGRGSNASLVGRIQGITVQIGNAHQLVTIVFETQRLKGSTLLTNGMVTAGSDEWAIYGGTGVFAMATGIIKRKNLADRTGGNTDELSMEVFCPVFG

SEQ ID NO: 42075 - protein, 123 aa, Sorghum bicolor
  Clone ID: SORBI-28MAY03-C16399_1.pep
VELNKRARRKERLRAEAEAKKMENISKEIDSLPNIMNEIAKEDKEKEKRRIRRTVVKEERRKLGPPRLGRHKFEPAPVQVLLTEEISGSLRKLKGCCNLARDRYKSIEKRGILAPSKRISKHR

SEQ ID NO: 42076 - protein, 298 aa, Sorghum bicolor
  Clone ID: SORBI-28MAY03-C16519_1.pep
RPGLAYSERYTFDDAIDIVQYAEKRGVNVLAEIDVPGHALSWGVGYPSLWPSATCKEPLDVSNEFTFQVINGILSDFSKIFKFKFVHLGGDEVNTSCWSTTPHIKSWLMQHGMNESDAYRYFVLRAQKIAISHGYDIINWEETFNNFGDKLDRKTVVHNWLGSGVAEKVVAAGLRCIVSNQDKWYLDHLDATWEGFYTNEPLTNIYNPEQQKLVLGGEVCMWGEHIDASDIQQTIWPRAAAAAERLWTPIEKLAKDTRSVTARLARFRCLLNQRGVAAAPLAGYGRSAPSEPGSCLRQ

SEQ ID NO: 42077 - protein, 162 aa, Sorghum bicolor
  Clone ID: SORBI-28MAY03-C16667_1.pep
SSSHQSSLERCGIPDSELLQYEEKSSWKGFLLVAHEPGTTVGGSHIRGSMVRASEAGYEEVDLVLPGTGRFRVQLGVNMPARARKVHEYMNTELENPNTIEEYDVVLYLGIIDILQEYNMSKRVEHAVKSLKFDPLSISAVDPNSYSKRFVKFLESVFPEQD

SEQ ID NO: 42078 - protein, 192 aa, Sorghum bicolor
  Clone ID: SORBI-28MAY03-C16910_1.pep
CHSALCSRVYQISRHSTVIHKTGTVARHHHALGISVNVVVEHPGLMLEQLAAVHLHRSRSDISSSLLSCFSFPCSFLFILALLPGAELRCGDGLRPCRGRGLAGGGLRRGSTLGFRSHRENVRISVSGQGRDERRAGRNGRRSGTERARQGKRHRNGPGRASQLTRDCAIPSQAQATGNTATGLLWHVYGFT

SEQ ID NO: 42079 - protein, 183 aa, Sorghum bicolor
  Clone ID: SORBI-28MAY03-C1695_1.pep
MAVPASASACVRAGPPPSRRACTSTTGGTGTAAFSLICRKRLPPPTRQPIHLQLQGRASSDLRCRRRLLTARGERPAPDEDEEEAAGAGGGSFDAAVALFNRGEYHACHDVVEELWYGAEDPARTLLHGVLQCAVGFHHLFNQNHRGAMMELGEGLCKLRKLQLDSDGDSGGGGPFSRFRDEV

SEQ ID NO: 42080 - protein, 174 aa, Sorghum bicolor
  unsure (1)..(174): unsure at all Xaa locations
  Clone ID: SORBI-28MAY03-C1663_1.pep
LRQLINQTERELDSRKERMLLNPASEALVLDTIRQHLLEEPAAAAAGDESFGSLVADQWSGSLPFRTDDADDMVVFGALQDAFAYGWLPDGSFAHVKPEPALSPDSHSYSYSYDGSSCCFGGLLLDPAEPLTPSSEAAATPRRGAAAAARAGGEHARGRXEEEAAVAVAGRGKH

SEQ ID NO: 42081 - protein, 212 aa, Sorghum bicolor
  unsure (1)..(212): unsure at all Xaa locations
  Clone ID: SORBI-28MAY03-C18862_1.pep
AGRAGNVAKETAAAAAAAVEKPESSVEKDSMEVDKKEEGNVRQPNAGNGLDLEKYSWTQQLPEVNITIPVPQGTKSRFVVFDIKKNHLKVGLKGQPPIIDGELHKPVKVDDCFWSIEDGKTLSILLTKHNQMEWWKSVIKAYPELDTQMVEPESSKLSDRCYAKGGTVEKMMFDQRQKQMGLPTSDEMQKPADLKGPMSEXPNMDFSRAKLA

SEQ ID NO: 42082 - protein, 46 aa, Sorghum bicolor
  Clone ID: SORBI-28MAY03-C19085_1.pep
MIYDVNSPLFRSFLSQKGGADKRKMEEHKPKEQRPKASENKPVMNE

SEQ ID NO: 42083 - protein, 280 aa, Sorghum bicolor
  Clone ID: SORBI-28MAY03-C19159_1.pep
HEAPSTPGGGGGYYGPPSPSSDTTPGGGGGGYSAPPSPAGDTSPSTPGGGGGYYGPPSPSSGTSPTTPSAPSGGYYGPPSPSSDTSPTTPGGGGGYYGPPSPSSDTSPTTPGSGGGYYGPPSPSSDTSPATPDVPLPPISTSPPFSPLTPTPTTPTPYDPNTPPFTGPCTYWIMHPGVVWGLFGFWCPLVRLFGPSAAVPFGHDLTVPEALANTRQDGVGALFREGTASLLNSMVNSGFPFTTQEVKDAFGAALSSGDDGAAAAQAQLFKKANEGHVKRN

SEQ ID NO: 42084 - protein, 69 aa, Sorghum bicolor
  Clone ID: SORBI-28MAY03-C19179_1.pep
MRNGEESNGEPANLVMSPMRNGEEGNGDLNNLDLESENSPDGISIALNLGEREPKRLRTDSMLDIDLQK

SEQ ID NO: 42085 - protein, 288 aa, Sorghum bicolor
  Clone ID: SORBI-28MAY03-C17467_1.pep
PAGPGLATIGATVHGHYGKILYKGDRLVTFIYEKSRSSDITQGLPKVEQIFEARSIDSLSPNLERRIEDWNERIPRILGVPWGFLIGAELTIAQSRISLVNKIQKVYRSQGVQIHNRHIEIIIRQVTSKVRVSEDGMSNVFLPGELIGLLRAERAGRALDESIYYRAISLGITRASLNTQSFISEASFQETARVLAKAALRGRIKKLKGLKENVVLGGIIPVGTGFQKFVHRSPQDKNLYFEIKKKNLFASEMRDILFLHTELVSSDSDVTNNFYETSETPFTPIYTI

SEQ ID NO: 42086 - protein, 214 aa, Sorghum bicolor
  Clone ID: SORBI-28MAY03-C17519_1.pep
MGKDCGNHADDDFRQSCRRLLLILLTLALLTGVIALIIYLVLRPTHPRFYLQDASLRQLDLTNGTAPLLSTTAQVTLASRNPNGRVGVYYDRLDVSASYKYQQITLASRLPQVYQGHGDVDVWSPVLSGPGVPFAPFLADALSKDIAAGYLILQVRIDGRVRWKVGSWVSGHYHIFVTCPAYFINAGAGSGYRGGTVGAHGLRFQTATYCRVEV

SEQ ID NO: 42087 - protein, 152 aa, Sorghum bicolor
  Clone ID: SORBI-28MAY03-C17314_1.pep
MASSSPSCRGGGNKADVDRIKGPWSPEEDEALQRLVARHGARNWSLISRSIPGRSGKSCRLRWCNQLSPQVEHRPFTPEEDDTILRAHARFGNKWATIARLLSGRTDHAIKNHWNSTLKRKYYAASAADGDAANGGAADADDERPLKRTSSD

SEQ ID NO: 42088 - protein, 162 aa, Sorghum bicolor
  Clone ID: LIB5049-002-R1-XP1-C8.pep
MGAEAECDRIRGPWSPEEDDALRRLVERHGARNWTAIGREIPGRSGKSCRLRWSNQLSPQVERRPFTPEEDAAIVRAHARLGNRWAAIARLLPGRTDNAVKNHWNCSLKRKLAVATTAAAVSGSGVVSADAAAEIEATRPIKRVSLSPDSPSGFRVGGPGSR

SEQ ID NO: 42089 - protein, 155 aa, Sorghum bicolor
  Clone ID: SORBI-28MAY03-C17520_1.pep
VNDQRCYTYLHIVLSQFQFTLEHKYSLWQFKAIIKAQCPGSWATSGLAEHTTGSSGTPRTPICGNVTHTHGSLGGAGLGRARRRPGVGRLVGDGDELRPVPLLRHVLVPVLIHAASAYAAARRPDDGRPDLRHRLGDGDEGLPRGFHLRELCCSG

SEQ ID NO: 42090 - protein, 115 aa, Sorghum bicolor
  Clone ID: SORBI-28MAY03-C17688_1.pep
MASSTMRTGLLFVVVVAAIHAFATSTMAETTPINVNDPVYQKIARWAVTEHVMLANDGLKFNKLVSGEVYVSLGYLYHLIIDASDRDGKDARYTAVVRQSTLGGELSLWSFKPAN

SEQ ID NO: 42091 - protein, 341 aa, Sorghum bicolor
  Clone ID: SORBI-28MAY03-C1977_1.pep
MSGDAAPHVVEDFFGAVQLLSDGTVVRGDEALLMPAEPFPDVPGVEWKDAVYDTARGLKVRLYRPAAADAGDGGSNIKLPVLVHFHGGGYCIGSYNQLGGGDHLRRRLADDLPALVLSVQYRLAPEHRLPAAIEDGATFLSWLRGQASLAAAGGVGAGAEAEPWLAESADFARTFLSGVSAGANLTHHLAVRAGSGQVDLAPVRLAGHVLLSLFLGGVQRTATESDPPDGVSLTVAMSDQLWRMALPVGASLDHPLANPFGPDSPGLENVALPPVLVEAPEVDVLRDRVLLYAARLREMGKDVELAEFEGEQHGFSVRRWGQANEELIRILKQVCTPGVPT

SEQ ID NO: 42092 - protein, 150 aa, Sorghum bicolor
  Clone ID: SORBI-28MAY03-C19960_1.pep
RGTRAATTAMIRSDSDLTSASPRSTTTHTYRLVLAGVDVDVEREREDGEGGEEDEGVHEDGLAVGVEAAEVDVAVRARELAEQARRQQHEEHHAHHHGAPVRHAELIADQIRSREQSSRGRGEGGDCERSVRGLSTRKERDDGKKSTCIP

SEQ ID NO: 42093 - protein, 129 aa, Sorghum bicolor
  Clone ID: SORBI-28MAY03-C19973_1.pep
HEGLLAVPVSFVSEHIETLEEIDMEYKELALESGIENWGRVPALGCTSTFISDLADAVVEALPSASALAARKVVDTVPSADLLANLTKMFFGSSMAFMHYLSKMLFSAILAFVLLLSPRLVSAFRNTML

SEQ ID NO: 42094 - protein, 149 aa, Sorghum bicolor
  Clone ID: SORBI-28MAY03-C20230_1.pep
MAGMTAVGKKLALAAALLCAAAAMAAAQQASGVRATYNYYNPAQNNWNLAGTYCATWDASKPLSWRSKYGWTAFCGPAGPTGQASCGQCLLVTNSATGASLTVRIVDQCSNGGLDLDYDTAFKPLDTNGAGLNAGHLTVSYQFVNCGDN

SEQ ID NO: 42095 - protein, 265 aa, Sorghum bicolor
  Clone ID: SORBI-28MAY03-C20322_1.pep
MARGLKKHLKRLNAPKHWMLDKLGGAFAPKPSSGPHKSRECLPLILIIRNRLKYALTYREVISILMQRHVLVDGKVRTDKTYPSGFMDVISIPKTGENYRLLYDTKGRFRLHSVRDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDALGHAFATRMGNVFTIGKGNKPWVSLPKGKGIKLSIIEEQRKRDAAAQAAANA

SEQ ID NO: 42096 - protein, 421 aa, Sorghum bicolor
  unsure (1)..(421): unsure at all Xaa locations
  Clone ID: SORBI-28MAY03-C1822_1.pep
SPSKSAIFPSIFSSPPPPALYLSSHCAALLPHARIPARFLRLRLGFHRRPFSFLLPLPARPGLSFALLSQLPARPGLSFALLSQLRPSQFFASRRRERGKGSLVTSLTRDSGSRGATVPRLDMCVEELDDAAGRLGFGDQEIDRRAGAAMERVCENTVSVEFKQTKLNNFVPFIRSGDWSDIGSRDYMEDAHVCISDLAKNFGYNSVDDEVISFYGVFDGHNGKDAAHYVRDNLPRVIVEDADFPLELEKVVKRSFVQTDSKFAEKFSHQKGLSSGTTALTAMIFGRSLLVANAGDCRAVLSPRGTAMEMSKDHRPCCINERKRVESLGGYVDDGYLNGQLAVTRALGDWHLEGMKEMGAPGGPLSAEPELKMVTLTKDDXFLIIRRDCIWDFLXSHNAVDFSRWKVQNPNNPGVCWKEIC

SEQ ID NO: 42097 - protein, 229 aa, Sorghum bicolor
  Clone ID: SORBI-28MAY03-C18563_1.pep
MDPDAVKSTLSNLAFGNVIAAAARDLQKEMVAKDKAQAAPASHDEVDLDELLDDPELEKLHAERIAALKKEAEKREVLKRQGHGEYREITEGDFLGEVTGSEKVICHFYHREFYRCKIMDKHLKALAPIYVGTKFVKLDAENAPFFVSKLAIKTLPCVILFKKGIAVDRLVGFQDLGSKVDFSTRALENILKMKGIIDEKKKDDDDDDEESESKNRRVRSSTAQDSDSD

SEQ ID NO: 42098 - protein, 172 aa, Sorghum bicolor
  Clone ID: SORBI-28MAY03-C18167_1.pep
MASTSMSLVLFLLLATFAAGASAATFTVKNNCNYTVWPAAIPVGGGTQLDPGQTWTVDVPAGTTGRFWGRTGCSFSGGSGHCDTGDCAGALNCTVSGQPPATLAEFSIGGTEDYYDISVIDGYNLAMAFSCSTGVTLVCRSPTCPQAYPFASEDPKTHGCSTNSNYQLTFCP

SEQ ID NO: 42099 - protein, 155 aa, Sorghum bicolor
  Clone ID: SORBI-28MAY03-C18658_1.pep
MMATLKDAAARKPVLATIRLIVPAGAARPAPPVGPALGFYRLNLMAFCKDFNARTQKYKADTPMQVTLTAYKDSTFEFVVKSPSVSWFLKKAAGIETASSRPGHSNVSSLTLRHVYEIAKLKQADPFCKHMSLEALCKSIIGTANSMGIAIVKDL

SEQ ID NO: 42100 - protein, 148 aa, Sorghum bicolor
  Clone ID: SORBI-28MAY03-C18586_1.pep
MRRCSSKISSSPPLVALALLFLLVVVCSSSSSFHGAAAARPLQPAVPLPPLIAHHEDGAKAAATATAAASSASDGLVLDESAAVVSGDDELSLSVSSEVMGADQSELEEEEGGVACEEAGNDDEYCMQRRLLHDAHLDYIYTQHKGKP

SEQ ID NO: 42101 - protein, 318 aa, Sorghum bicolor
  Clone ID: SORBI-28MAY03-C1874_1.pep
MAGQYVSPSPSKDQSDEDEAMPVEVSTTTGQYVSSLKSKVPARPVSTPTDAYTSPDELPPAAKSSATSDAYAPPKQQVVSSRQPIAGGSPDELPPAAKSSATPDPYLSSKHQVVSSQPMAGGAPDEVPPNVAANGQPNLPAAGNKPKLSMETLSGMIKKPIAKFLSPVIKSVCAKTEYPVDCEASIGGLPGAASAAATDSVGVLKLAMEAVRQKVIVAMNAATDRMNAPGVDGTTKDALDSCTSSYSDIKTSLDSVDDALKRGDVDTAHTNLDSVETDLTTCDDGFQEHGIPSVMTDHDQELQKLASNLLSIGAAIHR

SEQ ID NO: 42102 - protein, 109 aa, Sorghum bicolor
  Clone ID: SORBI-28MAY03-C20685_1.pep
GNAAEHASAIMFAMKDKLDITLGVPSGPATQLAMFVIPFCVVIGWMMGHKMDLNFQLFATATLFITVLVVAFMLQDGTANYLKGLMLILCYLIVAASFFVHVDPQSSDG

SEQ ID NO: 42103 - protein, 64 aa, Sorghum bicolor
  Clone ID: SORBI-28MAY03-C20841_1.pep
MARLHWLEAVLPLGIIGGMLCIMGNAQYFIHKAAHGRPKHIGNDMWDVAMERRDKKLMEQSSGN

SEQ ID NO: 42104 - protein, 217 aa, Sorghum bicolor
  Clone ID: SORBI-28MAY03-C20859_1.pep
MASAPTPPPLLPVTNPAPGSSPATTGGSDAPIATPAFRLFLSRLSDSARRSLSDRRPWGELLDRSAFSKPDSVSDATSRLRRNLAYFRVNYAAVVAFALGASLLAHPFSLLILLGLLAAWCFLYLFRASDQPVVLFGRTFSDRETLLGLVGASFVLLFFTSVASLIISGLLVGGALVAAHGAFRVPEDLFLDEPNAATGNSAAQGLLSFLGAPGSGV

SEQ ID NO: 42105 - protein, 82 aa, Sorghum bicolor
  Clone ID: SORBI-28MAY03-C20889_1.pep
MATSLACAGFFFDTEPVGEPRLAALNACALCSKPLARDSDIFMYRGDTPFCSQECRYEQMQHDAVRGARPRQAARSAARRQP

SEQ ID NO: 42106 - protein, 170 aa, Sorghum bicolor
  Clone ID: SORBI-28MAY03-C21278_1.pep
MAAFLRSKCPSVGRTLMGSLGNSLFGAANSSVGAVTRPSHCDAISQQIRTFIQMRTNLKVVDNSGAKRVMCIQSLRGKKGARLGDTIIGSVKEAQPRGKVKKGDVVYGVVVRAAMKKGRSDGSEIQFDDNAIVLVNNKGELIGTRVFGPVPHELRKKKHLKILALAEHIV

SEQ ID NO: 42107 - protein, 301 aa, Sorghum bicolor
  Clone ID: SORBI-28MAY03-C22400_1.pep
RDACGHDAHTTMLPGAARILQDRKNDLKGTVKLIFQPAEEGQGGAYYVLQEGVLDDVSAIFGLHVDPALPVGVVSSRPGPFAATSGRFLATVTGKGGHAAMPHDSIDPVVAAATTIVSLQQIIAREIDPLQGAVVSITFMKGGEAYNVIPESVAFGGTLRSMTNEGLSYLKKRIKEIVEGQSLVHHCTASVDFMEDTMRTYPAVINDERMYAHAKEVAESLLGDKNVKLGPQVMGAEDFGFYAQRMAGAFFTIGVGNKSTMETIHSTHSPYFVIDEDVLPIGAAFHAGVAIEYVKKNHASI

SEQ ID NO: 42108 - protein, 165 aa, Sorghum bicolor
  Clone ID: SORBI-28MAY03-C33164_1.pep
MGGEKETFDISDLNASLPAAAAALSAEDRAGLVNALKDKLQSLAGQHADVLESLSPNVRKRVEFLREIQSQHDEIEAKFFEERAALEAKYQKLYEPLYTKRYDIVNGVVEVDGVSDEPTSENAAEGKEPDAKGVPDFWLTALKTNEVLSEEIQERDEPALKYLKD

SEQ ID NO: 42109 - protein, 181 aa, Sorghum bicolor
  Clone ID: SORBI-28MAY03-C33177_1.pep
MSFRSIVRDVRDGFGSLSRRGFEVKILGHRRGRSHGAVHELHDPAPVIQSSCWANLPPELLRDVIERLEASEATWPNRKNVVSCAAVCRTWREICKEIVKNPEFSGKITFPVSLKQPGPRDVTIQCFIKRDKSTQTYYLYLCLSTAVLVESGKFLLCAKRTSRPTCTEYTIFMNSENLSRS

SEQ ID NO: 42110 - protein, 247 aa, Sorghum bicolor
  Clone ID: SORBI-28MAY03-C33221_1.pep
MECIAEMPRAPLDSRPRKRQRLGWDVGPAEMYQVTRPRLGWDVGPAEMYQLGLCGQEVVNAISAAALGLSSGCVSSQVNQEQPRDGSPPLREDDKDGHYVFAVGDNLTSRYKIIAKMGEGTFGQVLECWDKERKEMVAIKIIRGIKKYRDAAMIEIGMLEQLGKYDESRSSCVQIRNWFDYRNHICIVFERLGPSLYDFLKKNNYRSFPIALVREIAKQLLECIAFMHELRLIHTDLKPENILLVSP

SEQ ID NO: 42111 - protein, 463 aa, Sorghum bicolor
  unsure (1)..(463): unsure at all Xaa locations
  Clone ID: SORBI-28MAY03-C33227_1.pep
TRVFICIDLHNGTYKRKGRGITTMNDIFSRTADMPKIKIILNQYGQPVGDDYRKFASAIGCQVRKKLPVGFNDWRAVPLGKKLEVWDNLXAFYDVDAAAKKWFMDTAAKKWKDYKADLKDKYFDEILTDEQMKERLXNILDDEDLNNLIMLHEAPECQARTERGKANRAKLRVHHTSGSISHACRSYNLGKALGRRPRRDEVYINTHTRRNGVPLREAAGTIDELKAIVEAQPELKDKTIQEGDAYAAVCGAKEPRGRVRVLGLGPTPXEVGTPRLKALMSTRMQMEIVARQNAESKNRALEQRILELEEERLAQGRTNVEVLSQHGSNSRQYAILTPEEHIDEAHNDPQPENYDNYVQDEENERYGEEDEDLLPCRHGATRSAMNITTPNVQIEENLTPIRPAVAVRSAVHMNTAPSDIHPCLANDSHVAVQESLLPPRTVAARSTINMTCGHYIKILITFL

SEQ ID NO: 42112 - protein, 252 aa, Sorghum bicolor
  Clone ID: SORBI-28MAY03-C33239_1.pep
MADSGGLSANNAAAANHDDDANTAPFPDTVQVGGSPEYKVERKLGKGGFGHVFLGRRLTAAHAGRSAASAAQEVAIKFEHTTSKGCTYGHEAEWQVYTALGGTHGVPKVHYKGRQGDYYVMIMDMLGPSLWDSWNSLGQSMSSEMVACIAMESISILESMHSKGYVHGDVKPENFLLGQPSTPQEKKLYLVDLGLATKWRDTASGQHVGYDQRPDAFRGTVRYASVHAHLGRTASRRDDLESLAYTLVFLHR

SEQ ID NO: 42113 - protein, 209 aa, Sorghum bicolor
  Clone ID: SORBI-28MAY03-C2202_1.pep
MAAFPSASPSPAISASTWRMASLRAALPALRPSPGGRLRSSFAPAAAATAASVGCLGSFSGLAPVSNLLSFGAENSNFEHRLFGIDARGRIVAMRHGRRVPKLNRPPDQRKALLRGLTTQLLKHGRIKTTKPRAKAMRKYVEKMITLAKDGSLHKRRQALAFIYEKHIVHALFAEVADRYGDREGGYTRIIPTFPRRGDNAPMAYIELV

SEQ ID NO: 42114 - protein, 118 aa, Sorghum bicolor
  Clone ID: SORBI-28MAY03-C22272_1.pep
MELQARCLCVVAMLLVAGLAGLETAHGAGECGRVPVDQVALKLAPCAAATQNPRAAVPPSCCAQVRAIGRSPKCLCAVMLSDTARKAGVKPAVAMTIPKRCAIANRPVGYKCGPYTLP

SEQ ID NO: 42115 - protein, 174 aa, Sorghum bicolor
  Clone ID: SORBI-28MAY03-C22344_1.pep
ADAPNLYRLCIVFLTFSCIGYAMPFILCAMICCCLPCIISVMGFREDTNNTRGATSESINALPTYKFKTKKRRHGSGSEAEGQEGGIVAAGTDKERSLSAEDAVCCICLAKYAHNDELRELPCAHCFHKDCVDKWLKINALCPLCKSEIAGSSGTSDARQLDQNAIPVQEIEMH

SEQ ID NO: 42116 - protein, 284 aa, Sorghum bicolor
  unsure (1)..(284): unsure at all Xaa locations
  Clone ID: SORBI-28MAY03-C22194_1.pep
MAMAIAKGSVLLLVFTFLCFYDAIIRSHASPDDFPQCLSAASIPSQLVFTQSSPSFTSVLVSSIRNPRFFTPSTVRPQWILTPTNASHIQAAVVCGRRHGVRLRVRSGGHDYEGLSYRSQRPEVFAVLDLSNLRAVRIDTRSSTAWVDSGATLGELYYAVAQASDRLAFPAGLCPTIGVGGHLSGGGFGTLLRKYGLASDNVLDAVLVDXHGRLLDRTAMGSDVFWALRGGGGESFGIVLSWQVRLVPVPPTVTAFRIPVAAAGDGERAVDVVTRWQEVAPALP

SEQ ID NO: 42117 - protein, 177 aa, Sorghum bicolor
  Clone ID: SORBI-28MAY03-C19874_1.pep
MPPRSDHAGGSAAAAAATHADFDSIDPLFHVLRVLPFSFLRPPRTRLRLPSNLALPSPMTVFSLILLTYFAVVSGLVYDVIVEPPGIGSAQDPGTGAVRPVVFLPGRVNGQYIIEGLSSGFMFLLGGVGIILLDLAVDRTRPRSLRVSFGSAGAVAVVIAYAMAMLFLRIKIPGYLW

SEQ ID NO: 42118 - protein, 204 aa, Sorghum bicolor
  Clone ID: SORBI-28MAY03-C2033_1.pep
MSTRSPTTTCRRRAAVSSFPPFPLQATQVPPPGRAPRPPLRPRRLRRPAAAPAPPPRLAAPPPRCPGRFPSSPRGRKDPVNYFHTLAASPLPMATPLIAGLAVAAAALAGRYSIQAWNAYKARPVVPRMRKFYEGGFQPTMTRREAALILGVRETANAEKVKEAHKRVMVANHPDAGGSHYLASKINEAKDILTGKTKGGGSAF

SEQ ID NO: 42119 - protein, 261 aa, Sorghum bicolor
  Clone ID: SORBI-28MAY03-C20350_1.pep
TRRQWSAVPACGSREAISHTYLAFDPVVSSHFHLVQLQIPDVQENVVSLHVYSSETGTWSHNQIDKQKEQGQLEGWHHQFTLDPLQHQCAFVNGFLHLIVWGSNVHHILAVDVQGKARRMITVPLPGLADGRHGHAFVCYFGQSQGHLHCMILESADKKNVELSTWVLQDYDTQEWVLKNTVNSLDVFGDMGGVLDFQVVDIHQDCNVVFIFDQLNYELVAYDMDRKEASVIATLEDDKTQSDFARYIPYFSESPALTNKY

SEQ ID NO: 42120 - protein, 365 aa, Sorghum bicolor
  Clone ID: SORBI-28MAY03-C2037_1.pep
MPPAAAAAAFLFPAVAVPCRVLPQRRARSLAVRAVASPPASTVKPAPAPSKTGKWEWKFENKPVNIYYEEHEQEVAENVKNIIMIPTISDVSTVEEWRVVAKDIVGRKGELGYRATIVDWPGLGYSDRPSLNYNADVMESFLVELINSPNSPVANADDELVIVGGGHAATIAIRAAGKGLIRPSAVAAVAPTWAGPLPIVFGRGSDMETRYGLLRGTLRAPALGWMMYNVLVSNEKSIQSQYKSHVYANSDNVTPDIIESRYELTKRKGARFVPAAFLTGLLDPVQSREEFLQLFAKLDGDIPVLVVSTLNAPKRSKAEMEALKGSKGVTKFVEVAGALLPQEEYPLAVAEELYSFLQESFAARR

SEQ ID NO: 42121 - protein, 208 aa, Sorghum bicolor
  unsure (1)..(208): unsure at all Xaa locations
  Clone ID: SORBI-28MAY03-C2038_1.pep
AFFARAIRDVGDEELRSFFYGMSPWQFILIVAASSIGEELFCRPAMXGALADIFLRSTELMKDARGIASLSGIVPPLVPFAQTFAAVITAALTGTLYYIATAPKDPTYVVTPAMRSRTGRENLKKLFAAWYERRQMRKIYSPLLEGILAFYLGFEWIQTDNILAPMITHGIYSTVVLGHGLWKIHDHRRRLRQRIQQVRSQESTSDTL

SEQ ID NO: 42122 - protein, 168 aa, Sorghum bicolor
  Clone ID: SORBI-28MAY03-C23063_1.pep
FARQYRSPSADRSHRYGGRNDRDRYMGYRGSRHRSPPRRYRSPPRGRMPSPSRYRRRSRSASRRPVHRERGRGGGYSKSPVRSLSPPPRPRSHGDRARSVSRSHLSGSRSRSPPALHPSPPDSPSLKRASVEKSQSPSRSPSLSGSPSRGGKKGLVSYGDGSPDSAGK

SEQ ID NO: 42123 - protein, 174 aa, Sorghum bicolor
  Clone ID: SORBI-28MAY03-C235_1.pep
VHAGNLWLLRDGRIGFIDFGIVGRISPRTWAAMEVFLASFATEDYDAMARLLKGMGATGNDININEFAKDLQKIFSSIQDLDTEIIVATARTPDATAVSANVVLDERQMNALFLDLVRVSESYGLKFPREFALLMKQLLYFDRYTRLLAPSMNMLRDERINISTNRQLRRTDRF

SEQ ID NO: 42124 - protein, 200 aa, Sorghum bicolor
  Clone ID: SORBI-28MAY03-C2288_1.pep
MDSAFRRALNEPMCLEETVVQQGIERCPFLRNINEPTSFSFSSVNFPVPARGAKGPIFEDGPNFDMAFRVFHGRDGVVPLSEGSLAQIEKPLPKPNPEFNPLAAKAATISLSAFGGFFSFGDFSNKHNKKNSNKKNPNNLPQNKGQSKSNNHEALSNEWLETGQCPLARSYRALSGVVPLVAKMMTPPAGMKLKCPPAVV

SEQ ID NO: 42125 - protein, 73 aa, Sorghum bicolor
  Clone ID: LIB3481-006-Q6-K1-F2.pep
CKWTLARFQPLVTQCFMIVRLRLAFILKFQGKQNQTTEWRASQKNTAMFLSCTNYSVYHCERLFRYVARNVSV

SEQ ID NO: 42126 - protein, 233 aa, Sorghum bicolor
  Clone ID: SORBI-28MAY03-C23529_1.pep
MVSKRTMSSSLAFLMALLLSCSTMSSAARYLEETKPAEEYPPHPTVPEIPKPELPPHPTVPELPKPELPPHPTVPELPKAELPPHPAVPEHPKPEPPPHPTVPEHHPTVPELPKPELPHPTVPEVPKPELPHPAVPELPHSAVPEVPKPELPHPAVPEVPKPELPPHPAAPEVPKPEMPHPAVPEVQKPELPHPEVPKPELPPHPTVPEVPEVPKHELPPKPESHYPVPEAKP

SEQ ID NO: 42127 - protein, 150 aa, Sorghum bicolor
  Clone ID: SORBI-28MAY03-C2151_1.pep
FYAVIFPSLMQLHEGINEVEDKKQKAICLERYRRRDEDQKTVISEIDDNIEEECGICMEINSKVVLPTCSHAMCIKCYRDWRSRSQSCPFCRDSLKRVNSADLWIYTDNKDIIDVATVRRENLRRLFMYIDKLPTVIPESVFDVYDSHVK

SEQ ID NO: 42128 - protein, 196 aa, Sorghum bicolor
  Clone ID: SORBI-28MAY03-C21618_1.pep
TRGDIFGSARCDCGNQLALAMIMIEKTGRGVVVYLRGHEGRGIGLGHKLRAYNLQDDGRDPGEANLELGLPADSREYGIGAQILRDLGVRTIGLITHSPATFPGLKANDYRVFVRVPLLRPGKDENRRYSEPERGKGWDGYGRRANHHASGSGDELAGSREDQEHNYSAVVQNNTPVACVPKSAFLLSVAEIYASI

SEQ ID NO: 42129 - protein, 210 aa, Sorghum bicolor
  Clone ID: SORBI-28MAY03-C2164_1.pep
MAAAAATTSSHLLLLSRQHRCRLSFLGQSRRPAGRVTSPQAPAANNVRCMAAVDTASAAATETTSPKSSSYEIVTLTTWLLQQERTGAIDNEMTIVLASISTACKQIAALVQRAPISNLTGVQGAVNVQGEDQKKLDVVSNEVFSNCLRSSGRTGVIASEEEDVPVAVEQSYSGNYIVVFDPLDGSSNIDAAVSTGSIFGIYAPNDECLA

SEQ ID NO: 42130 - protein, 362 aa, Sorghum bicolor
  Clone ID: SORBI-28MAY03-C21676_1.pep
HEEQVQQAEVNQELDSIPVHSGEDVDEELEGERTAQAGLEQECDSVPIDSGEHGCLTSYAHTDDEQAEVKQKVTSVTADVLQYAADNFNVNTNTWKEDIEEDPTEAALTAIHPHSYEPLTSLDKFSPDHSVSEEDREPDTPTHIEGICDSQELLDSKAAASDAKSVDSSVATLSTDLESTELVSVDQLKSALASTRKSLKTLYSELENERNAAAIAADETMAMINRLQEQKAAMQMEAIQYQRLMEEQSEYDQEALQRLNELVVKREKEKQDLERELELYRHKVHLYEVKMRKMSRHKADDQNGSSSTSSSAEDSDDLSQSFYEGDESSHGLNGSNGSIPTDVVLQETARHLVTLDGSLPDF

SEQ ID NO: 42131 - protein, 148 aa, Sorghum bicolor
  Clone ID: SORBI-28MAY03-C2171_1.pep
VRNDQWHTLKDGVPHLVVYTAFFYFSISCFVIGVGLNILFLYRPMAGVPRSSFGAYLRDWNGRQWALLAGLLCGFGNGFQFMGGQAAGYAAADAVQALPLVSTFWGVLLFGEYRKSSRKTYVLLGFMLFMFVAAVAVLMASSGHRSTE

SEQ ID NO: 42132 - protein, 88 aa, Sorghum bicolor
  Clone ID: SORBI-28MAY03-C2177_1.pep
MSSQRPGRHQRRASQSVFVLPENLASLDVDAAGEVGANSKAGGPDGAGAEQQARPPAGRHRRAMSVAVASTRDLELIKEDLGSYKLGA

SEQ ID NO: 42133 - protein, 183 aa, Sorghum bicolor
  Clone ID: SORBI-28MAY03-C24215_1.pep
MASIIIIAVVLVLDVLAFVLAIGAERRRSYAYVSVDSNARGYCVYSSDASTAYGVSALLLLLAAQAVAMVATRCFCCGRALSPGRRRAWSGICFIVCWVTFVIAELCLLAGSVRNAYHTKYTTLFSKGPPQCAMLRKGVFAAGAAFTFLTALFTELHYLFYARARDAADVPPPIVGGIGMTRM

SEQ ID NO: 42134 - protein, 278 aa, Sorghum bicolor
  Clone ID: SORBI-28MAY03-C2423_1.pep
MGIPSDDVVQIRHADAAGEPTVVTVSCPDKTGLGCDLCRGARLFGLSVVKGDMSTDGRWCYIVLWVLPRGGRPVAVPWDLLKDRLLQLCPVTPPFGFDNAYLAAAGLQDVAPPAPQLFLLKLCCLDRMGLLHDVTRVLCELELTIRRVKVSTTPDGSVLDLFFITDARELLHTKNRREETQDKLESVLGDSLTCCEIDPAGEDMLSCLQSWASLTPAIMEQMFNTNLIEEQSISTRGGTISVTMDNSLSTVHTLIQIQCGDHKGLLYDIMRTVKDLHI

SEQ ID NO: 42135 - protein, 332 aa, Sorghum bicolor
  Clone ID: SORBI-28MAY03-C2428_1.pep
MRQPHLSPQLSPSPVLSSHFSPPATGASPWRRRLHRGRAFQPPLSSLREPNKATLRKASPNVPFRLGGGGGGSGSPKDRRPAADDKEEEAEGSGGGGGAGALTGTLIAGALLVGFVGGFGAAGYVYKDQINTFLTQFSGFIDGYGPAGYALFVLVYAGLEVLAIPAIPLTMSAGLLFGNVTGTIIVSVGGTLAAAVAFLIARYFARERILKMVEGNKKFLAIDKAIGENGFKVVTLLRLSPLLPFSLGNYLYGLTSVKFLPYVLGSWLGMLPGSWAYVSAGAFGRAIIQDESEIGLGGNGQLWTLGVGLLFTAIAATYVTRLAKDAVKEIDD

SEQ ID NO: 42136 - protein, 229 aa, Sorghum bicolor
  Clone ID: SORBI-28MAY03-C24350_1.pep
MAARRLGSTASRWLRPSALLLLVASALLLAPSPARALRFDLESGHTKCISDEIKVNAMAVGKYHIVGPDPNFPDAQLPESHRISLRVTSPYGNSMHYAENVQSGHFAFTAAEAGDYLACFWAPDHKPPVTIGFEFDWRSGVSAKDYPSVAKKGKVDMMELELKKLEETIRNIHEEMFYLREREEEMQDLNRRTNSRMAWLGFLSLGICLSVAGLQLWHLKTFFERKKLL

SEQ ID NO: 42137 - protein, 170 aa, Sorghum bicolor
  Clone ID: SORBI-28MAY03-C2254_1.pep
MWSAAAAAARAVSVPVSPVPAPSLLSGRRGGPRGGRGAVSVRSSLLDFVGGDLVRPDLGKWLDDVEKHKALAIYPPHEGGYEGRYLNRLRYQGYYFLDLSARGLGDPETTLTKIHPVCPVLSKAELQFLAMLPDIRPKVRVLAEVGNWRSFVWKPLKQIAGLEQNPDAEE

SEQ ID NO: 42138 - protein, 233 aa, Sorghum bicolor
  Clone ID: SORBI-28MAY03-C22622_1.pep
SVVRYGGPHFVYPSSYSKSLAFLFSQGYNLLVVNYRGSLGFGEEALQSLPGNIGSQDVNDVLTALDLVIKRGLIDPSRVAVVGGSHGGFLTTHLIGQAPDTFVAAAARNPVCNLSLMVGTSDIPDWCFVEIYGKEGKKYFSESPSVDDICQFHQKSPISHISEVKTPTLFLLGAQDLRVPVSNGLQYARALKERGIESKTIIFPEDIHGIDKPQSDFESFLNIGVWFKKHMSK

SEQ ID NO: 42139 - protein, 479 aa, Sorghum bicolor
  unsure (1)..(479): unsure at all Xaa locations
  Clone ID: SORBI-28MAY03-C22643_1.pep
MPLAAVLPILLLVLVLGASPACHGAAATHNITAILAAHPDLSDFSAALVSTGAAAEIDSRQTITVLAVDNAVMARLKAQKPDPKELQRVIYLHVLLDYFDAAKLGSIQGGFAQVTSLYQATGKAQGSDGILNITVFTDSRVAAFTPSTGPSNRLPTAFYQRSIKEVPSDIAVLQVKDLIWSPATADGVQAPAAAPAPAPAPQPGAAPELTDLLSKNGCGGFAGLLAGTVDAVAAYDRSAGAAAGLTVFCPDDKAVDAFNSTFKNLTADARIAVLLYHGVAAHYSAQSLKAINGDVGTLATDGFKNHEYNLTVRADGDTVKLSSASASNATVTKTLLDKARLAVYLIDAVLLPTEXLRAARAALRPPLRRRRRLHMHLRLRLPLRRRLPLHRSRRRQLHKHPHPHLPLLRRLHHPRTGVALRHRLRTLPQLLRRTRTANRQQIRRTTEQGTRRLGLLARRRRPRPRRWRPCSSFDEGFKL

SEQ ID NO: 42140 - protein, 316 aa, Sorghum bicolor
  Clone ID: SORBI-28MAY03-C22427_1.pep
MDGGEHEAESSSQRRERLLALRSAANASPAGDPPQAPAGSLLPDPELPGDQAASVCPPPPQRFDYYTNPAAAFTSSYSGGATNPTWSHKRKSPPACYAPPPPAYGNYGSNYPPRQQHIPSQVHSPSLMPQDAPGNSPWRSPMQFQDPMSGYRGAPPRAPPSWGSHCGPRGRGPYSNSPNFGFRHPNPGRGGSPMNYGPRGGPYSSYGRGREPNYFGNPGSRGRGGRGGVGFQNHPGWQGRSYFNKSMLDDPWLDLQPAVGNILIPRAEYDSNKSWLPESLRKRKETPAQGQIKTTSGLSLAEYLDLSFNEVSDKEK

SEQ ID NO: 42141 - protein, 117 aa, Sorghum bicolor
  Clone ID: SORBI-28MAY03-C2294_1.pep
VDPRVRDLIRESGIAYTIVRPCALTEEPAGADLIFDQGDNITGKISREEVARICVAALASPNAVGKTFEVKSTVPFSEPYVIDPTNPPSEKDYDVYFKELKEGITGKEALEATPAQV

SEQ ID NO: 42142 - protein, 168 aa, Sorghum bicolor
  Clone ID: SORBI-28MAY03-C23062_1.pep
MGTVLDSHFLALTAIVTVGYQLLFFIITALLRFDKVTDFAGSTNFVIIAILTLVLKGAWHFRQIVLTVLVTIWGLRLGLFLLMRILQWGEDRRFDEMRDNLGKLAFFWIFQAVWVWTVSLPVTVVNASDRNPSIEARDIIGWIMWLVGICVEATADQQKLVFKNSPSN

SEQ ID NO: 42143 - protein, 165 aa, Sorghum bicolor
  Clone ID: SORBI-28MAY03-C25379_1.pep
LMLFNSSDVLTYREIEQSTAIPATDLKRCLQSLALVKGKQVLRKEPMSRDIADDDSFFVNDKFTSKLFKVKIGTVAAQKETDPEKLETRQRVEEDRKPQIEAAIVRIMKSRRVLDHNSIMMEVTKQLQPRFMPNPVVIKKRIESLIEREFLERDKTDRKMYRYLA

SEQ ID NO: 42144 - protein, 106 aa, Sorghum bicolor
  Clone ID: SORBI-28MAY03-C25367_1.pep
KPVVPGADATDTGTPADDTPAAVVAADDEPSGEQQEEEEDPAALVTCSPESTLGEAIEAVASRHVHRLWVVDEEGLLHGVVSLTDILRAVRDAALGEDRELHSIVS

SEQ ID NO: 42145 - protein, 151 aa, Sorghum bicolor
  Clone ID: SORBI-28MAY03-C25381_1.pep
KNTDAATDDERARLEVVGEYHLGEFVNRFRHGSLVMRLPDSEIGQIPTVIFGTINGVIGIIASLPHDQYVFLEKLQSTLVKYIKGVGNLSHEQWRSFHNDKKTAEARNFLDGDLIESFLDLSRSKMEEVSKAMGVPVEELSKRVEELTRLH

SEQ ID NO: 42146 - protein, 527 aa, Sorghum bicolor
  Clone ID: SORBI-28MAY03-C25390_1.pep
ARGAFLSHLAEDKNIWGPFLVVAPASVVNNWAEELIRFCPDLKILPYWGPERMILRKNINPKRLYRRDASFHILITNYQILVNEEKLLRRVKWQYMVLDEAQAIKRAGSQRWKTLLSFNCRNRLLLTGTPIQNNMAELWALLHFIMPTLFDSHEQFNEWFSKGIEGHAEHGGALNEHQLSRLHAILKPFMLRRVKIDVIAEMTKKKEEIVPCKLSSRQQVFYQAIKNKISLNELLDGSRGHLNDKKLLSLMNIVMQLRKVCNHPELFERNEGSSYFYFADIPNSLLSPPFGELQDVHYAGKRNPIIFEIPKLVYEGIICNTENSGNICGFQNGYLNRLFNIFLPSNIHRSAIPEVNSSNESVLSSGAFGFTRLSNLCPVEASFLATASLFERLAFSVMQWNRNCTDEIMDAFLDSEDPDIQSSQNDSTTVRAVARLLLSSTKAKPSLLRTKIGTGPSDGPYEALVLSHRDRLASNIRLLRSADAFIPPARAPPINVWCADRSFAYKVTDEMHDPWAKKLVLGFARTS

SEQ ID NO: 42147 - protein, 318 aa, Sorghum bicolor
  Clone ID: SORBI-28MAY03-C23577_1.pep
TRLGANVATVYQPGCTNVGCSGNSLQLDAATKAAASADVTVLVVGADQSIERESLDRTSLLLPGQQPQLVSAVANASRGPCILVIMSGGPFDISFAKSSDKIAAILWVGYPGEAGGAAIADVLFGHHNPSGRLPVTWYPESFTKVPMTDMRMRPDASTGYPGRTYRFYTGDTVYAFGDGLSYTSFAHHLVSAPKQVALQLAEGHTCLTEQCPSVEAEGAHCEGLAFDVHLRVRNAGDMSGAHTVFLFSSPPAVHNAPAKHLLGFEKVSLEPGQAGVVAFKVDVCKDLSVVDELGNRKVALGNHTLHVGDLKHTLSLGV

SEQ ID NO: 42148 - protein, 144 aa, Sorghum bicolor
  Clone ID: SORBI-28MAY03-C23580_1.pep
MGSAPVHGALVLFLLLLVGAAAEETAPQEPTLPAASSGSGSGAAGSAAAVGVNSNSVLVALLDSHYTELAELVEKALLLQTLEDAVGKHNVTIFAPRNEALERDLDPEFKRFLLEPRNLKSLQALLLYHVLASRLPSDAWAAAS

SEQ ID NO: 42149 - protein, 240 aa, Sorghum bicolor
  Clone ID: SORBI-28MAY03-C23768_1.pep
MGTNPLLQELAAVVVAAADSEPPRPRPRVVRILVHDADATDSSSSEDEARPPPRRRARGGNSSVGVRRHVMEPAGASSSVRFRGVRRRPWGRWAAEIRDPHSRRRLWLGTFNTAEEAANAYDAANIRFRGASAPTNFPAASYSPPPEPAKPIISLTPEPGKVITLPPVPVKQTFPLQVKEEGGSRDGQVKGGSSEVKALPPKRVWEMIPSKRQKYPGCADGSGLRAIHAASLYVEEVGGA

SEQ ID NO: 42150 - protein, 101 aa, Sorghum bicolor
  Clone ID: SORBI-28MAY03-C23778_1.pep
MAAAAGAGGGAGGKVSFKIILTSDPKLPFKVFSVPEAAPFTAVLKYAAEEFKVPPQTSAIITNDGVGINPQQSAGNVFLKHGSELRLIPRDRVGAAVVPSY

SEQ ID NO: 42151 - protein, 140 aa, Sorghum bicolor
  Clone ID: SORBI-28MAY03-C24068_1.pep
TLFSAQPRVLPSRRAAAVSPPRLASAHPDLRLQLAPMAEETNVKKEEEEFSTGPLSVLMMSVKNNTQVLINCRNNKKLLGRVRAFDRHCNMVLENVREMWTEVPKTGKGKKKALPVNKDRFISKMFLRGDSVIIVLRNPN

SEQ ID NO: 42152 - protein, 189 aa, Sorghum bicolor
  Clone ID: SORBI-28MAY03-C24194_1.pep
MEHASAFLARALTTPLPASAALPRRRPARVAVAAAAPERKPPGAVASTTNYVVPLDAAPSGITRPLVEILRDLNKRVPDAIVRPPSRRASASDPVIPWYHANRMLSFYAPGWCGEVRDVIYTDSGKVTVIYRVTVRGTDGEVHREAAGTASLSDARFDDPVSAAEEAAFCKACARFGFGLYLYHEDETP

SEQ ID NO: 42153 - protein, 297 aa, Sorghum bicolor
  unsure (1)..(297): unsure at all Xaa locations
  Clone ID: SORBI-28MAY03-C25884_1.pep
ARGEYIKTSSKPTASIIFNGTSLGTTPAPVVAYFSSRGPSTASPGILKPDVIGPGVNVIAAWPFKVGPNTAGAGPEHDTTFNSISGTSMSAPHLSGIAAILKSAHPDWSPAVIKSAIMTTAYVAYGNSQPILDEKLNPASHFSIGAGHVNPAQAISPGLVYDTDVEQYIMYLCGLGYTDSQVETITDQKDACNKGRKLAEAELNYPSIATRASAGKLVVNRTVTNVGDAMSSYTIEIDMPKEVEATVSPTKLEFTKLKENKTFTVSLSWNASKTKHAQGSFKWVSSKHXVRSPIVIF

SEQ ID NO: 42154 - protein, 245 aa, Sorghum bicolor
  Clone ID: SORBI-28MAY03-C25845_1.pep
MRGPASVKAGSRPPWLGLGAAAWVQVAGGASSTFALYSHALKVALGADQSRLALLGVACDVGENLGLLPGVLCNRLHPALLLLIGAGACLLGYGTAWLLVSGVAPALPYWLIWFALCLATNGGAWLATAVLVTNMRNFPLSRGAVAGILKGYSGLSAAVYTAVYTGVLRDSPINLLLFLTLGIPAVCLLAMYFVQPCEPSLVETNAEQVHFLFAQMASILLGVYLVGATILDHVVTLNDIINYSL

SEQ ID NO: 42155 - protein, 107 aa, Sorghum bicolor
  Clone ID: SORBI-28MAY03-C26031_1.pep
MKQKIVIRLSVASDKCRSKAMVLAAKADGVSKMGITGDGKDQLEVEGDGIDTVCLVNCLRKKIGRADIVKVEVVKPEEKKPEEKKPEVVPLPYGWCYPNYYQYHPHW

SEQ ID NO: 42156 - protein, 104 aa, Sorghum bicolor
  Clone ID: SORBI-28MAY03-C263_1.pep
PAGPGQSAYTYPHSGGDPSSSIDQETGSMAKQQHHQAVCMVFLMAFIILSAMHAVPVEAGRALREASSVSRFDPLDPNSRHSVPAGEPYTRPGCTNVYQCHGAP

SEQ ID NO: 42157 - protein, 262 aa, Sorghum bicolor
  Clone ID: SORBI-28MAY03-C26157_1.pep
MAGLYEKPSETYAKKRPQYPKEWFSMLAGLTAGHQRAWDAGCGTGQAAISMAEHYESVVATDVSEGQLRHAAAHPKVRYLHTPEHLTEDELVSLVGGEGSLDLVVVATSIHWFDIPLFYAVVNRALRKPGGVLAVWGYNYEIHPFEGALHGQLYPALRPYQDPRAVLAMERYRHLPFPFEPVGVGAEGAPADVDIEVEMTLEDLVGFLNTGSVVTTARAKGVDLEAVTRDALKRVEQEWGGAPTSPRKLVFKAFMLAGRPKC

SEQ ID NO: 42158 - protein, 209 aa, Sorghum bicolor
  Clone ID: SORBI-28MAY03-C24364_1.pep
KLLVSCTLLHLLPLALRHLHTSESRPPGAMAASGLKVPEMALRVCVVPLALASLWEMATNAQADDTYGEVKFSDLSGFSYLVGVNAVTAAYALVSILLSSLKPLARYDWVILVMDQASAYLLVTSASAAAELLQLARRGDREVSWGEVCSYFGRFCGKATVSLALHAAALACFVALALVSAFRVLSTTGSSCHPPKHAQAQEHEQGRYN

SEQ ID NO: 42159 - protein, 206 aa, Sorghum bicolor
  Clone ID: SORBI-28MAY03-C24624_1.pep
MALASLAASLPIAATASAASAAVRLRFRVRIGRAMASSAAAGASAATGASPARVGVVQMTSVGDVDANYATCSRLTKEAAASGVKFLCFPEVFSFIGSKDGESVKLAEPLDGPIMQRYCSLAKESSMWLSLGGFQEKGPDDSHQYNTHVLIDDTGKVRSSYRKIHLFDVDVPGNMVYKESRFTSAGDTLVSVDSPFGRLGLTVCYD

SEQ ID NO: 42160 - protein, 275 aa, Sorghum bicolor
  Clone ID: SORBI-28MAY03-C24637_1.pep
MPSSRLPVLLCLAAVAVTAAMAAGEGGLRLPRDATFPAAQAERLIRALNLLPKEKGGGDGPSVAPGELLERRIRLPGVPDGVGDLGHHAGYFRLPHTHDARMFYFFFESRGKKEDPVVIWLTGGPGCSSELAVFYENGPFTIANNMSLVWNKFGWDTISNIIFVDQPTGTGFSYSSDDRDTRHDETGVSNDLYDFLQVFFKKHPEFAKNDFYITGESYAGHYIPAFASRVHQGNKANEGIHINLKGFAIGNGLTDPEIQYKAYTDYALEMNLIEK

SEQ ID NO: 42161 - protein, 154 aa, Sorghum bicolor
  Clone ID: SORBI-28MAY03-C2484_1.pep
GSSPGHPPPSEGAFLRPCVGLRPRAWAPGRPRRVVPVVFGSIPGIIADDIVLPFADAIPWEEIAVFVAEDDVLKLDTILTSIPMEEILRKQRLLANPSMKQAMLFPQPAEPRDAFHQVLNGLARKLPHGKGVFLKPGQKVLNWTEGTREDLKPW

SEQ ID NO: 42162 - protein, 169 aa, Sorghum bicolor
  Clone ID: SORBI-28MAY03-C25032_1.pep
HEGNPNSSPGPETPVSATVTTSFAVARRLPSAISPDRRPRTALTQEEPPNYEIGWKRTKALPLEKPRGWAVADFLEKLEGLLARGRYGSAQLPGTVAGVVTERAREETEVLVAEGGVEERVVTELFRVLRLVEMDVEMVKAAVKEETVKERVETARARCRQAILVALSL

SEQ ID NO: 42163 - protein, 217 aa, Sorghum bicolor
  Clone ID: SORBI-28MAY03-C25339_1.pep
ARGKTKPDRGIFVKHFKNIPMADMEIVLPEKKNPSLTPMDWVKFLISAVIGLVTLVGSLEMPKADVWVVIAILSGVIGYCAKIYFTFQQNMTIYQNLITKSMYDKQLDSGKGTLLHLCDDVIQQEVKEVIICYYILMEQGKATTQDLDLRCEELIKEEFGAECNFDVHDAIKKLEKLSIVHRDSIGRILCVPLKRANEIIGTTTEELVLRAQQSPSS

SEQ ID NO: 42164 - protein, 154 aa, Sorghum bicolor
  Clone ID: SORBI-28MAY03-C25354_1.pep
SFYNAANAALINFFETLRTELGNQVGITVVTPGWIESEMSKGKYLKEHGEVEVDQEMRDAQIGLFPVEYAKNCAKAMVQAAQQGERYLTVPAWFRPMYLWRVFAPEVVEACYRLLYMHGHGARQADTASRTMADSGGKQLLYPTSLRSEEIKSD

SEQ ID NO: 42165 - protein, 140 aa, Sorghum bicolor
  Clone ID: SORBI-28MAY03-C26563_1.pep
EPDSSTDTSKFARLVNSCDVMVGVHGAGLTNMVFLPAGAVVVQVVPYGRLEWLARNTFAEPSAGMEVHYLEYVVQLDETTLSEQYPSDHPVLRDPMAIHKQGWNALKTTYLDKQNVRPHLGRLKNTFLQALKMLPHGRDD

SEQ ID NO: 42166 - protein, 176 aa, Sorghum bicolor
  Clone ID: SORBI-28MAY03-C26574_1.pep
TRAVRARRRAQGDVDSIVGFDLDELREMHYVHAAITESMRLYPPVPINSLRAETDDVLPDGTAVQAGWFVAYNSYAMGRMKSVWGDDAREYRPERWLNTGDGTFRPDSPFRFVAFHAGPRLCLGKEMAYIQMKSIVACVLEELDVAVDGAHQPRPVASLTLRMADGLPVTVKPRRD

SEQ ID NO: 42167 - protein, 184 aa, Sorghum bicolor
  Clone ID: SORBI-28MAY03-C26706_1.pep
ARGVDEAQKALEEAEALKKLAPRPEPPSDPSKYTAVLLRFAGHMFRLRPHEGAFLSVYDNDRRLADHFGGKLHLGYMLIREKQKELQEQRNKRRTGKTEDDRRSREHSKDRNGRSSRDRDSERRDRVESRDGRRDYDRDRDRRHDRDRRHDRDRDRDYDRSRGHDSRRRERSRSRERSRRHERY

SEQ ID NO: 42168 - protein, 191 aa, Sorghum bicolor
  Clone ID: SORBI-28MAY03-C26741_1.pep
MAGSARSSAAAKHAYRMFAPSRGGGAATRGPGAGAAEEFDESDVVWGSFGGGGGADSHSSPGAELQAAAGWARPIPASRAGAGRKKPAAVDGGGPAGSLPMNIPDWQKILGVEYRDHYRAGEWEPDADDDDHGRARGGGGAGAEMVPPHELAWRSRAASMSVHEGIGRTLKGRDLSRVRDAVWKKTGFEAD

SEQ ID NO: 42169 - protein, 202 aa, Sorghum bicolor
  Clone ID: SORBI-28MAY03-C25524_1.pep
MNGGGGGQKKRGTRIEPFRHRVETDPKFFDKSWRKLHDAIREIYNHNASGLSFEELYRTAYNMVLNKFAPQLYEKLTENMKEHLEDMRTCIDAAQGGLFLEELQRKWNDHNKALTMIRDILMYMDRTYIPTNKKTPVFDHGLELWRDTIVRSPTIQRRLSDTLLELIHSERTGDVINRGLMRTTTKMLMDLGLSVYQDDFER

SEQ ID NO: 42170 - protein, 152 aa, Sorghum bicolor
  Clone ID: SORBI-28MAY03-C25666_1.pep
ASKESPASAVASDKGTPIPSSSSQEKDSVTKTILNKVKEKSDDEGKPLPAELDGKENLVVNSKNEKSDSGVDRSRERERERSRGRERDARGRDSDRDSRGRDSDRERDRRRRSRERSSGHSDKEKSRRHSSRDRVDYYSSHSSREKDRHRHH

SEQ ID NO: 42171 - protein, 229 aa, Sorghum bicolor
  Clone ID: SORBI-28MAY03-C25541_1.pep
HTSMRGYRAYYRRDSPVHASNYKYGRSHPETRIREEYDERRYTSKYPKHRQAMHETMERDAYCRNKYGHSYQERAHRTCPCPECNLSGQNCSYPNGEEFSAISGCEQAYYKTDRDLTPSTSQVASHCEDSCCKGQQLMPKSSSVMCDCDECYANQESTPSPSEHARKRSNLPVPLHHRLAKHSNEHGRHVDDAHSAFEVEYTVRESRSRYLSSKDAPSTHSRKHHRSAR

SEQ ID NO: 42172 - protein, 281 aa, Sorghum bicolor
  unsure (1)..(281): unsure at all Xaa locations
  Clone ID: SORBI-28MAY03-C25579_1.pep
MATARALRLVVTRPPATSRDGLLADVRHRLLSVSTEAAGAGDTAVHSGDAPSDDYMDRPPKFSGAEEATGAGGRGGKHPVGKAGATPGHAEAAADQRVPPFAPSGKKPPLAGSEHELADPAGGASFTQKRRLSSSSRERDPREAATPGESESAARKVREEDREYYRTHKPSPLAEVEFADTRKPITRATDGSATDRYADVPGRMVEDTVDDSLARAEAMFREAAARXTPSGRTPARSPTCWRAASLGRTLLGAANPAGAAEGGGLTQKQCLTSTLYLYSCL

SEQ ID NO: 42173 - protein, 428 aa, Sorghum bicolor
  unsure (1)..(428): unsure at all Xaa locations
  Clone ID: SORBI-28MAY03-C25711_1.pep
MASQGEPSSSDPKGKKDYSTAILERKKSPNRLVVDEATNDDNSVVALHPDTMERLQLFRGDTVLLKGKKRKDTICIVLADDTCEEPKVRMNKVVRKNLRVRLGDVVSVHQCPDVKYGKRVHILPIDDTIEGITGNLFDAFLKPYFLEAYRPLRKGDLFLVRGGMRSVEFKVIETDPIEYCIVAPDTEIFCEGEPVKREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTXNMKLAXNVDLELIAKDTHGYVGADLAALCTEAALQCI

SEQ ID NO: 42174 - protein, 188 aa, Sorghum bicolor
  Clone ID: SORBI-28MAY03-C25791_1.pep
MLALLAPFAVACLLFVSRPCARDMRLFLASLCQQLLLSLLGLLAGLRLLGGVAAASHAANTETMPLMPSFKRKRAAVTVENAEEAAGAAAGGEPSVLDLPELAIDCILERLQPAELRSMAAVCRSMRERCRSDHLWERHMTSKWGRVLGRAARDEWRTHVASASESGAVSGGGGGGKRRRWLAALSCV

SEQ ID NO: 42175 - protein, 338 aa, Sorghum bicolor
  unsure (1)..(338): unsure at all Xaa locations
  Clone ID: SORBI-28MAY03-C26979_1.pep
TQVTSSAGAVLNPNPSPPMAAGGGAPWAERARVVGTQIRNRFRVAPVDHRSLWLRADSRVATEAVRRWSDRVRALLQRDRGADRSSTSTETSPEAAAKPSSSALRFYRKRVGKEVNGIEDSVIFRSLQALAVPLIGNACYVFMHGLNSVQVYGAEKLHQALQGRPKGKALLTVSNHVAAMDDPFVIASRLPPSVMLEAQKLRWTLCATDRCFTNPVLSTFFRSVKVLPVSRGEGIYQKGMDMALSKLNSGGWVHIFPEGSRSRDGGKTIAPAKRGVGRLVMDADSLPVVIPFVHTGMQDIMPVGKRIPRAGKRVIXXVGDPINFDDLLIDNCDDAQHI

SEQ ID NO: 42176 - protein, 251 aa, Sorghum bicolor
  Clone ID: SORBI-28MAY03-C2714_1.pep
HEAGSLLGAAAHRLVKNSLQIKSGNAAGLIDMPYRGAPYSPGNRPRPAGPLGYERGFVDNPYHAHMSRSVPNPHPQFFGDSQANKQPMRILERPNPRSHDAGIRASMSKLTIRVGPRPHQNNRMQNSGYWPNQPHSNHFAGPPAQRPMQNISFIPQRPFQTGGFPQQRPVNGVPPPLPPSNWIGKQPNGGHTGVPAKHDPRTAPDRQPKQDNPRSQQDKRQQATTKVYRVKTQATNGNGLSESGKQEESAA

SEQ ID NO: 42177 - protein, 226 aa, Sorghum bicolor
  Clone ID: SORBI-28MAY03-C27154_1.pep
LDRWVEERYMDDEKNAKILEVDTGNKPGRYASKRRGGGGGNHHHQSPCSTMTSDQNSRSYATMPESPSKDSTTAQQSVPSPSSVGMAEALSPLRMPVDIAELCDSPQFFSATSRPGSSRRGPFTPTKSECSRSLFGGYSDYPNYMANTESFRAKARSQSAPKQRPQYEKSSSLRKASAHAFATGPCAPPSAGAAAQRSSASLHAKFTNKAYPGSGRLDRLGMPVRY

SEQ ID NO: 42178 - protein, 103 aa, Sorghum bicolor
  Clone ID: SORBI-28MAY03-C27219_1.pep
YFVVGFPSTYSVLVTWPAVNLGDFRKARNPVLAWALDLVFGARSDVFIPAVAGLFYGHVTGKRIASGRTQIIVPSQSSTSTHASDFISTYISNKNHLAYSCYC

SEQ ID NO: 42179 - protein, 143 aa, Sorghum bicolor
  Clone ID: SORBI-28MAY03-C2723_1.pep
MATLSAISAKAGYCKAPTLSWKGSRVSARNVVSMATTRRGGLVSLRSPRFRVYAAKAETVSKVMDIVKQQLALAADVGLTAESKFADLGADSLDTVEIVMALEEEFKITVEEDNAQSITTIQEAADLIDKLVDQNPAAAAPPA

SEQ ID NO: 42180 - protein, 202 aa, Sorghum bicolor
  Clone ID: SORBI-28MAY03-C26316_1.pep
MAAVGSLQPGMEALHVQGDYKDAPPPAKASVVAAAVESLQPAMESLHVQDFKDAAAAPAKGATAVGSLQPGAENLQAQDYKDASMYYGAYPAYAYGAYGGWGEYSTYLADGAQSPTAGTYADMYYGYAPYGVATLGSDGQIYGSQSYDYQYPSTYNKQQNSTAKLSTNGKSEKLAPAPQGDVSTVGVDEVKGLKNSNSTLKA

SEQ ID NO: 42181 - protein, 168 aa, Sorghum bicolor
  Clone ID: SORBI-28MAY03-C26357_1.pep
DVVRSRNSSASYDETEDTTNVRQHKLDDAQEEDTGTNLDDEEAAALQEQVRQIKAQEEEFETFNLKIVHRKNRTGFEEDKNFHVVLNSVIAGRYHVSEYLGSAAFSKAIQAHDLHTGMDVCVKIIKNNKDFFDQSLDEIKLLKYVNKHDPADKYHLLRLYDYFYYRVN

SEQ ID NO: 42182 - protein, 211 aa, Sorghum bicolor
  Clone ID: SORBI-28MAY03-C2637_1.pep
MLLAVEGGGFFSSSASGYSHGLALLLLGRKAEEKPVKVSPWNQYRLVDRETEQVYQLPSAANAKDQAPGKCAPFVCFGCTANGLEVASPPKAASSSAPGNGASQEEASCSANKTLTTSGSIGGSERRGCLKSNSKRDSLEHRIVVSEGEEPRESVEEVQTLRSSVERRKVQWTDTCGKELFEIRSFARPDEGLSDDDAENEGFRKCECVIQ

SEQ ID NO: 42183 - protein, 116 aa, Sorghum bicolor
  unsure (1)..(116): unsure at all Xaa locations
  Clone ID: SORBI-28MAY03-C26523_1.pep
QHEIQYGGDNASASPRSQYPSQSTAPTVHIPNXTSSQHPSPSLFAPGNPGLTQSKNSMVFSNALSSPIRRSLQPYHLEQGGDAGYFANGASRDVNPTASNDSSMDMHSDSPAHDSY

SEQ ID NO: 42184 - protein, 169 aa, Sorghum bicolor
  Clone ID: SORBI-28MAY03-C26529_1.pep
MSAQFASEHACYVNCNYCNTILVVNVPNSCSHNIVTVKCGHCTMVLSMDLSPFHQQARTVPDNQVVQNRGFQYNNFGSYEQASSRNLRTPSMYSVSNNQPQVPPIRPPEKRQRVPSAYNRFIKEEIQRIKTSNPEISHREAFSAAAKNWAHLPRLHFGLSVADGGGGSN

SEQ ID NO: 42185 - protein, 353 aa, Sorghum bicolor
  unsure (1)..(353): unsure at all Xaa locations
  Clone ID: SORBI-28MAY03-C33429_1.pep
MGASSSAPPSPAPAGAADDRRPSKDDDGKRRRRAAGASPEAAAAPVPVPPRPRPRRGVAAPSRAGRRPAPAPSGSSCPATRPASGGPAAGSPTPSPPSTPPPPGADVKREVKILKALKGHQNIVHFYNAFEDDSYVYIVMELCEGGELLDRILAKKNSRYSEKDAAVVVRQMRKVAAECHLHGLVHRDMKPENFLFKSTKEDSPLKATDFGLSDFIKPGRQFRDIVGSAYYVAPEVLKRKSGPESDVWSIGVITYILLCGRRPFWDKTEDGIFKEVLKNKPDFRRKPWPNITSSAKDFVQKLLVKDPRVRLTAAQALSHDWVREGGKASXIPLXISVLHNMRQFVKYSRFKQF

SEQ ID NO: 42186 - protein, 252 aa, Sorghum bicolor
  Clone ID: SORBI-28MAY03-C27581_1.pep
MAASTLAFGHPKTLGAAAASAGAKALPTSSSVSFPATQQPACHLSSSASASAHGARRRDVAAMVYAPPAVGTAMPSLDFDTSVFNKEKVSLAGHEEYIVRGGRNLFPLLPEAFKGVKQIGVIGWGSQGPAQAQNLRDSLAEAKSDIVVKIGLRKGSKSFEEARAAGFTEESGTLGDIWETVSDSDLVLLLISDAAQADNYEKIFSHMKPNSILGLSHGFLLGHLQSLGLDFPKNISVIAVCPKGMGPSVRRL

SEQ ID NO: 42187 - protein, 165 aa, Sorghum bicolor
  unsure (1)..(165): unsure at all Xaa locations
  Clone ID: SORBI-28MAY03-C27540_1.pep
MRDMEDRSVVSRRHEPTTVARTADDDDDDVASGDEDSDSDAEFEFPFVSRESEAAADELFAGGRIRAFYPVFGRVLDDEAPAPAPRPPRGRPCRLEQARTSSVASTSSSSSSSTAGAGAAGLDGASPDTGRPGXAPAAAAPARAPPVAGSTGSIPRWRRIGELVV

SEQ ID NO: 42188 - protein, 242 aa, Sorghum bicolor
  Clone ID: SORBI-28MAY03-C27784_1.pep
MNSHGAGRRTPKRRRTTTKSHSQLLDLNCPPAEGAGEGALPFNSMPVSHIQASSSMPVQHIQASSSTPPATDEPRIGMLSCPIDVEAIDDDVVIYSSSSLPQARQQSTRTAVVIIDDDSETNPEPAGDALHEHVNTLLSLGINRRHEPPRATNARPVISIVDTPEVNTFKAPPEPVKEVPKEPKFSCPICMNELTEAASTVCGHIFCQKCIKAAIQAQKKCPTCRRRLTPSQQHRVYLPLTE

SEQ ID NO: 42189 - protein, 203 aa, Sorghum bicolor
  Clone ID: SORBI-28MAY03-C27831_1.pep
TRSWLGGWFLPQKKSYFALKLPNGWWVFGLDQALHGDIDVYQFKFFAELCQQKVGETDSIIIITHEPNWLLDWYWGDSTGTNVAYLIREYLRGRCKLRMAGDLHHYMRHSCIESKEPVHVQHLLVNGCGGAFLHPTHVFESFTAVFACTSGTKSTYPSYTDSSKIALGNILKFRRKNWQFDVIGGFVYFVLVFSMFPQVRETR

SEQ ID NO: 42190 - protein, 141 aa, Sorghum bicolor
  Clone ID: SORBI-28MAY03-C28021_1.pep
ARGFFEKLVKISTLSLSLAGGSDSGASVSSAIVGWYLQRDGMKHARKMYKRFLALPRPSLKFMQYCIELEANLASLGDHGALTNARRLYDSALDLYPQEREVWRNYYNLELKMGTSESANAVYSRARKVLGDSTALTAPRS

SEQ ID NO: 42191 - protein, 229 aa, Sorghum bicolor
  unsure (1)..(229): unsure at all Xaa locations
  Clone ID: SORBI-28MAY03-C39698_1.pep
HPARPAVSCPPTIAVDGAPRPPGPQPARPPFEAGASEASASLPQLASCSCSAAGPTNARASRGRTAADSSGSLCSGGCHVRPRQTWAHDRRILVHFILRLTPRRFIPISKPILFSLLFPFILSTPSATAKILPENGPFSCLAPSTGAGGLLVVGHTPGLVHVTVNVAPGWGVDTQSIINMTMNMTSGWCIVKEELTFPAGGAPFRSCHASTIVQVEEXQFLVAYFGGSS

SEQ ID NO: 42192 - protein, 149 aa, Sorghum bicolor
  Clone ID: SORBI-28MAY03-C39880_1.pep
EAFKTCHTSSKKGLDESAREALSNMEALRAAPVDEGETAVSSVQVVSQALPKNSSNSFLKNIGIKPTTSSKSAALNESDLREQLAAEARAVVQGELDALKKKSEEADEKLERQQKEMEEMRKQTEINQKELQETNVLLRRLLSLNNAST

SEQ ID NO: 42193 - protein, 119 aa, Sorghum bicolor
  Clone ID: SORBI-28MAY03-C3970_1.pep
CPKKWRTNYTIYATCLSLFCFPIPLADTIYMTPAAEAKCSSSHEVGGYAAVSVTHSHVMLLRQSSPRSQISGFRQELLYIHMEPPGSFRELERNRVEPPVSIPTESAGDCSAPPSRGRF

SEQ ID NO: 42194 - protein, 108 aa, Sorghum bicolor
  unsure (1)..(108): unsure at all Xaa locations
  Clone ID: LIB3481-032-P1-K1-D6.pep
NYCTPSFMLVPKEMENQLYNICYLPLSFLFSYSPCRYNIHDTSCRSKMLQFPRGWWVRGSVGYTLACDAAAPIIXPEPNIGIPAGVALHPHGAPRIFQRTKETAWSRR

SEQ ID NO: 42195 - protein, 122 aa, Sorghum bicolor
  Clone ID: SORBI-28MAY03-C39889_1.pep
SYISEVRWIDDGFRGLLPFPFNETLGGTTAAPSYFNNKNKAAEGQYLKDIGACTLLVELDLRRPYPSRGSDLSKWEALAALQFLDRELSPALYRSFFIPYRWQQNNVFGLYKLLRRLHPDHA

SEQ ID NO: 42196 - protein, 120 aa, Sorghum bicolor
  Clone ID: SORBI-28MAY03-C39997_1.pep
TFGYHAPEYAMTGQLSSKSDVYSFGVVLLELLTGRKPVDHTLPRGQQSLVTWATPRLSEDKVRQCVDSRLGGEYPPKSVAKFAAVAALCVQYEADFRPNMSIVVKALQPLLNARASNNPG

SEQ ID NO: 42197 - protein, 148 aa, Sorghum bicolor
  Clone ID: SORBI-28MAY03-C4006_1.pep
MALRRIIKELKDLQRDPPTSCSAGPVSDDMFHWQATIIGPSDSPYSGGVFLVTIHFPPDYPFKPPKVAFKTKVFHPNINSNGNICLDILKEQWSPALTVSKVLLSVCSLLTDPNPDDPLVPEIAHMCKTDRLRYESTARGWTHKYAMG

SEQ ID NO: 42198 - protein, 180 aa, Sorghum bicolor
  Clone ID: SORBI-28MAY03-C28658_1.pep
MAAAVAAVAAATTAEDEARLLRLEEQAEHGGGGAWEYLCLARRLRARRPAHVLRVGLALLNNASARSGLAAEQWTLYEQVAMAAMDCQRLDVAKDCIGVLSKQFPGSTRVARLEALLFEAKGEWTEAERAYALILENNPFDQIVHKRKIAIAKAQGDMSIVVDYLNKYLGLFMADHDAWR

SEQ ID NO: 42199 - protein, 123 aa, Sorghum bicolor
  Clone ID: SORBI-28MAY03-C28836_1.pep
MGSFVQGDEVEVPVYESGAEVLQKAQEKWSVAPPPYPAMYSSVLGGIILDPAMMVVPIDDHMVHRGHGVFDTAMILDGALYELDAHLDRFLRSAAAARVVATPPFPRHALRSILIQMTAASGC

SEQ ID NO: 42200 - protein, 119 aa, Sorghum bicolor
  Clone ID: SORBI-28MAY03-C28850_1.pep
LGATHYSTGVDMWSVGCIFAEMARRQALFPGDSELQQLLHIFRLLGTPSEEQWPGVSELRDWHEFPQWKPQSLARVVPTLEPEGVDLLSKMLQLDPSNRISAIAAMEHPYFDSLDKSQF

SEQ ID NO: 42201 - protein, 172 aa, Sorghum bicolor
  Clone ID: SORBI-28MAY03-C28927_1.pep
HEADSTQSPATAFDMGNGFVNATAALDPGLVFDCSYDDFFSFLCGINGSSPVVTNYTGNSCVASTMTGADLNLPSITIAVLNQTRAITRTVTNVAAADESYTVSYSAPYGTAVSVVPTQFLIPSGQKQLVTFVVNATMNSSSASFGNVGFYGDKGHRAIIPFSVISKVVYSP

SEQ ID NO: 42202 - protein, 117 aa, Sorghum bicolor
  Clone ID: SORBI-28MAY03-C27259_1.pep
KDMALAAVSMRPIPLAPIMEKLSLTPENYGTVRRYFIQTLDDHMLSPDAQEKLVRENPPDGIFKIKGGDHCPFFSKPQSLNKILLEIAQIQSSVGLLPGKASAEETTAATAAAAAKS

SEQ ID NO: 42203 - protein, 290 aa, Sorghum bicolor
  Clone ID: SORBI-28MAY03-C27374_1.pep
MSMLDAFFSKGGGGGGFRGAKCKTLLKLSIPRIKLLRNRRELQLRQMRRDIAKLLEAGQEATARIRVEHIIREENMMAAQEILELFCELIAVRLPIIEAQKEGPIDLKEAISSICFAAPRCADLPELMQVQMMFATKYGKEFVAAASELMPDCGVNRQIIELLSIRPPPVDAKLKLLKEIAEEHEVDWDPSETETEFLKPHEDLLNGPTYFNGSTLPLPKEKHEETVAASAAEQPDEDYESDTGLDSLDLPEVPKAAIRPPSDAPVTPDIGPHVQGSQSLPHEFSEPTDL

SEQ ID NO: 42204 - protein, 406 aa, Sorghum bicolor
  Clone ID: SORBI-28MAY03-C27527_1.pep
HEVTGARVGAARQVQELNATRGNLVALQQKLTVILYVSQALTALKLLVAAADCAGALDVIDDLQNLLDTDELAGLYCFRHIRDQLGTSLDSVNSILSAEFVHAAVPDGKAVDAMILSTVKRKASSPLNGTDHEGNVDEEESFILRDRLLPLIICLLRTDKLPAVLRIYRDTLITVMKASIKATVAELLPVLTARPIDSDSVTGDRATDADAGGQSLANKLRSLSSEGFVQLLSAIFRIVQVHLQQAAEVKRIVEWIMGNLDGTLSGDSSNSTLRHGGSVISDTQENDSSRGSNTITRSTSKIPFVQGKTNDFSIINSIKNVRADVLRENTEAVFAACDAAHGRWAKLLGVRAALHPRLRLQEFLIIYNITEEFIAATEKIGGRLGYNIRGILQQQSKQFVDYQHNV

SEQ ID NO: 42205 - protein, 141 aa, Sorghum bicolor
  Clone ID: SORBI-28MAY03-C27506_1.pep
MDMSSSSPVITDPISISPPLLGGLTSNLMPFSVMSGGCSSPSMTASRRKIEEVLVNGLLDAMKSSSPRKKHNLAFGQDNSLDEDPAYSAWLSKCPSALTSFKQIVANAQGRRIAVFLDYDGTLSPIVDDPRQAFMSPVMRA

SEQ ID NO: 42206 - protein, 317 aa, Sorghum bicolor
  Clone ID: SORBI-28MAY03-C27532_1.pep
MGRRKMSAAAPPSRSWSNVGGSVIPELRAKHKMDLENLTLTKQPLRTLHFFLLAMLRYLKRLATYILSKGGFFFLLIVLLVASGILLAVSDGQNKKHVQEFLNYAKFVLWWASLGVASSIGLGSGLHTFVLYLGPHIALFTIKAVQCGRIDLKMAPYDTIQLKVGPSWLDKKCSEFGPPVYPASAHSVRIPVFDLLPQIQLEAVLWGIGTALGELPPYFISRAARLSGSKSKAVKELDVATSKQDGTVASTLNRTKRWLLSHSQHLNFFSILILASVPNPLFDLAGIMCGQFGVPFWEFFFATLIGKAIIKTHIQTL

SEQ ID NO: 42207 - protein, 158 aa, Sorghum bicolor
  Clone ID: SORBI-28MAY03-C29262_1.pep
SVFMGVSLCGNRCPELVVAVFVVVTEVFLGIFIAVVVTSEVSKNKINSSPTSLVLLPGLLHGGEGDMVLFPSMAESQGKSTVSNNAVVTCGNNVKINASSRSDDVRRRLCDERPTRLDAAAVCTAQAVLCGQAATGCSGSSQSSGRSTTSRGRLHRAY

SEQ ID NO: 42208 - protein, 224 aa, Sorghum bicolor
  Clone ID: SORBI-28MAY03-C29358_1.pep
MAEAEATAGRLRLYSYWRSSCSHRARIALNLKGVEYEYKAVNLLKGEQSDPEFVKLNPMKFVPALVDGDSVIGDSYAIALYLEDKYPEPPLLPHDLQKKALNHQIASIVASGIQPLHNLTVLRFIDQKVGAGESVLWTQQQIERGFTAIESLIQLKGCAGKYATGDEVQLADVFLAPQIYAAIERTKIDMSNYPILARLHSEYMAHPAFEAALPRRQPDAPSSS

SEQ ID NO: 42209 - protein, 324 aa, Sorghum bicolor
  Clone ID: SORBI-28MAY03-C29383_1.pep
ERERGANRIESSRGEAWRRAAESAPAAGMEDLSVEELASNLSTYKEQLREVKKLIKEKKDDPGISEYIDMEKELQEVITLTEEILATAKQTESAQNAAGLSPPNYSAGAQSEGLDDLSHSHKFAVGTRVQAVWSEDGEWYNATVEALTPNGYYVAYDGWGNREEVDPDNVRLPEEEAADALRQAEKEAEATKMAIKRKIEQAATSDFQARSLPAKLRIEPSDPEDVKAAKRKKIHAFKSKARFEQLEFAQNKRQNAWQQFQTKGKSKKVGFFSGRKKESIFKSPDDHRGKVGVTGSGKGLTDFQRREKHLHLKGGSGDAADDEE

SEQ ID NO: 42210 - protein, 367 aa, Sorghum bicolor
  Clone ID: SORBI-28MAY03-C29417_1.pep
LPYSDLEGATPPSSPLASCLVPTPNCRGGVEGQFRCARACVRAEVNPRSISTAGGWEIEVAPLPHTPLNAAPTGSSGDLDGLASAALRLCGGWVAGAGSLAKPSGADCRAGWGREESTGRQGIMSETGHTVQVTNLSSRVSESDLHEFFSFSGPIEHIELIRSEDYGATAYVTFKERFALETAVLLSGATIVDQPVCITYWGQPEETFNFWDRPTWETEEEIEYRNYQTCQYNTTPQEAFTVAQDIMKTMLAKGYVLSKDALAKARAFDESHGLTAAAAARAAELSKRIGLTDRVNAGVGAMRSVDETYRVRETTKTVATATGRTAAKVVNGIVTSSYFSAGAMMLSDALTRAAKAAADLAAHGRQS

SEQ ID NO: 42211 - protein, 165 aa, Sorghum bicolor
  Clone ID: SORBI-28MAY03-C29470_1.pep
RISQGFQKVHICYFTTYLRISMHFQSSPMKSAKTKEKENRSFTGDPELSMNHLTAHKHYSYESWLRIWNPGLFLIRTRGPFFILFTKAETEPDGEGGVRPADGCCKERRGHDGNRPVHTYSHVHGLAAAGSCSAAAPAPMEAACPWRTEGESGASCRRVEDGRAL

SEQ ID NO: 42212 - protein, 77 aa, Sorghum bicolor
  Clone ID: SORBI-28MAY03-C28196_1.pep
GVCLPARAPLPCLRCARPLGGAPARSSTTVKLELLPLTDGIITLDTLQITAREKGLAYIPEHSLEIHATSGMSSGRS

SEQ ID NO: 42213 - protein, 302 aa, Sorghum bicolor
  Clone ID: SORBI-28MAY03-C28246_1.pep
HDVYTMHDQSVTHWSSLEQTSTELARADDCIVPKQRGHGSQSVAMVQVTTMAVDSNLLVVGGFQGELICKRLDDDGVVYSTRVTDDENAITNSLEIYQDPSGSRRLVAANNDCSIRIFDTEYFDLLKHYVFPWSVNSVSVSPNGKLFAVLGDHEDGCIVDPKCGKAIGSLRGHLDYSFASAWHPDGNIVATGSQDTTCRLWDIRNLSQSVAVLGGRMGSIRCVKFSSDGRFLATAEPVDFVHIYDAYADYSKCHEIDLFGEIGGLAFSPDTEAFYVGLADQTYGGMIEFRKRHQHHYLNSLW

SEQ ID NO: 42214 - protein, 124 aa, Sorghum bicolor
  Clone ID: SORBI-28MAY03-C28334_1.pep
YTVMFKKGAFELGCAVCPIAIKYNKIFVDAFWNSKKQSFTMHLVRLMTSWAVVCDVWYLEPQYLREGETAIAFAERVRDMIAARAGLKKVPWDGYLKHNRPSPKHTEEKQRIFAESVLRRLEEK

SEQ ID NO: 42215 - protein, 149 aa, Sorghum bicolor
  Clone ID: SORBI-28MAY03-C28394_1.pep
YGLPYLVFVMWLDLVTYLHHHGHHERLPWYRGEEWSYLRGGLTTVDRDYGWINKIHHDIGTHVIHHLFPQIPHYHLVEATKAAKPVLGRCYREPQKSGPLPLHLLGVLLRSLRVDHFVSDHGDVVYYQTDHELNTSAPGWAAQNHHKQK

SEQ ID NO: 42216 - protein, 170 aa, Sorghum bicolor
  Clone ID: SORBI-28MAY03-C2852_1.pep
GFVILSDSSLAETFHSFPSLSRPHNTLKYTFKRPLGLKNQKDQHFSNLMVEQKEELKNRANHLIKTLESCGWDVAIGCGGISMLAKPTAYIGKPFKADGFDGKLDASNIREAILKATGLSINSSSWTGIPDYCRFSFALESGEFERAMGCIARFKELVLGGSGQAQMNGV

SEQ ID NO: 42217 - protein, 106 aa, Sorghum bicolor
  Clone ID: SORBI-28MAY03-C29777_1.pep
RFLAQVKDGTWGEQGWPKVWTDYSVSKLALNAYSRLLARRLKARGARVSINCFCPGFTRTDMTKGWGKRTAEEVADVGARLALMPPAELPTGTFFKWCTPQLYSKL

SEQ ID NO: 42218 - protein, 128 aa, Sorghum bicolor
  Clone ID: SORBI-28MAY03-C29889_1.pep
GLEDEARRRPVEAAVLVKKSQLSADDDEGSSCDENFVGTDASGTLPEIEARVSDRTVLVRIHCENRKGVLIAALSEIERLGLSIMNTNVLPFTTSSLDITIMAMAGDDFCLSVKDIVKKLNQAFKSSF

SEQ ID NO: 42219 - protein, 266 aa, Sorghum bicolor
  Clone ID: SORBI-28MAY03-C30090_1.pep
MDAETGDARSPLLPHHLPSQTQVSSANQHYNKPFSWKAPAIILAFEFLESIAYSGIALNLVVYLGTVLHGTTASNAATVDAWNGATFLTPVLGAFLADTYWGKYKTAAISIIFYVVGLLIITASAVIPSLRPATCEGGSCPPATGFQYFVLFGSLYLISIGTGGVKSALLPLGADQYNDANLEESKNKQLFFSWFFMAVNLGVFISGTVLVWIQQNVAWSLGFGISSICLVIAAVAFLVGTPLYRVQLPNGSPLKSIVMVFVASFK

SEQ ID NO: 42220 - protein, 125 aa, Sorghum bicolor
  Clone ID: SORBI-28MAY03-C3017_1.pep
SLDPKPIQGDWNGAGAHTNYSTKSMREAGGYEVIKKAIEKLGKRHREHIAAYGEGNERRLTGRHETADINTFKWGVANRGASIRVGRDTEREGKGYFEDRRPASNMDPYVVTGMIAETTILWNGN

SEQ ID NO: 42221 - protein, 146 aa, Sorghum bicolor
  Clone ID: SORBI-28MAY03-C30346_1.pep
MATLLRRASLRRVVAAAASASSSQPESYKQVICGSTFHCREFASKAKKKKSSGTDSGEENMSKKDLALHQAIDQITSAFGKGAIMWLGRSQGHRDVPVVSTGSFALDMALGTGGLPKGRVIEVYGPEASGKTTLALHVIAEAQKNG

SEQ ID NO: 42222 - protein, 169 aa, Sorghum bicolor
  Clone ID: SORBI-28MAY03-C29163_1.pep
ARGSNVTLRQPDSSGGTLTYEGRFELLSLSGSFMPTENNGTRSRSGGMSVSLASPDGRVVGGGVAGLLVAASPVQIVVGSFLPSYQMEQKNKKPRVDAAPATVPQTPPAVPISSTDTHSSEQGQQAQRGMTSTGAYGADQSWASSAQQPMAEVSRTPSSGDLKMTASGS

SEQ ID NO: 42223 - protein, 255 aa, Sorghum bicolor
  Clone ID: SORBI-28MAY03-C29164_1.pep
MAVVGVLALQGSYNEHMAALRRIGVRGVEVPKPEQLLGVDSLIIPGGESTTMAKLANYHNLFPALREFVGGGKPVWGTCAGLIFLANKAVGQKTGGQELVGGLDCTVHRNFFGSQLQSFETELSVPKLSEKEGGNNTCRGVFIRAPAILEVGPDVEILADCPVPADRPSITISFGEGTEEEVYSKDRVIVAVRQGNILATAFHPELTSDSRWHRFFLDMDKESQAKAFSALSISSSSRDTENLPKNKPLDLPIFE

SEQ ID NO: 42224 - protein, 120 aa, Sorghum bicolor
  Clone ID: SORBI-28MAY03-C29167_1.pep
FSQLQIICAERDSCLFVFPCPDMMPFSLYNVIVTTAHTNNKQIEVTKLFLYYTYSADVQSTYKHARLYPDMKKNVRPLWQKLKRTPSTARTTLVSIYDLITKTKTTSKLDQKSLASPLFR

SEQ ID NO: 42225 - protein, 140 aa, Sorghum bicolor
  Clone ID: SORBI-28MAY03-C2920_1.pep
LFPLELLIMGEFDQMKVDSSNVSNWLSFDVVLPVALSCLFGLSISFFGFSCRRAISATGFTVLGIVNKLLTVVINLLIWDKHASFVGTIGLLICMSGGVLYQQSTTKPKAPKAEPKEENDEEQQKLLQMQGVQESNSTQK

SEQ ID NO: 42226 - protein, 204 aa, Sorghum bicolor
  Clone ID: SORBI-28MAY03-C29229_1.pep
MAPFCSSVASRGLALQTALVVSPPPRCRGTPVISASPHAHRQSLIGSTTTNSSGTSPIKRTTRIRAVDPASANSLGEGNLVIPIPDLLSVLSWPWMFGAAIAAAVPLYRRFRTLEDNVEKAAEAAIEVIDSVAEATEKVAVDVAEAFPGNETLKQAATKIKAIADEIEEDADKAEALIEKVDEIKREVDSIIDPLIDKVTKNKS

SEQ ID NO: 42227 - protein, 225 aa, Sorghum bicolor
  Clone ID: SORBI-28MAY03-C29337_1.pep
HGGAMVPPPRPSEFLMPLPANPIKEVCRNIDSQPEGTSTLERIYAGVNVYYNYTGTVGCFDLNDDPHGMGGWDWQACTEMVMPMSYSEGRSMYPPYKFDYPSYADGCIKSYGVRPRPRWITTEFGGHNITTVLEKFGSNIIFFNGLLDPWSGGGVLKNISESVIAIVAPLGAHHIDLRPATPDDPDWLVALRESELKIISGWLSDYYGAGGAVFQPVAAKGSSSS

SEQ ID NO: 42228 - protein, 338 aa, Sorghum bicolor
  Clone ID: SORBI-28MAY03-C30678_1.pep
MVAGSRLRPEPAILVGVLVASLVLGLPSDGQLLGPRRSQSWAQVPHLLNELGWLCQRASACTLSTRSDMSDLDLIKFSTARFKYLLLFSSERDWCSLTKTLLDILAKRSLVSKELSKETMEMLAEIHLLNRAVKRKSRSMGRLLVQFVVICPDNSKVYPFLPNLPGPGGLTPLHLAASIENAEDIVDALTDDPQQIGLTCWQSVLDEDGQSPETYAKLRNHNSYNELVAQKLVDVKNNQVTITVNGDEICMDQLGNVGDHKQSGVQALQIRSCSQCAILESGVLRQPVRSRGLLARPYIHSMLAIAAVCVCVCVFMRALLRINSGKSFKWERLDFGTI

SEQ ID NO: 42229 - protein, 461 aa, Sorghum bicolor
  unsure (1)..(461): unsure at all Xaa locations
  Clone ID: SORBI-28MAY03-C30758_1.pep
MAAVQPSMETTQQGPPPAANYSPARDGGRSAEEKAAEIDNWLPINASRNAKWWYSAFHNVTAMVGAGVLGLPYAMSELGWGAGVTIMILSWIITLYTLWQMVEMHEMVPGKRFDRYHELGQHAFGERLGLWIVVPQQLVVEVGVNIVYMVTGGPSLKKFHDAVCDGKCKXFKLSYFIMIFASVHFVLSQLPNFNSISAVSLAAAIMSLSYSTIAWGASLDKGKGTDVDYSLRATTTPGKVFDFLGGLGDVAFAYSGHNVVLEIQATIPSTPEKPSKKPMWKGAFVAYVIVAICYFPVAFVGYWAFGSGVDENILMTLSKPKWLIALANMFVVIHVIGSYQVYAMPVFDMIETVLVKKLRFAPSFTLRLIARSVYVAFTMFVGITFPFFGGLLSFFGGLAFAPTTYFLPCIMWLKVYKPKRFGLSWFINWICIVIGVLLLVLGPIGGMRQIILSAKTYKFYQ

SEQ ID NO: 42230 - protein, 246 aa, Sorghum bicolor
  Clone ID: SORBI-28MAY03-C30857_1.pep
FQGDIDLDVPSPVEFALGENLLLTAVKKCSKPLVECLLRYTTTNYAPVGSGDGAPVQFLFTPAMTGLSNITPLHIAATISDATGVLDALTDDPQQLGIKAWKNARDATGFTPEEYARQRGHVSYIQMVQDKIDRRMSRDHVLVTIPTTIDAVGKHASGLKSADQITFGVEKQLNINETSSCRQCVQQVQQFAFQPRTNRFLSNRPAMLSLVAIAAVCVCVGLLMKSPPQVACMRPFLWDNVRWGPN

SEQ ID NO: 42231 - protein, 198 aa, Sorghum bicolor
  unsure (1)..(198): unsure at all Xaa locations
  Clone ID: SORBI-28MAY03-C31004_1.pep
ARGRVRTRQLLRYIVEETPEDAEKKRIFRFPFIACEIFTCEVDVIMKTLVEDEDLMNLLFSFLKPDHPHGTLSAGYFAKVVICLMMRKTLPLVSYVQGHPEIVSQLVDLIGITSIMEVLIRLIGADEAMYSSYADSMQWLDDIQVLEMIVDKFSTSDSPEVHANAAEILCAVTRYAPPALAAKISSPSFVGRLFXHAF

SEQ ID NO: 42232 - protein, 124 aa, Sorghum bicolor
  Clone ID: SORBI-28MAY03-C30911_1.pep
MQLRHPERTGKGTPQWMAPEVLRNEPSDEKSDVYSYGVILWELVTQKIPWENLNSMQVIGAVGFMNQRLDIPDEVDPQWKSIILSCWESDPQQRPSFQELLERLRELQRHYAIQHRNTKNSIEE

SEQ ID NO: 42233 - protein, 158 aa, Sorghum bicolor
  Clone ID: SORBI-28MAY03-C29486_1.pep
ESEVIGQNGHTQLGSFEVHTKGFGSKMMAKMGFIEGTGLGKDGQGIVQPIQAIHRPKSLGLGVQFDSLAEAIKARTEPIKLISEPGKVRSDLRRNVWAPETSGVGSFERHTKGFGSKMMVKMGFVPGSGLGKDGQGVATPLTALRRPKSRGLGAKDKY

SEQ ID NO: 42234 - protein, 62 aa, Sorghum bicolor
  Clone ID: SORBI-28MAY03-C29577_1.pep
ASKLWTYLFIISTKGYKYLIKRITTKCYEPTLHYFVTDALCYSQPSNLSVILLSSYSMPSMT

SEQ ID NO: 42235 - protein, 186 aa, Sorghum bicolor
  Clone ID: SORBI-28MAY03-C29585_1.pep
AGSHVMEYGDKTFKGEKLYLYQGFDPANANVTNKLLRPGLEAVVNQRDADILFLWKRYELLHEKSEEKQEVLREITGTVRHRKHLDSSIDFIGKLLFGIEKGPFTLQAVRPSGQPLVDDWDCLKQMVRIFESHCGSLTQYGMKHMRAFANICNSGTPGASMKQASMGACGSYNSARWSPLVQGYSA

SEQ ID NO: 42236 - protein, 200 aa, Sorghum bicolor
  Clone ID: SORBI-28MAY03-C29672_1.pep
PHAAAYPPPKAAPAAYHPPPASTTPAADPRRLPPRNTAAFPDVDVLWFRNPLEHVTAYAVMSVSSDAAFGDAHTVDIFPNTGFCPVKPSIRTLAMTAAWHEARERFPGKNEQPVFNAIKKGLVADLGLRLQYIDPAFVAGFCSYGKVLRTVGTMHANCCVGLRNRLADLRAVLVDCTNVAAMPHWARHQAKWPVPGACIH

SEQ ID NO: 42237 - protein, 114 aa, Sorghum bicolor
  unsure (1)..(114): unsure at all Xaa locations
  Clone ID: SORBI-28MAY03-C29696_1.pep
MHPSPDLYRKRGSSLLELNRRSFFTLTALRRCHDLPISCVEIDYLLIQFKIMFHLNQRFHIQLNARGHGPMSSLPLSSHHMMTHFRSYHLTCXQGLQMMPWVWNWAXVAASNFS

SEQ ID NO: 42238 - protein, 190 aa, Sorghum bicolor
  Clone ID: SORBI-28MAY03-C28726_1.pep
NNKSIPVTQQLQGSNHWEILELYLDKYKDLHPRLPVIVAETLLYTDPEIELPLWLVQMFKTNKAGNKISWGMSGKEADPAALFRLYINYGRHAEATNLLVEYLESFASSRPVDLLHRKQMSATWFPYTAVERLWCQLGEMQRAGHSVDQCDRLKKLLHGALMSHLQQVVVDSGDVLSSVGDGQGMEGQSR

SEQ ID NO: 42239 - protein, 137 aa, Sorghum bicolor
  Clone ID: SORBI-28MAY03-C32012_1.pep
ASAEQTPGLRCFSLFYPSQFSVPLFLSVLHCFRLCARIGAVHEQAQISPLSYAAVSIPSTCVVPVQFLFVNFCFVLADFLLSCFCIYVSTLSISAPSVSATSFTCFTVYVAFLVSFCASVQQVGEQLLYCCACVLQS

SEQ ID NO: 42240 - protein, 175 aa, Sorghum bicolor
  Clone ID: SORBI-28MAY03-C32055_1.pep
MVLAQLGGSISRALAQMSNATVIDEKVLNDCLNEISRALLQADVQFKMVRDMQANIKRIVNLEALAAGTNKRRIMQQAVFTELCNMLDPGKPSFTPKKGKPSVVMFVGLQGSGKTTTCTKYAYYHQRKGFKPALVCADTFRAGAFDQLKQNATKAKIPFYGSYMESDPVKIAVEG

SEQ ID NO: 42241 - protein, 159 aa, Sorghum bicolor
  Clone ID: SORBI-28MAY03-C32107_1.pep
DDISLDKLPDDAFVVYQGHHGDKAVYRANVILPSSAFSEKEGTYENTEGCTQWTIPAVPTVGDARDDWKIIRALSEVAGAQLPYDSLSAVRDRISTVAPNLVHLDEREPSTISAEVKPPVKQQVSSTPFKTVVENFYMTDAITRASKIMAQCSATLLKK

SEQ ID NO: 42242 - protein, 196 aa, Sorghum bicolor
  Clone ID: SORBI-28MAY03-C32336_1.pep
EGDELKRNADVQEIHRRTIFNPVSRVNMPKTIYDHERIVWLGDLNYRLNLPYEKTHELISKQDWNELFGKDQLKVELKKGHLFEGWTEGVINFPPTYKYKVNSEKYISDDHKSGRRTPAWCDRILSHGKGMRLLSYKTVDLRLSDHRPVIAVYMADVEVFSSKKLQRALTFTDAEVEEQLSFEEDSTSGIYNLGLN

SEQ ID NO: 42243 - protein, 341 aa, Sorghum bicolor
  Clone ID: SORBI-28MAY03-C32282_1.pep
TRVSTSLPITVLSFFGQFAAAWNMLGVFVLMIAVPTVATERASAEFVFTHFNTDNGAGIRSNLYIFVLGLLMSQYTLTGYDASAHMTEETKNADKNGPIGIISAIGISILVGWGYILGITFAVKDIPYLLSPDNDAGGYAIAEVFYLAFKSRYGSGVGGIACLGVVAVAIYFCGMSSVTSNSRMAYAFSRDGAMPFSSVWHKVNGQEVPINAVWLSAFIALCMALPSLGSLVAFQAMVSIATIGLYISYALPILFRVTLARKYFVPGPFNLGRYGVLVGWVAVLWVATITVLFSLPVTYPVTKDTLNYTPVAVGGLFVLVLGSWVLSARHWFKGPVTNLDG

SEQ ID NO: 42244 - protein, 185 aa, Sorghum bicolor
  Clone ID: SORBI-28MAY03-C30388_1.pep
MSGGGGSSGRAAPRYAPDDPTLPKPWRGLVDGTTGYLYYWNPETNVTQYERPTPPDNQLLPPPPPLPPPPPRSRDRRDRSRSRSRSRTPPRRDHRDRDRDRDRRHDEHASSKSASAHHHPAPVAAAAADPSTEAYRRRHEITVTGDNVPAPITPFEAGGFPSEILKEMRYLLRGGANVVCCPARP

SEQ ID NO: 42245 - protein, 291 aa, Sorghum bicolor
  Clone ID: SORBI-28MAY03-C3037_1.pep
HEASIVADKIALKLVGKGGFVVTEAGFGADIGTEKFMDIKCRYSGLVPQCAIIVATIRALKMHGGGPEVVAGKPLDHAYVSENVALVEAGCVNLAKHISNTRSVRVNVVVAINKFASDTEAEMNVVRSASMAAGAFDAVVCTHHAHGGKGAVELGLAVQRACESQTEPLKFLYPLESSIKEKIESIAKFYGASGVEYSEQAEKQIEMYTKQGFSNLPICMAKTQYSFSHVPSMKGAPTGFVLPIRDVRASIGAGFIYPLVGTMSTMPGLPTRPCFYEIDVDTATGKVMGLS

SEQ ID NO: 42246 - protein, 385 aa, Sorghum bicolor
  Clone ID: SORBI-28MAY03-C30407_1.pep
RTLSEGGCVGNFSREQVELFCVNNLINCSLESNEEFIFMEFRFARGDNGMRAAFQLLHMVLEHNVWLEDAFDRATQLYLSYYRSIPKSLERSTAHKLMLAMLNHDERFVEPSPHSLQKLTLQSVKDAVMNQFVGGNMEVSIVGDFTEEEVESCVLDYLGTARAASSPSTEERIEKISFRPFPSDVHFQQVYIKDTDERACAYIAGPAPNRWGFATEGNDLFNVIQRSDADAEISEPVNLDLTGKRRIDVRSHPLFFGITLSLLAEITNSRLFTTVRDSMGLTYDVSFELNLFDKLDLGWYVIAVTSTPSKVHKAVDACKGVLRGLHSSRIVERELDRAKRTLLMKHEAETKTNAYWLGLLAHLQSSSVPRKDVSCIKELTTLYES

SEQ ID NO: 42247 - protein, 447 aa, Sorghum bicolor
  Clone ID: SORBI-28MAY03-C30432_1.pep
MPVGEVAARPGGGGGMVLGGGMAAAAVGGDDAVVMQLAAAARGETVITVNCPDQAGLGCDLCRTILEFGLRITRGDVSTDGHWCFVVFWVVPRSSSIKIRWASLKNRLMSMCPSSYSIPFYPDISQPGPSQYYLLKLLSPDREGLLHDVTHILSDLELIIHRVKVCTTPDGRVVDLFFITDGMELLHKKERQEETCSTLIATLGPSISCEVLSAEGFQQGFSSLPPKIAEELFRVELADSEICSSSLSVELKKVQTATINFDNSLSPAHTLVQIICADQKGLIYDILRTMKDCNIQIFYGRFRSDKKGSVSKGCREVDLFVKQVDGKKVMDPEKQDALRSRLRSEMLHPLTVMIVSRGPDTELLVANPVELSGKGRPRVFYDATLALKALGICIFSAEIGRQAASERQWEVYRFLLDDSKEFPLANSLTNRNRVVDRVRKTLMGCYN

SEQ ID NO: 42248 - protein, 265 aa, Sorghum bicolor
  unsure (1)..(265): unsure at all Xaa locations
  Clone ID: SORBI-28MAY03-C30533_1.pep
MTTARFVSTCPTRLSSTSTSPIRTSGWVIGRVPARPLGFSLRLKPAMAAAGVRGNGSPTAPGDSIGSSTIGEVKRVTKETNVHVKINLDGTGVAECSTGIPVLDHMLDQVAXHGLFDVYARATGDTHIDDHHSNEDIALAIGTALLEALGDRKGINRFGHFTAPLDEAAVEVILDLSGRPHLSCGLDIPTQRVGTYDTQLVEHFFQSVVNTSGMTLHIRQLAGKNSHHIIEASFKAFARALRQATEYDLRRQGTVPSSKGVLSRS

SEQ ID NO: 42249 - protein, 254 aa, Sorghum bicolor
  Clone ID: SORBI-28MAY03-C30567_1.pep
HEVATLVLDFLATRFYEAKHRDEAARVKAAAAAALVATTSSASDEDITVLTVDAEDERKAPLLQTHCHGHGHGHSHSHGHELVQVVGSEAEVSAHVRSIVVSQILEMGIVSHSVIIGLSLGVSRSPCTIRPLVAALAFHQFFEGFALGGCIAHAQFKNLSAILMASFFAITTPAGIAAGAGLTTFYNPNSPRALVVEGILDSVSAGILIYMSLVDLIAADFLGGKMTGSLRQQVVAYIALFLGALSMSSLAIWA

SEQ ID NO: 42250 - protein, 331 aa, Sorghum bicolor
  Clone ID: SORBI-28MAY03-C32994_1.pep
AGGVGGSVVAAARSRPGPLAPPPPPPPSASCSEPIGVTEPPACAWRAPPPPGHSQHDAPVRRRIRAPAAALLVLSYLGLRDILAVEMVCKSLRSAVRNEPFLWKCIHIDSHLGKKVSDADLLCLTQKSPGSVQCLSLMGCLSITDQGLKAVLESNQQLTKLGIFGAFRITHQGLIDNLRSFNMVADIGLKKLRVTNRVTASEAQYEELLSLMKIDKELALHKQEPRIFHADRLLPDLHGGYVPDSFVPDLHDEYALDIEKCPLCPNYKLVYDCPSKECKTSGASTCRGCVVCISRCLRCGRCIDSEFQETFLLENLCRDCVKYEDSPPTEK

SEQ ID NO: 42251 - protein, 222 aa, Sorghum bicolor
  Clone ID: SORBI-28MAY03-C330_1.pep
MLPPPEVVREDAVDEGMLRLAAARDWVSGDSSPPLSKRLSAKDRQNESDKRKELNLLKYEALKDELLLLTTGIGAACSLYCLLVFSLETAVSYAFGVGFSCLYLQLLCRHADNLSKEDIPEVFLRKKVKKIGITSEDLKNTIEKTLGGAGVALSSPRLVIPAVIFGLSALSDHFQNSFSFEVLPGMMGFLAYKAAALVQVYRDNEDLRLILPEEEGADSDST

SEQ ID NO: 42252 - protein, 204 aa, Sorghum bicolor
  unsure (1)..(204): unsure at all Xaa locations
  Clone ID: SORBI-28MAY03-C33023_1.pep
MQTEARVGMAAATMDGSGAAAAAARRYTTQQQQQQQXQAQLQHHQPQLGTVPHLLAGGVAGAVSKTCTAPLARLTILFQVQGMHSDVATMRNTSIWREASRIVYEEGFRAFWKGNLVTIAHRLPYSSISFYAYERYKNLLQMLPGLEKNGGFGADVGVRLLGGGLSGITAASMTYPLDLVRTRLAAQTNTAYYRGISHALYAIC

SEQ ID NO: 42253 - protein, 210 aa, Sorghum bicolor
  Clone ID: SORBI-28MAY03-C33136_1.pep
MASAAAQCFSYSSSPATWAMRQRGGGGSPAGAGAGVLRLSSRRTFSVPAAARFDTQTLLYVTTGRGNAAGFAARTFVVLGMADRRLCIVSKEPVPPYERPALTKGYLFPPDKKPARLPGFHTCVGSGGQRQTAEWYKENGIEVLYEDPVVAFDGKTQTLKTSSGKILKYGSLIISTGCEASRLPEKIGGTLPGVHYIRDGADADSLVSSL

SEQ ID NO: 42254 - protein, 146 aa, Sorghum bicolor
  unsure (1)..(146): unsure at all Xaa locations
  Clone ID: SORBI-28MAY03-C31313_1.pep
TRALQLIVDVNDTANPTDISYIFXGYAPLSIRLVQHAVRSGWRSIEELLKLLPGPHLDLKRGGLTINSSPEVHPGLGAQQSIDRVGHRSLVLVVFIGGVTFAEIAALRFLSAQEGMGYDFLVATTKVVNGNTILRPIIANSKEGMM

SEQ ID NO: 42255 - protein, 183 aa, Sorghum bicolor
  Clone ID: SORBI-28MAY03-C314_1.pep
VVTTNTWESSSLPATSSGKRDRRLEGAEDPSKFFCRSSREVEAKVQVKMFYGGYAYHGNSFEQTYRCYPASFFDKPHLEGGDKVIMPPSALDRLASLHIEYPMLFELHNDATQRISHCGVLEFVAEEGMIIMPYWMMQNMLLQEGDTVHVKNATLPKGTYVKLQPHTTDFLDISNPKAILEKT

SEQ ID NO: 42256 - protein, 187 aa, Sorghum bicolor
  Clone ID: SORBI-28MAY03-C3159_1.pep
MARPHVVVVPYPCSGNINPALQIAKLLHRHGVYVTFVNTEHNHRRVQATEGAGAVRGRDGFRFEAIPDGLPDADRGRQDYGRGLAVSTSTRCAAPLRDLLARLNCTPGVPPVTCVLPTMLMSFALDVARELRIPTMSFWTASAASLMTHMRLRELQEKGYVPLKDESFLTNGYLETTVIDWIPGMPP

SEQ ID NO: 42257 - protein, 257 aa, Sorghum bicolor
  Clone ID: SORBI-28MAY03-C31696_1.pep
TRDPSDKYKIQTKPHGHGDVHPLPRSRGSRAPRCHGSLAPSPPHYPPPTLTTTMNPSPPPATRARRAPLTPPALTPWSPTSSRTPRAAALRAGSPSGPSPAPARPGPLPPASRHPRGGARRGTGYSPYPGNINQLILELGPYIEELKKTHGAISEFVNPKYTDSTKTAFKSSTRLECMMQDYPKSLPPSALVRPTLLVTPPPVAPVKNNPEDAAKVPKGNPYHSATSGEMAIYRANSLILRKAGAQIADPVVDTFNG

SEQ ID NO: 42258 - protein, 126 aa, Sorghum bicolor
  Clone ID: SORBI-28MAY03-C3171_1.pep
IQHVINYDMPAEIENYVHRIGRTGRCGKTGIATTFINKNQTETTLLDLKHLLKEAKQRIPPVLAELNDPLEDEEIIAKESGVKGCAYCGGLGHRVSDCPKLEHQKSMAIAGSRKDYFGGGGYRGEI

SEQ ID NO: 42259 - protein, 181 aa, Sorghum bicolor
  Clone ID: SORBI-28MAY03-C33563_1.pep
MASSNVSTVYISVIDDVISKVREDFITYGVGDAVLNELQALWEMKMLHCGAISGNIDRTKAAAPSAGGTTGTTPPVHDLNVPYEATSEEYATPTADMLFPPTPLQTPIQTPLPGTDTGMYNIPTGPSDYAPSPISDIRNGMAINGADPKAGRPSPYMPPPSPWMSQRPLGVDVNVAYVEGR

SEQ ID NO: 42260 - protein, 267 aa, Sorghum bicolor
  Clone ID: SORBI-28MAY03-C33581_1.pep
HEAPQVGSVNRYLPLNNAYPPKVPFSYGSSYGSYGSHGSYTGNPGFGNSYGSTGDVNTMNMYYSPLGFSGLAQIGSSPDVRLRMRLPHDRGIRLSPGSLGPMSLGASPSHFTPPNYQMQIPANSTGKHGSGSPASGGIHGSPLGRAAAVGPYNMRRNLPMPPHDYVSQHGQGRFGDGVSFSHSDAYARGHTGHSHTAAGPSSCHSSWRPQIGPRSGISLEESFSHVPSQAPSQSLDFSASSELDPANWDPNYSDESLLQEDNSLSAD

SEQ ID NO: 42261 - protein, 172 aa, Sorghum bicolor
  Clone ID: SORBI-28MAY03-C33708_1.pep
MAASLLLRAVRRRELASPLGSLGASLQSTCAANVCSKWGNFARPFSAKAAGNEVIGIDLGTTNSCVAVMEGKNPKVIENAEGARTTPSVVAFTQKGERLVGTPAKRQAVTNPQNTFFGTKRLIGRRFDDPQTQKEMKMVPFKIVKAPNGDAWVETTDGKQYSPSQVGAFVLT

SEQ ID NO: 42262 - protein, 184 aa, Sorghum bicolor
  unsure (1)..(184): unsure at all Xaa locations
  Clone ID: SORBI-28MAY03-C3345_1.pep
TRLCDGAASVALAAAAAAGIRVHGVYAHRARRAVPPGVAVLNLASRDASVSPVGSGFSHGSLLADRDGNKVLDATTISSYFSSDGNWFMDVFNVTDRDGNKVLDATTMFYIQKTLEADDWYYPEARNTVGIVPSEDYTSIELTXPTTRTDRPGRASDACAWAAALSCASQSAATRTHNTRVTAV

SEQ ID NO: 42263 - protein, 125 aa, Sorghum bicolor
  Clone ID: LIB3481-022-P1-K1-A12.pep
VRPSEDYTSIELTGTDRPGLLSEVCAVLAAMGCAVQSAELWTHNTRVAAVVHVTDAGAGAGAGSLALHKERRLHQMMFDDRARPDGSPGPPRTEVSVTPCAERRYTDVVVQGPDRAKLLLNTVGT

SEQ ID NO: 42264 - protein, 113 aa, Sorghum bicolor
  Clone ID: SORBI-28MAY03-C32702_1.pep
SADGLIRFWENEGGIKCVKNLTLHTATVLSISAGDHWLGIGAADNSMSLFHRPQERFGGFSNAGSKVAGWQLYRTPQKTAAVVRCIASDLDRKRICSGGRNGLLRLWDATTSI

SEQ ID NO: 42265 - protein, 123 aa, Sorghum bicolor
  Clone ID: SORBI-28MAY03-C32745_1.pep
NEAQELAILALRCSEMRRKDRPDLNDHVLPTLERLKDVAAKAREDAFQGHTAPPSHFICPILQEVMIDPYVASDGYTYDRKAIELWLSTNETSPMTNLRLPNKSLIPNHSLRSAILDWRSKSK

SEQ ID NO: 42266 - protein, 295 aa, Sorghum bicolor
  unsure (1)..(295): unsure at all Xaa locations
  Clone ID: SORBI-28MAY03-C32786_1.pep
TLPPGFRFYPSDEELVCHYLYKKVANERAAXGTLVEVDLHAREPWELPDAAKLTASEWYFFSFRDRKYATGSRTNRATKTGYWKATGKDREVRSPATRGVVGMRKTLVFYQGRAPNGVKSCWVMHEVRLDSPHTPPKEDWVLCRVFQKRKDSEQDNGGGSSSPTTFAGASQSQGVLPEPDQPTSMMDASYVVDQPGSTAGIFAAPPHHHQENLMSLGIGGLDALLMNGAMWQYTSSSVFDHFPQQEVTSSPTMMGLGSSRGGGGDGGCSSSFFYDSGFEDMANIGGMGFPQGWTG

SEQ ID NO: 42267 - protein, 190 aa, Sorghum bicolor
  Clone ID: SORBI-28MAY03-C32840_1.pep
ARGIGAKPVVSPFEAVGVSAEVGGIEVDSLFRTSVPGIFAIGDVAAFPLKMYDRVARVEHVDHAREAAHHCVETLLTSQTKAYDYLPYFYSRVFEYEGSARKIWWQFYGDNVGEAVEVGSFDPKIATFWIDSDSRLKGVFLESGTSEEFSLLPQLAKSQPVVDKSKLQAATSVENALEIARSSLQSSASV

SEQ ID NO: 42268 - protein, 188 aa, Sorghum bicolor
  Clone ID: SORBI-28MAY03-C32954_1.pep
MEDAKMGNAATIRAVLAILQWWGFNVTVIIINKWIFQKLEFKFPLTVSCVHFICSSIGAYIAIKVLKTKPLIEVATEDRWRRIFPMSFVFCINIVLGNVSLRYIPVSFMQTVKSFTPATTVILQWLVWRKYFEWRIWASLIPIVGGILLTSVTELSFNTFGFCAAMVGCLATSTKTILAESLLHGYKF

SEQ ID NO: 42269 - protein, 129 aa, Sorghum bicolor
  Clone ID: SORBI-28MAY03-C32972_1.pep
MGCFEQVTPEGPETNQHDEQRSIRLHAFSDLSHVPAATFIYLLKDCYGYGTNKATSKFKILMQLVKVALHNGPQPGPFTYVVQCMYIVPLLGKTYSEGFSHMLTSSLRHLESVESVQRDFLEAKHLAAQ

SEQ ID NO: 42270 - protein, 307 aa, Sorghum bicolor
  unsure (1)..(307): unsure at all Xaa locations
  Clone ID: SORBI-28MAY03-C342_1.pep
MERLQRIFGASGMGQPPTDSPLLDSSEQVYISSLALLKMLKHGRAGVPMEVMGLMLGEFVDDYTVRVVDVFAMPQSGTGVSVEAVDHVFQTNMLDMLKQTGRPEMVVRWYHSHPGFGCWLSGVDINTQQSFEALNPRAVAVVIDPIQSVKGKVVIDAFRLINPQTMMLGQEPRQTTSNVGHLNKPSIQALIHGLNRHYYSIXINYRKNELEEKMLLNLHKKKWTDGLILKRFDTHSKTNEQTVQEMLNLAIKYNKAVQEEDELPPEKLAIANVGRQDAKKHLEEHVSNLMSSNIVQTLGTMLDTVVF

SEQ ID NO: 42271 - protein, 104 aa, Sorghum bicolor
  Clone ID: SORBI-28MAY03-C34289_1.pep
PARVSAGQPEAATWLLPALFTNFLIPSWFEVEGPTKYNPFTLPEVYWASQRKKHASLVDIQKNIRELEIDDNRKKELACALHAQFKDWLYASGNIRQLYCLQGE

SEQ ID NO: 42272 - protein, 361 aa, Sorghum bicolor
  Clone ID: SORBI-28MAY03-C34385_1.pep
LPATPVEVEQSILEDLRNRAQLNSVALPSVSFYTFVNTHNGLNCSARAHDGSLVVGGFSDSSVKVWDMSKIGQPTKMSSSQSENGSSQGERISTLDEGKRTYTLFQGHSGPVYSAAFSPFGDFLLSSSSDSTIRLWSTKLNANLVCYKGHNYPVWDVQFSPVGHYFASASHDRTARIWSMDKIQPLRIMAGHLSDVDCVQWHVNCNYIATGSSDKTVRLWDVQTGECIRMFIGHRSMVLSLAMSPDGRYMASGDEDGTIMIWDLSAGRCVSPLLGHSSCVWTLAFSCEGALLASGSADCTVKLWDVASSTKTLKTEDTKGSSANRLRLLKALPTKATPVYSLRFSRRNLLFASGALSLSSS

SEQ ID NO: 42273 - protein, 117 aa, Sorghum bicolor
  Clone ID: SORBI-28MAY03-C34405_1.pep
MGSGNLVMKKAIRPSSFDLDIKIDQSWMEDVACPICLDFPHNAVLLRCTSYEKGCRPFICDTDQTRSNCLERFKGAHGLPANLKVSSRTVAPLNSIHIISSNANNRPACPLCRGDVI

SEQ ID NO: 42274 - protein, 156 aa, Sorghum bicolor
  Clone ID: SORBI-28MAY03-C3441_1.pep
MSSTAFSHLFPSAAVAAVSLLPRCVSFGASGGAAPGWRRRSRSMAAATAEAAAPAYTSDSLVLYFKAEGTMEERAIPKITESLQGMEGVKDLEVLIEEGIASVVLTKETTVQATGVASNLVEAIQGAGFKLQTLSLSFDDFDDITAGAGGNVQPSE

SEQ ID NO: 42275 - protein, 250 aa, Sorghum bicolor
  Clone ID: SORBI-28MAY03-C4812_1.pep
MWRRRVGALLLQSPLASSSSSSTAASSCQRLRHHLLPSEEPLALNRRLARLFTSQDGSDGGDTQKPFIAFVLGGPGSGKGTQCTKIASDFGFAHLSAGDLLRHEIASGSEKGELILDIIKEGRIVPSEITVELIRKAMETKNAKRVLIDGFPRCEENRIAFEKIVGTEPDIVIFFDCPEDEMVKRLLGRNQGRVDDNIETIKKRLKVFESLNLPVVDYYSSRGKVHKINATGTADEIFEAVRRLFSSLRL

SEQ ID NO: 42276 - protein, 75 aa, Sorghum bicolor
  Clone ID: SORBI-28MAY03-C48285_1.pep
MQPSDIWKAHAGSSQSEGSGLDMERNGCSHNCCPSPLQPIASAGQHSESSAAYFSWPTSTLMHGSAEGRANYFGN

SEQ ID NO: 42277 - protein, 63 aa, Sorghum bicolor
  Clone ID: SORBI-28MAY03-C4813_1.pep
ADTGGSCASSPSMFCRMSRFLVSAAADLQCLFLLQSRLWKIKSFDRNNKVHEQWHAITLYLHR

SEQ ID NO: 42278 - protein, 122 aa, Sorghum bicolor
  Clone ID: 14823749.pep
ARGFLALAVSAAFLALAVSAALSFPRCVVRRVHRTRYRAGGGGGGSHRATHAAVSVRVHRITYRAGGSAAVPAPRRNTSLYLLPSLVSQIHLWPSVRGDLEGFWWFLCFLPSVSPDLQGCRR

SEQ ID NO: 42279 - protein, 144 aa, Sorghum bicolor
  unsure (1)..(144): unsure at all Xaa locations
  Clone ID: SORBI-28MAY03-C4835_1.pep
MESHNGEADDLPPPPPLNAGVEPLKADETKVPLKHRTLVQRNGFGRKGQQIKLLTNHFKVSLTNAADYFYHYYVNLKYEDDTPVDRKGSGRKVIEKLQQTYAAELXNKDFAYDGEKSLFTIGALPQVKNEFTXXLXDVSTGKTP

SEQ ID NO: 42280 - protein, 165 aa, Sorghum bicolor
  Clone ID: SORBI-28MAY03-C48299_1.pep
MAYFPEEVVEYILGYVTSHRDRNAASLVCRVWYDIERRGRRSVLVSNCYAVHPERVHMRFPNMRALSVKGKPHFADFNLVPAGWGASAEPWVDACARACPGLEELRLKRMVVTDECLKLLSCSFTNFESLVLVCCEGFSTAGLANIATNCRFLKELDLQESCVKH

SEQ ID NO: 42281 - protein, 133 aa, Sorghum bicolor
  Clone ID: SORBI-28MAY03-C34703_1.pep
SQHAYSHPQPVKASNPFDLGNESAPIQAHMPPSGPPGASAGLASQTLIGNSSFGVPPQQPHQLYQSAAQPSHFMMQQVPNSMPMPEQQPNSMLATQQGLGSFNMGFDQQAPPRYPQPNTPPSYGSVGGSNPFG

SEQ ID NO: 42282 - protein, 151 aa, Sorghum bicolor
  Clone ID: SORBI-28MAY03-C34808_1.pep
TSAEVSQDGRFITTTDGSSVKFWDANHFGLVKSYNMPCAVESASLEPNCGNKFVTGGEDMWVRVFDFFTGEELACNKGHHGPVHCVRFTPVGESYASGSEDGTIRIWQLGPANSDEQEAASANGKAKVGVNDVARKIEGFHISKDGQVEGT

SEQ ID NO: 42283 - protein, 157 aa, Sorghum bicolor
  Clone ID: SORBI-28MAY03-C34833_1.pep
PTDLETNVHALLAVVPAPFLERAVDKLKNCFGPRHFGLGFAYKNLGQAYLEMDQHQSAVKFYKLANDIIEAAFGLTHEDSIDTKQSLANAYGLMGSYKLAIDFQEQVVDAYSRCGSGAFEDLREANRLLEQLKKKAQGLPHAVFPAYSLPVLPENND

SEQ ID NO: 42284 - protein, 70 aa, Sorghum bicolor
  Clone ID: SORBI-28MAY03-C34827_1.pep
GEPLGIEYCEVVVNVVMKRDALLPRAYGDVQTMASALKITIAWPYNKIKECKKKASGPLKSTEEVLQTSL

SEQ ID NO: 42285 - protein, 188 aa, Sorghum bicolor
  unsure (1)..(188): unsure at all Xaa locations
  Clone ID: SORBI-28MAY03-C34849_1.pep
SLGADLDCGLAHTVLRGXRSWGPVTSCSRQLSFLGALDAGFQATQLAEFQRCMVPLFRQIARSMNSSHFQVAERALFLWNNDHIENLIKQNYKVLLPIIYPALERNSRGHWNQAVRSLTLNVRKIFSDHDSAFFGECVQRFNDEEVKQEESDSKREALWKRLEEMAASKPGENNPLGAPNGKPSQAAG

SEQ ID NO: 42286 - protein, 180 aa, Sorghum bicolor
  Clone ID: SORBI-28MAY03-C36227_1.pep
NCSIFCLPADLVFLPGVPWGRSRATRRSERFRSLGNSFQVDTVAYHLSVLKDMYPEGMNVLSLFSGIGGAEVALHRLGIRMKTVISVEKSEVNRTILRSWWDQTQTGTLIEINDVQTLTSERIEAYIRRFGGFDLVIGGSPCNNLAGSNRHHRNGLEGEHSSLFFQYVRILESVKSIQRL

SEQ ID NO: 42287 - protein, 290 aa, Sorghum bicolor
  Clone ID: SORBI-28MAY03-C33792_1.pep
MIALKLEFGVFHNQVFERTIAVHFTNPFHVSTRVVDKCNDGALLLQVILCSEVKATLHVKDVRLDLQSGFEHLGKGDGRPALSLFPLVIAPSSKAGILFMIRLSGTKDADEAENADSMLNITYGISGDRTTGAHSPVPVKSGDSEELLFKIALRLKRPVLDPCLAVGFLPFSTDCLRVGQLVNMRWRVERLKTPEDASISVDELLYQVEANPQNWMVAGRKCGHVSLSNEQGSRMEIMVTCVPLVSGYVHPPQLGLPEVGEANISCNPAGPHLVCVLPPALSTSYCIPAA

SEQ ID NO: 42288 - protein, 79 aa, Sorghum bicolor
  Clone ID: SORBI-28MAY03-C3378_1.pep
STSDQGGGNSFMRYDSMNSSSDHDRGDPFARFDSMKSSDYNSRGYSFDDEDPFGTGPFKSTETKNSSPTKHGTDTWSAF

SEQ ID NO: 42289 - protein, 167 aa, Sorghum bicolor
  Clone ID: SORBI-28MAY03-C33814_1.pep
DGSADQIVEFVVSKENANQLWSSIINKLETPTKTITPVIPQCDGIQDDYNDQFFFQGVPTEDYNTPGESAEYRAPTPAVGTPKPRNDAGDDDDDDDEPPLNEDDDDDDELDDLEQGEDEPNTQHLVLAQFDKVTRTKNRWKCTLKDGIMHLNGRDVLFNKATGEFDF

SEQ ID NO: 42290 - protein, 262 aa, Sorghum bicolor
  Clone ID: SORBI-28MAY03-C3392_1.pep
MAATLSSVAAPSLPKHGSIIRAQQQAPPSIISASTTKTAFHGVSLVDRRWAAAGHRGGGGARRRLLQVNARTAAKNIEVEVDKPLGLALGQKPGGGVVITSVESGGNAARAGLKAGDQVLYTSSFFGDELWPADKLGFTKTAIQAKPDSVYFVVSRGAEVDVKRLPKRPAPPRFGRKLTDAQKERATHICLDCGFIYFLPKPFEEQPDEYGCPQCNAPKKRFAKYDAATGKAIGGALPPIAVIISFVIGIAGVGALLVYGLQ

SEQ ID NO: 42291 - protein, 86 aa, Sorghum bicolor
  Clone ID: SORBI-28MAY03-C33921_1.pep
ISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 42292 - protein, 111 aa, Sorghum bicolor
  Clone ID: SORBI-28MAY03-C33946_1.pep
MFVLLGNITNSQLNCADLSKEEEEDVQFKQAWLIYFWRRAKTNSVEEDIAEERLQMWIDRHGQQPTSHDAVDVEQGIHELRKLGIEQLLWELSRHEANLTKDEPSDVEDLT

SEQ ID NO: 42293 - protein, 241 aa, Sorghum bicolor
  unsure (1)..(241): unsure at all Xaa locations
  Clone ID: SORBI-28MAY03-C35692_1.pep
AREQIKVRMEPIASKGTHNSFAELAQACYMERVDLSAHGFYATPNIGFDWTIGKGTPFNYFTYGAAFAEVEIDTLTGDFYTRTADIVMDLGFSINPXAIDIGQIEGAFVQGLGWAAMEELKWGDDNHKWIRPGHLFTCGPGSYKIPSVNDIPLNFKVSLLKGVPNPKAIHSSKAVGEPPFFLGSAVLFAIKDAIFAARAEEGHLEWFPLDNPATPERIRMACVDSITKKFAGIDYRPKLSV

SEQ ID NO: 42294 - protein, 128 aa, Sorghum bicolor
  Clone ID: SORBI-28MAY03-C35794_1.pep
YVGGVGLSLLQFCNLNSFRTKFIMGFAFFMGLSVPQYFNEYTAVASYGPVHTGARWFNDMINVPFSSKPFVAGLVAYILDNTLQIKESAVRKDRGNHWWEKFRSFKKDARSQEFYSLPFNLNKFFPSV

SEQ ID NO: 42295 - protein, 74 aa, Sorghum bicolor
  Clone ID: SORBI-28MAY03-C35849_1.pep
TGTSKVPLEGFSALQGISGPQRFQIHKAYGSTNHLPSAHTCFNQLDLPEYTSKEQLQERLLLAIHEANEGFGFG

SEQ ID NO: 42296 - protein, 224 aa, Sorghum bicolor
  Clone ID: SORBI-28MAY03-C3616_1.pep
MSFIFGKKKTPAELLRENKRMLDKSIREIERERQGLQAQEKKLRHEIKKVAKQGQMGAVKIMAKDLIRTRHQITKFYALKSQLQGVSLRIQTLKSTQAMGEAMKGVTKAMGQMNRQMNLPALQKIMREFEMQNEKMEMVSEVMNDAIDDALEGDEEEEETEELVNQVLDEIGIDVNSELVKAPATAVAKPVAAGKVAAQAEAAGGPDGGIDDDLQARLDNLRKM

SEQ ID NO: 42297 - protein, 139 aa, Sorghum bicolor
  Clone ID: SORBI-28MAY03-C34632_1.pep
LVRYKAMRMLRGNESALFLSLCQAFIEVAYPYCTACFGRCYPNGATLISECQGTFDALRQLLTVPARSNSSSIERRQSGGMERRQSGSIERKQSVESTGTAVTDNGLSADGPGLETNDAVATTTPPVEDGVSTHPLASK

SEQ ID NO: 42298 - protein, 183 aa, Sorghum bicolor
  Clone ID: SORBI-28MAY03-C34476_1.pep
MSPPSSLKHLPPATAAAASPRAVATPRATGIRGLCALPTWRLRCSASAAVAATEMVGAPLDWAGRSLEELRSLPDHDTFCLMALSPLDGRYDRFVKELMPFFSEFGLIRYRVLIEIKWLLKLSQIPEITEVPQFSKEAQAFLNAIIEDFCIDDAKEVKKIEKVTNHDVKAVEYFLKQRCSSNP

SEQ ID NO: 42299 - protein, 230 aa, Sorghum bicolor
  Clone ID: SORBI-28MAY03-C34639_1.pep
HEVLSKPDGDVFTMIASRWADKEEALISSKERENTKRLIYGILYGMGANSLAEQLECSTEDAAQKIQSFRRLFPGVSSWLHEVVLSCRQKGYVETLLGRRRFLTKITAGNSKEKAKAQRQAVNSICQGSAADIIKVAMIRLHSVITNRTRATDSTDEVTRKFSEFGGQCHLILQVHDELVLEVVPCMVAQAGRLLQICMEEAASLLVPLRTKIKVGKTWGSLEPFYPEPC

SEQ ID NO: 42300 - protein, 130 aa, Sorghum bicolor
  Clone ID: SORBI-28MAY03-C34649_1.pep
PNSVGLGDYVIEYGDDEAGDDYEVYHRVRANWWTSCIFCKAFCRSSGGGRRRTRSRERRSSGTRSSNRSSQESFTLEVPTRSVDMREIRFDEIDDEYIVTGAMARAAVSRRMAAHYRDPRFGRRIPRIIN

SEQ ID NO: 42301 - protein, 315 aa, Sorghum bicolor
  unsure (1)..(315): unsure at all Xaa locations
  Clone ID: SORBI-28MAY03-C3468_1.pep
MASSFSFPLFTPADIVAALHSYGIAPSPSFCAEDVVHPQPGLLAEVXQLFLLNFVGDEPDEQLQFNALQVLDNPEHHMRALRLPPAVYAAGARRRAAQLRHRALPDLLRPGRPPRGHILSALIHFLFFRQEKLTLLEPIVEEYGAIEKRQGELRAKIAELSKAKEDHLLKEQVEAHMVQQLENEVNALKQRLHDYNREQLSLRNASKALDASSAPTLCKINQADFELVKVMQEKKKLSAKIVHSPEKLQRNLEEKKSVRDELKNLEKIAMQKVQEKTNTLEMYTKVSEKLAKHLSKISAVHEKSAAAKAFEKDVK

SEQ ID NO: 42302 - protein, 171 aa, Sorghum bicolor
  Clone ID: SORBI-28MAY03-C36377_1.pep
NAQRRIGNGSDPFLEANRREAAKQEAAARRVHPTLHLPTPAQPMAQIAAPATTTSQPQQSSFPSAATSSSALSTFSTPASAPSSSSLFATPTTPAPSGNLFGASGSAQLTTPFGTASTPTLTSTPAPGFGTSTTSLGGTSLFSTPFGGGATASGSSFGGATKGRSKPRSRR

SEQ ID NO: 42303 - protein, 117 aa, Sorghum bicolor
  Clone ID: SORBI-28MAY03-C3665_1.pep
SLAKQKSPVRQEVSTSKDAVFASSSILGRSSGSLRRPAVPSSRVPTSEALLRSRTPDGSPGSFQRNAPTHRTSQTHEYLDRSGVSLSGRLMPNTKHYESTLRSIQGLNVDANDRIHY

SEQ ID NO: 42304 - protein, 351 aa, Sorghum bicolor
  Clone ID: SORBI-28MAY03-C36762_1.pep
MATLQDLGVSAFINILSAFVFLLLFAVLRIQPVNDRVYFPKLYLAQKRQHDHTARSAVRRFVNLNICTYITFLSWVPGALRMSETELVAHAGLDSAVYLRIYKLGLKIFLPIATLALLVLIPVNVSGGTLLDLKKEVVFSDIDKLSISNVNPGSNRFFIHLLMAYVFTFWACFMLYKEYSNVAFMRLHFLASQKRCADHFTVIVRNIPRVSSHSTSETVDEFFRRNHPDHYLGQQPVYNANRYAKLVKQRERLQNWVDYYELKFERHPERRPTGRTGCLGFCGREVDQIDYYRARISELEKRMASERQKVLNDPKAVMPVSFVTFDSRWGAAVCAQTQQSKNPTQWLTDWA

SEQ ID NO: 42305 - protein, 92 aa, Sorghum bicolor
  Clone ID: SORBI-28MAY03-C36808_1.pep
DTQQSRIVAISKNHLKLFEQIYSLQVTTMRERGIADDAPEKISIKAETAKFLYGRPTSTLMLQGQQYLDDTRQRGLGVGDAKEIKNINHDPV

SEQ ID NO: 42306 - protein, 137 aa, Sorghum bicolor
  Clone ID: SORBI-28MAY03-C36850_1.pep
ARGDLKSANCLVNKHWTVKICDFGLSRVMIDSPMTDNSSAGTPEWMAPELIRNEPFTEKCDIFSLGVIMWELCTLSRPWEGISPVQVVYAVANEGSRLEIPEGPLGRLIADCWAEPENRPSCQEILTRLLDCEYTVS

SEQ ID NO: 42307 - protein, 115 aa, Sorghum bicolor
  Clone ID: SORBI-28MAY03-C34905_1.pep
VYETLRSHWQVERPCDSPVLISLACGSLSGIASSTFTFPLDLVRRRMQLEGAAGRARVYQTGLFGTFGHIVRTEGFRGLYRGILPEYCKVVPGVGIVFMTYEMLKAILTGLESDD

SEQ ID NO: 42308 - protein, 103 aa, Sorghum bicolor
  Clone ID: SORBI-28MAY03-C34915_1.pep
TKLQDLVSSLEPLLRNSSEHRRNYLVIKNLIFRANLQVKEDLYKRCQAVVKIDGDSMCSLCHKRVANSAFAIYPNGQTLVHFVCFKESQQIKAVRGANSLKRR

SEQ ID NO: 42309 - protein, 287 aa, Sorghum bicolor
  Clone ID: SORBI-28MAY03-C35323_1.pep
HEADKDSISRYGAGEAHDEVRKGKPVSMKKLYSMVRPDWFFGVSGTISAFVAGSQMPLFALGVTQALVSYYMGWETTKLEVRKIAVLFCCGAVLTVVFHVIEHLSFGIMGERLTLRVREKMFSAILRNEIGWFDDTSNTSAMLSSRLEADATLVRTIVVDRSTILLQNIGMIVTSLIIAFILNWRITLVVLATYPLMVSGHISEKMFMKGYGGNLSKSYLKANMLAAEAVSNIRTVAAFCSEEKVIKLYADELKEPSKRSFRRGQGAGLFYGVSQFFLFSSYALALW

SEQ ID NO: 42310 - protein, 267 aa, Sorghum bicolor
  Clone ID: SORBI-28MAY03-C35514_1.pep
MGLDNTYGELSGMFCGGLSYDGYIDHSSGSDYFRFTDPLPVVVPQMTAEACSNPSSTVSRANTETDNPEDWEFISDESLNYISRMLMEEDIDEKVSMYQAESAALRAAAKPFYDILGHKFPPSPDHQPIPWSMDSPSESSSSICTQSIASSVTSSSIGGTVDSNWRYDVGRSEQLEAYQGLCGQSSQPLVGTSSDASNAVDGLDDPLITNGQIPEYLFESLPTWDFRRGIEEAQKFLPVSNTLVIDLEAGGITRPQEARKDVSLNAK

SEQ ID NO: 42311 - protein, 275 aa, Sorghum bicolor
  Clone ID: SORBI-28MAY03-C35437_1.pep
MTSLSSAVALPSSCRACPAGGRHEARMVVTRAAASSPKLPNGRRLRVAVVGGGPAGGAAAEALAKGGVETVLIERKMDNCKPCGGAIPLCMVSEFDLPLDLVDRKVRKMKMISPSNVAVDIGRTLAPHEYIGMVRREVLDAYLRSRAQSAGAEVVNGLFLRYEAPKEPNGSYVVHYNHYDSSNGKIGGEKRSFEVDAIVGADGANSRVAKDMGAGDYEYAIAFQERVKIPDDKMVYYEERAEMYVGDDVSPDFYGWVFPKCDHVAVGTGTVTHKA

SEQ ID NO: 42312 - protein, 173 aa, Sorghum bicolor
  Clone ID: SORBI-28MAY03-C37490_1.pep
MGANCCVAAKERTQPCITPIEVSAYRNVRHSPSWSFRWDNRTHIEDIMDIPTLFSNHSSGSIRPDTKSGSIAPTEGFSNGNSRGTSPSNVFHGAKWHKSDKKTEAPKVTKVDPRADRTTASNCSPEAKLSRKSLDMSSVASDLKTSVSVPSTPPLVSRADPSSSRGHSQPTDS

SEQ ID NO: 42313 - protein, 140 aa, Sorghum bicolor
  Clone ID: SORBI-28MAY03-C37743_1.pep
TRSVSSPGRRDPYGRKEHEVQLASPETKRKDVNLPGISPISNILRKVEKVSQDIPKHRKVTHHEYEVETANGRITKRRKTRSTVMFGEPNTQKSLHNTADKDVTKIKKVPTGSHAHPANLGELFSEGSLNPYADDPYAFG

SEQ ID NO: 42314 - protein, 143 aa, Sorghum bicolor
  Clone ID: SORBI-28MAY03-C37832_1.pep
VRADCHFVCIGKPLSSSWLHDTILKESLDSKGRVMVENDLRVKGYNNIFAIGDITDIPEIKQGYNAQKHALLVAKNLKLLIKGLPNSKLSTYSTGYPLALVSLGRKEGLAQIPFLTICGCLPGKIKSGDLFIGKTRKQIGLSG

SEQ ID NO: 42315 - protein, 159 aa, Sorghum bicolor
  Clone ID: SORBI-28MAY03-C3794_1.pep
MEAAVPSRVALSAASRLPNRHAVAGDRSFVYKGRCQSLAIPMALSAAAPGKGGVLDRPVEKTTPGRQSEFDVKKSRKMSPPYRVILHNDNYNRREYVVQVLMKVIPGMTVDNAVNIMQEAHVNGLSVVIVCSQSEAEEHCTSLRGNGLRSSIEPASGGC

SEQ ID NO: 42316 - protein, 58 aa, Sorghum bicolor
  Clone ID: SORBI-28MAY03-C3624_1.pep
MSNSDGTATCIDIILAIILPPLGVFFKFGCGVEFWICLILTFFGYLPGIIYAVWAITK

SEQ ID NO: 42317 - protein, 140 aa, Sorghum bicolor
  Clone ID: SORBI-28MAY03-C36265_1.pep
EDLDAMLPKCDVIVINTPLTEKTRGMFNKERIAKMKKGVIIVNNARGAIMDTQAVADACSSGHIAGYGGDVWFPQPAPKDHPWRYMPNHAMTPHISGTTIDAQLRYAEGARDMLDRYFKGEDFPVHNYIVKEGQLASQYQ

SEQ ID NO: 42318 - protein, 154 aa, Sorghum bicolor
  Clone ID: SORBI-28MAY03-C36280_1.pep
VGLRAPPREAPMLVRPPAARRTAHFCIAAGAQSSAPAPYLSEVRARSTSSSLPIRARPTATLSRVDELTAELNETKESHAHLTAQHAQLTTQVAQLTAQVTQLIQSMGQGQGVLAAGHYTPPPSAGSNANAPPAVDPVNPSPMTGRPPFESSPQ

SEQ ID NO: 42319 - protein, 138 aa, Sorghum bicolor
  unsure (1)..(138): unsure at all Xaa locations
  Clone ID: SORBI-28MAY03-C36375_1.pep
CNLQILGLAGRGLCICFASCLSCLHVCGSLLRAASPSCHFSQAHVNSSCNKFHTCTSHFGTPKHIQIFMKTLTSKTITLKVESSDTIDNIKAKIQDNXGIPPDQQRLIFAGKQLEHAVIQICVVVYSFRRLLLCFAWF

SEQ ID NO: 42320 - protein, 164 aa, Sorghum bicolor
  Clone ID: SORBI-28MAY03-C36287_1.pep
NGEVGPKTIHVPTSDKLFVFDAAMRYKADGHHTIVLAGEEYGSGSSRDWAAKGPMLLGVKAVIAKSFERIHRSNLVGMGVLPLCFKPGEDADSLGLTGHERYTIRLPTNVSEIQPGQDVQVVTDTGKSFTCKLRIDTLVELAYFDHGGILHYVLRNLVKQQQQQ

SEQ ID NO: 42321 - protein, 120 aa, Sorghum bicolor
  Clone ID: SORBI-28MAY03-C35610_1.pep
LLGGQPSRSRCRPLAAADPSDRAEWNHQFQERPSSSHRKDDAAANKELTVVNGTKKNRIHYSGPLMPPGVNMDEILREHERQIQQAVRRARLDKGKGKHNGERDQSEALLYTTGNIRADR

SEQ ID NO: 42322 - protein, 176 aa, Sorghum bicolor
  Clone ID: SORBI-28MAY03-C38612_1.pep
MRPSTAPSAILPPPTCSSRLSPLRSFIGLRWSAPRFQVRERAGASVAGANGKPGCSFRLGVLTLNVCQSSQRAVVIRNEHGQNADFPRKYSKREKKPFPIPVLELRRRAKERMKAAQGKPKQPMPPPKNGMLVRRLIPVAYKVYNARILLINNLKRLMKVVPVKGCKYCPVPLLYR

SEQ ID NO: 42323 - protein, 142 aa, Sorghum bicolor
  Clone ID: SORBI-28MAY03-C38536_1.pep
NEIKARRYQTNKMQRTKSNSKKKLSKADAASSSSSYSSQRHLHREMETVCTVSAVRPRRPLSGQVAGTVCFSLLHGHGVHRVGLLAGAGAGGCDGGRALGEHGLVGGGGGVHNAAVAVAVPAELFDGQEPAAEFVHVALHQE

SEQ ID NO: 42324 - protein, 141 aa, Sorghum bicolor
  Clone ID: SORBI-28MAY03-C38638_1.pep
MEGSPVTRLPEANTLPDGFVPDVESSGTDAASPSSAPIAADALDSDIPAATNPGGEETLSDLSLPASAAEDASSAAAAEALGTLSLAAAAEPERALGEHGPTGAARGEETLKENCASEQVGAPTAQKGSGEPKRKVGKRSK

SEQ ID NO: 42325 - protein, 162 aa, Sorghum bicolor
  Clone ID: SORBI-28MAY03-C38663_1.pep
ARGLAPSAADPCSRGPQARPLCTGGASLTVQLKHISLGSVRAPNPHGDSIRDNANMYAILLANELLSIELQWQDQRDTLELILGVWVEMSLYAADHCSQESHARQLSNGCEFITIVSLLAHHFKYYSGVFRGTDNLGEDKPASENNPVSESNPMSENCGNLV

SEQ ID NO: 42326 - protein, 53 aa, Sorghum bicolor
  Clone ID: SORBI-28MAY03-C38677_1.pep
TLMKLDFTCAELMHLYSYNLSIQFICFHLTILLLSLMCVTPANHNFIQLLLCF

SEQ ID NO: 42327 - protein, 179 aa, Sorghum bicolor
  Clone ID: SORBI-28MAY03-C36938_1.pep
MDIGGGSSTEHPRKRKAATAEDADDEQKSVIPAEDDDEQKSVIPAEVVEGSKHEDGSIYRPDEHPLHSLYHLHDPRETRLDPMRLTDPTDICHPCWTVCRQHVGCAMMQIFSLKLSKLPSGAAAAAAAGGGPIQLYGFMAVRDLLDPLRNYVFNYSRDDPFIIHDLHSDPFVYLSGPRR

SEQ ID NO: 42328 - protein, 111 aa, Sorghum bicolor
  Clone ID: SORBI-28MAY03-C37182_1.pep
KSFQNIIMETSPPNDNCKLFYSLQCLAQNPFFLVESVSETDRGGRDPMEKCLLKNGRLNGTFMLELVPNLGSLLPFFWCLLPFPSGFISTATFFGILLLIFDSSFPNSFTV

SEQ ID NO: 42329 - protein, 162 aa, Sorghum bicolor
  Clone ID: SORBI-28MAY03-C37270_1.pep
HEASLPYVDAVVKETMRLHPVAPLLVPRLAREDTTVAGYDIPAGTRVLVSVWSIGRDPALWDAPEEFMPERFLGSKLDVKGQDYELLPFGSGRRMCPGYSLGLKVIQVSLANLLHGFAWSLPDGVTKEELSMEEIFGLSTPRKFPLEAVVEPKLPAHLYAEP

SEQ ID NO: 42330 - protein, 200 aa, Sorghum bicolor
  Clone ID: SORBI-28MAY03-C37293_1.pep
ARGTFLYVDILDTTGSLYTMARFAGFVDDVTGEFEGQYFAFMSDATAIVFGSLLGTSPVTAFIESSTGIREGGRTGLAALTTAAYFAAALFITPVLASIPSWAVGPPLVLVGVMMMRAVAEVDWDDMRQAVPAFLTLALMPLTYSIAYGLVGGIASYMLLHSWDWACHATKRLGCRKKIGGGAERTNCGGEEQRKDMESA

SEQ ID NO: 42331 - protein, 171 aa, Sorghum bicolor
  Clone ID: SORBI-28MAY03-C37350_1.pep
YVMLVGAYPFEDPDDPKNIRKTIQQIMQVQYKIPDYVHISTECQQLLARIFVANPMRRITMKEIKSHPWFLKNLPRELTETAQGMYYRRDNRVPSYSDQSSEEIMKIVQDARTMPKSSRSGYGWSTEYSDEEEEKEEEHRPEEHEEQEDEYDRRVKEVHASGELRLDALHI

SEQ ID NO: 42332 - protein, 277 aa, Sorghum bicolor
  Clone ID: SORBI-28MAY03-C37356_1.pep
ARGCDGTGDGPASLAFAGCLAGLLALELRACRAVADRVLLLAADHCRTLTSLLVYDGGSSEALHRFIQQRAAGLHTLDLRLPLDLHNDHLLAIGAGSVQHGQDATHGLAALRLQSCVLITGHGLRSLARTATGAGIEELALVSCDVVEREPGLLTFLSQSMPRLRRLNLSYNETLNDKVIGAMLSSCRNLIEIRLRGCRGLTGGSLISLLRHCGQSLEILDISRCPGIAVGNVELFAQRATRLNHMIIEESAMSEELKAIAQRKGMKVGSLPCEGPF

SEQ ID NO: 42333 - protein, 127 aa, Sorghum bicolor
  Clone ID: SORBI-28MAY03-C39582_1.pep
STALPRTAQETQNFGGDLWRRRAEIPPFSLWQLGSGGRQQCSRLAARKGKTFSWMASRSKFLRLRGSREEFFQLKNRSRIPSANCYHSSSFSLSAPQELQISLLPLYAVDFCFRLPALPLSTLQCAK

SEQ ID NO: 42334 - protein, 196 aa, Sorghum bicolor
  Clone ID: SORBI-28MAY03-C39598_1.pep
MKVEVVETTLVPPSEATPRHALWLSNLDLAVPKTHTPLVYYYPRPPDPDPEPDADAPAGEGSFFDPARLREALASALVAFYPLAGRLVVGQGGRIEIDCTGEGALFVVARADFTGDDMFRDFEPSPEARRLLVPFAESGDPPCVLAMVQVTFLKCGGVAVGTGMHHVTMDGAGAIQFIRAWTALARGESPTWAPTY

SEQ ID NO: 42335 - protein, 217 aa, Sorghum bicolor
  Clone ID: SORBI-28MAY03-C39624_1.pep
MDPTSPSPAARRAAAVARHLAGATAPFPASTPLEPSCCLSYVPPESTERPAAFAPGDLRLLLDGHDLPARDWLFRAMEESPLFRSPSARTGSRVFVGADLNDGKEGQREATMRRIAYLKQRGVFRGWLTKDGADAELRKLALLDCIAIYDHSLAIKIGVHFFLWGSAIKFLGTKRHHDKWLVATENYDIMGCFAMTELGHGSNVRGIETIATYDSET

SEQ ID NO: 42336 - protein, 264 aa, Sorghum bicolor
  Clone ID: SORBI-28MAY03-C38313_1.pep
ARGRDRRPVMSMPDRARRLPPPERAYDRRPPAPVYPKRSPRREYGRRDELPPPRSRATIDYSPRVPVDRRPSLRDDYSPRGSGYSDLRPRSAPRLSDRRAYADDSYGGKFDRPLPSYREGRGRDYDTISGSKRPYADLDDVPRYQEIGVRQSKARLDYDIGGSSARYGDTYSERSGRPHVGYSSSRSIPGHDSAYGSSRHGMSYGGSASSADAGGMYPPSYSGSYGSRGSDVGGSSYSSLYSSSRNLGSSNGGYYGGSGSGSYY

SEQ ID NO: 42337 - protein, 182 aa, Sorghum bicolor
  Clone ID: SORBI-28MAY03-C38408_1.pep
ELTVQHIKDIPLDKVLAKQQMDLLTAKSWLMENKELERKVVKLSIQNSLPSEYTRMVLLQTSLDKIDPAQQAKNKPTKQSSPDELPAMPLGGLALGFGDVAATRENLTTGFGDMKAPEKFVIFEKAVGCCSRVADCCCCMCFIKACSKMNDQCAIVMAQACAALACLGCFECCSELCCGGSN

SEQ ID NO: 42338 - protein, 389 aa, Sorghum bicolor
  unsure (1)..(389): unsure at all Xaa locations
  Clone ID: SORBI-28MAY03-C38434_1.pep
LTRQILAPNFDRSYARPAELLVSTSGKNSKQEKGENSGAYIIRLPFGPKDKYXAKEHLWPFIQEFVDGALSHIVRMSKAIGEETGRVHPVWPAVIHGHYASAGIAAALLSGALNLPMAFTGHFLGKDKLEGLLKQGRQTREQINMTYKIMCRIEAEELSLDASEIVIASTRQEIEEQWNLYDGFEVILARKLRARVKRGANCYGRFMPRMVIIPPGVEFGHIIHDFDMDGEEENPSPASEDPPIWSQIMRFFTNPRKPMILAVARPYPEKNITTLVKAFGECRPLRELANLTLIMGNREAISKMHNMSAAVLTSVLTLIDEYDLYGQVAYPKHHXHSEVPDIYRLAARTKGAFVNVAYFEQFGVTLIEAAMNGLPIIATKNGAPVEINQ

SEQ ID NO: 42339 - protein, 97 aa, Sorghum bicolor
  unsure (1)..(97): unsure at all Xaa locations
  Clone ID: SORBI-28MAY03-C38461_1.pep
HGSGTTSCCAARRRPTSRRPTPPAAGPCASRASAPPASTTAAPAXTPPPEAPSPAGEPPAPPPTSGGTAAAPEVSSSAHSWSSDSEVGRTNPPDPKP

SEQ ID NO: 42340 - protein, 168 aa, Sorghum bicolor
  Clone ID: SORBI-28MAY03-C3847_1.pep
VRLYLKISSFLSMETAALTSHSLQCPAAAAAAAVHGKRRRGGGAAALPRRRQTFAGRIRALPSAEVISEILHPKLVPGSPSDTGDVSSLVPVSALMLLFYFVSNWVVPELLMKRLNEPKPEEDEAAAAAASMASSGAADGGDDAAASPRKIRLKVKKKKNGKATIVKV

SEQ ID NO: 42341 - protein, 175 aa, Sorghum bicolor
  Clone ID: SORBI-28MAY03-C38476_1.pep
MGADGGLNRAAEKPRDGEGGEARVFRCTDYSLPRTTLALTLWLGGIHFNVLLVLASLFLLSRRAAAIVVAFQLFFMFAPVNDRDKWGRSVARFICRHAMGYFPISLHVEDYKSFDPSRAYVFGYEPHSVLPIGLSALADLVGFMPLTKIKILASSAVFYTPFLRQIWTWLGLVPA

SEQ ID NO: 42342 - protein, 333 aa, Sorghum bicolor
  Clone ID: SORBI-28MAY03-C4013_1.pep
RPVIFQLSEDIPCISAVVVALLADPEPKIDYTLKAIGGSLTAVPGLSDMIDDTVNSIVSDMLLWPHRHVVKLGVNVDTSDLELKPQGRLSVTVVKATSLRNKEMIGKSDPYVKLYLRPMFKVKTKVIDDELNPEWNETFDLIVEDKETQSVIFEVYDEDKLQQDKRLGVAKLAVNPLEPEITQEFTLKLLHSLDPIKNRDTKDRGTLHLKVKYHPFTKEEQLEALEMEKQAIEERKRLKEAGVIGSTMDAVGGAASLVGSGVGFVGTGIGAGIGLVGSGIGAGAGLVGSGIGAVGSGLGKAGKFMGRTVTGPFSMSRKNGSSSTAPQPDQPSA

SEQ ID NO: 42343 - protein, 146 aa, Sorghum bicolor
  Clone ID: SORBI-28MAY03-C4016_1.pep
DAWARDEGVRSLWRGSSLTVNRAMIVTASQLATYDQAKEAILARRGPGADGLATHVAASFTAGIVAAAASNPVDVVKTRMMNMKVAPGAPPPYAGAVDCALKTVRSEGPMALYKGFIPTVMRQGPFTVVLFVTLEQVRKVFKGVDF

SEQ ID NO: 42344 - protein, 192 aa, Sorghum bicolor
  Clone ID: SORBI-28MAY03-C4028_1.pep
TRERERERERERERERLDLMSSWVSHLPPEVQFRRVVGHGLNAQELARNPRLDYFFVKDLNKEQQLELQSGTFDAVLCTVSVQYLQSPEKVFAEMFRVLKPGGVCIVSFSNRMFYEKAVSAWRDGTAYSRVQLVTQYFQCVEGFTQPEVIRKLPSAGGSSPSSPLDAVMRLFGVAGSDPFYAVISYRNFKPM

SEQ ID NO: 42345 - protein, 67 aa, Sorghum bicolor
  Clone ID: SORBI-28MAY03-C40338_1.pep
KMPRTVVALDGGLYEHYKKFSSCVEATLTDLLGEEASSSVVAKLANDGSGIGAALLAASHSQYGESH

SEQ ID NO: 42346 - protein, 313 aa, Sorghum bicolor
  Clone ID: SORBI-28MAY03-C40423_1.pep
MVSGGSIKEQQHEMNISFGMMNHHHQQQPPSSSSSSSLHAAAASFMSGKQASGAYDHLGELDQALFMYLDHGSSHVHGGTQQEHQRQTLNIFPSQPMHVEPSPKGEISLVLSPAPVGSKQPARSPDHHHHQHQQAAMEELAGSRRQQQEHHHLQHQPFAAAAAEPAAPVGMIKDVKPLAKKDHRRGTSTSERDPKTLRRLAQNREAARKSRLRKKAYIQQLESSRIRLAQLEQELHTARAQGVFFPNSGILADQGVAGKGVPIGGIDGLSSEAAMFDVEYGRWQEEHYRLMYELRAALQQHLPEGELQMYVES

SEQ ID NO: 42347 - protein, 77 aa, Sorghum bicolor
  Clone ID: SORBI-28MAY03-C38859_1.pep
LSQHSQIFNHHKLLLPSPKSFLWHKYENYIGCIQNVKVNILPCEISERVGHPTYSTSIQSHSAGVFMVPCRHAMLRL

SEQ ID NO: 42348 - protein, 316 aa, Sorghum bicolor
  Clone ID: SORBI-28MAY03-C39_1.pep
MSFLFKSSNGGTTEKTMPLEEQQEKINELRKVLGDHSSPAIQDFLSDASLARFLRARNWNVQKASKMMKAAVKWRLAFKPENICWDDISEEAETGKIYRADYKDKHGRTVLVLRPGLENTTSATGQIKYLVYSLEKAIMNLTEDQEKMVWLTDFQSWTLGSTPLKVTRETVNVLQDCYPERLGLAILYNPPRIFESFWKIVKPFLDQETRKKVKFVYSNDKESQKIMAEVFDMEELDSAFGGKNPATFEYNSYAERMQEDDKKMGSLHSSTNSLLESAEKEANGADSDASSEASFYSGTDSPKHEDGEHSIAKKSG

SEQ ID NO: 42349 - protein, 198 aa, Sorghum bicolor
  Clone ID: SORBI-28MAY03-C39265_1.pep
MERAAGEAGAPTPAARGGAAAPAGAGAGGGMVKGKSCKGCLYYSSALRSRARGPVCVGVTRAIPQVSERMVGELELEAIQEGRYLADFRYGCIGYSMYLDDKETPTGIRDKARAQLPVCAGVELLADRKVPTNVKKEDLKRRHYKPGQPGHVGDDFLTKFQRNAGLVANGVAKNLNRVGTYIKDTVGDMMQPYRKRPK

SEQ ID NO: 42350 - protein, 203 aa, Sorghum bicolor
  Clone ID: SORBI-28MAY03-C39379_1.pep
REAREVDVGEQLHSLAGVLRSFVAGGCRPVERAPPLPRLRAAASEAAPRLRGAARLPAPHPPLRSKRGGARRAGLVSSVGTITLIALTGLLIFMFFLLVATANAVIVSVLMSLAAAGGFLAIFFACLVAVYIGAVSAAIFAISATVISAVVGVMIATGWVGFFWMIWFAARKSMDLTKHSIGVTSSAIQSYSASRHVNQKPVD

SEQ ID NO: 42351 - protein, 182 aa, Sorghum bicolor
  unsure (1)..(182): unsure at all Xaa locations
  Clone ID: SORBI-28MAY03-C39436_1.pep
MPKAGGGAADEEEFRAEVEERLINEEYKIWKKNTPFLYDLVITHALEWPSLTVQWLPDRTEPPGKDHSVQKMILGTHTSDNEPNYLMLAQVQLPLDDAEADARHYDDEHTDIGGFGAASGKVQIVQQINHDGEVNRARYMPQNSFIIATKTVSAEVYVFDYSKHPSKPPLDGACXPDLRLKG

SEQ ID NO: 42352 - protein, 199 aa, Sorghum bicolor
  Clone ID: SORBI-28MAY03-C3931_1.pep
MAPVKAQDASTDQQTMLDAQLQLWHHTFGYIKSMALKAALDLRIPDAIHQHGGSATLPQIATKATLHPSKIPCLRRLMRVLTLTGVFQHSTTTDDDGGELVYELTPASRLLVGSVTTNVSPFLNMVLGTVFVSSFLDLGEWFQHELPDPSPFKLTHGRHVWDLAIHDASFAKLCDNGMVADSGFIMDVMVKECGDVFQG

SEQ ID NO: 42353 - protein, 181 aa, Sorghum bicolor
  unsure (1)..(181): unsure at all Xaa locations
  Clone ID: SORBI-28MAY03-C39560_1.pep
RPPRVHPQWWQPGVEVVREWHNKNKSPPGYSRKIITRRIKKASGPNMPPGGRSGKRVRAPEGSQLEPPSAQLRSSKRLQLSAIDGQPAEEGNGSAGAVQGNGAGAQQGNGAGGDDIAAAENDNGAADQDMATVHEDNVAAEDDTQAPAQRRPRDPRPPTKGAYLDKMXKAMGHRLPIAVAP
